United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 22

SEQ ID NO: 89054 - DNA, 738 bp, Glycine max
  Peptide Sequence Number=SeqID_205832
atgctgaaatcgggcattggaattgaggagaggaagcaattgaagaagccagcacaagccagctcgagaaagggttgcatgagaggaaaaggaggtcctgagaatgctagttgcacctacaaaggtgtgagacagagaacatgggggaaatgggttgctgaaatccgtgaacccaatcgaggtgctcggctctggctcgggacttttgagacctctcatgaagctgctttggcttatgatgctgctgcacgtaagctttatggctctgatgccaaactcaatttaccagaactctctatcaaatctcaatctcagtgtccaccaccatcaccaccaccaccttcttctgttaccaacaacactcaaatggaaaacctgcagcagattcaaaacaattacatagacatggctacgtgttctaatttcaacaacatcaataatccagaagtttccatggcctctcagcaggttggagttggaccaatttacaccagtgactccatcgtgtctcttcccttggacaccaatcccaagcctgtggagaatgaggtcgagtttcgtccatcgtgggcgacaatgaacgagggtttgccggttttcgatgattccatttgggctgaagctgctatgtctctagattttcctcacattgcagcagagactgcgatttacgcgtcggggaacaacttggctgatgttggtgtttgggactctctgcaaaccccatggtgcatgtaa

SEQ ID NO: 89055 - DNA, 2166 bp, Glycine max
  Peptide Sequence Number=SeqID_205833
atggataccattgccaattcagtttcgaagctactcacattgtttctcacggtcttgtttgtgggttctgagctgacacactgtaatgtcacctacgacagaaagtctcttctcatcaatggccagaggagaatcctcatctctggctccattcactatcccagaagcacccctgagatgtgggaggatctaatttggaaggccaaacacggaggacttgatgtcatagacacttatgtcttctgggatgtccatgaaccttctcctggcaattacgattttgaaggaaggtatgatctagtacggttcattaagacggtgcagaaggtggggctttatgccaatcttcggattggaccttatgtatgcgctgagtggaactttggaggaattcctgtatggttgaagtatgttcctggcgtaagcttcagaacggataatgagcctttcaaggcggcaatgcaaggtttcacgcagaaaattgtccagatgatgaagagtgagaagttgtttcaatctcagggtggtccaatcattctctctcagattgagaatgagtacgggccagagagtaggggagctgctggccgtgcatatgtaaactgggctgcaagtatggctgttggattgggtacaggagtgccatgggtgatgtgcaaggaaaatgatgccccagatcctgtgataaattcatgtaatggtttttactgtgatgatttctctccaaataaaccatacaagcctagcatgtggaccgagacttggagtggctggtttacagaatttggcggcccaattcaccagcgaccagttgaggatctatcctttgcagttgctcgtttcatacaaaagggtggctcatatgtgaattattacatgtaccatggaggaactaactttggacgatcagctggaggcccattcataactacaagctatgactatgatgctccaattgatgaatatggtttgatcaggcaaccaaaatatagtcatttgaaggagcttcataaagctatcaagcgatgtgaacatgctttggctcatgtattctcttcaggaactggaacatgtgcagcttttctagcaaactataatgcacagtcagctgctacagtgacattcaataacaggcactatgatttacctccttggtccataagcatccttcctgattgcaaaattgatgtatttaatactgcaaaagtgagagttcaaccttcacaggtgaaaatgcttcctgtcaaaccaaagttgttctcctgggagagctatgatgaagatctatcttctctggccgaaagttcaaggattacagctcctggactcttagaacagctgaacgttactagagataccagtgactatctatggtacataaccagcgttgacataagttcatcagaatcctttcttcgaggcggacaaaaacccagcattaatgtgcagtctgcaggacatgctgttcatgtgtttgttaatgggcaattttcagggtcggctttcgggacaagggagcagagaagttgcacatataatggacctgttgacctacgcgctggagcaaataaaattgctcttctcagcgtgactgttggattacagaatgttggtcggcattatgaaacatgggaggcagggatcactggtccagttttgctccatggtcttgaccaaggacagaaagatttgacgtggaacaagtggtcatataaggttggcctaagaggagaggctatgaatttggtatctcccaatggagtctcgtctgttgactgggtccaagagtcacaagctactcaaagccggtcacaattaaaatggtacaaggcatattttgatgcacccgggggaaaggaaccactggctttggaccttgaaagcatgggtaagggtcaagtatggataaacgggcagagcatagggagatattggatggcttatgcaaagggtgactgtaattcttgcacttattctgggacctttcggcctgtaaagtgccaacttggctgtggacaacccactcaacgatggtatcacgttccaaggtcctggctgaagccaacaaagaacttgatagtagtgtttgaagaattaggtggaaatccttggaaaatatctttggtaaagagagtggcacatactccggcagttcatgggcagtga

SEQ ID NO: 89056 - DNA, 141 bp, Glycine max
  Peptide Sequence Number=SeqID_205834
atggccgaagagggacaagtgattggtgtccacagcgtggaggagtgggaggaacatctcaagaagggacaagagtccaagaaattgttgtatgcatcccttgtgccccgtcccttctctgcaaattaccctctctgctag

SEQ ID NO: 89057 - DNA, 900 bp, Glycine max
  Peptide Sequence Number=SeqID_205835
atgtgttatctaggtgcatgttgggcgttctcagctactggtgctattgaaggcataaataagattgtcacagggtctcttgtaagcctttctgaacaagagctgatagattgtgatacatcctacaacagtggttgtggaggtggactcatggattttgcataccaatttgtcatcgacaacaaagggattgacactgaggatgattatccgtatcaagctcggcaacggtcctgcagtaaggacaagttaaaaaggcgtgctgttacaattgaggattatgttgacgtgcctccgagtgaggaagagatactaaaggccgttgcatcacaacctgtaagcgtaggcatatgtggtagtgaaagagaattccagttgtactcaaagggtatcttcactgggccatgttcaacttttttggatcacgcagtattgatagtaggatatggttcagaaaatggagttgattattggattgtaaagaattcatggggaaaatattggggaatgaatggctacatacacatgatacgaaatagtggcaattccaaaggaatatgcggaattaacacattagcttcatatcctgtcaagaccaagcctaatcctcctatccctcctcccccaggtcctgtaagatgtaatttgtttactcactgttcagaaggagaaacatgttgctgtgccaagagctttcttggaatatgcttttcttggaaatgctgtgggttaacttctgccgtgtgctgcaaagacaagcgccactgttgcccccaagattatccgatttgtgatacaagaagaggtcaatgtttaaagagaactgcaaatgggacgacaacaatcacttctgagaaccaagatttttcccacaagtcaagaggttggaaatctcagtga

SEQ ID NO: 89058 - DNA, 852 bp, Glycine max
  Peptide Sequence Number=SeqID_205836
atgaattttcaggctgtaaatgataatgacatccacaacattgttctgtcatatcttatacataattgctacaaagaatcggtagaatcattcattgcttgcacgggagcaaagcagccgacagattatttggaggacatggataaaaggaaaaggcagaaccacagagggtgttgggaaatgctcctgacacctgtggagttcattgcctttttattggatcctgttataagttgtgaagaccttcttgatgataaatttcatttgtctctaggaatttttcactttgcactagagggaaatgcactcaaggctattgagcttactgaacagctggcaaaggatattctagagaacaataaggatttgcagtttgatctactaagccttcattttgttgagcttgtctgctcaaggaaatgcacagaagctttggagtttgctcagaccaaattgggccctttcggaaaggagcccaaatatatggaaaagcttgaagactttatggcccttcttgcttataaggagccagagaaatccccaatgtttcatctccttagcttagagtatcggcaacaggttgcagatagtttgaatcgagccattcttggttgcacacttgaatcttcccagttacacagcaatggagaggctaatacagcaggctacagttgtaagacaatgcttaagtcaagaagctggcaaggatgggccaccattttccttaaaggattttctcaaaagttgatggaaaacagtaaaaaatggagagtcaattggggaatgaagctcgtttaccttgaacctttctcgtctcatattggattggtgtacggtttcatcatagtgtaa

SEQ ID NO: 89059 - DNA, 156 bp, Glycine max
  Peptide Sequence Number=SeqID_205837
atgtcactcaaggaccttccccattttagtggatcaaataagtccaaaattatcagcacagaagttcagaagggttggccaactgcgtgcaggaacaaggaaacagataaagctcccgtggtaggcctaagagacagtgattatggcaggggttga

SEQ ID NO: 89060 - DNA, 447 bp, Glycine max
  Peptide Sequence Number=SeqID_205838
atggctgtcaacaacaacaagcttgttctgttaacattcgccatatgccgtttaatagtaactgtgggattaacggtggtcccggagctgctcgatgtgggactccagggtcgtctcagcgtggacacgttggaactggaggcggcttcggtggatttcgggaggctgagtcgaggggagccttcggaggtagtcactactagaaaagtgcttttttacgacgcactttttaagtcggttatttggaaccgccttaaaaaatggtgcggtggcaaacttgtaattataaaactgagaataattttttacaacgtaaattctaaggcggttatcaaaaaccgtcttagaatatgccagggtgggattccatttcgatactacctagagccgtccctttccactgttgatcgatttcctccgtcttcacccagtcttcgaagactttga

SEQ ID NO: 89061 - DNA, 705 bp, Glycine max
  Peptide Sequence Number=SeqID_205839
atgggaagcctttcacttttcacaggaaacaaagttgaacactgccgtggtttgttacttacctctgtggttgcaggaaaaagaaaagcggcgggaaggatggaaaagacgagtgtgggaaggtctacgagtgtagattttgttccctcaagttctgcaaagagggaaacggagacgctgaaccaggctcgtcaactggtatttcgtagcgatcatatcattgctccacaaggtgcccctcacttaggatgctgccagccaataggaacggggggttatcacccatcaggagacccaacagtgcctctaagattcccgagatacttctcaggttcatcctcaactcacatgccaccaccgccgccgccgccgccgccaccgcaacaatcacacctatacgcatcaccttcgaggccagtgtcatttgggtcatcacacttcccccaccagcatgctgtgaacgattactatgtgggccacgtgatgagtggtgggagccacggacactatgttggaggagagagcacgagtagttacacgtacattggtgccccggtggggcaagctggtggattcgctggtggtggtaaggaggggtcagcagtgcaggaggaagggttgagttggggaaggagctattcaggaggagcacagcatcgtttggatcctccctcagcgatcaatcggtttcatgatggtttctaa

SEQ ID NO: 89062 - DNA, 528 bp, Glycine max
  Peptide Sequence Number=SeqID_205840
atgggaagtgcttctctgattccagtttcatggttggctttcaagggaacggtgaaaagcttagttgcaaaaccgtggctgaaggttgagcaagcaagacccctcgtttccagcgtcggcattcgaggaatatcggcaggccaaggagcaagttgtggttttgggatgagaggtcagaagtctcgctctggccctgccgttacaataggtttcgaaggtggccagatgcctctttatcgacgtatccccaaactcagaggaattgcaggagagacagaagatgctaaatttaaggaaggggaagaagtgtctctagagttcctgaaggcgaaaggtgtgattaacacatcaggaagagaaaggagactccctttgaagattttgggtgaaggagaactgagcaagaagttgacattaaaagcccgcgccttttccacatcagcaaaggagaaacttgagaatgttggttgttccctcactgtgcttcctggccgcaagaaatgggttaagccatctgataactgctaa

SEQ ID NO: 89063 - DNA, 528 bp, Glycine max
  Peptide Sequence Number=SeqID_205841
atgttcaacaaaataaacataggcaggtttataaatgagggtggagcaaaacaagttagtgctggagctacgctttctcatactcccaacagaaatggttctaataatccatcacctcgtattacggaaccttctatcaagtctgtgcatgctaagcaagaatataaaccccttgaagctcccagcccttctaacaataattctttgttgaatactaatgaaatcgaacattcgcacgaaaataatgatgttcctgctggagatgctaaaagtgagataagatttcaatcctctgatgtactggagaaggcgcgggctgccattgcttctgcagatcgtgcatctgcagctgctcgtgctgctgctgcactagttcagagtaattttggatcattgaaactgggaggtgttgtgtccaacaacctggcatggtgcaaatatgacagcttcgtgtgcgattggttcgtttctataaagcgactaaagttcaaagctaactacgttgtgaaaacaatagaagcctcttag

SEQ ID NO: 89064 - DNA, 228 bp, Glycine max
  Peptide Sequence Number=SeqID_205842
atggttggcaatagaaaggagcaaattaaggatatgtccaaagagaaaatggcaaacgtagtagaagaagctaaaaagacatcaactttatattattactgtctgcctgtgcctgaagctgccctgcagcattcagatttcatatatccctttctttctaagatatccatgcttattttgaggatcaaactgcagacaatgaaagtcaagacattgtgcttcgtctaa

SEQ ID NO: 89065 - DNA, 468 bp, Glycine max
  Peptide Sequence Number=SeqID_205843
atgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttatcaagaaggatctcgaacttaatgatttggatagaagtatgagaactaataatgtatttagtaatcatgaaagtccaaagggattacaatcgccatcatggcccattcaaacgtctgtaccatcataccttgggtttctatttgactacttactgggcctgatatcctcacttgattgttcgcaccacgatcacctagagtctctttactggtgcaaaaatttgatataa

SEQ ID NO: 89066 - DNA, 498 bp, Glycine max
  Peptide Sequence Number=SeqID_205844
atgttgtttgccggcggcaagaaactcctctatgtgtgtgtggtggtgatgcttgtggtgttgcatatctgccacacgtgccaagttggggcgattcgtgtgttcccaggaaatgcagcggccaacgtagaattcagccacggcaatatggataacaataagagcaaggaagatctgttcaagaagtacttcggtggaaggactcatcttcgtcccagcaacacaacccaaaagggttttgatgatagcaaaagaagaggactagaggaagaaactgagaatggcagagaaatcgaagtaggaaagcgccacgtattatgcggcgaagaagagggagttctattggctttcctagttgctgtttcactcattattgttagaccaatattccttgccaaatacacctacctattcattaatttgtctttgatatttcaacaatccatgtgggttgctgggtggggcgacatgtaccctaccatcgttaacgctgaatga

SEQ ID NO: 89067 - DNA, 1326 bp, Glycine max
  Peptide Sequence Number=SeqID_205845
tgggtcaccacgcgaaatcccttggattagagaggcagccaatgagaaagcagggattaggatgaactttcttagttccaccaatcaaaaaccagataaggccttcaatctctttcactctccaagttcggctactaagaacgcggcaaacgcggttggggccaaaacggcaagagcatgtgacagctgcataaccaaacgtgcacgttggtactgtgctgccgatgatgcttttctctgccaggcctgcgactcttctgttcactcggcgaatcctttggctcgaagacacgaacgagtccgcttgaaaacggcgtcctacaagtccactgatgaacaacaacaacaacaacaacaacaacctcccacgtggcacactaagaaacctcgaacgccgaggcacgggaaacattctcgtaacaacaaccctttccatttggtccctgaagagggttcggaggaggcgaattcccatgatgagaacgaggagcagcttctttatagggtccccatattcgacccttttgttgctgagctatgtgggactaatagttctccttctcctgttacttcaactgatcaaggagtagttgctgctgctgaggttgaatacaaagggtttcaaagcaatggtttttgtagcaatagcagtgagatggaaaacttgcatgggatgcttccttctgatgcagaacttgctgagttcgctgctgatgtggagagcttgttgggtagggggcttgaaaacgagtgcgtggggatggaagaattgggactggttgatgcgaaagaggaggagtgttcggtaggtagtgggaaggtgaagatggaagatcaggaagagagccctctggtggagatggagatggatatggtcgtgggcagagatgatcaatcgtttgagttgagctttgattatgaaacgtgtgaagaggtgaaggtttgtgatttgggattggggaatgaattaggagcgaagaaagagaatgatgatgaggtgaaaaagaacaagatttcgttgcagctagactatgaggcggtaatcatcgcctgggctagccaaaaatctccgtggaccaccgctgacaaaccaaacttggaccctgatgagtgctggaaacaatgcatgggaagttgcgaaacggcatatcatcatccttgcggtgaaatgggtggatttgggattcatccagtgataatagacgggggcagagaggcgagggtgtcaagatacagagagaagcgccgaacgaggttgttctcgaagaaaataaggtacgaagttaggaaattgaatgctgagaagagacccagaatgaaggggag

SEQ ID NO: 89068 - DNA, 288 bp, Glycine max
  Peptide Sequence Number=SeqID_205846
atggcattttctgaatcatggataactttctcaggactttccctgtggctaactctcttcgctcctcatgcagttattataaagtatggcagtcgcagagactgtatggatcctcaattctttttcagccaaagaatgcagatgcaagtcaaggtcttctggaagctagaaattaagttacatcgattttcgtgtaaagtaccagataggtatatgaatgttttagcagtcactactaatggccggaaaggacataatcagtggcgcttaatagttacgtcaaaatga

SEQ ID NO: 89069 - DNA, 252 bp, Glycine max
  Peptide Sequence Number=SeqID_205847
atggcgatcatcatgggtatgagagtgagagtcagaatgtggttcaccaggtattggtaccctagtttcacgtacttgagtttcaccgagtggaagaaatccggcaagatgggaggcatattgttgttctttagcaaagggaccctagggtctgaacgggggcagatgagaggtattaatgaaacacttcacgtcactcaacgctcacttaacttggtattaattttcataactccacccttcgacatctaa

SEQ ID NO: 89070 - DNA, 528 bp, Glycine max
  Peptide Sequence Number=SeqID_205848
atgtcggagtgcgctgtcatctcagcctcacaagcatacgagacctacgctttgatcttaaaagtgaaggctccaccgccgccacctccttcacggatcagcgtggcatcgtcccagtgtgcaccaatagatctggtgaaagtgctggacgtaggtggaaacatgaccggcgggaagcttcacatgttgaagcgcgcgatgcgtttggttatctcatcgcttggcaccggtgacaggctctccatcgtgactttctcaaccacctgcaaacgactcttacctttgcgaacaatgacaagccaaggtcagcacatggctcgtcgcatcgttgaccggctagtgataggtcaaggctccagcgtaggaaatgcgttgaggaaagccaccagagtgttggaagatcgcagagaaagaaatctgctagctaattttttggaatgcactgtttacacaattacactcaacagtttaatttacaacaacttaattaaccaaaaaatcttccttcaattttctgcttaccattga

SEQ ID NO: 89071 - DNA, 783 bp, Glycine max
  Peptide Sequence Number=SeqID_205849
atgcctaggttcatttcactttcgggtcaccaaaaggatacacctcactcgcactctctgaaacccggtctttacctcgttggaacaccaatcggaaatctcgaagatatcactctgagggctattcgcgtgctgaactcggctgacgtcatactctcagaggacacgaggcactcggggaagttgcttcatcactatcacatcaaaacaccccttatgagttatcacaagttcaatgaatcgcaaagggaacaggttgtgctgaggaggttgaagcagggtgagattgtggctctcataagtgatgctggaatgccaggcatcagtgatcccggtatggagttgggcattgctatcactcctcatattatatgtttaccgagtgcgtgtttggtgatgagattttgtaatgacccgaaagcttctcaaattttaatgcaggccaaactgtgtgtgagtgagaatatcctggttgttccaatccctggtccctgtgctttggtatcagctctttctgcctcgggtttaactactgatgaatttacatttggtaataagctggctaaactgaattttggcatttatggcattttggggtctaagatggctgttgtgatgtatgattttgtagttggttttcttcctaaacattcggaattgagaagaaaaaggctcatggtttcagctgatcaaactacaactcaaatattttatgttgctcctcacaagctttctcagttccttgatgagagttcttcaatttttggtgatgcaaggtgctaa

SEQ ID NO: 89072 - DNA, 381 bp, Glycine max
  Peptide Sequence Number=SeqID_205850
atgtctccactttttaggtctagtacgagttatatgttaactcgtattggaatcaggtggttcaacatccaagttaatgggacttggacgagtggacccaacaagaagggaatggtagcagagggagctggagcagaagaaggagaagagagaagagggaagttgcttgcgaatgctaatgggaagtccattggtagcgccgaaacggaagtgaagtgctgcggcaaaacaaatcgccgtccaaggcaatcgtcgaatcaacattttccctatgcggaaaattcggaacgctatcggtgcagacacacagcacacggatccttttgcctttcaatcaggcccaatggattacacaatccaacaagagatttggaccagtag

SEQ ID NO: 89073 - DNA, 1113 bp, Glycine max
  Peptide Sequence Number=SeqID_205851
atgataaaagagaagaaaggagtggtgattgaaatgggaaaaagtgatagtggtgaggatggtagtagtattagagtgagtgagaaaggaatgtatgtggacgtgtggggtgggaagttgtggatagatgttttgagtgcaacattggagtatgggctggctcccatgtcttggaccgattacttgtatttgtctgtgggtggaaccctatccaacgctggaattagtggacaaaccttcaatcacggtcctcagatcaccaatgtttatgagctcgatgtcgttacaggaaagggtgagctggtgacatgttcagaagatcgtaactcggagttgttccatgctgttctaggtggtcttggacaatttggaatcatcacaagggctagaattgctctcgaaccagctcctcacagagttcggtggatacgagtactgtattcgaattttgcaaggttttgtaaggaccaggagtatctgatatctctgcatgggaaagcagcaagggagagattcgactatgtggagggtttcgtgatagttgatgaagggctgatcaataattggaggtcttcgttcttttcagctagtaacccagttaaaatcacttccctcaacgctgacggaggtgttttgtactgcttggagattaccaaaaattacgaccaaggaaacgcagattctgttgatgagtctgatttaatattgttaatggtatctttaagtaattggtcaaacaattcaattaacaagaaaaatgatatacgctgtccagaggaaatacaagctctattgaaaaagttaaattttataccaacatcggttttcacaacggacttgccttacgtggattttctggatcgtgtacataaggcagagctgaagcttagatccaagggtttatgggatgtacctcatccgtggctcaacctttttgttccaaaatcaaggataggggacttcgacaagggtgtgttcaagggcattcttggaaataagacaagtggacctatcctcatataccctatgaacaaaaacaagcatgcacatatctcctcatatataaaccacatgtctgctgctgatagcctcatatcgactgtcagtgtttag

SEQ ID NO: 89074 - DNA, 1944 bp, Glycine max
  Peptide Sequence Number=SeqID_205852
atgtatcccaaccaagccttttctttagggtcctatgcggagatgatgtctgggacttctctttttcctcatgactacagtgaaactgtaggaggaggacaaaacgaggttaagtttatcacagcaatgggtgagacagtgactatgcactctattaatggccattccaatgctgcaagtggtgatccagcatgcaactcttttgctggggattcccatgttgtttcaaggacacaaatgggaatggtagatagtgagcaaaacatcaattgccagggcctatctctcagtctcgggacactcatgccttctaatgcatccgtctctccatttcaataccaatatcacgacacgggtctcttaccactaatgaatgattttccaaatataaagggaaccatgtctctcaaagatgatgaggccaataacctacatggagagtttagaagtgttgaatgcatggcatctgtgtcctctggaggctttcatgacatgataaaaaaggagggtttttacaaccccaaccacccctcaatgtgtcttaaagaagtcccctctgatctaccaggttactcaaacagcattttgaactcccaataccttaaggcggcacaggagttacttgatgaaatagttagtgtccaaaaggctttgaagcaatctggaatggaaaaacaagagaacaaccgtgacattggattagatggctctaaagatgctgatggaaaatctaccagtcaatctatgcaaatgtcttctgcccctaatggttccagtgccaatgcttctagtgacctatcgtctgcagaacgccagaccttgttggacaagaaaacaaagcttttgtccatgttggatgagagattccaattgcccaaaacagtaaacgaagtagataaaagatacagacagtactgccatcagatgcagattgtggtgtcatcttttgacatggttgccgggtgtggagcagcagaaccatatactacacttgctttaagaacaatttctcgccactttcggtgtttgcgtgatgccatcagtggccaaattcaagtgacacaaagaagccttggggagcaagagggaataccccgtctccgctatgtggatcagcaacttagacaacaaaaggcccttcagcaacttggtgtaatgcgacaagcttggaggcctcagagggggcttcctgaaagctctgtttcaatactccgtgcttggctctttgaacattttcttcatccttaccccaaggattctgagaaaattatgctggctaggcaaacaggcttgaccagaaaccaggtggcaaattggttcatcaatgcaagggtgcgtctctggaagccaatggttgaggaaatgtacaaagaggagtttggagattccgagatgaactgcaacctttcatctgagaacaacacggtcaaaggtaaaagagatgatgttcaagagtctgataacattaacaataataataataaatgggaagagtcacaggacaatttagtaactgttgacagtgtgcaagtccaacctcaagcagaaatggatagagtggtcaatgtagaaaatgtggtgatgaattctggaactgggaaattgcagggtgaccaaaaccaacaaaggcttggcttgaacaacaacaacaacagcagcagcaacttttattctatctcaaccaacgagaatggtggggatggaggcctaatgggtacttctactcatgccacatatgatttatcagagttgggtaactttactgtgggtagccacgtttcccttgcattggagttgaggaactgtgaaaatgatgggtttgccatgtctgatgatgccatacagaaacgacgtaagcaaacattgtcctcttccccggagactgatttgctagattatcatttcacggattcaggaaagcaacagcacaggcaatttttgtaa

SEQ ID NO: 89075 - DNA, 1329 bp, Glycine max
  Peptide Sequence Number=SeqID_205853
atgtcagcagttatcatgggatcagcttgttgtgttgctgcaaaggatcatactattcccagcactagcagaactggaggtgaaagtttaaatagaaatgctgtatgttcgccatcatggagttttcgttgggatagttggggccgtgttgctggtgaaattgaggatccttcctttcacacatctcgcagagtcagcagaaatgtcagcatggagttaaaagggtcattaagttctgaaagaggcaatttatctgattggggaagcaccctggataattctgtaacacctttgtctctgaagtcccctgttcgggagcatttggttacaagtcagatgactccatcttcagatctatccatgtcaagtaattgctctgcagtggtgaagaatctgattgaatcaccagagattgcagaatcttcaataccaaatcgttcagtaccttcagttttctcaatccctacgacagatccaatgactaatcataattatcacaatcttcctaactcaacaccatccagatgggctcattgttctcccggacacccactgttaacacaaatttctgatagtcgaattctgggtcttaaatcacctgacaactcaatttctgaaggcaggccatcatttgtactctccaactgtagcaatgatatggcaacaggatcccaatgcgggtcatctgatggctggtctatgcgcaccttttctgaaatggtggccccatctcaaaaggaaaggtggtcttttgatagcgagtattcaggttcaggacgtcacaagataagtggaactagtagcaggttctcgtattccccctccatggatttacaatcttgtggggcttgctcgaagctcttgaccgagagatctgcatggggcagccagaaatttattgccagcagtgacctctcagttgttgctgtactggtctgtggtcatgtttatcatgcggaatgcttggagactataacaccagaggcagatagttatgatccagcttgtccaatttgtatggttggagagaagcacatgtcaaagttatccaaaaaaggttttaggactgaatcagagacaaaggccaagaattacaaaatatccagaaaccgagtagttgatagctacgttgatggtgggatagatgtttttgatcgcctcaaagatatagtttcaaagatggagcccagtagctccagtacaacgagttcatttggaaaacccttcttgaggcgccatttttcgttgggatctaagtggagccggtccctattggagaatgattctgccaggaagaagggcttttgggcaagatatcgcaaagactga

SEQ ID NO: 89076 - DNA, 573 bp, Glycine max
  Peptide Sequence Number=SeqID_205854
atggcgaagcattcggtggcaatggcgaagaagcggtggctgataatgttggcggcattcctgtccgtctcaacagtgacggtgctcttaatgagatccaacaactccgattcctgcaacaccaaccattttactattgcacaagataataaccagattcgttcccctgtccaactcactaatgccgcttccagcccccttaatttcatgaagtccaagctagttctcatggtttcgcacgagctttctctttcaggtgctttattacatgccaaatccaatctctctttttccttttttcagtttgatgatatgaaaacatacggattggattcacattcacttgcaggagggcctttgcttctgatggagttggcgtttctgttgagaggcgttggttccgatgtcgtttggatcactaatcagaaaccttcggaacatgatcaggttatttacagtttggaaagcaagatgttagacagaggagtgcagtttagcaacattgattttgatagttttctcttgaagggtatgggtggtggcgtattgctagcagcagagaccaaagcttaa

SEQ ID NO: 89077 - DNA, 1263 bp, Glycine max
  Peptide Sequence Number=SeqID_205855
atggctgaagcagaggatgccgtaagacgccgtaatgcggtcgccgagtatcggaagaaacttctccagcacaaggaattggaatccagagtccgatccgtcagggagaatttgcgagcttcaaagaaagagttcaataaaacagaagatgatttgaaatctcttcaaagtgttgggcagattattggcgaagttctcaggcctcttgacaatgaacgcctgattgttaaagcaagcagtggtcccaggtatgtggttggttgccgcagtaaagtggataaggaaaaattgacttcagggacaagggtggttcttgatatgacaacactcaccataatgcgagctcttcctcgagaagttgatccagtagtttacaatatgttgcatgaagatcctggtaatatcagctactcagctgttggtggcttatctgatcagatcagggaattgagggagtcaattgaactgcctctaatgaatcctgagctcttccttcgagttggaattaaacctccaaagggtgttctcctttacgggcctcctggtactggtaaaacattgttagctagggcaattgcaagtaatatagatgcaaatttcctaaaggttgtttcaagtgccataattgataagtacattggagaaagtgccaggttaatcagagagatgtttggttatgcacgtgatcaccagccttgcatcatttttatggatgagatcgatgccattggaggtcgccgtttcagtgagggaacaagtgcagatcgtgagattcagagaacgctaatggagctgcttaatcaacttgatggatttgatcaacttggaaagcaaattcctaggttaaggaatttttgtctttttatttttgtggaggtagtgggtggtaggtctgtggttaaaatgataatggcaacaaaccgacctgatgtacttgaccctgctctcctgcgtcctgggagattggatagaaaaatagaaatccctctgcctaatgaacaatcaaggatggaaattcttaagattcatgctgctggtatcgctaagcatggtgaaatagactatgaagctgttgtgaagcttgcagagggatttaatggggctgatcttcgaaatgtctgcacagaagctggaatggcagcaattcgtgcagagcgtgattatgtgatccatgaagattttatgaaggctgttaggaaactgaacgaggcaaagaaacttgaatccagtgcgcactacagtgctgattttggtaaagactag

SEQ ID NO: 89078 - DNA, 1323 bp, Glycine max
  Peptide Sequence Number=SeqID_205856
atgtccaactctattacctatcatcaaaaccaatttgagaaccaagagcttgatgcttatggctcttctatgaggctcaacaatgcatttcctgaggccttgggagcatttcctactagcattggagtagttgctgagggctctgagataagccacactaggcatttgatggatcttcttggagcagcaaatgagagcaatcaccaccaaactgctcaagggctttctctttctttaggctctcacatgcttgttccttctgatgaatacaggcatccccaccaaagacccttaaacccgggtctcatcaaccccaattacttcatgtctggacaagaggcacgtgagccttgtaacaacccacctgtggagcagcataatataaccagtgactacttttacaatactgggagtggcacttttgcttcttcttcccctttgaacaaccgttctcctaattccaccagctcttatgctgctgtcattgggaactccaggtacctcaaaccggttcagtcccttcttgaagatcttgttgatgttggtggaaatgtggttgatagaatcaatgagaagtatgctgagaagttgtttcgtgggagtagaggcagtgctaggacactttcctcagagttgaaggcagagttggggaataatggtcatttattggctgacaaacatgaacatcaaatcaaaattgcacggttgattactttattggatgaggttgagggaaggtgtgagaaatactaccatcaaatggaagaagtggtgtcatcttttgagatgatagcaggtttgggagctgcgaagtgttacactgctttggcacttcaagccatgtcaaggcatttctgcagcttgagagatgccatattgtcacaaataaatgctgagaaaagaaaactctttcaggatttacctaagatcagtagtgggttgtctcaactaagcttgtttgatagagacagtagacagagtagaatgtctctccaacaacttggggtgatccgaagccaacgccaagtttggagacccatcagagggttgcctgaaacctctgtggctattcttcgttcttggctcttcgagcactttctccacccttatcctaatgattctgaaaagttaatgctggcatctcagacaggtttaactaaaaaccaagtctcaaattggttcataaatgcacgagtacggctatggaaaccaatgatagaagaaatgtacaaagaggagtttggagagttttctgaagactccaacccggctggtaacaactacttgacgagggaagataccacggattgtgtagaggattga

SEQ ID NO: 89079 - DNA, 462 bp, Glycine max
  Peptide Sequence Number=SeqID_205857
caggaacatgaaatggaactccaacgtcttaatcaaaatgaagaaatcaacaaaaagaaaagaagtatagcacttaaagcctcctcatcaatgcattctgaaaatgaagaagaagaatcagaagatgaagaagacttctcactttttgtgcagaagtttcaaaaatttgtcaagaaaagaagaatcgagaagcgtcaaaacttcaacaatggaagaagatctcaagaagactatcaaattcttagatgctacaaatgcaaccaacttggtcacatcaaagcaaattgtccttcaaatgaggaatggcctgagaaaagtgataggaaaaggtatgaagaaagaaggaccaagaagtcctacattgcatgggatgacaatgactcatccaacggtttagagaaggagatcaaccttctaaccaaggactatgagagtaatgagaacatctctctagaagattaa

SEQ ID NO: 89080 - DNA, 999 bp, Glycine max
  Peptide Sequence Number=SeqID_205858
atggctggtttcttctctctaggtgggacacaaaacaaggaagaagaggaagtagaaaaaggagacaagaataacctattgctgttgaggaacgaggagatctacaacaacaagggtgggttcgagatatggccacagtcgtcgtcgtcgtatcacttgagcaactactttgcgtttggagtgggtcctagtcgcaggaacaggtcggaggatgtttcattgtgcgtgtcggaggatgagtctacgagatttggattaagtgtgatgaggactggaggaagcagcagcagcagcatgagcatgaactgtcaggactgtgggaaccaagccaagaaagactgcgcgcatcttagatgcaggacttgctgtaagagccgagggtttcagtgccagacccacgtcaagagcacttgggttcccgcagccaagcgccgcgaacgacaccagcaactcgctgagttgcagctacaacaacaattccgtggagtaggagacaatattcctaaacgacatcatccagatactactactagtactcaacttgcctccgctccacaacccgttacagggttagagctgggacaattcccagctgaagtgagcacttcggcgttgtttcggtgtgtgagagtgagcgcagtggacgcttcagatgaacagtatgcgtatcaaacctctgtcaacatcggaggacatgttttcaagggatttctctacgatcaaggtcctgaaagttcttacactggtgcagcagctgagggttcctccggtggtgaacctcaacaacttggttttataaccgccgccgcaaccacagccacaacaagtgggaacagcccatttgacccttcactttacccagctccgttgaatgctttcatggctgtatttttctttttctgggttaatgttgaaggagctttctggctggtgctgaactcgaagccgctttttcccgtttatccgtttgcttgccagatcgaaatagaacgaaagtag

SEQ ID NO: 89081 - DNA, 291 bp, Glycine max
  Peptide Sequence Number=SeqID_205859
atgatagagctttttgggccgaaacctaaggatccgacacgagtggcttttgttactgcgctgcgtgcagaaacagagaaggagagaagaatggacgaggagaatggttacagtgggagtagcagctcaaacttggagactacaaaagcagagagatctgtgtggctgatgaagtgccctttggtggtggctaagtcatggcaggctcatcctccttctcaacctctcgccaaggttgtgctctcccttgatcctctccaccctgaagaagacgatccctctgcagtccag

SEQ ID NO: 89082 - DNA, 1506 bp, Glycine max
  Peptide Sequence Number=SeqID_205860
atggcacgtaggctacggttgtttaaggaacaaatgacgaaagcaggtgtatctccctcaatgtggtcaacaagagacgatcattttgatctggaacatttggaggttaaacttgaagaacttgaagctgagctcctcgagattaatgcaaataatgagaagttgcagcacacttacaatgagctattagagtataagcttgttctagagaaggttggtgagcttttctcttcagcaaaaaataaggctgtagctcaccagaaagagcttgaatttcagacaactgttgaagggtctattgacagtccattattattggaacaagaggagacgacaacaaagcaaattaagctggggtttattggtggacttgttcatagggaaaaatcaattcctttcgaaagaattatatttcgtgctgctaggggaaatctgtttctcaaacagggtgtgattgaacatcctgttcttgatcctttgtcaggagagatgcgggcaactatggactgcagttctcaagttgtggcgatattccaggttttagagacaacggaatcaccacctacctatttttgcacaaacaaattcacttcttctttccaagaaattgttgatgcctatggggatgcttctacaacaggtttcataaaagtgcgtagcacttatccatttggcgtggatcctaaatgccatggtactcggagtgaactgccatttcttaattctttgaagatgaagatgtcaattctgctgggggctgacctgtatcatctgatgatatacacgttcctaagcccaactgatgatttgggtgaaaaccagcttttcgttggtcaaaagctccttcaactcgtgttactactgttggcagttgttgctgtgccatggatgctactaccaaagccctttctcctgaagaagcaacatcaagaaaggcatcaaggccaatcttacgatttgctctgcggcaccgatgacactcttgaatcagaatcacaaagtattgcccatgaccatgacgagtttgacttcagcgaggaatacaatttaggctttttgataaacttgcaattggtggatggcaagaacttgggacatgctaggtgcagccagcaacattgttggtgcacccagcaattagaaaaaccttcttctggagaagttaccggaagaagttcttccgaaccttcttctggaaacttttcggaagaaggttcttctggaaaaaggttcttccgcctagctcattcggagttgtccagtgttttctatgacaaagttctgcttctggcctgggggtataataacactattgttcttattattggcatttttgtttttatctgtgcaactgttggtgtgttactgttaatggaaagtccaagtgctttcttacatgctttgagacttcactgggtagagtaccagaacaaattttatgagggagatggttacaagttcttcccgttttcatttacattactcacggatgaggatgaactgtaa

SEQ ID NO: 89083 - DNA, 177 bp, Glycine max
  Peptide Sequence Number=SeqID_205861
atgagaattgaaaaggagtcgcacatctttgaattgaatggggccgagatcgccaagaaaaaaactcaaaagaaaaaatcgtttacaattatcttaccaaatcatatctttgccgctacttccaacccgcggtttaaaatgcttttttttcgtcctaaagctcgcgcgcacgagtaa

SEQ ID NO: 89084 - DNA, 183 bp, Glycine max
  Peptide Sequence Number=SeqID_205862
atggataggggtacatatgaatcaggtactgtaataggagaaacccacaggttggggactgaggtgaggataaagatctcttcccgtatggggatggggattattttttccatacctgtatccagtgccatccttattggcagaacaacatatgaaacctcctatattgttttgaaaaattaa

SEQ ID NO: 89085 - DNA, 531 bp, Glycine max
  Peptide Sequence Number=SeqID_205863
atgggtacgccactttcaaagctttggggggtttacaaagagctccttgacgtcaaggagctttttgacaaccccaaagtggcagtatctcgagccacggccgtctgggttcgggacgtcgatgatgtttccgtcgaggtccgtcatctttgtagagtgcttcgagtaattcggcttgccgagctccacgatgtggtgtttccagtgggatttttcattgatgagcttgttgatctcgttgttgagatcgcagaggtggtgctcgctaagaccctcgttctagatctcagtaacttttcggccgatctcctgcgttcttgttacgagccatcttccgataaagaaaccctaacaacaaggtgttcggggatagcaccaccttgtgcggctgcaggttgggtggtgggtgtgtgtgttggtatttttttgttggatgtcgtgatcgacggtggcaacactggttggacagcggtggtggtagtttccaatggaggaagggaagaaggagatgatgtagtaataacgtgttag

SEQ ID NO: 89086 - DNA, 216 bp, Glycine max
  Peptide Sequence Number=SeqID_205864
atgaccaaacttggtctctgcttgccatcgggcccgccgcgtctggatgacaaaggggtgcgaataaccataagaatgaccaaacttggtctctgcttgccatcgggcccgccgcctctgaatgacaaaggggtgcggataaccgtaaggggtgcggataaccgtaagaatgaccaaacttggtctctgcgtgccatcgggcacgaccgcgtctga

SEQ ID NO: 89087 - DNA, 1293 bp, Glycine max
  Peptide Sequence Number=SeqID_205865
atggctgattcaggctcagcctcttcttccagaatgtggtgctccatccccgaacgggttcagctgcatgcggccatgttggccctgcagtttggctatgctggctttcatgtggtctcaagagctgcccttaacatgggcattagcaaacttgttttcccagtctaccgcaacattattgcttttctcctcctccttccttttgcctacttcttggaaaagaaggagagacctgccattactttaaacttcctcttacagttctttcttctggcacttgtcggaaaaaagaaaaaaggtagaagtaaagctgcagagactattgactggatggattacagcgaaccaaggtttttacttgcttggcttggacaacacatccccaacctttgcatcagcgattcagaactctgtcccagccattacatttctcatggcagtcatactcaggcaagcccttataaattaattgttgttattcatttgttgcaccagcaagaagcatgcacaacattaaataggatatggatagagcaagtgaggctgaacagaaaggatgggatagcgaaggtggcgggaacgatattctgtgtggctggggcgacggtgattacactatacaagggtccaacaatatatagcccaagtccacctctacagagtgagagctcagtagtagttgagtttgggacactctcatcactgggagatgcaaaggggaagaactggacccttgggtgcctctacctcatagggcattgcttgtcctggtctgcttggcttgtgctccaagcacctgtactcaagaagtacccagctcgcctctctgtcacttcctatacatgtttctttggactcatccaattccttgtcattgctctcatcgttgaaagagatgctcaggcttggattttccaatctggtggagaagttttcactattttatatgcgggagtggtggcatctggaattgccttcgctgtacagatatggtgcattgacagaggtggccctgtgttcgttgcggtgtatcagcctgttcaaactcttgttgtcgctattatggcttcccttgctttaggcgaagagttctacttgggcgggatcataggagcagtgttgatcgttgtgggactgtactttgtcttgtggggtaaaagcgaagagagaaagtttgcaaaggaacatgctgcaattacgtctactccagagcacagtggtatcaggtcctcaagccatgccaaaacattactcactcagccacttctcccttcatctacggagaatgtctga

SEQ ID NO: 89088 - DNA, 231 bp, Glycine max
  Peptide Sequence Number=SeqID_205866
atggtggcgataatgatggtggtaatggtgctgacgacagtgggatggaataatggcggcgatggcgatggtagtagcggtgaaatgtggttgtcgcaacgtgcccttttgcgggcgagcgagggcgaggctcacgggtgcgctttccaaaggaggaaagatgcgcggagtcgccaccaacgtttatttgtggaaaacgtcggaaaaactgaaggaaaccggtcaaaatga

SEQ ID NO: 89089 - DNA, 588 bp, Glycine max
  Peptide Sequence Number=SeqID_205867
atggaatcgagagctccaagtgggccatttttgcgctctgtgcgcgtactccgaaagggaatcgggttaaaaattcctgaaccgggacgtggcgggctgacggcaaacgttagggagtcccggagaccgtcggcgggggcccccggaaagagttatcttttctgttttaacagcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 89090 - DNA, 831 bp, Glycine max
  Peptide Sequence Number=SeqID_205868
atggagaacatcatgaaccattatcaggcagcaatcatcggatttggtaaagcaggtaaaacgctggcggcggcactggggcgcgccggatggcgtgtcgcgatcatcgaaaaatcccgcgtaatgtatggtggcacctgcattaacgttggctgtatcccaacgaaagcactggtacacgatgtgcaacatcatgccagtttcagcgatgccatgcagcgcaaggcggcagtagtagaattgttgcgtgagaagaattacctcaatctggccgccattgcgcagatcgatatcattgatggtgaggcggaatttgtggatgcccacacgctgaaaatcacctcctcgcagcaggtcagccagattcatgctgagcgaatttttatcaatagcggtgccgaagcggtgtttcccgcactggaaggcttagttgccggaccgcgcgtggttgacagcagcggtatcctgaatttgacgcaactgccgcagcggctggggatccttggcggcggttatattggcgttgagtttgcttccatgtttgccggttttggtagcgaagtgacgttgtttgaaagtgcaccgcaatttctggcgcgggaagatgatgatatcagtgcggcgatagccaggatcctgcaggagcagggcgttaagctcgagctcaacactgcattacagcgtgtaaccagcggtcgcgacagcgtgacgctgcataccgcacagggcgatcgtgaagtcgatgtgctgctggtcgccacgggccgtcgcccggcgacgaaggcactgaaactggaaaatgcgggagtggtgaccgatgcgcgcggcgcg

SEQ ID NO: 89091 - DNA, 258 bp, Glycine max
  Peptide Sequence Number=SeqID_205869
agtacctgtacctccagcaagggcatcaggccccctactgatcgagctatcatcaagaagtactgcgtccctaggcaggcgcggggcgaaacaccacagcagcattgggatggtcggcaacgggaaacagacgcaccgccatcacctctagagttcacctctgctcatccacgaaaaggtttgagtattgcctacacaacatggccgacccataggcgaccaagtccaaagccaaaggacgcacctagttgctcatga

SEQ ID NO: 89092 - DNA, 2779 bp, Glycine max
  Peptide Sequence Number=SeqID_205870
atggctgccgcacgaaaagccgatgctgccgggatcgccctcgacaccgctgcatgcgccatcgaaacgcatcgcgtttggtctgatcggcctgctgatctccataccggcgcgctcagtaatgcgctggtgaccgccaacctcaccaatctgcagggcaccttcgccgcatacagcaacgaaattgcctggctgccggcggtctacgtgatgggcaatatctccattaatctgttgctggtgaagttccgccagcagtttggtctgcggctgtttaccgaagcttttctggtgctgtacgtcatcgtggcgttttttcacatcctcgctaacgatctcagctcggcgattatcgtgcgtaccgcgcacggcatggttggcgcggcgctcagctcgctgggcatctattatcagatccaggcctggccggcgaagcaccgtctcaaagcgctggtgattggtatcaccgcctcacagctggcgattccgctggcgcggctgttctccagcgagctgctgcagctggaggagtggcgcggcctctatctgtttgagctgggcctggcgatgattgcgctgggctgcgtgctggtggtcaagctgccgccgggcgaccgtatcaaagcgttcgaaaagctcgatttcgtcacctttatgctgctggcaccgggcatggcgttattgtgcggcgtgctgtcgctcgggcgcattgagtggtggttcagcacaccctggcttggtgtctgtctggcgctggcgctggtgctgattgtcgcggcggtggtgctggagcataaccgggctaacccgctgattaacacccgctggctgagcaatggcatgatcgtgcggctcggcatcgtgatgatcatgatgcgcatcgtgctggccgagcagaataccggcgcgcgcgctgaccatcaaacccaaccatctgagctggccaatcgtggtctcgctggccgtaatgattgtcgcctcgctgatggatgcgcaatccagcccggtaacgcgcgccagcaatctctacttcagccagtttctgctcggtttcagcagtgcttttttccttgggccagcgatgctgcttggcatcggcggcgtggtgactcagccgaaaaatctggtgagttttgtcgtgctgtttggcatgagccagaatcttggcgggctgattggctccgccattctcggcaccttccagacgtggcgcgaaaaatatcactccagcctgctgggcgatcagctgtcgctgctcgatcccaatgtggtggatcgcctcagccagtacagcgcgctgtttcgcagccagcaggcggacagcggcctgctcagcgcgcagagcagcagtcagctgcaaaccgtggccacgctgcaggccaaccagcaggctgcgccagcaaaccgaacggagaccccatgagtcaacaggacgatctacaggctgcggagcgcgagcgcaccaaccgccgacgcattctctctatcgccgccgggagcggtatcgccatcgtgggcgtgctggtgattttatacgcctggcagctgtggcccttcaccagcaccatccagtcaacggaaaacgcctacgtgcgcggccaggtgacctttatcagcccgcaggtcagcggctacctgacgaacgttgaggtggttgatttacagccggtgcgcaaaggacagctgctgatgaccattgacgatcgtatctatcgccagcgcgtgcatcaggcgcaggcacagctggcgatgaagatcgccgcgcagaataacaaccagcagcagcagaagagtgcggaagccactatcgtcagcaataaagccgcgctggagaatgccaaagcgcaggcgctgaaaagcagtctcgatttgaagcgggtggaaaatctggcggcggatggctcgctgtcggtacgcgagcgtgatgccgcgcgcgcagccaatgcgcaggcgcaggcccagctgcgccaggcggcggcgcaggtggcggtctcgcagcagaatctgcaaaccaccatcgttaaccgcgcggcgctggccggcgacgtagccagcgcacaggcggcactggagctggccaatatcgatctggacaatacgcgcattatcgcgccggacagcggccagctcggtcagctgtcggtgcgcaaaggcacctacgttactgccggcacgcggctgacctcggtggtgccggataataaatgggtgattgccaacctgaaggaaacccagctggcgcgcgtgcgccccggtctgccggtgtcgatccgcgttgatgcgctggacggcaagcgctttgacggccgcgttgagtttatctcgcccgccgccggatctgagttcagcgccatctcgccagataacgccaccgcagctgcggcccggcatgtcggtggaggtcaacatcgataccgccgccgaaccccaccgggagacaccatgatgcggccgttaagcgtggcgctcctcgcgctgctgctcaccggctgcgcccgcgaagtggagcgcgcgccgtcgtcactgccgattccgcccggctggcgccagcaggtcgggcccgccgccgcgccggaagcgcagtggtggcgcagctttggcgatgatcgcctcaactggctggtgaaccaggcgctgcagcacaacagcgatattctcattgcccggtcgcgcgtcgatcagtatcgcgccgagctgcgcgctgcgcagggcgacaacttccccacgctgtcggcgggcgtggcggcaacccatcagcgtgcgctgtcagcggcgaccg

SEQ ID NO: 89093 - DNA, 558 bp, Glycine max
  Peptide Sequence Number=SeqID_205871
atggccaggcgatcagcgccagcgcgttcagcagctgcaacagcctgtgcatggcgtttatcaggcctggtcgcgcatcagctggtcgacggcgtcaaccacgtcctgtacggtgcgcaccgcgcggaaggcttctggcttgatcttacgcccggtgcgtttttgcagatgcaccaccatgtcaaccgcatcaatactgtcgagttcgagatcttcatacaggcgagcgtccgggcggatctcgtccggatcaatttcgaacagcgtagtcagcagcgtcgccacttcctggtaaatatcttgtttattcatgtcgacgcggccagcgtggccacggaaaaaaagtgcgcccgcagcgtttcgctctcggcggagagctgcacgccgaagcggtttttcaccgccagtcccagctccagcgcatcgatcgagtcgagccccagcccttcgccaaacagcggtgcatcgctatcgatatcatccggactgatatcttccagattcagcgtgtcgatcatcatgggttttaatgtcgtcaatcagtgcttgcataactga

SEQ ID NO: 89094 - DNA, 285 bp, Glycine max
  Peptide Sequence Number=SeqID_205872
atggctggcgctgactcacccgcagtggcgcggcgtgctggtgctgctggcgctggtgtttgcggcgcgcatctggagcctgcgtcaggcgcagggcgcgctgaaccgcacgctgctgctgctggcgctgatcggctgcctgctgtctctcgccagtatcgtgttgcgggcgcagcatctgctgctgtggtatccggtggtggtgaatggcctgttgcttctgctgttcgccgcgtcgctgttcagcccgatgccgctggtagagcgcctggcgcgcctgcgtga

SEQ ID NO: 89095 - DNA, 207 bp, Glycine max
  Peptide Sequence Number=SeqID_205873
gattcaacaagcgattctcctcaaatttcagccagcccgtatcaattagacttcacactttatgcttcggggtcatacaatgctcaatggaatgccccggggctcctccatgataagcacacgttgcgttcgagtcgtatcctcagaaaaatggaggttgaggtggtcttcgtcattggaagtgcggtagacaggctttgtggttga

SEQ ID NO: 89096 - DNA, 637 bp, Glycine max
  Peptide Sequence Number=SeqID_205874
atgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgccagatggaagacccgttgatatggtcttcaatccactaggggtaccttcacgaatgaatgtaggacaaatatttgaatgctcgctcgggttagcaggag

SEQ ID NO: 89097 - DNA, 464 bp, Glycine max
  Peptide Sequence Number=SeqID_205875
atgcgtagatcttctgtaggtgaattggttccattggatttagaaattgaagccacctttagaagaaacaacgcagaaaggaaaagaaagcttttgcacaacataacagtagcatcaatccttgaagaggctcacttttatgagtcatcatcttctaattcacctacatccaaggaatctcaaacaacagaatttgaagccgaagtcatggctgaagagcaacctcgacgagtgaccttggaagattactcaagtacttcagtgccacaatatttctcaagtgctacatggccaaagtcaaagcaattactcgacacttctgcaggaggaaaaattaagttgaaaacacctgaagaagccatggtaaacctttacttacttgacactaagttacaggttgcacactttgtggtggagcttatgggtcaggcctgtgtattcccactgaagaaacatctcatgaa

SEQ ID NO: 89098 - DNA, 228 bp, Glycine max
  Peptide Sequence Number=SeqID_205876
atggctatggatttgaacttctcttcgactactcgggctctttcaagctctgcctttagggcttactctcagccacttatgatagccgccgatgatcccattactgcttcgcctaagctctctgtcctttcttcacgccgcatcccatgccttgcgaactccttggagtaccctcgcgttgtggtcactaaaacctcgtgcgatgaaaggcgtgatgctttcgtctga

SEQ ID NO: 89099 - DNA, 252 bp, Glycine max
  Peptide Sequence Number=SeqID_205877
atggagataaggagccattgggagggatggagatgtgaaaacaatattacttggccaaaaagcagtctaaagctactctgtcatcatggacctcatgtatcaaaagcaaatacaaatggtaatgatgctgatgttgcacctggattttctcctttgaaaactgttcaatttggaaatccttctcaagacactgttgaaccaagagatggaggctttggaggaagactatggagatggaaatgggaaaaatga

SEQ ID NO: 89100 - DNA, 240 bp, Glycine max
  Peptide Sequence Number=SeqID_205878
atggaagagaattccgaatcagcttggtctacgaacaaggaagctataagtaatgcaactaggaatctcatggagagttcgatcctggctcaggatgaacgctggcggcatgccttacacatgcaagtcggacgggaagtggtgtttccagtggcggacggctggaaacggctgctaataccccgtaggctgaggagcaaaaggaggaatccgcccgaggaggggctcgcgtctgattag

SEQ ID NO: 89101 - DNA, 135 bp, Glycine max
  Peptide Sequence Number=SeqID_205879
atgtgccaaatactcaaaaagagggcaaaagggtcaattttagggcatttttcagcccttgaatcacctagacaacttcatgatgaagtaaccagctcgcctgggcatgggaaggctgaagtaaagggtccctga

SEQ ID NO: 89102 - DNA, 149 bp, Glycine max
  Peptide Sequence Number=SeqID_205880
gaacggatcacttgatacaggctacgaagatttggatgacgccccttccggtgaaggaagataaatacggggatgcgccacatccggtgaagggagaaaactcgggggaaacccccctatttgatattagatgttgctttgaagcctaa

SEQ ID NO: 89103 - DNA, 758 bp, Glycine max
  Peptide Sequence Number=SeqID_205881
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcaaggaatgggtactcctcctgctctatagtggagagatgtgatatacctttgatcgaccttagccggttaagtcttgagagagaagaatgcatgagagaaattgcagaagctgcaagagaatgggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 89104 - DNA, 125 bp, Glycine max
  Peptide Sequence Number=SeqID_205882
tggttgttgactatgtctctaaatgggttgaagcagtggctaccccgcataatgatgctaagacagtcgtgaaagtttttgaagaagaacattttctcaagatttggggtgccctagaattctga

SEQ ID NO: 89105 - DNA, 222 bp, Glycine max
  Peptide Sequence Number=SeqID_205883
atgaacttaatcattgttatgaaaaggaaagaacgcgctttacggcacccttaccaaacgcgtgctagagctagagtaatgggtgaagtagaggaggtacaagaacagatcaaggctgacatggaggccatgaaagagaaaatggccacaatgatggaggccattatgcgcatgaaggagataatggaggtcaatgcggttgcattgctgaggtggacctga

SEQ ID NO: 89106 - DNA, 174 bp, Glycine max
  Peptide Sequence Number=SeqID_205884
atgcatgaatatggggcacagtgccccatgtgtgcagttaagaaggtgatatggaccttccggcttcccgtgacaaaagacgagaccaacatacaacacatgcgtgacgacatgatgcagatgcgcaatagtgcaacagggggatgtacacagcatggcaatatcctcaaataa

SEQ ID NO: 89107 - DNA, 627 bp, Glycine max
  Peptide Sequence Number=SeqID_205885
atgatggaagccatgttgagtatgagaaaaatgatggaggttaacacagtgacagtcattgccgtaagtatcgccactaaggtggacccgactcacctatatggtctcaaccaagtaaattgcccagcctcggatatggtaggtcagggcagcgaagcattaagaagtgtgggcggcccccattttgtgcaggaacaggtccctcaacccatgggggagacacatgaagtaacccgagaccatactctagccaactccgagccttgcctcggatatgccactgaagggcaggcgtttggtggcccctcagtatcgcccacaaccataacccttacattttgtggtggaaagactgcctcctgccatggagatggcaattatgcctttgctgacatgaaagagttgtgcctagtgcctaacgtggtcattcctccgaagttcaaggtgtcagacttcgataagtacaaggggactacttgccctaagaatcacttgaagatgtactgcaagaaaatgggggcatacgcaaaagatgaaacattattaatgcatttcttccaagaaagtcttactggggcagccataacctggtacaccaatctggagtcttcccgggtccgttcctga

SEQ ID NO: 89108 - DNA, 231 bp, Glycine max
  Peptide Sequence Number=SeqID_205886
atgagattaactgcttatgaatcttcaaagctgtataaagaaaggcttaaatggaaatggtttggaccatttactatcaagaaagtccgaccatatggggcagtggagctttgtgatcctcaatctaaggatcttgacaggacatgggtagtgagcggacaaaggttgaagcaatatcatggtagagctattgaaaaattgaacactgttctatgcttcgaaccaggataa

SEQ ID NO: 89109 - DNA, 270 bp, Glycine max
  Peptide Sequence Number=SeqID_205887
atgggcccgctgagcgcgagaagagacaacattctcgctggggggctggctgcgtgttgggcatcaactaacatggaccttgcatcaaacaacttcatgctcccattaaaggctagtggcgaaggcctacacaggcatcgcaaacatggagcttggggaagtggtccacgcgctcgcgttgaaggctggtggtttctcttacttgtttgtggggaatgcgttgatcgccatgtatgggaaatgtgcacatgttgtgattcaaacccctaa

SEQ ID NO: 89110 - DNA, 227 bp, Glycine max
  Peptide Sequence Number=SeqID_205888
atggtgaggactcgtattcctctgacggcgagggtgtgtaaacctctgaaggcgaggacgtgtagtcctctgaaggtgaggacgtgtactcctctcaatgggaggacgtgtagtcctctgatggcgaggacgtgtaatcctctggaggtgagggcatgtagccctctgaagacgaggatgtgtagtcctctgaaggggaggacacgtagccctctaaaggctaggag

SEQ ID NO: 89111 - DNA, 520 bp, Glycine max
  Peptide Sequence Number=SeqID_205889
atgtcctaccctttcagagggctgcatgtcctcgccttcagaggactaaacgtcctcctctttagaggattacacgtcctcgccatcataggatttcacgtcctctccttcagaggactacacgtcctccccatcattggactacacgtcctcgccttcaaaggactacatgtcctcgccatcagaggtttacacgtcctcgccttcataggcctacacgtcctcgccttcagagggctacacctcctccccttaaaaggactactcatcctcacctttagaggactacatgacctcaccttcagaggactatacatcctcgcattcagagtgctacacgtcctccccttcaaaggattgcacgccgtcgccattagaggactacacgtcctcgcctttagagggcttcattccctcaccttcagaagacttcacgtcctctccttcagaggactacacgtcctcgcattcgaagggctacacgtcctcgccttcagagggctacacgtcctctccttca

SEQ ID NO: 89112 - DNA, 143 bp, Glycine max
  Peptide Sequence Number=SeqID_205890
tttctattgctagtgctgcaaatgtatatgctcaagtgaatagtatccttatgctgaatgtgacaaattttaaggtctgcaaggaagccatagaaattgttctcggctgtatggatttggatttggcactgagaacggaatga

SEQ ID NO: 89113 - DNA, 243 bp, Glycine max
  Peptide Sequence Number=SeqID_205891
atggagcaggcgttaatcgctttaagagacgaagaccttcgtggagatttacctaaaatcaagattccgacacttatcatgcaggcaaaacaggacaggatagtggcttatgctttagcagagcaaatgaacaaagctattaaaggatccaagcttattccttttgaaaacagcggacatgcactgttcctcgaagaaaaagacaaattcaatgaagaattattgaaatttcttaagcaataa

SEQ ID NO: 89114 - DNA, 360 bp, Glycine max
  Peptide Sequence Number=SeqID_205892
atggcatttgcaaccaaaagtatctctatgaatgaactgcgcaataacgttgcggtactgtgtggagcatccaaaatattcaatgttccgacaattgttaccacagttgcagaacaaagtttttcaggtcctgttttcccggaaatcgaggaagcatatcctatggcaacctcaggctatatagacagaacaacgatgaatacatgggaagatgaagccgcttataaagccattacaggaaccaagaagcaaaaactggttctcgcaggattatggacaggcgtttgtattgtggggccggcattatctgcacttgaggaaggctatgacgtgtatgtcattaccgatgcctgtggcgat

SEQ ID NO: 89115 - DNA, 267 bp, Glycine max
  Peptide Sequence Number=SeqID_205893
atggaagagtttcatcactccttgatgacagagttcatcaaattgtgcgattgtcgtgtcaatgatgagacccattcaccatcgttcagtgcaaaatcagtgtcagaatacaaaatggcaacaaagaagtggactcgaactgctgacatccaccataggttaaaccaccgcctctcaggcctcgacaataactccccccctccccccgaacacagcccaactcacaattgtgctctccaacgagcaactcttctccaaagtttctga

SEQ ID NO: 89116 - DNA, 150 bp, Glycine max
  Peptide Sequence Number=SeqID_205894
atgaaaaaaataattcatagggacgaagagagtgggaagattctgaatttggtgtttgtttgggctgaggatggaatgaaattgaaggtggatgtgcctgttgttttcaaaggggaagatgcctgtcctggtgttcagaaaggtatttga

SEQ ID NO: 89117 - DNA, 348 bp, Glycine max
  Peptide Sequence Number=SeqID_205895
atggcctcgatcacttggcaggccaagctgaaggagtccgagctcgaagtggagagggagaaggaggcgaataaggaacttgaggatgaactcctcatgcaggcaggactttttgttgagggtctcaacctgaacctccttgacccatttaaagatatgaaggatgggcaattgcttgacaatgacgacattgctgccatggaggcatttgatggagagaagggtgatggggccgatcatatcttcattttggacttatacaatgtttggacatggccttgtcgtggaacaatgagtgtggtcctttgtgttgagtatcaaaccaccatgcttgacaggtctgtatga

SEQ ID NO: 89118 - DNA, 171 bp, Glycine max
  Peptide Sequence Number=SeqID_205896
atggctttgtacaagaagcttccgcattttggatctaaggttgacgagcagggtttacatgtgtactttagtgccgtatcacttgccacatcatttgtagcccttgggcaagcaaaagaatgtatgttgggagtccaatttatggatgccacaacggacaaaacttgttga

SEQ ID NO: 89119 - DNA, 1413 bp, Glycine max
  Peptide Sequence Number=SeqID_205897
atggttgtctctattgtcattgccaacttcatggtgtctaaagttctttttgaccaaggaatgcaaaccagaggttacgtggacctgatgaccaccttcggccagggcaagttctcgtggagtttcactgtaagatatttaattgtttatgcaaatacttcttacttttccttgattggaaggaaaacattgaatgagcttggagccatagtctctacctcgcacctcaaaatgaagttccctaccttgacggaagaaattgtcattatcaaggtagactataagcaagcccgacaatgctatgttgagaacctaaaggtggccctttatcctcccatcagagagctgagaaagccccattccccatttggtggcagcagcagtcaagtcatgagcattatcgaagaattcccaataaggaccctggtcatctatgagataaccaagggaaatcctggtgatacattcgatgtggaccctcgggatgatcacttagaggaagtatttggagaaatccacaaatatgacatgtgcctcaaccctgagaaatgcacctttggggtcggcagcgggaaattctcaaggttcatgatcacccacagggggattgaagctaaccctgacaagtgtatgatgatattgaaaatccacatccttaccaatgtcaaagaagttcaaaagctgaatggcttggagcaagatttcttagcttttaagaaaactatcgcaacaccgccataccagaagaagccattagctcagccctcgtccaagaagatggcaagcactagatacctatctactttgttagtcgtgtccttcatgatgttgagaagaggccatcagatcattgtcaagatagaccaccccattaagcaagtgttgagaaaacttgagctagcagacattctagcagagtttgctggccatgtccaagctaccccagactggtggaacctgtatgtagatggcacatctaacgtgaaaggaagtagggtaggcatcatccttgaaggacccaataatatcactttggagcaggccctgcaatttgaatttaagggatcaaataaccaggttgaatatgaggcactcatagtagacctaaagttggcaaaagaggttggagcaatgaagctcatgtgctgtaacgactcacaacttgtccaaagggggcgctccttagcaaccaaggtagtacattctggctactattggccgacacttaaggctgacgtcttcaacttcacgagaaaggatggacatactggagccattgctaaaagctccaggacaagtcaagttcttgctggttgccgtaggctattttaccgaatggatcaaagcaagaccattgcgagagatttcagtcagcgaggtagaaaagtttacttggaaacacctcatatgtag

SEQ ID NO: 89120 - DNA, 414 bp, Glycine max
  Peptide Sequence Number=SeqID_205898
atgaagttggcaatgacgatagagagaaccatagggtcatcatggttgatggggttgatgcctttgaaatctctatcaatgaaggttcgtcttcctgttcatgttgaggttagtgctcacatctttgtgacgcctcgatctccccctatcctttgttctttctccccttctatcttgtttcttctctcttaccctacgatggccctcattgtgccctccgggtcattctccggtctgggctcaacaatcttcggtgttgtgaccatggttgcggaggtacctataatgcttagttctatccagaccatgtctgagcggaatggagaaaggaagagagagaggagacaccacttcaaggagaagatgagcctagaagaagctcaccaccataggaggccatggataagagcttag

SEQ ID NO: 89121 - DNA, 281 bp, Glycine max
  Peptide Sequence Number=SeqID_205899
atgtcatcgagtcatccacccttcgtgtcggtgtgcgtgacaagggtttttgtcgtctatggtactgctggtctgttagggttgccactctccctaggtatgctcattaatcgtgtgagcgaaagttgtcgaagtggatcgttgtccgtcacggtggctgttggagtaggccgatctgatgtcagggttgactccggtgatcttcatggtggtgaattcgtcggtatcctccacctgatgaatgggaaaaaggtacctacaaaagggactttgatgctcaa

SEQ ID NO: 89122 - DNA, 615 bp, Glycine max
  Peptide Sequence Number=SeqID_205900
atggaggaagtattcgaggaaatccataaatacgacatgtgcctcaaccctgaaaaattcacctttagggtcggtggcagaaaatacttggggttcatgatcacccaccaagggatcgaagtcaaccttgacaagtgtgtggcaatattggaaatgcaaagtcctaccaacatcagagaagtccagaagcttaatggtagattgatgtctttgtccaggttccttccaaaactcgtagaaaaaataaagcttttctacaagctactcgggaaaacagagccgttctcgtgggatgaagcctgtgaacaagctttcctatctttcaagaaacttattgcggcaccaccaattctgactcgaccaaagattggagcacctctactcatataccttctaatggcagaagaagtcattagttcagccctcgtccaagaagatggaaagcaccaaacacgaatctactttgttagtcaaatcttccatgatgttgaaaagagataccaaatgattaagaaagtggcactagcactcataacctccgctcgacgccttaggccttatttcagagccaccggatcatcgtcaagacgaaccaccctatcaagcaagtgctaa

SEQ ID NO: 89123 - DNA, 2379 bp, Glycine max
  Peptide Sequence Number=SeqID_205901
atggatgcccatgatgataccattgacaaaggcccaaagcccattgaagagctcatcaaactacagctgggacctaaacccgagcaatgcatgcaactcagtagagacctcaccaataaaaaatatagacatatagccgaagtcctacaaaggaacatggatttatttgcatggcaaccatccaacatgccaagcatccatcccaacatcatatgccacaaattggtcattagccctcaggccaaaccagtctcacagaagaagagaaagatggtagaagagctaagaaagatgattagggaagagattgacaagctgctcaagggccagtttatcagaaaggtcaaatactcaacctggttggctaatgttgttatggtaaagaaggccaataggaaatggcgcatgtgcactaactacaccaacctcaataaggcatgccccaaggacgcatattcgctacccagtattaacaagctggtggatggtgggttcgacttccaattgttgagcttccttggcgcttattcaggggtcatgccttttggactcaagaatgcaggagctatgtacctaagactcatgaaccgagaagtgtttgaagagattcacaagtatgacatgcgccttattcctaaaaaatgcacctttgcggtaggtgataaaaaattgttgggcttcatgatcacccaccatggaatcaaacctaaccctaacaaatgtacaacgatactagaaaatgcacagtcttaccaatgtcaaagaagttcaaaaactgatggcagactggcatctttgttcgggtttctcctgaagcttctcgagaaggcgagaccattctacaggttacttaagaagactaagccattcttgtgggatgaggattcaaaagaggccatcagctcaaccctcgtccaagaagatggaaagcaccaaatactcatctattttgttagtcgtgtcctttatgatgctaagaagcggtatcaaatgattgagaagaccctcaaatttgattttagggcatcaaacaaccaggaaaaatatgaagcactcatagcaggcctaaagctggcaaaagaatttggagcaaggatactcaggtgctataataattcgcagcttgtccagggacatgttgcaaacatatatcaagccaaggaggcagttctactcagatactatcatgttgtaaagacccctgtaagcactaagaagactggacaccttaagaacatcatccaggagacactccaagcaccaatagtagacaccaaggaggtcatgatgggaaaagaggtggaaccaaactgtatgaccccctataagaatttcttaattcaggtggtgttaccaccaaacaaaaataaagctcggcgcctgaaaaggaagcctagttactatgtcatccttaacggagaactatttaaaagagggttgacaacacctttgctcaagtgcctaaacaaccagcaagcagactatgtcatgcgagtattacatgaaggaatctgcttccttcatacaggggggtgctcccaggcaaccaagaaattcgccaatgttccatgcacaccccctgacaaccttcataacttgagctctccttggccttttgccatgtgggggatggacatactagggccattgccaaaatccccaaggcaagtcaagttcttgttggttgccattgactattttaccaaatggattaaggcaaggccactgggagagatttcagccagtgaggctagttgcaagcatctcatgacttctatcgagcatcctcagacaaatgaccaagtagaagtagtgaacaaggttatctttaaagccctgtacatgagactggacaagtccaagggcctgtggaaaaaagaacttcccagcatacattgtgtgaatcatctgaacacaagggatgggttgtccctgtgtggttcagactttgtaaaggattttacaaagatattagaaatctcaagtgggttgcttgagtactggacgccacaaggtctaactctttgggctcatcactgttcttcccaaatggacgccatgatccctattgaagtcggggaaccgtcaacaagaaaactatttttccaagcacaccagaacgaagaaaacataagggtggaattagagatggctagaatcaagaaagaagctaccaagcttcaagcattaacaagatacaataccaaggacctaagtgggaaggcctatttagggtcaaggatgaacatgtccttggtcgaatctccaaaggctcatcaaacccaaggtttgcccttggtgagtctcgccaagcctaagacgaatgcgttagtggttgaatctccaaaggctcgccaacccaaggtctgcccttggtga

SEQ ID NO: 89124 - DNA, 315 bp, Glycine max
  Peptide Sequence Number=SeqID_205902
atgccagccctcctcgtcagccttagttatggaccatcaacattactcgctcagcagcaggtgattgagccggaatccgcttaccaatctattacaagttatcaacagagttgttacgctactataacaaccccaacaattaaggacccaaggctcccgtccaatgttataaataaccagagtccttttttcaagtaccccccttttgttcttccgatagaggatacctgcgagtccaacgcaagaaatcgtagagccatcccgatgacggtccaccttgacgtcagtccactccaaatttcgggaatcaattga

SEQ ID NO: 89125 - DNA, 579 bp, Glycine max
  Peptide Sequence Number=SeqID_205903
atgcctattgactttgtatccccctttgataaaacgcttattcaatcagtcggggtgcaaaactcatctaatgttgtgaaggtcttcctccataggagcctgactacattggaggagaatagacaaaggcataaggaggccctgaccaggattacttctttggagtataaggttgccaaattgagggccactgctcgaacaatatgggttgacgatgtctttgctaagttggtgagcataagactggatggcgacgaggtgttcgaatgctgcatagatttattgaaggaaaagaatgacttgatgagcaaggtggagtgctttgctgaggagaaggaagaacttaatgcgacgatggctgaacctaccaaagctcttaattttaaaaagaaggtcgtgcagcatcatgagaagggatttttcaaggccaacaagcaggtcagattctttattgagggtcttgacctaagcttctttgacccattcaaggatgtaaaggatggacaattgcttaatgaggatgagattgctgcctgggaggaggacgatggcgaaaaagacgatggggccaatgtttag

SEQ ID NO: 89126 - DNA, 543 bp, Glycine max
  Peptide Sequence Number=SeqID_205904
atggtgaaggcctttgagattctacgtccattcttcaacattaggcccaacattcccgtgttcccctacttctttcaaatgaagctgactgggaagattggttgggtgtcattgaacaacgagtccaagaagatgttcgagttcgactcgaatgtgtttcgcaaattcagggatcggttcttaaaggtcaaggcaaccagtatcattactgacagaggctctccgcatggaattaatgcaaatttcacttcaatttcagcaacttttgtctcgctaagcctggaccatgcgcttaacgagtatcatctgctaagcgagacatcagcccgcttagcgagtaagaggaatcttgaagggaatctaccacgcaagcatgaggtcagcgcgtcatcagctcgcccaacaagtcatctgtctctttgggcgcttaacgggcctggcttgcttagccaaagatcacttactcgtgctaagcgcgcctttgaggatagaatgccctttttaaagcctggagtgaaagaaaagagagagctgggcagatag

SEQ ID NO: 89127 - DNA, 400 bp, Glycine max
  Peptide Sequence Number=SeqID_205905
tgagagtttggttttatatccgttagcattggaggaggcacttgagaaactgaaggaggctctccaaatcttgaattctccttccccttcttccccagctggattccttaggtttcaggtggcgctccctcccagtcctaagaccttcactttgttttgctcccaaccccactcctcctcggtctttcctctcatttatgtttccaagaacgacgccgactctaaatcactctatgtcaatttggatgataatgtgagtcaccagaaagaaagccgctcccagattgagttagatgagctggaaagtgtttccattctgtcaatgacccttgcatgggatgaattttccttctctacttttcaagaagcccattattcgcttcaagattctctagaccag

SEQ ID NO: 89128 - DNA, 408 bp, Glycine max
  Peptide Sequence Number=SeqID_205906
atgcacataaatttgcctaggttcaacaggaactcagttattgaagagcaacaaagaccactagaagaagaaaaagggaaattccaagaacataaagaaaatcaacttagagtacaaagattaatccatactcaagaagaggagaaagaacaacaacaatccttgcaaaagtcaaatacaaagggggaagatggatggaaagggaaaagaatcaacgtggaagtagggtataacaaatggcttgaggactattgggtgggtattctctcaaactggaagatgtttgacaaggtaaaatatatctatataatggatggtctggaggaagtgaaaatgagatacttggcgggagacttgattttcatatcaagcagaaagggtacaagaattaacagaaatagaagatga

SEQ ID NO: 89129 - DNA, 522 bp, Glycine max
  Peptide Sequence Number=SeqID_205907
atggatccagaagttttgaacgagaaaagtaggtttgatgttttttggcggaacggcccaggaatgtcaacagtaagcaaaggctctcacaaaagtaggcctttgaacaacaatgtgttgatgaagggagattgtgagactctaaatgaaggcaaccaaaacgaatgcacagagaaagataagtttttagattttaatgcaaatgttggttgtaagggtcctatcttatttgttagatcaaataagtcctttaggaagtccacaatcaaggaaacaagtcaacaatcaaataacataacaaggaataagtctaaaacattactagaggaaggaggttctcttagtaattcaattcaagatgatcacattaggacttgcaataaaaacttctggctacaaaatgatgaagaagacatgggaaagatgttgaagatgggattatccatggaagtatctataggtgctaatggtgaggatatgattcaacgtataacaaaaatggaaaaaagagatgtagagtag

SEQ ID NO: 89130 - DNA, 288 bp, Glycine max
  Peptide Sequence Number=SeqID_205908
atgggtgcatgggacaaacttggtaactttgtttccaagattgtttctcattcagaagaaaaagagaaggctatatgtaaaatgggtttttggaaggaggacaattgggtatgggatgtgagatggaggagagaggcatttaagtgggagaaggtttgtaaacacactacggatacatggttttggaaattttgctctattgaagagtatagcacaaactcagcctatggcatcctgtcacaggacggtggattggactcatcaaatgaaatattctccttggtttga

SEQ ID NO: 89131 - DNA, 366 bp, Glycine max
  Peptide Sequence Number=SeqID_205909
atggtggatggtatgcgtgatgtgtgggcacttattcaaccaagagtacttacaattggcttcgggagggaaaacatgtgttggaggactcgggctcgtggtcatggctctagaaacaacagctaccaaccaacgctcaattctttttatggcaagtgcttcacggtgcaattccggaatgagatctacctcatcaacaaactcatggaaaaggattggatttgcactttggagcatactctgagggaaccaaatcatgaagcttccttggccagacctttggttgtcattcatgaagcatcccagttactgatgcccaagttgcattgttatgccctcggaaccatgtttccacgagggttctaa

SEQ ID NO: 89132 - DNA, 531 bp, Glycine max
  Peptide Sequence Number=SeqID_205910
atgtcaaacgaggaaacatcagagagaatcatgtacaaagaaaaagtggaagggaaccaaataattattccggaagctgcaaaagcagaactagccaaggcaaaggaaaagcccaatagagctaaagagagttccgtgcaatcctggcttgactccgagcctctcatagatgaactcgagaagcagaaaaaaccaatcttgctaatgctcaacagacaagagatcatccacaagagcatcaaatccaaaagagaggatcagctcaagacagaattgatgatccaagacatccaaaatgcttttgatcacacgcataacggcatggaaaggctcaaacttgagggaaagaaagcaatgcaaatactagcaaaactgaggcaaaccctgcatcaaaggaagcagacagttcaaaccttgcaactcactcttcaagctgtgctactggagtcggatgcagtggaaaaatcttctgccaaagctcttcaacagatcaagctttcagaaaatcagagatgttgtgcagcttactaa

SEQ ID NO: 89133 - DNA, 873 bp, Glycine max
  Peptide Sequence Number=SeqID_205911
atggtgaaccctagatgcttcctcgacatcaccatcggcggcgagttagaaggcaggatcgtcgtcgagctcttccacgacgttgttcccaaaaccgccgagaatttccgcgccctctgcaccggcgaaaagggcatcggccccaacaccggcgtccccctccactacaagggcatgtgtttccaccgcgtgatcaaagggttcatgatccagggcggcgacatctccgctggggatggcaccggtggggaatcaatctatggcgccaagttcgaggacgagaacttggagatgaagcacgagaggaaggggacgctttccatggccaatgcgggacccaacaccaacggctcccagttcttcatcaccaccacgcgcactcctcacttggacggaaagcacgtcgtgtttgggaaagttctgaaaggaatgggcattgttcgatctgtggaacacgttgttactggggagaatgaccgtcccactcaggatgttgtggtagttgattgtggggaaattgctgaaggggaagatgatggagttgttaacttctttaaggatggtgacacctatcccgattggcccgctgatctcgatgtcaaacctgatgaactttcttggtggatgagtgctgtggacgctatcaaaacccttgggaatgagcagtacaaggcttgtaaattgaaattaggtgatctacaaggagcgttactggattcagactttgcgatgcatgacggagataatgcgaaagctctgtttcgcaaaggccaggcatatatgttactcaacgacctagatgctgctgttgaaagtttcaagaaagcattagagttggagccgaatgatggtagttgtctacttaaattctga

SEQ ID NO: 89134 - DNA, 321 bp, Glycine max
  Peptide Sequence Number=SeqID_205912
atgaaaaagattgaagatctcttggagaactcaacacttttatctgagaggagagttaatgggagaaattctcctaacagattggtaaatgaaagactcaaaaccaggagcgaagaggaagaacatcctgagttcctaatccaagagaagatgattagagaaagctcaagataccattatttggtggggatgctttcagatgggtcaaaagagtggaaaggtactttaacctcaagccataaaggaaggccctctgctggtttcaagggtggaacttatacaccaacacttaatcttgggaagctttcaagattgtggtga

SEQ ID NO: 89135 - DNA, 474 bp, Glycine max
  Peptide Sequence Number=SeqID_205913
atgtataaaaattgtgacatattaatgagtgagagtgaaaactccggcgacctccgtatccaccatgatggagcttttttggtgctttatttgaaggcgaagaagaacctgtcatcatttacaccacatcacaaaggagccaatgctttagacggtggagagaatatcgttgcaagagtgacggagggagcatccatcgacaaatcagagggagtcagaggaggagatggtagaaagtcgacggcggtcggtgaaggagagggagtgttcaccgccggatcgggaggagagaacgacggtgacttgacggagggggtaaccgtcggcgatggagacttatatggcgtggccaccacgggggttctcttcggagggaaggtagttgaagtgattgtggtgagaagttctgacaaggccaagatcaaagaagaaagcatggatccaaatttacaaattagtccacccaaatcttag

SEQ ID NO: 89136 - DNA, 918 bp, Glycine max
  Peptide Sequence Number=SeqID_205914
agtataggaacatattactggcgaccagcacttcttggtcgtagagacggcacaacagctagtgagagcgaggctagttggttaccttcaccctctgacaccttacaaaacattaccaacaagttcctttcaaagggtcttgatattaaggatttagtagtgctctcaggagttctcaatttctcaggacccctagatttaaatggagacatgcatggagcccacacaataggctatgctcggtgctttacattgaagcaaaggtttttcaactataaggacactggcaaaccggatccatcactggatgcttcactcttacaacatttacagaaactatgtccagataacagttctgacaccaatttggctcccttggatcctgtcaccacatacacatttgataacatgtattacaaaaaccttgttaagaacttagggttactaccaactgatgaggctcttatgagtgatagcacaactgcttcgttggtgaacaaatcattaacacctgaagagggaagtaagaaaaatagccaaaaagtgggcagcaggaccaggttcaatcccgcatcaagtaatttcgaagacgaggtcaaaggtactgttgccttcctcttggcaaatgcattagttctgctatccaagtcttcatcgtcatctaaagcatctcttgcaattgtggtagactctttagcaatattagtgatgtggcttcatgtagagttttgtgtggtggttttgagagtggctgaaaacagagaggttgagaaatcaaagctgttgcagaaaaatagagagttcaatagagaaagagagctaggtttaagagtaacagaattaatacgaagaaccaacaagtggcgccgtctgtggggaaagatcaagatcaagaaagatgggaacaacaaagtatga

SEQ ID NO: 89137 - DNA, 1572 bp, Glycine max
  Peptide Sequence Number=SeqID_205915
atggagcaggcagaaactaggtcatcgagaatggtgcagcaagatgcaagtggttgccgtgagagtgctcgagataatagtaataataacttggtgaatgtccctcataggaggagtatttcgggtagtccttcaatgagtcctcagaaaacaaggaatggtgattttgtgccatattattatgcgtgtccaaaaggaaatcagttctggtccacaccagaaatgcctacctgtgatgcagggttgctacctcctgccttctttgatttatccgcgttaagcacagaaacttctctttctcccaattcccatcaaagtccacaaagaaaaagtccccagaaacacaccagaacttttagtggacctccatcccccatacatcccatgttatcactcgagatcccaacagtgcgccacgaaaataatgctcctcctgtcgctgttcaccccttgcccctgcctcccagggctggcttgacctcgccgcctgctgccgctaccttttcccacgccatggttaagtcagaatcgctgccaatgaaaagccaatggaagaaagggaaacttattgggcgtgggacgtttggaagcgtttatgtcgcaaccaatagggaaaccggagcattatgtgcaatgaaggaagtagaattatttcctgatgatccaaaatctgctgagtgtataaagcagttagagcagtacatatcatatttgttaataggacttttacagaagtcagtgtgtcaaataatcaatttctttggaatagaaattaaagttcttagcaatctaaaacattcaaacatcgtacagtattatggcagtgaaatagttgaggaccggttttatatttatctggaatatgttcatcctggttcaattaataaatatgtccgtgatcattgtggtgccataacagaatctgtcattcggaatttcactcgccatattctctcaggggacatcaaaggggctaacttgcttgttgactctgctggagttgttaagctagctgattttgggatggctaagcatctaactgggtttgaagctaatctttctttgaggggaagtccatactggatggctccagaggctgtgatacaaaaggataacagccctgatcttgcttttgctattgatatttggagtttgggttgtaccatcattgaaatgttcactgggaagcctccttggagtgaatatgaaggagctgcagctctgtttaaggttatgaaggagacccctcctatacctgaaacactttcatctgagggtaaagatttcttgaggtgctgctttaaaagaaatccagcagagcggccaacagctgcagttttactagaacatcgatttttgaaaaactcgcaacagccagatgctatatctcccacccagctttataatggaacaagcttcatggacaaaccacatactcccagtgggcaatctgaaaatagatatggtcagttttcaactccctgtgcaaagattgcaaagggtaaagcagccgaaaggcgaggatttctcatttcttcgttagatattctccctgcatactttgaccaataa

SEQ ID NO: 89138 - DNA, 343 bp, Glycine max
  Peptide Sequence Number=SeqID_205916
agcttcgataatcaatttcgagcgtctcgatatattacgggacacagtcagacaaccgagtaaaaagttattgtcgtttgagttttctcagagcttcgagcctcaacattcaatttcgagtgttccgatatattacgggactcaatgggacagccgagtaaaaagttattgtcgtttgaatttgctcagagcttcgataatcaattccgagcgtctcgatatactacgggactcaatcagacatccgagtaaaacgttattgtcgtttgaatttgctaagagcttcggcattcatatccgagcttctcgatatactacgggactcaatcagacatccgagtaa

SEQ ID NO: 89139 - DNA, 1188 bp, Glycine max
  Peptide Sequence Number=SeqID_205917
atggcgctgctgaatcaggccgcatcgcgcggcgtggagtgggaggcgctgctggtggagatgctgcgtctgctgcaccgtatcgcgatggtccagctgctgcccagctcgcttggcgaagatgatgccagccaggcgcagcgcctgcgcgaacttgcgcgcgtgctgccgcctgctgacgttcagctctattatcagacgctgctgatggggcgcaaagatttgccgctggcgccggatcgtcggctgggcgtggaaatgacgctgctgcgtgcgctggcgtttcatccgcaggccaccattgctgaacctgtggcgcgcccgttgctgacgccgcaggccgcgccggccgttgccgcgccagcgcctcagaccaaagccgcacccgctgtggccgcgcagccgcagatggcaccgccgatggatgagtcgccaccgccggccgatgattatcccgatatggcaccggccccggataacttgcccgacgccaccagtcagctgttacaggcgcggacgcagctgctgcgtcagggagccggcaaagcaaaaaagagtgagccggcagcgcgttccgcgcggccggcaaacccggcgctggaacgtctggcaagcgtcaccgagcgcgtgcaacagcgcgcgtctgagccggcagtaaaagcgccggcgaaaccggaagcgtatcgctggaaagcccagcagcaggaggagatcaagccggagccggtggcgacgccaaaagccttgcgttctgcgctggagcatgagaaaacgccagagctggcgctcaaactggcggaagaggcgctgcagcgcgacgcctgggcggcggaaatcgccacgctgacgctgccgaagctggtccagcaggtcgcgctgaacgcgtggaaagaggtgaatgagcagggcgtgacgctgcatttgcgcagcagccagcgtcatctcaactctgccccggcgcgccaggcgattcaggaggcgctgagccaggcggccggccagccggttgaactgaccatcgtggaagacgataatccggcggtattgacgccgctggagtggcgtcaggccatttatgaagagaaactggcgcaggcgcgtcagtcgatcgaaagcgatacccacattcagacgctgcgtcgcttctttgatgcggacctggatgaagagagtatccgacccgtatga

SEQ ID NO: 89140 - DNA, 111 bp, Glycine max
  Peptide Sequence Number=SeqID_205918
atgacagcaactcagatgattaggaatttcattcatccagttgggagggagttaaatgacattgaaccccaaaagaggcaggttcaggattcagaatcagaagaagagtaa

SEQ ID NO: 89141 - DNA, 198 bp, Glycine max
  Peptide Sequence Number=SeqID_205919
atgagtcctgtgaaggaggacagggaagtaaagccacaccaagaagaaatggagattgagaacttaggtgttggcgaagaaagaaaagaggtcaaggttggcacaggcatatccatacatattcgggatgaattggtggctctgctacgagactaccaagacatcttcacatggtcataccaaatatgctcggcttga

SEQ ID NO: 89142 - DNA, 405 bp, Glycine max
  Peptide Sequence Number=SeqID_205920
atgcgggggtaccttatggttatccgcacctattgtcaaccagaggcaagggagaccgttgatacgcggagatttacgtcatcttccacacagactacctctgtcaagcacaaacctgtgtggttagggggcaggcggaaatacccaagtgactcaatgcctgatagcatgcagagactaacgtcgtcttttgcacccttttgtcaaccagaggcaagcgagcccgttgacacgcagagactagtgttgtcgtctgcacctttgtcatccagagacggcgagtccgatgacatgcgggggtaccttatggttatccgcaccttttgtcaaccagaggcaagcgagcccgttgacatgcggagatttacgtcatcttccgtgcagactacctttgtcaagcactaa

SEQ ID NO: 89143 - DNA, 411 bp, Glycine max
  Peptide Sequence Number=SeqID_205921
atgtgtaaggagagacagataaaccataaaattcttcctgctgataagagaaattatgttgttcagtatattatagagatggagaacccaagtgcctcattgaaactgcattctcagttcaaagggaactacgccaacctctcaatgcaaaaatttagcagtcatgtagttgaaaaatgcctcgtgcatattgtagagatcaggtcaaggatagtccaagaattgtcgtcttttcctcaccttgagcggttgctacaagacccatatgccaactatgttgttcaacgtgctctcggagtgaccaagggctctctgcatgcatctctagccgaagctgttcgcccctacaaaacattgcgcagcagcccttattgcaaaaggattttctcgaggagcctgcttaacaagtga

SEQ ID NO: 89144 - DNA, 237 bp, Glycine max
  Peptide Sequence Number=SeqID_205922
atggtgtttttgtggacaggtggcagtactggtcagttagggttaaaacagagtagtagcgtggtgagtgtgaatcagttctgtgaggatttgttgcacatttgggagaaagggtgggagcgagaaactcagggatacagaaagagggaaaatcagcactaccactaccacactgcaactgcactagccgtttttttcagccaaaaagggcacttttctgagagcagtagggcataa

SEQ ID NO: 89145 - DNA, 1200 bp, Glycine max
  Peptide Sequence Number=SeqID_205923
atgagaaacgaagagctaggaggaatgtggttgaaccggttttccaatcttaatacactcaacaacaccccccttcaccgtggccacgtcacctcacaaccacaatcttcttcgagtgttttctccatgatccatgatgattgtgttgatgttgatgtgacgctgtctaatgattttgctagaatgagtgtttttaacgaactagggaatgttggtgtcaaagccagaggaaatggttatggatatggtgctaatgttatggactcatcatacccacatgcattctcacactcactttgttcttttgatgcacatgttcatgaagaaacggctaccccattacctatttggggtgtttcagtgtcttctgatttgaagggacacacttttggacccccaatggagttttcttctcatacccaaaggagtaacccttgttatggacaggttccacttcagaacccttttcatgctacaaggccttttgcaatggactgtgatgtgaaaagtccctttctgatgcaacaacaacccaaggttgctatgaatcaaaagaaagaggaacgacaaggaggctgcaattctttgtggggttgcaatgagagtttatccttaccagttcaagaagtgggagtgggtgaggaacttcctcaacacattccttctcgtgttgctcccactaagcacgaaaagaatggtgttctcgcgagcgacgtttcaccttcttcgcagccgttgttgtacaattttagtcctttggctaagttccaaggctacatttattacctggctaaggatcagaacggttgccgcttcctgcagaggatgattgatgagggcacctccgaagatgtgctagtattgttcaatggagtcatagatgatgttgttgagcttatgattgacccttttgggaactacctcgtgcaaaagctgcttgatgtgtgtggagaagatgaaaggttgcaggttgtgtcaatgttgactgaagaaccagggcagctagtcaaaacctctttgaatctacacgggactcgggtggtgcagaagttgatcaccactgtggactctagaaaacaaattgcaatgctgaggtctgccattcaatctggttttcttgcccttattaaggatctgaatggaaatcatgtcatacagcgttgcttgcaatactttagctgtaaagataatgaggtataa

SEQ ID NO: 89146 - DNA, 258 bp, Glycine max
  Peptide Sequence Number=SeqID_205924
atggaaaagtgtgcgaaatcggaagcagcggcctcactgcgtcgctgtgcgaaagctgcattgcttctccacagcttgaattccacaatctcccaagatcaggagaagtggaagagagaaatccatgacctgaaaagggaattgctgaaggagcgtttcatgaggaagaagatgaagctctgcgccttcacggagttgttcgctgagctcctcttgttgctctccgtttggaccttcgtcctcttctactttctttga

SEQ ID NO: 89147 - DNA, 1533 bp, Glycine max
  Peptide Sequence Number=SeqID_205925
atggcgttgggtcggagaaacaccatgatcttcggtggctgcatcttttttgcgggtggtgccattaatgctgcggcggaaaatattgctatgctcatcttgggtcgtatcttgcttggcattggggttggtttcactaatcaagcgacgccggtatacctgtctgaaatggccccagccaaatggcgaggtgcgttcaacacgggcttccaattgttcaacaacatgggtgtggtggcggccaattgcataaactttggcactgcaccgcacccatgggggtggcgcatgtcccttggcctcgccacggtccccgcagctatcatgacaatcggtgccttgctaatacccgacagtccaagtagcttagtcgagcgcaaccacatcaaccaagccagaaacgccttgcgcaaagtgcggggccccactgctgacgttgaatccgaattgcaatacatgatccaatcgtcgcagcgccggtatcggcctcagttggtgatggcgcttgcgattcccttgtctcagcaactttcgggaatcagcattgtcgcgttttatgcgccaaacctgtttcagtcagtggtaattggcaataactcggcgttgctttcggctgttgtactaggactcgtcaaccttggttccactcttgtctcaactgttgttgttgatcgacttggtcgaagggtcttgttcatagtgggtggcattcaaatgcttgtttgcatgatttcggcggctgttgtgctggcaatggggagtggtgttaatggtacagagcaaatttcaaagggcaacgccattgctgtgttggtgctattgtgcttctacacagcaggatttgcttggtcgtggggccctctttgctggctaattccaagtgagattttccccatgaagattagatccactggacaaagcatagccattgctgtgcagttcttggcaacatttgttttatctcagacattcttgacaatgctatgccactttaagtttggagcttttctcttctacgcgggttggcttgcactcagcactatctttgttatactgttcttgcccgagaccagaggaatttctttggattcaatgtatgcaatatggggcaaacactggtattggcgccggataaaaaggtgcaagaagcaattgcccctatgggatcttcaaggcctattaaatctagtgcaagctggtgaagacgatggcctggtactagttttgggcatggtgacggtttggattcctagaaagctaggttatgttgatctatgttgggatttgtttccccctctattggatgaggttgtggtcgttgggaaccatactagaggttcaatgattgttgacaacaatgagtggaaggatttgcgacattggaggtgcaatggtggagtcatgacccgtgacgtcgaaagtgcaatgaaaccaaggaaggtggaagcatcgggtggtggtgttttgagaagaagggtaaaaaggagatttaaggaaaattggaggtgcaccaagaaaaatgggatgtcttga

SEQ ID NO: 89148 - DNA, 270 bp, Glycine max
  Peptide Sequence Number=SeqID_205926
atggagtttgatggatacaggttccggagtgaggaacaccagcgccgctttgaggcaattaagggctggtcgttcctcaaggagaggcgggtccagctgagggacggagagtacactaaatttcaggaagaaattgccaggaggctattcagcttccggcaagtgcaccgaatcgcacaaatacctaatcctgatcaagcatcgtccacagattcctcttgtaagactaaactcaaccaggaccgcattaagacacgcatactcaactaa

SEQ ID NO: 89149 - DNA, 105 bp, Glycine max
  Peptide Sequence Number=SeqID_205927
atgagcatcaaaggaggaggccatcctcatcctttaaacattggtgatttgttttcagaagggtctcttaatccatatgcagaggatccctatgcatttgattag

SEQ ID NO: 89150 - DNA, 207 bp, Glycine max
  Peptide Sequence Number=SeqID_205928
atgcagagtccgtcgagaccacccggttgtgcacgtaactgtccccctataggtgatcagcctgggccaaaaggggcaccctaccaggtgacaagccccctcagtacaaagtacactctgccacagttactctatttcttgtgtcatatgagctatgaacacgaccaaaagccatccgacaaggtcagtgcactccaccccccatga

SEQ ID NO: 89151 - DNA, 1938 bp, Glycine max
  Peptide Sequence Number=SeqID_205929
ggttccatttcgatcttcgcaatgcagaagaagctaggattcccaatctccaagagcctcgaccagttcaaatcactatacggttcaatttcggcaacaccgaagccattatcttcgcgtccttccgcggattccgtttcatcggggagtttcgcgaacctcaagctcaccgcagagaaattggtgaaagagcaagcttcggtgaagactgatcttgaaaatgcgaatgctaagctcaagaagtcgcaggagtatgtccatgcattagaagaaaagttgcagaatgcgttgaacgaaaatgctaagctcaaggtcaagcagaaggaagatgagaaaatgtggaagggattggagtctaagttttcttctactaagaccttatgtgatcaacttactgagacgttgcagcagttggctggtttggttcaggacgccgaaaaagataaggaaacattggaatataaactgtcagcaagttcagaagctcttgatagcttgaataaacagatggatggtttgtctttgaagattgattctgcacaggaagcaattagatcccgtgataatgagctagagaagctcaaatttggtacagaagaacgggagaaatttcacagagatgaacagtgcagagttgccaatgttatacaagagaaggatactatgataaggaatttagaagaaatgttaacatctagtagattggctacagagaatttgaattcaaagttggaagaggttcacctacagttaaaagttaaagaagatgaaattatgcatcacttaaccagtcaagagaaattggagaaagaaaataatgatcttcaattgtgcaatgctgggcttgcagaaaagcttgacatgtcacttcaggaaatcaaaaaccttgaagaatcacttcagtcattggctgcacatttgtcaaatttagacaaagaaagcctgaatcttttgaccaagtttgatgaaatgaatttgctctatgcttcttgtttccagttggttcagcaggagagacaaactttctcaaagcatgctcaataccagtatagtgagcttaataataaatttgttgtcttggaattagaaaagaatgcaactcaaatgaaaaatcatgagttaagcaaaactgtggatgaacttcagaaagttcatgaatctactctagcccagcttacggagggctctcgattagctgctgagaaaattcgaagtttggagtcagaagcggaaactttaatctcaaaaaagaaagatgcagaggtattaattttcaaattagaagagaaagctgaatttctgttagaaagttctagatcatcagagaaccaagtgcaaggtttactgctgaaggtttcagccttagagactgaaagcaaagaaaatacagaaagactgcacgcagaaatatcgaagaaatcagaggaaatagatactttgcaaaacgagagaatgaaactagagcagcatgctgattcccttgataaagaagtcatccagcttcagaatgccttggaggaaaaagaaaagtgtattttacattataaggaacaggaaaagaatctggaagatcagatcacagagaatctatcattattgactgctgctgaaagcaaactttcagaggctaaaaagcaatatgatcaaatggtagagaataaacagttagaactatcaaggcatttgaaagaaatatctcagagaaatgatcaggctattaatgatattaagaggaagtatgagttggagaagatggaaattgtgaacaaggaaaaagaaaaggctgacaaagccattgcagaaattgagggaaagtgtggccaaaaaattgaagaatgcaaagaagaacaaaggcagcagttgatgcgcattcaagatgaacacacgttgctcgtaagcatagaaaaagtcttgaatttgaaattattggctgcttag

SEQ ID NO: 89152 - DNA, 231 bp, Glycine max
  Peptide Sequence Number=SeqID_205930
atgaaggagacccattctagccaagggtggttgacagagggtagggtttctgtggcggagaaggaggaagaggaatcgtggcagaggaagcgcaatagcgaaaaaggaatgaatgggtttgaagaagagaaagggagagtgagagttacgggtgcagttcgacgggtacaaaataatgcggttccgatcccgtacactcaatctccacttaacgacaaatttgttgggtga

SEQ ID NO: 89153 - DNA, 552 bp, Glycine max
  Peptide Sequence Number=SeqID_205931
atggttggaatattcttgcaaaacagcattaccctgagtgatctccctatgattttacctagtgagagtgacctgacttatcagtgtgtgaaggtgtcataccctctcaccctcaaagtgttgcatcatgacaaggtggatgttggagtaacggtgactaaatacttgagctcaacttctcatttagaagcaatagtgtgggaattcatcaccgcttacatactgatgctcaccatttgtggtgttgccactgatcacagaggtagcaaagatctcactggagttgccataggcatttcagttctgattaatgtcatcattgccgggcctattactggagcttcaatgaatccagcaaggagtttaggtccagctatcgtctctggtgattacaaaaacatttgggtttatatcgtaagcccaattctaggagcagtctcagcaagaaatttcaggcataagcattacaaagacagggcaaacaaaaacaaagtttttggcactgtctttttagtttgccatatagagaagttttggagatgtgagcactga

SEQ ID NO: 89154 - DNA, 1584 bp, Glycine max
  Peptide Sequence Number=SeqID_205932
atgactatatcctcagccatagaacctgtgacatacgtcgaagcttcccgccatgactgttggattaaagctatgacggccgaattacaagctttacaaatgaacaatacttggagactcatgcctcttcctcctcacaaaacagctatcggatgtcgctggatatataagatcaaatatcgagccgatgggtccatagaaagatacaaggcacgcctggttgccaagggttacactcaaacggaggggttggaccaccttgacaccttttctccggtagcaaaactcacctccgtacgagttcttctagctttggccgcactcaacaaatggcacctgcggcaactggacgtcaacaacgcgtttctccatggggaccttgaagaagaggtatatatgcaagttcccccgggacttccagttgataacccgcagctggtctgtcgtcttcaacgttccctctacggccttaagcaagccagccggcaatggttcacaaagttgtcaagcttcctcacctcccatggcttccaacgatctgattcggatcattctcttttcttgcgcataaccggctccacaattaccatcctcttagtatatgtagacgacataattcttacagggaacagcttgacggagatacaggctataaccactcttttggaccaagagtttcgaattaaagaccttgggaacttgaagttctttctggggctggagattgctcgaacctctaaaggaattcatctatgccagcgtaagtatgtattagatatcttatctgaatcaggcatgttaggttgcaagccgcattcaacaccaatggattattcagtaaaactacaaaagagctcgggtaaccctcttccgaacgagtcttcttcctcttatcgaagattaatagggaagctcatatatctgaccaacacgcgtccagatattgcctacgcagtccagcaactcagtcaatatatgtccgctcctacaactgctcaccttcaggccgcttttcgtgtactacgatacctcaaaggcacaccagggtctgggctctttttcgcagcaacaggaacgccccaactccgagctttcagtgactcggattgggcaggatgcaaagattctcgaaaatccaccacagggttccttgtgtatctaggctcttccctcgtttcatggcagtcgaagaaacaatccaccgtctcccgcagctcctccgaagctgagtatcgcgctcttgcatccacaacctgtgaacttcaatggctgacatatcttcttcaagatcttcgcgtaacattcgttcaaccagccactttgtactgtgacaatcagtccgcaattcaaatagcaacgaatcctgtattccatgaacgcaccaagcatattgaaatcgactgtcaccttgttcgtaacaaagtcacttcagggttcatcaagcttcttcccgtatcgtccagtctgcaactcgcggatatctttactaaacccttgaccccggtagttttccagcatctttgtaacaagctgggaatgatcaacatacattcccagcttgaggggggcgtgttaacagtataa

SEQ ID NO: 89155 - DNA, 657 bp, Glycine max
  Peptide Sequence Number=SeqID_205933
atgactcagtgcttcttcagcttcaccgagacccgaaaccggtgctaccggtcaatgttcgccggctcgggtctccgctccaccgtcacggacctaaaagacgggaccgtgatgcactgctgggagccaaaggcccgagccgagtcgaagccaagtctgctcctaatccacggattaggcgcgaacgcgctgtggcaatggggggacctcatccgccacgtggcgcctcactacaacgtgtacgtgccagacctcgtgttcttcggcgggtcctacacggcccgaccggagcgcggggagcggttccaggctgagtgcgtggcgcgggtgatggaggcgaagggggtgcgaagggtgagttttagtggggctgagttatggcgggtttgttgggtactgcatggcagcgatggaggagggtggtggttatggtggagagagagggatgtgaaggaagggctttttcctgtcatggatttggatgaggctgcgaatatcttggtgccgcgaacgccggagagacttagggagcttgttggttacacgttttttaaaccacctcctttgtggtggttgccctcttgcttcctacttgatttcattgagcatgtgttcgaattacagttcaaagcttgtcaaacggaaaacacattctaa

SEQ ID NO: 89156 - DNA, 327 bp, Glycine max
  Peptide Sequence Number=SeqID_205934
atgtgcagggactatgaacaagaaaagagagaattgatcaaagcccttgcaaaggaccgaaaaatctctgacctccccaagatatctcagcccacattaattatctggggagaacatgatcaagtatttcctttagaactggctcacagattgaaaaggcatttaggggacaatgctcaacttgtggtcattaagaatgcagggcatgctttcaatgtggagaagtcaaaggagttcttcagcatcttgaagtcctatcttgtggattcgcagctacctgttgagagctcaccttcaaagttgcaaaataacaacaatccagaatga

SEQ ID NO: 89157 - DNA, 744 bp, Glycine max
  Peptide Sequence Number=SeqID_205935
atgaatgaagcttcgattaatagcgcagaaagctacttatatctccacccgagcgagaaccctgctatagcccttgtctctccagtcttagactcaaccaattaccactcatggagtagatccatggtcaccgcgctaagtgccaagaataaggtggaattcatagacgggagtgcacctgaaccgctgaagacggacagaacctatggggcttggcgccggtgcaacaatatggtcgtgtcatggctagttcactcggtggccacctccatacggcaaagtatcctctggatggacaaagccgaggagatttggcgtgacctgaagtccagatattcgcaaggagaccttcttcgaatctccgatcttcaacaagaggcgtctacgatgaaacaagggaccctctcagtcacggaatacttcacccatttacgaataatatgggacgagattgagaacttcagacccgactcaatctgctcgtgcaatatcagatgttcctgtagtgccttcaccatcatcgcacagcgcaagcttgaagatagggccatgcaattcctacgaggtttgaatgatcaatatactaacatccgatcacacgtgctccttatggatcccatacctgctatttccaaaatattctcctatgtagttcagcaagaaaggcaattgttaggcaacacaggtccaaagatgcctccatcaacgcggcgaaaaccatctgcgacttctgcggacgtgttg

SEQ ID NO: 89158 - DNA, 1896 bp, Glycine max
  Peptide Sequence Number=SeqID_205936
atggccatggtttggtgcttctctcttttgcctgtgaggaaggagaaactcaaggggaatgaaaggtcttcaaaagaggactttaacactctacttgccaaactacaatctacaaaaaaaatatcatcagagccagccacttttgatgccctgttcaatgcgaggattacaacccttgagagtcctgtgaaggctgaagctcaggaaacttataaagatgaagattcaacattgatcaagagagaactctctgatttttatctccaagatcatgaagctgtggcaagcaaaggatatgatacaacagataaagaggtagagtaccccattttgtatgaaaaccaagtcaacaatgaattggaagacaaaagtgatagattcagccgaaagagtgttgatacaaccgaaagcggacacaccagtgatcctggaattggcatggctgattcctgggcttctccaaagttcaagagatacttatccaaccttgaaaagtttgatgagcatgggaagattactcgtcacttgccagcggcttcaaagtcgaagtctttcaagaattttcaggagttatcatcaatggtcagtcttgaaagccccaggtctgtgatgagtcaccacagtgcagatagagtattgttgaaaaggcactcttcaagtcaggtactcccttctagaagtaaaaaattgtggtggaagatgatcctgtggagccacaggaacatacagagaactctctctagcaattcaacactagttcctactagtgctgctttaaatagtggatactcttcagacacccttgaaccaaaacaaggcaaggcattgaggcctgtgaagtcttctgattcaattactatggaatcctttaacaaacgaagcagaactggtaaaaatattgataatcaaagggggagcaggtttcaaagtgaccaatggatttctttctcaacagaatcatcctcttttaccagagtggatgcatgggtgaaaggtctcgaaattcagcagccgcttcctgaggatgattttgatgtcgacaatgctagaagcattgttttcccaccttctcctaatgctggtggatcaatgatcagaaccacatctcagttgacttatccagatgccaatctttcaaaagaggctttaactgccataagtgtagtcctgtctctaaatccaacttcaactattgctcacatatctggtattggtataaaagccatcccttctatttcacacttatccagtctccgtgctgtcaacttgtcaaacaatttcatagttcacatctcaccaggagttctaccaaagggtattcaaacacttaacttgtcaaaaaacaaaatcagcacccttgagggcctcagagaattggccaagttgcggatacttgacctaagctacaaccgcatttcgagaattggacaaggtttgtcaagttgtacactaatcaaagagctgtatcttgttgggaacaagataagtgatgttgaagggctacacaggctattgaagctaacagttctagacttgagcttcaacaagatcacaacagcaaaagcattaggccagcttgtggctaacttcaactcacttaaggcccttaatctccttggaaattcaattcaaagcaacatcagcgatgaccagctaagcaaagcagtctgtggtcttcttccaaagatggtgtacctgaacaagcaacctgtcaaggctcataggacacgcggaatattaagcgatagtgttgccagagctgcactcgggagcagcacgcgtagctgcaacagaagatcaattagaagagttggccatggaggatcaaatctctccagaggtaatagaaggagtaccagtgtttcccagaaaagcacgaaccggacaaggaagtga

SEQ ID NO: 89159 - DNA, 300 bp, Glycine max
  Peptide Sequence Number=SeqID_205937
atggatataatgaggttggggtgggaccacagtggtgcggcgttaactgtgtcggtggacaagaaaagtgacgcgtcggcgagggatggagggggtgaagtgttacgtgtcgcaggagatggaatcaatattcttcattttcttcttgggttagtggtttgcgaagtgttgctgttttctgactatgattgtgttgtgttgtggtggtgtcaacgcggaattgaaattcgggagcgtcaatggacaatagggttcacgggaaaaaatctgggattaggtgccaaggctggttatttttaa

SEQ ID NO: 89160 - DNA, 2625 bp, Glycine max
  Peptide Sequence Number=SeqID_205938
atggcaatgaaggttcaactacaaactctaacaaaagggtatctttctatgcttgaatatattgagcacaaacactccattgctgactctcttgctgaaaatcttcatccaatttccgatgaggatcttattggttatattttaagcggccttgattcctcttatagtgctttctcaactgctttcatgatgaagtctgatgatgtctttgttgatgatcttgctggccttcttcttcaagaggaggctcgcttagagcaggaacatgttcatcaagctgttgttgtttcacagcccactaacccatccccacttttgtctactcctgctatttacactacaaatcggttctcaaaccggtcctcttccaccaacaatccaaacaacagttctagttcttttcctaggcgtaacattgacaaccctcgtcgtcatcctatttgtcaactgcgtgccaacccaagattttcctctcgtcaagctaatgttgctcaaactagaacatctcccactgttatggacccgtcatggtactttgacaccggtgccacaaatcacgtcactccagatattagtaagcttaccattgccaacgattacaccggtgatgacaagatatatatttcccgtcatgttgttttcaatgaagatgtcttcccttattccttacatgcatgccatacggtccctactttatcaacctcatcgcaacccactacaccccacattcttcaacatgctgctgatttgttgtgcccacctccctcccctcctcattccaccaaccaatcttcctcctttattcctaaaacctcatccactactccctcctatctacaacccactatcagttcacatgccaaacacacccacccgtccacatctcattttcggcctgcagacaaaagtacacatcctatggtcaccagggcacaaacagactctctcaagcccaagaccttctctatctccatatcatctactccaaccactgagccacacacttttaaacaagttatccaacacccatgctggcaacaagccatgcaacatgaatatgatgctctcatgagaaattgcacttggtttcttgttccttgtcctactaatgttaatcttgttgggtgtaagtggattttcaggatcaaacgacgctcagatggttccattgaacgttacaaggctcgtttggttgctcaaggatttagtcaggaggctggcattgattactttgacacatttagtcctgttatcaaaccaactacaattcggttggtcctatccatagctctttccaatggttggtgcattcggcaacttgacataaacaatgcattccttaatggggatttaattgaaatagtgtacatgaaacagccccgtggctttgaagattcctctcgtccatcacatgtttgtcgtctcctcaaggctctttatggcctaaaacaagcaccctgtgcttggttcaacaagctgaaacactatcttgtcacccacggattcaaggcttgtcactcagacacttccttgtttgttcacttgtcttcaatatcaatcatctacattcttgtctacgtagatgacctcatcatcacaggtacacatgcaggaaaaattcagcagttcatcactcagttacatactacctttgctcttaaagacctcggtgatctgcactattttttaggcttgcaaatctgcaggtctccagctggtttaactctctcacaggagaaatacatacatgatattctttgccgcagcaatatgacagaagcctcatctatttccacaccagctgaccctacttctcgccttacaagtcgtggtgatccttttcatgatccaaagctctttaggcaaatcgtgggttctctccaatatgttatcattacccgtcctgatattgcctatgctgtaaatcgtgtttgtcaatttatgcattctcctacatctttacactggcaggcgacaaaacgcatcatcagatatttaaaaggaacttcacatcactaccttcatttcacacctacaagggctcaatctcttctcgcttattcagatgttggttggctttcagacactgaagatagcaagtctcagtatggttatgccatcttcatggatccaatcttatcagctggacttctcgaaaacaacgagttgttgcacgatctagcaccgaagctgatgtcggagcgcaaaaaggcgattcttgatgccaccggtggtatcaggcaacccattttgtttttgataaagcatgactctctcatttcgagattctctctttatgatattatcggaacccccaacattgatgtcgatggggttgccttattggaagttgttgcaattgaggtggaggacgataagcagggaaagagccttccatgggtgtggggtagtatagataggagggtccagctggtaagcgatgtggttgggttgaagagaatgtgccccttggtgcttgcacagaatagccatagtaataaggggaacccatggtggaagatgatggtccatagagttgttggtggtagtattgtggttgctgaatttgtgggttatacatcgtggcctgtgctcaacacaaaacattgcacaatcaatcattaa

SEQ ID NO: 89161 - DNA, 504 bp, Glycine max
  Peptide Sequence Number=SeqID_205939
atgtcaatcacagttgtagggagcatgaaactcaacattgatgatatcgagccaaagaagttgtgttcaaagtggcctaattgcaatcatgacctgttgagtacctttgaaaataaaaaattagtgcatatgttgggaggatacttttctgtgggcaactttgatgggttgtacaagagcatacttggtttaaatgaaaaatattttatgtctaaggaagagaaggacatgcttgcttatccttgcattgcctcaaagttcatgtcaagcataagcaagatgatgttaccaatttatgaacaagctttatattttactagtgttaaggatggcaccaaaaactggttgaacttggtggatcccaagtcatcaaatggttatgctaagggaccaacaatgttcatggctactgatgacttggtcgtggcaccaattccaatttcggctttatcattgctcaagcaatctaagatatctctggatgactcgaaggaaaaaagttaa

SEQ ID NO: 89162 - DNA, 813 bp, Glycine max
  Peptide Sequence Number=SeqID_205940
atggccaacacaagtccttctcttctagctcttgccaacactaccaattccaacctcaatcttcaaatcccttccattaatatcaaactagaaagagataattattccctatggcgatctaccattatttctgcacttgagacttttgaactagagtctttcattttgaatcctgcaccaccgatgcagactcacatcataaacacttctgacgccctctccttggtcgtacgtgccacctcttctcacatggcatggactgccattgaaaagaccttccaagctcaaacacgagctagacgcatggcaatgaaggttcaactacaaactctaacaaaaaggtctctttctatgcttgaatatattgagcgcaaacgcttcattgctgactctcttgctgaaaatcttcatccaatttctgatgaggatcttattggttatattttaagcagccttgattcctcttatagtgctttctcaactgctttcataatgaagtctgatgatgtctctgttgatgatcttgttggccttcttcttcaagaggaggctcgcttagagcaggaacatgttcatcaagctgttgttgtttcacagcccactaacccaaccccacttttgtctacttctgttgtttacactacaaatcggttctcaaaccgatcttcttccaccaacaatccaaacaacaattctggttcgtttcctaggcgcaacgttgacaaccctcgtcgtcgtcctatctgtcaactgtgcagtaaaccaggacacgagactattgattattggcagcgcactaatcaaactaattaa

SEQ ID NO: 89163 - DNA, 165 bp, Glycine max
  Peptide Sequence Number=SeqID_205941
atgtgtgttcaagaggaagggagacttgctcaagaaattggtgaaggtgctcttaccatgactcaagataaggggaagaaggaaaggaaggaaaagaatcatatacctcctattgccaaaattaaaaaggagtctaggattctcaagccagagggagccaaatga

SEQ ID NO: 89164 - DNA, 357 bp, Glycine max
  Peptide Sequence Number=SeqID_205942
atgacaaagaatgagatgcacataattggaattgtgattataatcatgattgtgatggatttctcacaagctaattacaatccttcatttgggcaaattgagcgaaatcatgtgtctaatctagcttgtgaggataaatgtagactaaaatgtgcatttttactaatacctccatttactcctgggtatctaatatgtctttacaagtgcatggcaacaaattgcaaagccaaccccattgtccaagattgtaagagtggttgtggcttgaccaagtccgttagcgtcaacgatgatgctcatggagttgcggccgccgacttggtggattcctgtttaccagagtgccagaagtaa

SEQ ID NO: 89165 - DNA, 276 bp, Glycine max
  Peptide Sequence Number=SeqID_205943
atggctaaacaaggaaaagcaaatgagcaatgtgtcttcacatccatgcatgtttatccgcgatgcctccataggatatcacaagcacaaccgcatataaacaaaacatctaaggagcatatcatttacaatcatcatgaattacaatcaggtaatcaacatcatcaatcaatcaccaaacaccatcatcacgagtctatcaatcgcactcaccaagtacatcaaacacaaccaccaaagacatactttactacatggagattcgacgttatttga

SEQ ID NO: 89166 - DNA, 219 bp, Glycine max
  Peptide Sequence Number=SeqID_205944
atgaagatgaaagcaaacaaaacaagaaatgaattgaaagtttcgaattcgaacacttaccggttgaagaccgaagaacagacgaagaacggtgaagaacaacgaaaaatcttcacggatttgctcatggaaacatctaggaagcgttacggaagcacctcgacttggattttcttcacggaaacatattttttcacccaaaatagtagaaatgcataa

SEQ ID NO: 89167 - DNA, 294 bp, Glycine max
  Peptide Sequence Number=SeqID_205945
atgattcatgaggctgcattcaagaagatgcactgggggagtcaacgatcaagtcctggctcaacgccgtcaagactgtcattggcactctgtttcatggcgagagaacgttgtgactacttctccggttcgccggagaggaagatcgcggagtcctatttctctatgatttgcagagaaggtctgcgactccaacccagggttgatcctcgaggaggatggttgacgaagcatgaattgaaggtgaaagagagtgtttcgaagtacggcgcatgggtcggaaacaacttttaa

SEQ ID NO: 89168 - DNA, 228 bp, Glycine max
  Peptide Sequence Number=SeqID_205946
atggaacataatggtgtttgggaccttgaagaattgccaaaggattgtaagagagttggttacttgttgctaagggatttactcagaaagatgacattgattataaagagacgttttgaccaatctcacaaaaggattctttcaggattatcatggcataagttgcccattatgacttggagctacatcagatggatgtggaaactatctttcttaatggagatttag

SEQ ID NO: 89169 - DNA, 818 bp, Glycine max
  Peptide Sequence Number=SeqID_205947
atgaccagcggaatcggtaccatcgagcgctcgacgtccggcacgcgccgcgcgaccgcgcagcggcgccgcccgccggactttcgccccaccgatttcgccatgtcccgggaacccacacactccgcgatgctctggatcgtcgccgctgcgttcttcatgcagtcgctcgacacgacgatcgtcaacaccgcgctgccgtcgatcgcccaaagcctgcaggcgtcgccgctcgcgatgcagcccgtcgtggtcgtctacacgctgacgatggcgatgctcacgccggcgtccggctggctcgccgaccggttcggcacgcgccgcgtgttctcggtcgcgatcctcgtgttcgtgctcgcgtcgatcggctgcgcggcgtcgcatacgctcggccagttggtcgtcgcgcgcgccgtgcagggcatcggcggctcgaagctgctgccgatcgggcggctcgccgtgctgcgtcgcgtgccgggcgaacagtacgtcgcggcgatcgcgttcgtgtcgatcaccggccagctcggcccgatcgtcgggccgacgctcggcggctggctcacgcaggcgatttcgtggcactgggtgttcatcgtcaacgtgccggtcggcgtggtcggcttcatcgccgtgcagcgctacctgccgcacgaccaggcgacgcagccgccgccgttcgacttcgtcggctgcgcgctgctgtcggccgcgatgctcgcgctgtcgctcgcgatcgacccgccgatgtccgcgcaccgcgccgcgtgggcggccgggcttgcggcgcacgcgctggcaagcgcgctcgc

SEQ ID NO: 89170 - DNA, 1126 bp, Glycine max
  Peptide Sequence Number=SeqID_205948
gtcgactctagaggatccccgaagccctgtcgctggtaacctacctgacgatgggctggctgtcgctgatcgtgatttatcagctggttacgcggctggaggccggcggcgtcacgctgctggcgatcggcggggtggtctataccctcggcgtgattttctacgcctccaagcgcattcgctttggccacgccatctggcacgccttcgtgctcggcggcagcgcctgccatttcatggcgatctacctctacgtctaaacgttatcgctacgactcatcacaatgatcgttcgcttatccaaagcgctgctggtctgcgctatcgctttgttcgcgtcgctggtggccttcggcaatatcaccgattacggctccaacttcgccttcgtgcgccacgtctttatgatggacaccattttccccgacgccaccatcggctaccgttcgatacaaacgccgtggctgcatcacgccggctatatcttcatcattgcgctggagagcctgaccgcgctgctgtgctggatcggcggcctgcgcttgctgaaaaagctggcggtagtggggctgacgctgggcttcctcacctggcaggtcggctttatgtcgattgggggcgagtggtttggcatgtggatgtcgaaacagtggaacggcgtgcccgatgcgtttcgcttcttcgtcaccatcattctggtgctgatttatctggtgcagcgcgacggggagttggacgagtaacgaagacggccgcaggcagggcgcctgcggccgacggattatttctcttcggccagcgaatacggcagcggtttgatcgccagctggctggcggcatcctcgcgcacccgcagcttgctgtcggcgtccaaatcgttgttcatcaccacctgcacccacagcctgccgtcggccagttggctcgacgccagcacggtgccggtgcggcgccagttttcacccagctgcagctccaggtcttccgccgcctgcggggcgcgggccgccttaccttccagccagtagagcgcacgcttgttggcgccgcggaatttggcgcgcgccaccatctcctgaccggtataacagcctttgctgaagctgatgccttccagcgcctgcag

SEQ ID NO: 89171 - DNA, 453 bp, Glycine max
  Peptide Sequence Number=SeqID_205949
atgtgtcctcctccagaaaaggtcaacaccaaaggtgctcagaagaaactgatgaccaaatatcaaagatcaacaaagcgtgatctgtcttactgggaatatgttgatgttttacattctgtgcaaaatagtaattcttcaatcaaatgtagtacatcattatctgaccaggcaattctgagaaggattatgctgatgttggatcaatttcatccattcattcacgatttcattgaaaacattgtcgatgtcaaagttgacggtaactatggatatcgtgcgattgctgccttattaggtatgggtgaagattcatggtcgttggttcgcaaccatttgcttaaagaacttgcaaaatggtctgatgagtatatcaacctccttggtggcatagacaaatttgaggaattaaaaaggtccctacttgttgatggattatccatgtttaaataa

SEQ ID NO: 89172 - DNA, 425 bp, Glycine max
  Peptide Sequence Number=SeqID_205950
gtatctccgcgtatcatgggtgcagaatgaccaaacttggtctctgcttgtcatcgggcccgccgcctctggatgacaaaaggggtgcgaataaccataagggtatctccgcgtatcatgggtgcagaatgaccaaacttagtctctgcgtgccatcggacacgactgtgtctgaatggcaaaggggtgcggataaccgtaagggtatctccgcgtatcatgggtgcagaatgaccaaacttggtctctgcttgtcatcgggcccgccgcctctggatgacaaaaggggtgcgaataaccataaggtatcttcgcgtatcatgggtatctccgcgtatcatgggtgcagaatgaccaaacttggtctctgcgtgccatcggacacgactgtgtctgaatggcaaaggggtgcggataaccgtaag

SEQ ID NO: 89173 - DNA, 204 bp, Glycine max
  Peptide Sequence Number=SeqID_205951
atgcggacactacgggtacatagaatgaatcgaaaatcttggttcgagcaaaataggggaggtggttgccgcccagctcgcccaggcgagctcagctcgcccaggcgagcagggttgcttcctccagaagcaaccgccttctggaggaatattccggagggcccaagtgggcctgggtgctatttgcacccccatttttactaa

SEQ ID NO: 89174 - DNA, 834 bp, Glycine max
  Peptide Sequence Number=SeqID_205952
atgagttcaggaggaaagcaggggggcttcgtttcgtaccaaaacgtcttcgtaatgaggcacggggagcgtttggacaacttcgagccgtcgtgggtgatgacggcggcgcggccgtgggacccgccgctggcagaggcaggtagaaaacgggcgttcgaaacgggtcggaggctccgggagagtgtcgggcttccgatcgggcgagtcttcgtttcgccgttcctccgctgcctccagaccgccggggaactcgtggcgtctttctccgatgagggtcgtggtggcaccgtcgccggcgatggtgttgccgttaagcctttcgaagtcaaggtctctgttgagtatggattgtgtgaaatgatgaacagcaaggctatacgtcccaatgtggcccctaaagatggaaatatggggtttgatgtagcagtgtgtgaagccatgcttccagctgaaatagtggataaaaatgtagaaagggtgtataaagagttgccccagtgggaagaatcagttctgcaagcaggggcaagatatcagcagttaattaaggaccttgcagataaatatcctactgagaacttgctgcttgttacacatggggaaggagttcaggttgctgtttcttcattcaaaaaggatgctgaggtaaatgaagtggattactgtggatatgtggaacttagacgtcctattttcaagaaagatcacacatttatcactggagagttcgatttactcactcctagtggtcaaactggcgaacttttcaaatggaagaaggagaaaatgaaagtgaaaatctatgttcctgagtgggatgtcataacttaa

SEQ ID NO: 89175 - DNA, 528 bp, Glycine max
  Peptide Sequence Number=SeqID_205953
atgacttcaaaactcaaccatagagatgatggctctaatggggatagtgcatcaaagccaatccactttttgaggatcatgcaccctgacaatcttctgcaaggaaagctaaggcttccagcagagtttgtaaacaaatatggaaaacacttatccaacacaatgtttcttaagcttccaaacggtgcagaatggagagtaaatttggagaaacgtgatggtagagtttggtttcaagaaggttggaaaaagtttgtggagcatcactcccttgcacatgggcacctattggttttcaaatatgatggaacattccattttcatgtactcatctttgatcctagtgccaatgaaatagactaccctgttaacaaagcaaatcacaaaagggtcagaattagtagtgaagaaattcaacctcccacgacgtgcaaaacaagtggaaataagaggagtaattccaatttgcaggacaatgcctttcatcagaaagtcagagaccacaaaggcatggttctagattcctaa

SEQ ID NO: 89176 - DNA, 207 bp, Glycine max
  Peptide Sequence Number=SeqID_205954
atggaagggtcatccattagtaactgtggaaatcatgaagcagctggaaatacttcattcaccgtgataatgaaatcaagctacgtaagtaagcggatcatgtcttgcaatgtccatttcccggagcctctggaggaagcttccggtgggtggcaggcagagctccagggggaacacattggccctcttgtggaggaatctgagtaa

SEQ ID NO: 89177 - DNA, 741 bp, Glycine max
  Peptide Sequence Number=SeqID_205955
atggcttccccaaacaaccacaaccctcctccacccaccattcccttcgacatgcactccttcttcaacccccaaccaccaccaccaccttcctctaaccctaaccctaaccctaaccataacccttcctcctcctaccctcccccctttcacttccccaacttcgacctccctctccctccccacccccaccaccgctccatctccttccccacccaacccatccctcccccttccaaccccaacgccggcgcccgcctcatggccctccttggtaacccctcccccgccccgccgcagcccccgccgcccgagttcgtccccgtctcctcctctgccgtcctcgccgctgcctccgccgctgccgcggccctcacgcgcctccccagcagtaaggtccccaagggaagacacttggccggggagctcgtgacttacgacgtcgacgtgaggctgcccggcgaggtccagccccagctcgaggtggctccgattacgaaatacgggtcggatcctaacccggttctagggaggcagattgccgtgaataagtcgtatatatgctatggcttgaaacaggggaacattagggtgcttaatattcacactgctgtcaggtccttgctcagaggccacactcagacgcatttgtctgcgttttgccacaatatcaaggaacatgaggaaaccagtactgcgactgcagttaaaactttggagataaattttagaaatggttaa

SEQ ID NO: 89178 - DNA, 543 bp, Glycine max
  Peptide Sequence Number=SeqID_205956
atgctagtggggaaatccaacatagaattgttcccatggccaatgttgctatctgctatttttgcgtcctatgaacttgagttgagcctcaacaaacacaacaagaatgcacccaatacactgaaaacaaactcagaaagcaaagaaaacctgagtgtggcctctgagcaaggacctgacagcagtcatatatacgacttattcacggcaatctgcctccccagaaccgggttaggatccgacccgtatttcgtaatcggagccgcctcgagctggggctggacctcgccgggcagactcacgtcgacgtcgcgcgtgagggccggggaagcggcggaggcagcggcgaggacggcagaggaggagaaggggacgaactcgagcggcgggggctgcggcggggcgggggaggtgttaccaaggagggtcatgaggcgggcgccggcgttggggttggaagggggagggatgggttgggtggggaaggagatggagcggtggtgggggtggggagggagagggaggtcgaagttggggaagtga

SEQ ID NO: 89179 - DNA, 678 bp, Glycine max
  Peptide Sequence Number=SeqID_205957
atgaatgaaatcgagttgtggtacgtgtttaaaaaatggggggatgttcgagaggtattcattgcaagaaatcgtaataagtggggaaagagatacggctttgttagatttaagggggtgaaggatgccatgacattggagagaaaactggacagcctggtagtaggaggactaaagatgcacgttaatgtatcaaagcatggcagagagaggatcatacgcggagaagacagtagaggaccacagcaggaaaagttgaaaccaccacaatatatgaacgaggcagcatcgtatgcgcatgttctcatgatggaaagtaagaaaccggacacaaggaggactcaaccaactttgagttcagttggacctgtatctcactcatcggtgcaattgaatatacctgtggatgaaaatacatggctaaataggacatgggtgggaagactgaggaagctcacactgtttgataggatagaagatgatcttatgtggattgggtacgacggcataacaccaaaatatatcggagatgatatggtattgctaatgggccttacagagactaatgctacacaaatggcggaggaaagagtgaaagaggcagttcgtttgttcttcttgcaaagatttcaagaatttgagcaatgtagaccaaagttggatgggatcagattttaa

SEQ ID NO: 89180 - DNA, 399 bp, Glycine max
  Peptide Sequence Number=SeqID_205958
atggtgttcaaagtagactacaaaaaggcatatgacttagtctcgtgggactttttgatatacatgttgtggtggctgggtttttgccccaagtggatccaatgggttgagggatgccttagatctgcttctatttcggtattagtgaatggaagcccctcggctgaattcattccacaaagaggactcagacaggggaatctactaacgcctcttttgtttaatattgttgctgaagttttaaacgggctgatgagaaaactagtggagaaaaatctattcagaggattctcagtgggaacaaacaatgtggaaatcagcatctcacaatatgctaacgacactatttttttggtgaggcatcaatggaaaacgtcaaggcaatccaagccattttga

SEQ ID NO: 89181 - DNA, 1110 bp, Glycine max
  Peptide Sequence Number=SeqID_205959
atggagcaaaggaagatcacgtgggtaaattgggacacagtatgtctaccaaaggacaaaagaggactaggtataaaagatctcaagacattcaacacagcgttgcttggaagatggagatgggacctagttcaacaacatggagcattgtggaccagagttctgacctcgaaatatggcggatggaggtccctagacggggaaataagtggtagccaccaatctccttggtggaaggatttgatgaggatccagcaacaagggacaagtaaactaaaaaagcaaacaacatggaaggtgggatgtggcgacaaaattaggttttgggagtactgctggacaagtgaagatgtacctttaatgctgaaataccccagattgtaccagatctccagccaacaacagcagctcatcatgcagatggggagacactttgatgaaggctgggaatggaactacagctggaggagacccttattcgacaatgaagttgcaacggctgatgaattcttaagggagacagcaaatctattaatacacccaaataaagcagatttgtgggttgggaaagcagatccaagtgggagttattcaacaaaaagtgcgtataagctactaaggggagattcacggggagaacaccaagatggggcttttgtggaactatggaaaattaagatatcagccaaagcagcggtgtttgcatggaggctcattagagatcgactaccaacaaagtcgaatttgagaaggagacaagtggaatcaagtcctcccttcatggtgtcttgggtgaacatcacaggtgcttttccacagagtccgaaggaccgctttctacagcatggcagcgggattgttcatgggataaaagccactagatggaagtgtgggtgggttgcattaacatggactatctggcagcatagaaacaggatagtcttttcaaatcagacattcaatggaagcaagctgtcggaggatgcaatacttctaatctggacatggcttaagactacagagaaagattttggagtgcactttaatcaatggtcaactaatccacaaaagtataatattatatatattgaaaagtaccagaggtactaa

SEQ ID NO: 89182 - DNA, 240 bp, Glycine max
  Peptide Sequence Number=SeqID_205960
atggacattcaaagcctgaaaaagcagcctgaggtcacttcacactgcttttgcgctatcggtaactatgatgagcagagcagagcaattcaaaatggaacccaagcccaggctttgcaagaacgtaaaatcgatcagtcagagacggagaaactgatgttgcccaacgctgcggcgatgacggtgagaagaggtggtcgaaggtttgacgcagtttcactctctcaggggtttttatag

SEQ ID NO: 89183 - DNA, 254 bp, Glycine max
  Peptide Sequence Number=SeqID_205961
atgtgctttatggtgcctttactgaaaagaggaggtgcaagagcagatgaaggccgatatggaggccatgaaagagcagatgaccaaaatgatgaaagccatgatgagtatgagataaataatggagatcaacacggctacaattgttgtcgcaagtaccaccattgtggtggacccgactcacccatctggcctcaaccaaataagtcgcccaacctcggatattgtaggttaaggaggggaagcattgaaaa

SEQ ID NO: 89184 - DNA, 728 bp, Glycine max
  Peptide Sequence Number=SeqID_205962
cttggcctgaccgtcgccactctgtggcagctgccgggcggggagctgacgcagcagtttgccgcgatgggcggggcggtgctggtcggcgtgctggtgtttggcatcgcctggggcaagcgtctgtcgccggtgacgctgatcctggccggtctggtactgagcctgtatgccggcgcgctcgacggccacaacgtggcgctgctgtggccgcgcctgctgctggcgttcgcactggcgctggcgctgttgcgtccgctgacctggttaacgtcgccggtatcatcggctttatcgggctgttcgcgccgctgctggcgaagatgctgggggcgcgtcgtctgctgagccgcttgctgctggcgccgctgattggcgcacttctgcttgtcaaccgggacggctaccgcgctgattggcgtgccgattctgctgtggctgctgccgcgtctgcgcacgggctcgctgccgccggcgatgaatgccggcgacacagtgccgcaggagcggcaggccgtgctgcgctggtgtctggcgggcgtgatgattctggcgctgtgcagtctggcgggcattgcgtttgggcgcgacgcacacggctggacgtgggtcagcggcgatatgctgcaacagctgctgccgtggcgcgtcccgcgcgtgctggcggcgctggtggtcggcacgatgctgggcgtcgccggggtgctgattcagcgcctgaccggtaa

SEQ ID NO: 89185 - DNA, 6525 bp, Glycine max
  Peptide Sequence Number=SeqID_205963
atgtttggcgaggcgcagaacccggcggttgccgatgggcgcgttccgctggtgctggagctgctttcgccggcgcaccgtccgctgcagatcacccgtgacctcgcggcgttctggcgcggtgcgtatcctgaatggatcgaattcagagggttctgccatgcgcggcacgagaaagcagttagagtagcggcgctgccggagcctgaagatgatatcgatcaggacgattttgacgaagatgatgaggagagtgcgccggtgccacccaaaggtaaaggaaaacgacccgcgcgtggcaaacgccgctggttaggctggttgattaaactcttcctggtgtttgtcgtggtgatggccgcctggggcgtctatctcgattcggaaatccgcagccgcattgacggtaaagtgtggcagctgccagcggccgtgtacgggcgcatggtcagcctcgaaccgggcatggcttacgacaagaaagagatgattgcgctgctggaaggcacgcagtatcgcgaagtgtcgcgcattacccgtccgggtgagttcagcgtgaaaggcaacaccatcgacctgctgcgccgtccgtttgattttccggacagcaaagagggccagattaacgcgcgtctcaccttcagcaacaacgagctgagcgagattaaaaacctcgataccggacgcgactttggcttcttccgcctcgatccgcggctgatcaccatgttgcagtcgccaaacggcgagcagcgtctgtttgtgccgcgcgccgggttcccggatctgctggtcgatacactgatcgccaccgaagaccgccacttctacgagcatgacggcatcagcccgtactcgattggtcgcgccttcctcgccaatatcaccgccggtaaagcggtgcagggcggcagtacgctgacgcagcagctggtgaaaaacctgttcctcaccaacgaacgctcgctgtggcgtaaagcgcgtgaagcctatatggcggtgatcatggatgcgcgctacagcaaagatcgcattcttgagctctacctgaacgaggtgtatctcggccaggcgggcaacgaccaaatccgcggtttcccgctggccagcctgtactactttggccgcccggtggacgaactgagccttgatcagcaggcgatgctggtcggcatggttaaaggtgcgtcgctgtacaatccgtggcgtaatccgcagctggcgctggagcgacgtaacctggtgctgcgtctgctgcaacagcagaaagtgatcgaccaggagctatacgacatgctgtcggcacggccgcttggcgttcagccgaaaggtggggtgatcacgccgcagccggcatttatgcagatggtgcgtaatgagctgcaggcgaagctgggcgataaggtcaaagacctctccggcgtgaagatcttcactacgctcgatccgatttcgcaggatgcggcggaaaaagcggttgaagacggcattcccacgctgaagaaacagcgcgggctgaaagatctggaaaccgcgatggtggtggtcgaccgcttcagtggtgaagtgcgcgcgatggtcggcggtgccgatccgcagtttgccggctataaccgcgcgctgcaggcgcgtcgctcgattggctcactggcaaaaccggcgacctatctgaccgccctcagccagccaaacagctatcgcctgaacagctggatcgccgacgagccgatcgcgctgaaacagccaaacggttcggtgtggaagccgatgaacgacgatcgtcgcttcagcggtaaagtgatgctggtggatgcgctgactaactcgatgaacgtgccaaccgttaacctcggtatgacgctgggactcgacgcggtagtggatacctggaccaaactgggcgtgccaaaagatcagctgcatccggtaccggcgatgctgctgggggcgcttaacctgacgccgattgaagtggcgcaggcgttccagtcaattgccagcggcggtaaccgcgctgcgctgtcggcggtgcgctcggtgatcgcggaagatggtacggtgctgtatcagagcttcccgcaggcgcagcgcgttgagccggcgcaggcggcgtatctgacgctgtataccatgcagcaggtggccgatcacggtacggcgcgggcgctgggcgcacgcttcccgggtgcgcatctggcggcgaaaaccggtaccaccaatgacctgatcgacagctggtttgccggtattgatggcaaagaagtggcgatcacctgggttggccgcgacaacaaccagacctcgaagctgtacggtgccagcggtgcgatgcagatctatcgtcgctacctcgacaaccaggcgccgatgccactggtcctgacgccaccggaagatatcactcagatgaatatcgattcggccggtaactttgtctgcggcagcggcagcagcacctggcgttcgctgccggtgtgggcgctggatccgaacacgctgtgccagcagcaacagcagcagattcagcagcagcaacagcaagaacagcaacagcagcaacagcaacagccgcagggcgagcagaaggactctgacggcgtcgcgggctggattaaagatatagcctgtgcggtgccggcgttttaccaccacgtggcggtgccagatacatggcggcgctccagcctgagccttacctataagctgaatttaaccccctctggcgctgcggcgcctttttctttgcccgccatttttttagccgcgatcatggatatgtgcgatccgctggcaaactcaccgccatcaggcattacatcttgcggtgcttgccgggcgctggccgaagataccgtggtggtgacggctgatggcggcagcggcgtcgcgcaggagagcgcatggggaccgtcgccgaccatcgccgctaaacacagcgcgaccggcaccaaaaccgatacgccaatcgagaagaatccgcagtcggtgtcggtggtgacgcaggaagagatgtcaatgcatgcggtgaccagcgtcaaaggtgcgttcaattacacgccaggcgtgctgaccggtaaccgcggcagctcggacgttatcgacgcgctgtcgattcgcggcttcagcgaaaccaacaccaaccagtatctggatggcctgaagctgcagggtgacaactactccgaattcgctatcgatccttacttccttgagcgcgcggagctgctgcgtggtccggtttcggtgctgtacggtaagagcaacccgggcggtgtggtgtcactggtgagtaagcggccgacccaggagacgctgcgtgaagtccagttccagatgggcaccgacaacctgttctccaccggctttgattttggcggctcactggatgatgacggcgtttacagctatcgcctgaccggcctggcgcgcagcgccgatgcgcaacaggagatgaacaaagagaagcgctatacccttgcgccttcgttcagctggcgtcccgatgccaatacccgctttgacctgctgacctacttccagaacgaaccggaaaccggctattacggctggctgccgcgtgaaggcaccgtggtgggcatcacccggccggacggcagcagctataagctgcccaccaattttgatgaaggcgaagacagcaataagatctcgcgcaacaccaaaatggttggctacaactttgagcacagctttaacgatacctggacggtgcgccagaatctgcgctatgccgaaatgcagaccgattatcgcagtatttatggcttcggttataaccctgagaatcaactgattacccgtaatgccgcattctcaaaagaaaaactcaaccagtttgccgtggatacgcaagcgcaggctaaattcgcaaccggtgatttagcccatacgttactgctgggcgtcgattttcagcgcacccgtaacgatattgatggtcagttcggcaccgccaccggcctgagtccattcaatccgcaatatggcaacgacagctacaccccttatgacgatccttatcagcgtttgaaccagcaacgccagaccggtctgtacgcgcaggatcaaatggagtggaaccgctgggtgctgacgctcggtggccgctacgactacgcgatgaattccgttaccgaccgcgtagcgcagagcgttgatcgccagaacgatcaggcctttacctggcgtggtggtgttaactatgtgttcgataatggcattgcaccttatttcagttacagcgaagcgtttattcctaatgctggcgcaacatggggcggcgaagcgtttgatccgtcacgcgctaaacaatatgaagcgggcgtaaaatacgttcccaaagatcgtccgattgtcatgacggcggcggtctatcagctgaccaaaacgaagaacctgacggccgatcccgatgcaagccatcaatttgccagcgtgcaaagcggtgaaatccgctcccgtggcgtcgagctggaagccaaagcggcgcttaacgccaacatcaacctgacggcggcttactcttataccgatgcggaatacaccgaagacaccttgctgaaaggccgtacgccggtgcaagtgccgaagcatatggcttcgctgtggggtgattacaccttccacgaaaccgcactgtcgggcttcaccgtgggtgccggggtgcgctacgtgggtgaaagcaaaggtctgtacgccagcggcgcaaatgccaaccacaactttgacgtccccgcgtacaccactgtacatgccgcactgaattacgatctgggccgcttcggcttgccgggctcaaccgtcggcgtcaacatcaacaacctgttcgatcgcgaatacgttgccagctgctaccgcgactacgcctgctactggggcgcacagcgccagatcgtcgggattatcatgcatcatccgcaccacgcagaaaccaccttttcactggaaaacgtcagcttccgtgtacccggccgcacactgctgcatccgctgtcgctgactttcgccccgggcaaagtcaccgcgctgatcgggcataacggttccggtaaatccacgctgctgaagatgctcggccgtcaccatgccgccagcgaagggcgcgtgatgctcaacggtgaagcggttgatacctggagcagtaaagcttttgcacgtcaggtagcctatctgccgcagcaactgcccgcggcagagggcatgacggtgcgcgagctggtggcgattgggcgctatccgtggcacggtgcgctggggcgctacggccaggaagatcgcgatcgggtagacgaggcgattgcgctggttggactgaaacccttcgccgggcggctggtggacagcctgtccggcggcgagcggcagcgtgcgtggctggcaatgctggtggcgcagaacagccgctgcctgctgctggacgaacccacgtctgcgctggatatcgcccaccaggttgatgtgctggcgctgattcagcgcctcagccacgaacgcggcctgacggtgatagcggtactgcacgatctcaacatggcggctcgctactgtgaccagctggtggcgctgcgcgcgggcgaagtgatcgccgaaggcggaccggaagcgattatgcaggccggggtgctgggccttgtgatgttcgacatttcccgtcgccgtctgctgaccgcgctggcgctctcaccgctgatgaaccttgcaccgctgcgcgccgcgccgccggacagccagcgcatcctggcgctggagtggctgccggtggagttgctgatggcgctcggcgtcgccccgctcggcgtggccgatctgcataactacgccatctgggtgggcgacccggtcttgccggctggcaccctcgatctcggcttacgcaccgaacccaatctggaactgatgacccagctggcaccgtcgctgatcctgcactccaacggttacggcccggcggtcgacaagctggagcgcattgcgccgacgatgggctttgacctcaacagcggcgatggcaaaccgttcaccaccgcgcgcacatcgctgcatgcgctggctgcccggcttggccttgaagcgcaggcacaggcccatttgcaatgggtggatggtgaagtggcggccgcgcgtgagcggttacgtccgtgggcgcaacgtccgctgctgctgatgtcgctgatggatccgcgtcacgccattaccttcggtaaaggcagcctgttcctcgaagtgatggagcagcttggcctgcgcaatgcctggcagggcgaaaccaacttctggggcagtgcggtggtcgggctggagcggctggcggaggtcggtgacgttgaggtgatctgcttcgatcacgataacgaacgcgatatgcagcaggtgacgcaaagcgcactgtggcaggcgctgccgtttgtccgctccggccgtttccggcgggtgccggcgcgtgctcagtttactggcgctggcgctcacgtttatcaacctgcgccaggcgctgccgctggcgca

SEQ ID NO: 89186 - DNA, 344 bp, Glycine max
  Peptide Sequence Number=SeqID_205964
gcagaatcatgctaagtagcaatgtcatccatatctgtgtaagggttgtcatgctggtgcgcatgatccgcaccccgtctccttgcggcatccaggcgaagttgatgcaatccgaccccccaagggtattggatagaagaatccaagaggattgggctagagctactaaagaaggccctagggttctcatgaacctagggtggatttctgagcccatgggtcaagctctagcttctcatctcaaggaggtgaacttagctattagtgagcttctcaaggaagttttctcaaagaagcttctcaaagaagttttctcaagaaagcttctcaaggaagctacctag

SEQ ID NO: 89187 - DNA, 978 bp, Glycine max
  Peptide Sequence Number=SeqID_205965
ctggacgtgaccgacaaggacgcgggtgaagccacgttcaacccgcagaccgacgccaagggcgaccacggcaagttctcgatcgacgccaacggcaactggaagtacgaactcgacaacgacgatcccaaggtccaggccctggccgtgggcgagaagctggtcgaaaccttcaccgtcaccaccgccgacggcaccaagagcaccatcaccgtcaccatcgacggcaccaacgatgatccgaagctgagcggcaagaccgacggcgccgtggccgaggacggcaccaccagcgccaccggcaagctcgacgtcaccgacgtcgacacttccgacacgcacacctggaccgtcagcaacaacggcgacggccaatacggcaagttcaccgtcgatgccaatggcaactggaagtacgagctggacaacaccagcgacaaggtccaggccctcaaggatggcgagaaggtcaccgacaccatcaccgtgaccgtcgacgacggccatggcggcaccgccaccaagaccatcaccgtcgacatcaccggcaccaacgacgctgccgtcatcacccccagcaagccgggcgacgacaagggcaccgtccaggaagacaccaccctgaccgccaacggcaagctggacatcgtcgacaaggacgccggcgaagccacgttcaagccgcagaccgacttccatggccagtacggcacgttctcgatcgatgccaacggcaattggagcttcaagctcgacaacgacgccgaggccatccagcagctgggcgccaaggaaagcctgaccgagactttcacggtcaccagcgccgacgggaccatgggccaggtcgtcatcaccatcaagggcaccaacgacgcgccgaccatcaggggcgcggccaccggcgacgtcaccgaagacggcgccaaggcggtgtcgggccagttgacccagaacgacgtcgacgtcgacgactag

SEQ ID NO: 89188 - DNA, 246 bp, Glycine max
  Peptide Sequence Number=SeqID_205966
atgaagaagaaaaagctcctactcttgaaagaagtcactgaatctactcaacaagcatttaaaagtctagaaattcaagttggtaagctagcagaagaagtgactaaatttgtggccaaaagagaagaaaactttgtagaggttgaagctcatgaggaaagcatcgtagaagagcatgattcaaaagaaaaatatgaagagaaagtgaggagaaagcacaacaatgggagaagcactcacaagtag

SEQ ID NO: 89189 - DNA, 204 bp, Glycine max
  Peptide Sequence Number=SeqID_205967
atggaagtaggtcaatttggagtgcttcttagtccaatagctcttaaggtggttggccccttgcttcttggctcaaattcttcaagggatggcaccaatccttcttcccaattccctatatggcaactcacaaacaaggaaacaaagagacaagtaataaccaaggaaaaaaatgaaatgaaagctaaaccaatagagttttaa

SEQ ID NO: 89190 - DNA, 588 bp, Glycine max
  Peptide Sequence Number=SeqID_205968
cgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcatt

SEQ ID NO: 89191 - DNA, 285 bp, Glycine max
  Peptide Sequence Number=SeqID_205969
gtaacctaccgcaatgataaagtggtgctagtgaaggtatatgttgaaaagcctagaaagaagagctcatcatcaattcagcatcatcaccttcattatcacattcatcacacaattagacaagaggtagttcacggctctggtagcaagggatcatatggtagaagagcagggttgcttatgtactcgcatctcctacgtgaatctgcaagaggagcatcatcaacaccctcattctccaagtgggttgcaaacaacaatttccagcctccaacccagatgtaa

SEQ ID NO: 89192 - DNA, 207 bp, Glycine max
  Peptide Sequence Number=SeqID_205970
atggctgccaagaagtacttcgtcacagtcttcaaaccggaggaacactccgaaagcatgcttatcccagatgcttttgtgaaatctacacgcttacaaggatggaggatccctgaggatgtcatcctcacaaatgttggtaggagagtttggaatgtgaaaacacgtcttgttggaaacaaaatttactttgaagagggttggaag

SEQ ID NO: 89193 - DNA, 369 bp, Glycine max
  Peptide Sequence Number=SeqID_205971
atgaagcaaaagatagtccttcaaatgcaactgcacagtgacaaaagcagaagcaaggccctcaagattgcagctcaagaaataggtgtgagctcagtggcattggaaggggataataaagacaaattggtggtgactggagatgtggatgcagtgtgcttgggtcgggttttgaggaagaagtttcggtgtgtcacccttgtaagtgtggaagaagtgaagaaaaaggaagaaaaacaatgcataaatgaagacaacaaagtgtgttgttattatccaccgtactgtgctcctccaccttgtggtccttctccctattgctacaaagttgtttatgattcatgcgacaatagttgctctatcatgtga

SEQ ID NO: 89194 - DNA, 219 bp, Glycine max
  Peptide Sequence Number=SeqID_205972
atgatgcatgcacctgactcaacactcagatgcaatgtggtacgtaccaacaacaaccaaatctcaggaaatagcctaagcgtgtccatacgacactctcacttagggaactgtgctgagtttgtcgagaccacccaggttgtgcacgtaacagcccccctcccacagatgatcagcatgggagcccaaaggtgttccatatcagccacaaccccatag

SEQ ID NO: 89195 - DNA, 303 bp, Glycine max
  Peptide Sequence Number=SeqID_205973
atgggggtgcaaatagcaaccaggcccacttgggccctccagaagattcctccagaaggctgttgcttctggaggaagcaacctggctcgcctgggcgagctgggcggcaagcatctcccctattttgctataataggggaggaaaaaatctaagccgagcgcttttgaaacgtttccgtaacgttttccgagagggatttcgcaaaggttttgaccgttcttcgacgttcttcattcgttcttcatcgttcttcgatcttcaacgggctaaaatcaactcgcctagtcaagctcgtccataa

SEQ ID NO: 89196 - DNA, 210 bp, Glycine max
  Peptide Sequence Number=SeqID_205974
atgttattgaaagaagagatcctagaacctggggggcaggtgcaagttcacatattgaagtggaagctaaagatgttaagggagcttgcaaaagctagcttctctggggacacaagggttgatgaagccagtaccagctacactttaggggaacaacaacattcatcaggtgaaatctatttgggtaatccaaagcgaaggtattactga

SEQ ID NO: 89197 - DNA, 253 bp, Glycine max
  Peptide Sequence Number=SeqID_205975
cgaggccaaagagtcgggctaccacaatgctgaagtcgataagcttatcaatgcgggtaacgcggtgctggatgtcgaacaacgcaagcctatttatcaccagctgtaccaggtgctggccgaggatccgccggttatcttgcttggataccgggagattctttccgccagcagcgcccgcgtgaccggctttaagccggatatctataacggcctcaccggcagtttgccgggcgtgaaaatcgtgaagtaa

SEQ ID NO: 89198 - DNA, 684 bp, Glycine max
  Peptide Sequence Number=SeqID_205976
atgctgctgctggcctcctttatcatttttatgctctttgccaaaacccccggcgactttatcgatggcaatatcaccttgacggccgcccgcgccgccgaactgaaggcgatatacggcctcgaccagccgcttttcacccgctactttcactggctggggcaactgctgcgcggggatttaggcttctcgctgcaataccaaattccggtcagccagttactgaaccagtacatctggaactccttcctgctggcgagcgtggcgctggttttctactggggtatcggcctgacggttggcgtggtctccgcgctcagacctaattcctggtttgatcatctggtgagtatcgcggtgttcgccgcgatgtcctttcccacctttttcctctgcctgctgctaattaagtggtttgccgtcgaccttcactggctgccggtaggcgggatgaccaataccggcagcgacgatagcggctggcggtatgtgctgcaggtcgccgcccatctggtactgccggtactggcgctagtgatgctgcaggccggtagcctgacgcgctattttcgcgccagcatgctcgacgtggtgaagatggatttcattcgtaccgcccgtgctaaagggctgcgagaacgcacggttatcatgaaacacgcgctgcgcaatgcgctactgccg

SEQ ID NO: 89199 - DNA, 357 bp, Glycine max
  Peptide Sequence Number=SeqID_205977
atggataaatttgacatcttcgtccctcatcccttcgcaatgacatctttgcttccacttgaatgtgggtgcaagccactggtttgtttgctcaagcgacatgtgctcctgagtttggacttccaagaccgtttaataaaaaattactcgtgctacacatttggtgaggatgtcgttgtgaaaaacaaaacaacgatggttacctcagagccctacactggggcaatgaaaggcaccatgcataaacctcaagcgaaccaagggcagattagaagttctcacccaataggttccctgctacaaggtcatgacaaaagacaacgattggtacctcaaagccttacactgggtcaatga

SEQ ID NO: 89200 - DNA, 484 bp, Glycine max
  Peptide Sequence Number=SeqID_205978
atggattctgtaggaataagatcggctaacccttatttggcgactcctggagcaacggttcatggccattatggggaaatactttctgaaggagatatattagttacatttatctatgaaaaatcgagatcggttgatacttggaatgggcgtataacaaaaattcttggcattccttggggattcttgattggtgctgagctaacgatagcgcaaagtcatggaatgtctaatgtttttttgcccggtgaactaattggattgttgcgagccgaacgagcagggcgttccttagaagaggcgatttgctatcgagttctattattggggataacaaaaacatctctgaatactcaaagtttcatatctgaagcaagttttcaagaaactgctagagttttatcaaaagccgctctccgggggcgcatagattggttgaaaggtctgaaagagaacgttgtttcagggggaatgatacctgttg

SEQ ID NO: 89201 - DNA, 345 bp, Glycine max
  Peptide Sequence Number=SeqID_205979
atggcgccctttacatgtgcatgcgacaaatacaataaggaagttgtgcttaggtataggcttgaggtgatgatcaaccagggaaatgaaagcacaaaattcctgctttgggaccgtgaatgcagtgaattaattggccaatcagctgatgcagttaataagcttaaaattgaagatggtgatgttgatttgaatgtttcaccccaagcacttgataagctgctgggtcatgaacttgctttcaagataaaggtgcaacccaagttcaggaattttgttgttttgaagtgttcagctgactcgagcttgataaatgctgtaatggatatgctagctaatgctgag

SEQ ID NO: 89202 - DNA, 282 bp, Glycine max
  Peptide Sequence Number=SeqID_205980
ctagatgactttgaggccgagctggagaggcataatttccataaacacctcaccaatttagccgatgggagcatagacctggctttgggagagactctacccgcctactccagatactgcaggttgcctacaaacttcagagagataaaggctgccttatgcatacctagccgagggttcattttgaactctaagggccaacctgggaagattctcaggaaggacctgactacactggctcagggagcactgatctctgaccagatgacctctatagcttag

SEQ ID NO: 89203 - DNA, 261 bp, Glycine max
  Peptide Sequence Number=SeqID_205981
atggaatcgagagctccaaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggacgggggaagcccgtctgatagcgctctgtgcgcgtactccgaaagggaatcgggttaaaattcctgaaccgggacgtggcggctga

SEQ ID NO: 89204 - DNA, 491 bp, Glycine max
  Peptide Sequence Number=SeqID_205982
gagctggtaaaggagtgttagttgaagctggtaactatggaagatgtggagtcgaagtggatggtgctgaaggatctggtaaagtagttgaagaaggagcagaagaatctggtgctgctaaagtagggggagcctcagatctcttacccctggccttccttggccctttgaatgtcactgttggatcatctagattgcaacaattcttctttatatatgccaagttaatggcagggctaaggctctacaaagatctggaatctgatgtgactcctctagctttacacaaagttgtgattaaggctggaaatccaagcctagaggagtcatgctgggcaatgatagaaatctggtgggagatgagaagtgtgggaggtagggaccaagttggagtaagaaagaacactctaagtctgaacgagtgtggtcatgttcttcctaaggatcttcagtggcaagccgtcagcattaagctcaaatcccctccctag

SEQ ID NO: 89205 - DNA, 156 bp, Glycine max
  Peptide Sequence Number=SeqID_205983
caccactcattgagttggtgaggaacaatgttccctcatgggaagatgtccatgaaatgggtgtcgagggaaggggcccagaatatgaagaaactcgggatttgaggtcaaatcctttccaatgtggaggggatgatgcaatcctaccccccaagg

SEQ ID NO: 89206 - DNA, 225 bp, Glycine max
  Peptide Sequence Number=SeqID_205984
ccttcaccttctggaagaggtggggcctctgcagcccaggagcctgaaccagaaaagccagcagcaacagtagcaaaaggggaggatgagctcactcctcatgagcccttctattttgatgcaggtgtacacatggctgaagaggaggagactgattcaccagctgctcagatgttggatcttaatgagcatgcaaagaagcaaccacaggagaaggacatttaa

SEQ ID NO: 89207 - DNA, 975 bp, Glycine max
  Peptide Sequence Number=SeqID_205985
atggcaaggataaaggcggattcctcagcctacacctccgtgggggccacgtggcaacagcagaagcatgaaaaaaatcagctcaactataacgtcgcgcataactggtacaccgatgcgcgcggtgaaaacgaatatggtctcaacgcttccgggattaatagcgactcgctaaatacttcggcctatacccgtcagggcggccgatttggtaatggaagtttgaccgtcagcgattcgtgggatcgccaggatcatcgccaccggttcagcagcagcggaaactacagttctacgctggcgttatctcgttctggcctgtggtttggccgctggggtgacggacgcccggcgtcagccattgcggtcaacgtcgcaacgccggaagcgtcacctgattcccgcattgccgtttcgcttgataacagcggtagcgccgatatcccggcaaacgcccgcgcgttgttcgccctgcccggctatcagcaaaccacgctgactattaatgagtcgacggacatttcccacggcgccaacagtgaaattacgcaggggtcgggaagcagaacggtatttatggtgcctggaaaaatgctgcacagagaggtgcaaaccaccacgcgatacacctggcttggccagttgaccgatgaacaacatacgccgtttatcggcggcatgccgctcaatgtcagcggttggagcgatttaggtaatggcggctttagtgcggaaagcgacagcctgatccagtcgctctacctggtgaaacaacagcagttttaccagtgcgcgctgaaggtgaagaccatgcgagacgtcgtgcgctatgtcggcacggtgacctgcgaagaactgacttattccgcgttaccggaaaccgtgcagcagcaggcgcaactgttgctggctggccgtacgccggcggtcagcccaacggcgatgaataactctactctctctacaggaaaatga

SEQ ID NO: 89208 - DNA, 891 bp, Glycine max
  Peptide Sequence Number=SeqID_205986
atggacaaagagttcctgcgcaagccgcgcaagtgggactccaaaaacatcgggcgctttatgctgtggattgggccgacctcgtcaatcttcgatatcacgacgtatgcgctgatgtggtacgtgttcgccgccaacagcgtggaacaccaggcgctgttccagtccggctggttcattgaggggctgctgtcgcaaacgctggtggtgcatatgctgcgcacccagaagatcccgttcattcagagcaccgcggcgctgccggtgttgctgaccaccgggttggtgatggcgctcgggatctacattccgttctcgccgctcggcgccctggttggcctgcagccgctgccgtgggaatacttcccgtggttggccgctacgctgtttgttgaccagcaggccgagcatgatggtcagcgtgaaggaaaacagcgtgccgagcagcacatactcggtgcgcatcttatcgtcgctctggcgcagatcgccgaaacggaagatagatttagccgccagcaaaaagccgatcgccgggatttgccccagcagcacaaaggtcaggatcagcgttctctccagatagccaatctgtttgcccgcgcgcagcagcgagtcgttgtcggccttggccgaaggcggcatttgcggcgtccagtgcgccagcagttgcccgatcagcaggctcatcggcagataaatcaggctgtaggccaccagcaccaggccggtttgccaacgccccagttgccgccccagcgcggcgagcagttcaccggcattcggcgtcagccccagccacagcaaggcgattaccgccagatgcaatccctgatcgagcaggaaactgcgggccgggctcaggcggttcatcgcggtgaccttcagtaa

SEQ ID NO: 89209 - DNA, 369 bp, Glycine max
  Peptide Sequence Number=SeqID_205987
atggccaccttctcatgctcaccatggcggctgacaccagcaagcacaccctgctccgggtcacagtggatgtgcgtgcgctgcacagagtgcacagccagccgagttgctgctgctgctcgtgacccgatgggtatgcgacacccaaaatgtggcgcgacgtgctctcagatgtgtcaactgtcaactgactgtcacatgtttgagaactgcagcatgtttcgtaacttctacggcaccgtacgggaccagaaccagcttacgtgtattgttgctgaaattggaggcacgatttctaggttgggtgtagaggcggcggcgttaggaaaaggcggggaagctataggccaggggaagaaagcgctttag

SEQ ID NO: 89210 - DNA, 150 bp, Glycine max
  Peptide Sequence Number=SeqID_205988
cggctctttttcctatattctgatggccctgctacgtctgcccactacagaacaggcctgactccccaagagaagggcaccgagatcccgcgtaagcgtcgtttgcccgttgccaataggatcgacttgggtagtaagattcacttgtga

SEQ ID NO: 89211 - DNA, 463 bp, Glycine max
  Peptide Sequence Number=SeqID_205989
actgtgagagacgatgaggttaaagctttggaagaaagtgatgaggtacaagccctaaaggcagagcttgaaagagcctgggtagtcgaagagaagttcaagtccatagccatcaaaggcagcaattccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagggtaattgaatcattgcaccaagaggcaacaatgtggactgaccgatttgctcttactttgaacaggagtcaagaacttcccccattgctagccaaggccaaagcagtggcggacacctactccacccccgaggagatccacggacttctcagctatt

SEQ ID NO: 89212 - DNA, 559 bp, Glycine max
  Peptide Sequence Number=SeqID_205990
aatacccgcaccccgccccccgcccccgcctcactcccaccgtcacgctcttggccaggttgcgcggcttgtccacatcggtgccgcgtgcgcaggccgtgtggtaggccagcagctgcagcgggaccacgtgcaggatggggctgagcgcgccgtagttctcgggcatgcggatgacatgcatgccttcgctgctttcgatgttggtcttggcatcggccagcacatagagcacgccgccgcgcgcgcgcacttcctgcatgttgctcttgagcttttccagcagttcgtcattgggcgccaccgtgaccacgggcatggcgctgtccaccagggccagcgggccgtgcttgagctcgccggccggataggcctcggcgtggatgtagctgatttccttgagcttgagcgcgccttccagcgcaatcgggtagtggatgccacggcccaggaagagcgcgttctcgcgcttggcgaaatcctcggaccagctgatgacctggggctccagcgccagcacggattgcagggccacgggcaggtggcgcatggcggccag

SEQ ID NO: 89213 - DNA, 246 bp, Glycine max
  Peptide Sequence Number=SeqID_205991
atggacgcagagaaacgcgaggaactggaaccagagaaacggcacgcaaaccgaggcaggattttagcgtttcaaagctccaagcaaagcttcaacctttggccatcatttctgccccaaatcgcgaaaggagggcattttcggggtcgtgaagtgcgtggctacgagtgggacttcgaaaattcaggtttgggtggacttctttctcctttaatttttgtgggtatggggtttggggagatatga

SEQ ID NO: 89214 - DNA, 249 bp, Glycine max
  Peptide Sequence Number=SeqID_205992
atggcacgcaaaccgaggcaggattttagcgtttcaaagcccccacactttttcagacagctctctctctccctcacgttgccattttcttctccctcattctccattgaagctccaaacaaagcttcaacctttggccatcatttctgccccaaatcgcgaaaggagggcattttcggggtcgtgaagtgcaaggctacgagtgggacttcgaaatttcaggtttgggtggacttctttctcctttga

SEQ ID NO: 89215 - DNA, 148 bp, Glycine max
  Peptide Sequence Number=SeqID_205993
caacttcatgtcgacgatgctgtcgatatgttggtggaattactcgaggtcagcgttgcagaggcaagagctgagacgattcaatgtcatggatcttatgttcgactattatggttgcgagatgtgtatcagacgaaaattgaggcat

SEQ ID NO: 89216 - DNA, 750 bp, Glycine max
  Peptide Sequence Number=SeqID_205994
atggcctccaagaagcgtaggagcattggggcaaggccaactgctcagtatgatactagacggttccattcacttgattcttggaaccattatacagataacattttgggaaggagtattttgccaaaaagaaaggttgagatataccacacagagtttgatgacttcaagacagagttggagaggcataatcttcacaaacgcctcaccaacttggctgatgggactattgatgttgctttggtgaaagaattttatgctaacctctacaactctgaggatccttcaccaaagcaagccagagttagaggccacttggtgaagatagatgccgacagccttaacacatttctagagactcctgtagtcctagaggagggggagacattgcccacctactctcgatactgcaggttaccaatagaccatagagagattgagactgctctttgcataccaggaagggggttcattttgaatgctgagggccattcgagaaggattctcaggaaggatctgactacattggcccaggtgtggagtattctctcttattccaacctggcccctacatctcatacatcagatcttactgtggacagagccaggttcatctttggcctggtctctcatatggacatgaacattgatgctctcatttcaggacagataacttccattgcccagtctaactcttgcatacttgggtttgattaccgccttatgccgagcctaaggggttgtctctga

SEQ ID NO: 89217 - DNA, 218 bp, Glycine max
  Peptide Sequence Number=SeqID_205995
atggacaagtggcagaaagagaatgagtcagaggagaattttgttgggagggcagtacaaggggtagtggagtgtgagaaagaggaagagaaaaagttgatcgaatggaagaacaacgaagagggctacgttgcttcaatgtcaatgtgttcactcacagaacatgcaagatgggctagggttcaatgtaacgaagaggggctaggaaaaaaagagag

SEQ ID NO: 89218 - DNA, 462 bp, Glycine max
  Peptide Sequence Number=SeqID_205996
atgacgagtataaacgttgtgcttttgggttggtcattccgggttttattcatttggctctcttcttcctctttcgttgcttctgcagttcaaggaaaaagaatcgtgaagccatcgaaggttgcaaaggatatacatactgatcatgttgcaagtgttttgaacattttggatgatgagctgatcaagaatgttggagactacattttaagattgttgattattttccttaataagctcaattggcaagctctgtgtgaggagttaactagaacagctgccactttggtggcagagaatgaaaacctaaaaagggagaaagaattggctttgaaagagtatgagtctttggagactacaaataagaacttgaagacacagatagccaagtcaacaaacactgaagtggagaaaactcctgttgagcctgtgtcatctgtggctgagataacacttcatccg

SEQ ID NO: 89219 - DNA, 222 bp, Glycine max
  Peptide Sequence Number=SeqID_205997
atgaagaacttggagatggggggcgggctaagggctgggcgacggggaccagggtggagagcagtttcgggagggtgtcatgacggtggactcttccatgccattcccaacagtgagagagtcgagcatgcttggtccgaatccatttggcctgtcgggctatatggattgggtaaaaaaggctcgtttctatttgggctgcattttattagcttagcctga

SEQ ID NO: 89220 - DNA, 424 bp, Glycine max
  Peptide Sequence Number=SeqID_205998
atggggactccaagaggaatagctcttctcagtttcacatccttcttgttttggagctcagcgaatgctttgctttctcctaagggagtgaactttgaagtgcaagctttaatgggcataaaatattctctagaggatccacatggtgttctagataattgggatggggatgcagttgatccatgtagctggactatggtcacatgttcttctgaaaacttggtcattggactgggcactcctagtcaaagtttatctggtactctatctccaagcataggcaacttaaccaacctccagattgtgcttctacagaataacaacataagtggaccaatcccttcagagctaggcaaacttcctaagcttcaaacacttgatctctctaacaacttcttcaaaggggagattcctccctctcttg

SEQ ID NO: 89221 - DNA, 231 bp, Glycine max
  Peptide Sequence Number=SeqID_205999
atggaaaaatccgacaagatgaatttcaaagagaagaaagaaaagaaaggatatatcacttgggaagataatgtcataaattattcaagtgattcagagaagaaaatcataagtctgaatatcatgatgaaagactatgaaaatggagaagagaaaagtcgatacattgatagcaatttctccaaacacatggcatgcatcaaagtttattcatttttctctccaagataa

SEQ ID NO: 89222 - DNA, 342 bp, Glycine max
  Peptide Sequence Number=SeqID_206000
atgcgcgggcttgtcaggctcgccaccggcggcgtagacggaaagtggccggcagccggccgttcagaagcttttaaccagcacgtcacgcggcatttcactgccgtgtttcagcaggtgctcaaacgatcgctcgctgcttttcagctgctgcaaaaattcctgcggcgacagatcgtgttttttgccgctcatgtaagccagcgccagttcttttgcctgatagcgggagaagttgtacatggtgtcctcgatacggtgaatgtcagtgctcacgattgtagcgaaagagcacataatgaacagcggctttggcgtatggaatcgatagccgaaacttaa

SEQ ID NO: 89223 - DNA, 582 bp, Glycine max
  Peptide Sequence Number=SeqID_206001
atggggactgcatcatctatgttaactcaatacgacatcgaggaagttcaggaacactgcaataatttattttcccagcaggaaattgtgtccttgtatcaaaggttttgtcaacttgaccgcaatgccaagggatttatttccgcagatgagttcttgtctgttcccgaatttgccatgaatccactttctcagaggctgctaaagatggccgacggcttgaattttaaagactttgtggccttcttatctgcattcagtgccaaagccagcgcacaacaaaaaattgagcttattttcaaagtatacgattcagaccgcaatggaaaggtgtctttcaaagatatgctggaagtgctaaaagatttgtcgggttcattcatgtctgatgaccaaagagaggaagttctcagccaggttctaagggaagcgggatacacaaaggactcctacttgacattggatgacttcattaagacctgtgggtcacgaaatgaaatctactttgtgtcaattgattttatttaccttgatactttgttggccactgtgggagggcttatgggaaatggttcttactag

SEQ ID NO: 89224 - DNA, 600 bp, Glycine max
  Peptide Sequence Number=SeqID_206002
caccttgacacaccggacaacaaccctaaacttccatgggaattcaccgaggccaatcaagcaaaggttaaggagattttgtctcactatccatccaactataagcaatctgctacaattcctcttttggatcttgcccagcagcagcatggtggctggctccctgtttctgcaatggatgcggtagctaagattgtagaggttcctcccatacgggtctatgaggttgccacattttactccatgttcaaccgagctaaggtgaaagcttattatgcttttatgctttcaatgttgctaatccacattaatacaggccaaagcttatctggaccaacttgctttcaggttgggaagtaccatctgttggtttgtggaacaacaccttgtatgataagaggttcacgaggaattgaagaagccttattgaaacacttgggagtgaagcgcaatgaagtaacaccagatggtttgttttctgttggagaaatggaatgcatgttgagggcgagccctggtgcagcggtaaagttgtgccttggtgacttgttggtcatgggttcgaatccggaaacaacctctttgcatatgcaagggtaa

SEQ ID NO: 89225 - DNA, 627 bp, Glycine max
  Peptide Sequence Number=SeqID_206003
atgtcttccaagattcaaaggactaaccgcctgagaattctttgtcccaacacattggagggtatatcctttgtggtacaagtagagggtacatctacttggggattgtttactgagaacaagagagggtacatctcttgtggatcagttcaagtggagggtacatccacttgggttttcaaagagaacaagggagggcacatcccttgtggatctttggcttgtaaaggattttacaaggttgaaaaaaatctcaagaaccggaggccacttgatccaacaaatgacagtgtagaggcttatttagattgggaaattaaggttgagcaaccctttgcttaccatcatacatgtgaggaaaggaagaaaagtgcccttaggaagaggcacatcccctcctactatgaaaaggagcttatggacaagctccaaaggcttagacaagggagtatgagtgttgaagagtataggaaacaaatggaactactcctcttgagagctgggcttagggaggaggaaagaacaagtattgctaggttccttagtgggcttaatttggaagtgagggacaaggttgaggtccttccatatagggacctagatgacctagtccaacttttcataagg

SEQ ID NO: 89226 - DNA, 321 bp, Glycine max
  Peptide Sequence Number=SeqID_206004
atggaaaagcttatggattttaaaggaccaagcgatggtacccagaagaattctgaaagcgaacgcggaaagtctgtggagcagcactatatcatcgtccagcgctggcgacccttcttcttgaacaatgctgaatcggttaagatagacaagatgagggcccggatatgcgtagagatagcttctcatatcatatcatggttcgaggaattcccatacagctcaaatatgagggcttacactcaatctgctttcgctgtagtagatatggccaggcaggagaactctgtgagcctagtggaagcgaaaaggggaggatga

SEQ ID NO: 89227 - DNA, 366 bp, Glycine max
  Peptide Sequence Number=SeqID_206005
atggtttactcctcctatctcacacctgcttccctccaaccctttcgagattctgccctccaggatatttgcttgggagaatatgaatatgcaaatggtggtggtgctgctgctgcaattgtggatgatgcctggatggatgtcatctcatcacagggatcctctttacttcatctagatctttctgcctctgatgtcactgatcatggtctcacctttcttggacattgcacaaatatcatctctttaaatcttaatcactgtcaccaaatttcagatcatggactagagtgcatcagcggttggtattcttttcaatatattattcatctggcatacataatgaattctgcaaagtgctgttga

SEQ ID NO: 89228 - DNA, 2031 bp, Glycine max
  Peptide Sequence Number=SeqID_206006
atgccgaattttgattcaaattttattattgagtctgacgataaaggaggggttcagtggttcctcactgctgtttatggaagtccctcaagagtagggagggatgcgcaaggaggacctaagagggattcggagttcgaagggtttgttcgcaggatcaggctaattgatgcagggagaattctattccctcaacctgtggtggaacacctacctcaatttcaatcagacagagacccttactggtccatattgattttggtacttcgcctaacagaggacgatgacctttcagctctcaaaacatggaacatagacgtttttggatcttttcagacaaggaagaaacatgttcttggtcgtctgaaagggttgaccaagccttacccaaaactgattgaagggatggttacagatttttataaaactctttttcactatgatggattatatgatcaatactgtctcacaggagcttttcctatggtggatgctgataggctggcaaagttgggagtacccattacggatgacgaggttaggcatgttgtgttcgatataggtagttttaaatccgcaggggaagatggcttccaaccaacagagcaaagagaacactctcatcccccaagaggtgatccattcaatgaagaagaagagagggaagtcagggagtttaaaccttctagaggcatcacgcagggtgaccctatatcaccctatctatttgttttgtgcatggaaagactaagtcagatgattgagttaattgtagaacaaggattatggaagcctattcagctagggaggggagggccaaaactgtcccacttggtgtttgctgatgacctaatcctcttctcagaagcctttctggaccaggtggaggtgattaattcttgcctaggtgctttctgctctagctctagggagaaaattagtaacgagaagatgaaagtatacttctccaggaatgtaagttggaatgcccgtaaccaacttagtagtgaacttgatttcaattgtacttcaaatttgggcaagtatctagggagcaagaatctgtctatggcgactagactgaccttgaccaagtcagtgctcttcgctttactggcctataccatgcaatctgcatatattccccgttcgatttatgattccctggataagatttgtcacccgtttctttggggtgatgatgatggtaaaaggaagttgcgcatggatatgtgtatgaatagagagaagctttgggtgaagattattcggggcaaatataggtgtggaggctctgtttggcctcatatttgtaggaatatcctgggttcgaatgcttggagaggtatatgcctagtctgggaggattttagtaagaagatatcttggcacattggggatggtaaggatgctcgtttttggctagatcaatgggtgcctaacactgggatgcttatcaagaaggatactatgcctctgcatgagtcagatctgaccaaactggttggtgaggtagtggacgatttgggggctgggacttccaaaatccgtctgtcatatgattctaaggcttccttctcttgctttggaggattttcaagactaccttctctgggacagttccaaggatgggagcttttcttcaagaaaatcctctctgtaaagctctttggagatggcacggtcctgaaagaattagaattttcctttggaggattagccaataagctctcctcaccaattcgaaaagacgggagaggcacttggctgatgacaactttcaacgataacctcctctcggtggaatgcgttcttcagtgggaaactccaagactaggtaatgagtgggaacctgacgcagctatcattgctaaagctaccaagctggcaaaaaaggtcctagttgtttgttgcaaaatgaattggctccctccctcggagcattgggtaaaggtgaattgtaatggtgctttctcggagacgactcgtagggtagcatgtggtggagttatatgggatgatagaggttaa

SEQ ID NO: 89229 - DNA, 888 bp, Glycine max
  Peptide Sequence Number=SeqID_206007
atgtcatgttttctgccagagcttcctgccctgtcaaacttgaatcttagtagatgtaatctttctaacgatggatgtgaaaagttttcacgactggaaaatttgaaagtattaaacttgggatttaatgacataacagatgcatgtttagcacacttgaaaggattgacaaagttgaagagcttgaacctggattcatgtaggattgaagatgaagggttggtccacctggcaggtcatcagcaactgaattgcttggaactctctgatacgggaattggaagcaatggactacatcatttatcaggattgtctaatctggagaaaataaatctatcgttcacttttgttaatgatagtggtttaagcaaactgtgtggactctcatctcttaagtcactaaatttggatgctcgccaagttaccgatactggattggcatccttaacaagtatgtgttcggtatttctatgcaaatttacagttcgaacaatggtttggaatattaccactaataacattactaatactgatgcaggcttcaagaacctaaggttgctggaaatatgcggtggagaattgactgatgatggtgtgaaaaatatcaaagaactttcatctctgaagagcttaaatttatcacaaaactgcaaccttacagacactaccctggagttaatttctgggcttactgatttgatttctttgaacgtttcaaattctggtatcacaaatgctgggctgcagcatttgaaaacactcaagaatttgaggtctctatcattggagtcctgtaaggtgacagcaaatggcattaagaaacttcaatcaacagacctccccaatctgaagtgtatagaacgtaaatcagcatgcactattccataa

SEQ ID NO: 89230 - DNA, 132 bp, Glycine max
  Peptide Sequence Number=SeqID_206008
atggatgtcttgtgtcttgttggaacaagtgtgaaaccaaccaaacacagagggcgggcaaggaaagcgtcgatcgctgctaggcctaccaaaccatccacgttttggaaagaggacgaccccaaaaattag

SEQ ID NO: 89231 - DNA, 2889 bp, Glycine max
  Peptide Sequence Number=SeqID_206009
atggagcttctgcatgtagagggcttgaattggcagcaccaactttgtaagaatccacggccaaatccagatataaaaactctttttgtggatcattcatgtggacaaccaaatggtgcacgggctccatcacctgctaataatccactactaggatcattaccaaaggctggaggatttcctcctcttggtgcacatgggccttttcaacccactccagctcctgtgccaacacccctggctggttggatgtcaaatccaaccactgtagcacatcctgcagtttcgggaggagctataggtcttggtgcgccatcaatccctgctgctttgaagcaccctaggacccctccaactaatccttctgttgactatccatctggtgattcagatcatgtttctaagagaacaagaccaattggaatgtcagatgaggtaaatctgcctgtcaatgttttgtcagcaacgttccctggtcatggtcatggtcaggcttttaatgcacctgatgacttgccaaagactgccatgcgaagtctgaaccaaggctcatctcctatgagcatggactttcatccagttcaacagacactgcttcttgttggtacgaatgtgggggacattgctttatgggaagtgggctctagggagcgattgctcatgaggaactttaaagtttgggatcttagtgcttgttcaatgccctttcaggctgctcttgtcaaagatccaggtgtttctgtcaaccgtgtgatttggagtcctgatggggctttattcggagttgcttactcaaggcacatcgttcagatatactcttaccatggcggggatgatgttggacagcatctggagattgatgctcatgttggtggagtaaatgatctagcgttttctcacccaaataagcaactatgtgtcataacctgtggtgatgataagaccattaaggtttgggatgctgctacgggtgcgaaacagtatactttcgaaggtcatgaggctccagtttattctatctgtccgcattataaagaaaacattcagttcatcttttcaacggcattagatggaaagataaaagcatggttgtatgataatttgggatctcgtgttgattatgaagctcctggacgatggtgtacaaccatggcctatagtgctgatggtacaagactcttctcatgtgggacaagtaaggaaggggaatcctctattgttgagtggaatgaaagtgaaggagctgtgaaaaggacttatcaaggatttcggaaacgatctttgggtgttgtacaatttgatacaaccaaaaatcgatatttggctgcaggcgatgatttctccattaaattctgggatatggacaatattcagcttttgacaactgttgatgctgatgggggtctccctgcaagcccacgaatccgttttaacaaggatggagctcttttagctgtttctgcaaatgagaatggaattaaaatcttagccaatgcagatggtattcgtttgttacgcacattagaaaattctttatatgatacatcaagaacatcggaagccatgacaaagcctacaataaatccaatttcagcagccgccgctgctgcaactagtgctgcacttgcagagagggcctcgtctgtggtagcgattactgcgatgaacggggatgcccgaaacttgggtgatgttaaacctagaataagtgaagaatccaatgataagtcgaagatatggaagctcactgaaatcaatgaaccatctcaatgtagatccttgaagctgcctgagaatgtcagggtgaacaagatatcaaggttgatatatactaattcaggtaatgctatcctggcgttagcttcaaatgccattcatctgctctggaaatggcagcgaaatgaccgtaattcaactggcaaggccactgccagtgtgcaaccccagttgtggcaaccttctagtggcatcctgatgactaatgacattactgataacaataccgaggatgccgtcccctgctttgctctgtcgaaaaatgattcttatgtaatgtcagcatcaggagggaagatttctctgttcaatatgatgacttttaagacaatgacgacattcatgcctccgccacctgcagcaacttttcttgcttttcatcctcaggataacaatattattgctataggcatggatgattcttccattcaaatatataatgtccgtgtagatgaggttaaaagtaaactcaaaggccatactaaaagaataactggtcttgctttttctcatgtgttgaatgtgctagtttcatctggggctgatgctcagatttgtgtgtggaatactgacggatgggaaaagcagaagtctagattcttgcaacttcctgctgggaggactccaccagcacaggcagatacccgtgtacaatttcatcaggaccagatccgcttcttggttgtacatgaaacacagcttgccatttatgaagcaacaaagctagaatgtttaaagcagtggttcccacgggattcatcagcaccaatatcacatgcaactttctcatgtgatagccagctcatatatgccagctttttagatgcaacagtctgtgtattgagtgtttcaaaccttagattacgttgtcgaatcaatccttctgcatatctttctgcaagtgtcagttctaacgtacaaccacttgttattgctgcacatcctcaagaaccaaaccagtttgctgtaggactgtcggatggcggagttcatgtctttgagccccatgagtctgaaggaaaatggggtgtgcctccacccattgagaatgggtcaacgagcaatatggcagctacttcagttggagcttcttcagatgaagctcagagatga

SEQ ID NO: 89232 - DNA, 198 bp, Glycine max
  Peptide Sequence Number=SeqID_206010
atgagggtggcacggcatagcaaagaggagggaggagagaggtgcgattctgggagggtgaggatgacatcgtcatggcacaacaaagcagagaggagggaagagaagagttgctcttggggagaagttgaaataaagagaggcatcggaatcgtgaaagggaaaagttttggaaaaagttgtcagcttagaaagtga

SEQ ID NO: 89233 - DNA, 1458 bp, Glycine max
  Peptide Sequence Number=SeqID_206011
atgtctcacagaaaggataataataattattcttccttacccattagctcgtatctagaattgcagcctcaaaatgattcctcaaaatccttacaaaggcccacttttgacgaatccgaggtgtatttgggatccaaggtcgatgacgacgacgatgacgatttggaaatcgacatcgataattatccccttattgttatggggcccaatcacggttctgggatacctggggctgttttcaatttaacaaccactgttatcggggcagggattatggccctccctgccactatgaaagttctaggtgtggttttggggattgttttgatcgttcttatgggaattttgtctgaaattagcgtcgaattgttggtgaggttttctgttttgtgtaaggcatcctcctatggtgaggttgttcaacatgctatgggaaggcctgccaggattttgtctgaaatttgtatcattgtcaacaatgctggtgttttggtggtttacttgataatcatgggggatgttatgtctggttccgtccaccatttgggggtttttgatcagttaatggggaatggggtgtgggatcagaggaagcttgtcatttttgttgtcatggtggttttccttgcccccctttgttcacttgacaagattgattccttgagcttgacctcggccgcctcggtggctcttgctgtcttgtttgtcattgttacttttactgttgctttcattaagctcgtggaaggacggattgatgctcccaggatggctcctgattttagctccaaaactgccatcttggatttgcttgtcgtgattcccatcatgaccaatgcatatgtttgtcattttaatttgcagccgatatataacgagcttgaacagcggtctcctcagaagatgaaccgagttggaaggtacaccacgattttgtgcatcctagtttattcttccactgccatatcgggttacctgctctttgggaaagatactgagtctgatgtgctgactaattttgataaggatcttggaattcggtttagctcggccttgaactatattgtccgggttggctacattcttcatttgatacttgttttccctgttattcatttctcgctgcgccaaacagtggatgcgctagtgtttgagggatcacctcctctatcagaaagtaggaagagatctctggggttgactgtggttctgttggtcctcatatatattggctctaccatgattccaagcatatggacagcttttaagttcactggagcaaccacggctgtttcattgggctttatatttccttctcttgttgcattgagattaagtcatcagggggacttaagctatggggaatggattttatcttggttgatgttggtattagctgtgactgttagtgtagtaggagttgttggcaatatctatagccttgagagtaactcttag

SEQ ID NO: 89234 - DNA, 1152 bp, Glycine max
  Peptide Sequence Number=SeqID_206012
atggatcgagaatggggatcgaagccggggagcggaggtgcggcgtcggcgcagaacgaagccatagaccggcgagagcgtctccggcgattggctctggagaccatagacctggcgaaggatccctatttcatgcgcaaccacctcggaagctacgaatgcaaactctgtctcactctccacaacaacgagggcaactacttggctcacactcagggaaagcgccaccaaaccaacttggccaaacgtgcagctcgcgaggccaaggactcccccgcgcagccccaacctcacaaacgcaaagtcactcttcgaaaaacagtgaagattggacgacctgggtaccgtgtcaccaagcagtatgacccggagactaaacaaagatctctcctattccagattgaatatccggagattgaagacctcacgaagccgaggcaccggtttatgtcctcctatgaacagagggtgcaaccctttgataaaagttatcagtacctcttgtttgctgctgaaccatacgaaatcgttgctttcaaggtgccgagcacggagattgacaagtccactccaaagttcttctcgcactgggatcctgactcaaagatgttcacgctgcaattgtattttaaatccaagccgccagaggcgaacaaaccacagcctgccactactgccaatggcacagcgccatctggtgttccaccaaggcctttgcccccaccaccccaaggtccactaccaccacctccccctcctccacaagggctacctcctggcgcacctatggcaaatcctcctagagctcctccacctccaatgccgggatctatgccacctcctcctcctatgacagcagctaacggtcctagacctccaccttctggtggaatgccatctattccacccccaccccctgttgcaagtgggacatcgggtttcaacatgggtgctagacctccatcaatgccacctccccaaggttttccttcccaacctatgcagggtcagggtgtccgtcttcctcctccgccccctaacatgggacacttgaagagggagaaaaagactattcggagtcaagaatacaaatgctacatgcgtaagtatgtatggtttccgaaactcggttctcggaattcatttatatga

SEQ ID NO: 89235 - DNA, 282 bp, Glycine max
  Peptide Sequence Number=SeqID_206013
atgcacctcctcttcgaattctcgcgctcgacgtcgacgtttggcttcttgaagaaggagaagccattgacattgttgattgaacaaatgcagagagagaaagagaacaagctagttttcttttctttccaagtttcttatagacgccttgtttcgggaatcggttacgtaaactcagttgtagcaagtaagttttattcactagacagtttattcgacatgatcaatagtgagaaagtgaaccggagaggaggaaagaaagaaagaattgtacgatattga

SEQ ID NO: 89236 - DNA, 864 bp, Glycine max
  Peptide Sequence Number=SeqID_206014
atgtcaccaaaagcattaagttctgctgtcagtgatattggttcagttgtcagcatgaacgatagaatagcaggatcagctccaggtaatggatccagagctgctgttggcgaagatttggttgctatgactaattgtcgtcttcaggctagaaattttatcacccaagatggtgccaatggaactaggaggatgaagcgctacaccaatgcaacacccttgaatgttgtaacttctgctggtagcatgaatgacagtatcaagcagttagctgctgaggcttctgatttggattcaactgcaacatctagattcaagatgccgaggattgaggctaatcattcccttttggaagaaattagggaggttaatcagcgacttattgacacagtagtagacataagtaacgaagaagttgatccaacggcagctgctgctgctgctgaagggacagaagggaccattgtcaaatgttcttacaatgctgtggctctcagtccgagcttaaaatcccaatatgcttcagcacagatggtgggctttaaaactcttaaaccatatgcatatcaatcaccaattcaacccttgcgattgcttgttcctacaaattatcctaattgttcccccatactcctagacaagtttccagttgaatccagtaaggagaatgaagatctttctgtgaaagcgaagtcaaggtttagcatatccttgcgaagtttatcacaacctatgtcccttggggagatagcaaggacttgggatgtttgtgctcgcactgttatttctgagcatgcacagcagagcggtggtgggagtttcagctctaagtatgggacttgggagaattgcttgaccacatga

SEQ ID NO: 89237 - DNA, 600 bp, Glycine max
  Peptide Sequence Number=SeqID_206015
atgttcaaagacagtccactttgtgtagttctaaagtaccaaccaacctccacaaccacaacaacaaccaccaccaccaccaccccagcaagagaaaccaaaccagtaatcgcttctccctctgaaacaaaacacccattacctcaaaaatggaactttctccagaaagcagcagcttcagccttagacatggtcgaaataggcttggtctcccacgagcggcaacacccactccccaaaatcgccgacctgcgtgtccaaatcactggcaacttcacccccgtgccggagcacctggcgcatcaattcctcccggtgatcggaaaaatccccaaatgcatcgaatgcgtctacatctgcaacggcgcgaacccactctatgagcccgtcgtggggcaccacttcttcgacagggatgacatggaggagctcgcgttcatccgcgaggcgcataaggtgcaagcgaggagggtgatgctggaggaggtggagagctttggattggattgggaaaagggaagaggagagaagaagaaagacctcagcgagcaacaagaagggagcacggacgtgaaatttgtgaaatatgaacggacgtga

SEQ ID NO: 89238 - DNA, 261 bp, Glycine max
  Peptide Sequence Number=SeqID_206016
atggggccaatatttgtgaaacccaaagaatcttctaaaacattcgcatatttcctttataaaccttcatcccctctttcaccgtctgatgatcctcttcttcaagaaacaccgtttgagatcgtggagtatcattcgaatgtgggtgtaggaggacacgtagaactacacccgtcagtcaggagagcagatgctgctatccatcaggcgatggaggtgctcgtcgacacgaagggtctgagtcataccttgcgttgttga

SEQ ID NO: 89239 - DNA, 678 bp, Glycine max
  Peptide Sequence Number=SeqID_206017
atggaagattgtggacttggtgctgcaggtaacaaggaacaagctcacgagttcatgaatagaattgaggcatctaggtctagtccagaccgcaagacatgggattctttaattgaggggcactgtgtagctgggaaccttgataaagcttttgaatcttttaaagagattgttgagaaagagggggttgcttctgcaggatattcttttgatgtgttaatgaattcatattgccaaatgaatagggcagtagatgcaagcaagattctatgccgactagtgaatgagaaaaagttaaagccctggcattctacttacaagctgctggtaactaagttattggttcaaggaggattcacagatgcattgaatattttgggattaatgagaacccttggatttccaccttttaccgatccatttattgaacacttgtcaaagagtggaagtggcaatgctgctgcactgtttctcaaggcaatgacatcaaagaggtttccatctacatccatgtttctctgcatgtttgaagcctttttcaagaacggaaggcatgaagaagcacaaaatttcctctctaagtgtccacgctacatccgcaatcatgctgatgtcttgaatctcttttgttccatgaattccaaagaagctgcttcttctggtatgttggctgcttaa

SEQ ID NO: 89240 - DNA, 1503 bp, Glycine max
  Peptide Sequence Number=SeqID_206018
atggaagtggagcagaacatagagcattatgcagcaacgaaagatgcaaaagaggcagcaaaaacagagcatacaaaagaaccaaacaaggaagaatgtaaaaagtcaaaaaggaaaatgaacaagcctcagtacctgaaggactatgcaatgaagcacaagctgccaaaatctgttaagaaatttcatccagaattgtataagaacatctataaatatgagagggatgcctcgaatcctagaattgattgtgcctatgacccaaaacaacttggtgctttcattgaattgatggttgaatccactcactccaaatcaaccatggatcgattggaggaagctctagctaaattggcctcaaatgtcactgagaaacttgatgacctgctccttcgtgttactgccctcgaaaccaatcctcatcattcaccatctccttcgtcttcctccgttatccctacaccaaatccacaaacagttagccaatccagaatgaaactcgacgggccggccttggcgtggtttcaatggattatgcgaaatcatcaactcaccacttggcctggttttctacgagccattgaagcgcgtttcgcccactcaccatacgaggatcccataggactcctcttcaaactcacacagaaagggtctgtccaagattacctgaaccaatttgaaaccctcgccaatagaatcatagaattgcccccttcttttcttttgaactgctttgtatcgggtcttgaccccaacatttgccatgaagtgcaggaggaaaaactccttgaatgtcgtaagggccctcacagtcgcttccctctgatgatcaaaccctccacacccgcaccaacccctgtacccttagccacccctaatctccctcttttaccatctccgactaaaaccccacctctaccagtacgacgcctcacacctgaggaacttgcaagtcgctgtgaacggggactgtgtttctactacgacgagaaatttatgagaggacatcgttgtgctttgcgatttttccttctcgtcgtagatgaggagcatgagaatgacaccttgagccctaaaataggcactctccatgccctctccggccacaccacacctgagaccctgcgcatggttggtcggattattcaccaccgcatcgtgattctcatcgacgaaggcaacacgcataacttcgtgcaggagcacttggtcaaatcatttggcctgatagcccaacctaccccaactctgcgtgtcctcatcggcaatggtaatgaagttcaaagctccaccgtctgccacgatgtcgtggtgcatgtacaaggccgagctttcacggtggaccttcatgtccttcctctttgcggggccgatgttgtcttaagggtccaatggcttaaatcccttggacttgtgatgactgattacagtaccttgtctatgaagttcatctatgaaggaactttgattgaactgaagggcgactccgatgcaccattaacg

SEQ ID NO: 89241 - DNA, 438 bp, Glycine max
  Peptide Sequence Number=SeqID_206019
atggagccacaacatgtgactgatcagaatatagaaactcaaaaatcatcaacaaaggggctagctgataaggtggcagttataactggtggtgcaagaggaattggggcagctgcagctaaactgtttgctgaaattggagcacatgtggtaattgctgatgtgcttgatgatctaggtaccacaatggctgaatccattggtggccgctacatacactgcaatgtgtcgaaggaagatgatgttgaatcagccataaaccttgcactatcatggaagggcaatctagacatcatgctcagcaatgcaggaattgaaggccctaagggaagcgtcacaacccttgacatggaccaagtgaggcacttgttctccatcaaccttcatggaatcaatcatgctgcaagggcaatgatcaaaggtaacaacaacaaatga

SEQ ID NO: 89242 - DNA, 221 bp, Glycine max
  Peptide Sequence Number=SeqID_206020
atggcgtcttctccaccaccttctccgttttcgcgaccgcattctcaatcactctcagcacaagccgacactgacaacctcctcgtcgtcgacattttctccaaacctgcggattccgaggacttcaaaaccctcctcgattcgaatcgcgttatgattacccacgacgcggtcctcgcagttctgtggaagctagattccaacgtcgaggcggcgcggag

SEQ ID NO: 89243 - DNA, 460 bp, Glycine max
  Peptide Sequence Number=SeqID_206021
atgaagtcgagggaaaggtcttcccatggacttgccgaaacgggcaagggacaaaagaggcctgattggcgccgacgaagtttttgcgaactctggctaacgtcttcgttacccccacatggcctcctatggacaatcgaagtgagtgtggggatcatcgagaatgcgttgtttgaagctcagaaactcctgattagctgccagctcgtccttcaacatcggctgcggaatttgcattgccggctcgatattgaatgtgaaaatcataacccaataaacgcacgagaacagcccccatactggtctttatgtgttcgtctcgactacaaagggaacgaaaaagtccgacagcctcaaaacgggtgtcgtacaaaaggtctccttaagattgcgaaaggcctggtctgccgtggctgtccattgaaaggaatcctttgccaacagagcagtgagaggcgtg

SEQ ID NO: 89244 - DNA, 597 bp, Glycine max
  Peptide Sequence Number=SeqID_206022
atggcgaagacattcatggatattgccgaaaaaattcacgacctatctcacagtctggtggaagctgtggatgaatggctgacgcatcgtgacgaagttctcgctagcttagcaaggaaattgaacaaggcacaacaacgaataaaggaattcgctgatcagaaatggtgcgatgtaaactttgaagtaggagatatggtgactcagcgtatcggggcagttgcttataaactagatttgccatcaacctcgaagattcaccctgtgttccattgctctttactaaagccattccaatcagacacgacaaccattcctctgaaactaccagctttatctgaagataatcaaccactaattacacccctcaccattctcgatactaagtcggagaagacagcttcgggcaagcagttattagttatggtccaatggaagggactatttccggaagatacttcatgggagaagtgggaggagcttaaggagaactacaaccttgaggacaaggttgttttagacattcgtggggatgttatggaagtggagcaaaacatagagcattatgcaacaacaaatgatgcagaagaggcataa

SEQ ID NO: 89245 - DNA, 1200 bp, Glycine max
  Peptide Sequence Number=SeqID_206023
atggagtctaaaggtgggaagaagaagtcgtctagtagtaagtcctttttgtacgaagctcctctcgattacatcattgaagacgttcgaccacacggtggaatcaagaagttcagatctgctgcttactccaacatggctggctcagctattggtttcgaaggctatgaaaaaagacttgagatatcattttttgaacatggtgtgtttgctgaccctgaaggaataggcctccgagcattgtccaaagaccaattggacgagattcttaaaccagcagagtgcagtattgttgcatcactttcaaacgattatgttgactcttatgttctgtcagagtcaagcctgttcatctatccttataaaattatcatcaaaacttgtgggactaccaaattgcttctgtccatccctgtcatcctcaagttggctgatgctcttgacattgctgtgaaatctgtgaggtacactcgtggaagtttcatttttcctggggcacagtcttttcctcaccgcagtttttcagaggaggtttctgttcttgacagctatttcagcaaccttggttctggtagcaaagcttatgttatgggtgacccttcgaagtcacagatttggcacatctactctgcaagtgcacagaccaaagggtcatctgaagttgtctatggccttgagatgtgcatgaccggtttagaaaaggaaagcgcttctgtgtttttcaaggagaatacatcttcagcagctttgatgaccgaaaattctggaattaggaagatccttccacagtctgatatatctgattttgaatttgacccttgcggatattcaatgaatggaatagaagggggtgcaatatccaccatccatgtcactcctgaagatggtttcagttacgcaagtttcgaagctgttggttatgactttgatgagatggctctaggtgaacttgtggaaagagttttagcatgctttcgtccagcagagttttctgttgctttgcacattgacatgcatggcgaaaaacttaacaaatttcccttggacatcaaaggatactactgtggtgagaggagctatgaagagcttggagtaggtggtgcagttgtgtaccaatcatttgttcaaggctgtgatggcagtacatctcccaggtctattctgaaatgctgctggagtgaggatgagaacgaagatgaa

SEQ ID NO: 89246 - DNA, 468 bp, Glycine max
  Peptide Sequence Number=SeqID_206024
atgggctttattgggcttgtaacatggtcaggggcaagaaggctaagaaagaaaggattagagaggctcaaagagtgtttaagggttatattgactaatagctataaaccaccatttaacacaattgggcaagtgtcaaattcaattcacaccacttggaactccaattttcgggctggaacgaccaaaggtgttgcaattcctaacatggaaagtgaaccaagccgaaaagtaatcaaccctagtttcaatcacaatagggtcaacaccttgcacacttgttccaccgtagaacatgttgaagtggatgaggttgaactggatgtgtggatgaagatgcatgaagaagccagacttgatgtcattgtggatgaaggcgtagggaagacgacgatgatgcagggaaatagccgttccggaatgggagtgcttgctaaaggggtacttttgtctgctagagtcttttag

SEQ ID NO: 89247 - DNA, 132 bp, Glycine max
  Peptide Sequence Number=SeqID_206025
atggcgactccgctcattttctcccttggagacagtcgctttggcttatcgattttgcctttgtcgtcccttcatgagaacttctttgatgatgaaaagcacgattggactcttcatagcaactggaactag

SEQ ID NO: 89248 - DNA, 408 bp, Glycine max
  Peptide Sequence Number=SeqID_206026
atggtctttttattgagtttcctagaccctagctcacacaggctagcctttggcttgcctaggccctcaaatgacttcaagctgaaggaaccagctcgcctgggcgagccagttacttcaggagtaagtcttagctcgcctgagcaagctgccatggtcccaagttcccttttttctatatataagtgtgctagggaggatgatgaagggttccaaggttcagaaggtgagggaattgagagaaaagagaaagaagaagaagaaagaagaggaaacgaagttgaggcgctaccgaatcacaatcgtgatcaaatccctacttcgtttcttgttcggtgttcttcgtgcgaccgtctacttaaagaactacgtaggtctgaattcctcatcgcacctgaggatacgtag

SEQ ID NO: 89249 - DNA, 264 bp, Glycine max
  Peptide Sequence Number=SeqID_206027
atgggggtgcaaatagtaatttcgaatctgggcccttctagaggtttctgggcaatttcttgcttaaggttgaagcaacctagctcgcctgggcgagctaggaagcaacccagcttgcctgggcgagctgggcggcaacctccccctctttttcctataaataggctgaaggaggttgttctaaggatcccggatgcccctggtgaggtatttcagctgttttgggtgaaaaaaaattgtttccgtgaagaaaatccaagctga

SEQ ID NO: 89250 - DNA, 252 bp, Glycine max
  Peptide Sequence Number=SeqID_206028
atgcaacaacaacaacaacaacaacaacaaagccttatcccattatgtgaggtcggctacatggattacatgacgtcactcacagttaaaaaccaaactttcagagatattattgagtctaaggtctcccttgacgaaaacctaaggatgcatgcaaaacaagatcaacgacgagagatagagtgtgagagagaaagcgaacctgatcgtggctggcaaatggtggttgcgaattttccggcggtggcgtga

SEQ ID NO: 89251 - DNA, 1587 bp, Glycine max
  Peptide Sequence Number=SeqID_206029
atggacacattaaaaagacatcttcctgttactggtcaagagggattgcatgaacttcagaagattgctcaaaggtttgaagagaagatttttactgctgcaacaagccagtctgattatctacggaaaatatctttgaagatgcttacgatggagactaaatcccagggctccatggcccccaacttacctacaaatcaaggtggccctagtaataaacctcctgatccaggacttggtattccacctcaagttcataatccagggcagcaacatcctattcctatgcccaatcaacctccgaaccgtcaacagcttctacctcagaacattcaaaatagtattgcgtctcaaccttcgaatatagcccaggctcccatccaaaatgttgggcagaataatcccaacatgcagaatattcctggtcagaattcggtggggagcaccattagccaaaattccaacatgcaaaatatgtttcctggttcccagagacaaattcaaggaaggcaacaggttgttccccaacaacaacagcagcaatcacaaaattcgcagcagtatatctaccagcaacaaatgcaacatcaacttttgaggcagaagctccaacaacaacaacagcagcagcagcagcagcaacagcagcagcagcaacaacaacaacaacagcagcagaatcttctacaatcaaatcagttgcaatcttctcagcaacctgccatccaaacatcaactgttatgcagcaaccttccatgatgcaagcatctctacctagcattcagcacaatcaacagtctaataatcaacaatcaacacagtctgtgcttcagcaacactcccaagttatcaggcaacagcaacaccaacagacttcgatcattcatcaacaacaaacaccgatgactcaacagtcaatattacctacacaacagcagcagcagcagcagcttatgggggcacaggcaaatgcaccaaacatgcaccatacccaaatacttgggtcacaaaataatgttggtgatttgcagcagccacagaggttacttactcagcagaataatctttcaaacctgcagcagcaacagttaataaatcagcaaaacaacctatcaaatatgcatcaacagctgggtaataatgtccctgggttacagccacagcaggtccttggacctcaatctggcaactcaggcatgcaaacaagccagcactctgcacacgtgctacaacaatcacagcaaaatgcatcaaatttgttaccatctcaagtgcagcagtcacagcctcaggctccacagcagcaattgatgccacagattcaatctcaacctgcacaattgcaacaacagttgggtttgcaacagcaaccaaatcccttgcaacgagatgtgcagcaaagacttcaggcctcaggtcccttacttcaacaatcaaatgttcttgatcaacaaaagcagttgtaccaatcacaaagaccccttccagaaacttcatccacttctctggattcaacagcacagactggacagtcaagtggaggtgattggcaagaagaagtgtatcaaaagatatttgtcaaatga

SEQ ID NO: 89252 - DNA, 270 bp, Glycine max
  Peptide Sequence Number=SeqID_206030
atgatgatttggaaacagcgtgcaaaattagtcatggccacagctaggtgggcactcaagcatccagtttatggcattgtgatactacggttggggatttacacaaacaaacccaacatttccaaattatgttctttcatcggttcaatgaaaccatccattcttatctcggtcattcaggaaaataaactcttagcgacgacgttcctaaatgaaaaactctacacggttccagaatttcaacaaacactattgacaacaacgaagtaa

SEQ ID NO: 89253 - DNA, 1338 bp, Glycine max
  Peptide Sequence Number=SeqID_206031
atgcgtcgtgggttgatttccatttcacgttcaagtctccttcgaccctttcaatggcatctatccacagccacagccacaaccacacctcctcccgatgacgccaccgttcggcaaacgctcctctccttcaacaatgactggaagcgcgccctcgagttcttcaactgggtagaagagtcccactcccagttccatcactccaccgacaccttcaacctcatgctcgacattctcggtaagttcttcgagttcaagctctgctgggacctcattcgccgcatgaacgcccacccctcctctccccccaaccacgccaccttccgcctcatgttcaagcgctacgtctccgcccactccgtcaacgacgccatcgacaccttcaatcgcctcggtgaattcaacctcaaggaccacacctccttctccaacctcctcgacgccctctgcgagtacaaacacgtcctcgaggctcaggacttgctcttcggaaacgacaaccgcgtgaccctcagcgtcgacccaatcggcaacaccaagatccacaacatggttctccgcggctggttcaaattggggtggtggagcaagtgcaacgagttctgggaggaaatggacaaaaaaggggttcacaaggacttgcactcttattcaatttacatggatattctctgcaaaggtgggaaaccttggaaggctgtgaaattgttcaaggagattaaaaaaaaaggtttcaaattagatgttgtggtttataacattgtcattcgagccattggtctatcccatggagttgatttttcaattagggttttccgtgaaatgaaggagttgggtatcaaacccactgttgtcacttacaacaccttgattaggcttctgtgtgattgctatagacacaaggaggcacttgcattactccgaaccatcatgcccagcgatggctgccaccccactgccgtttcttaccattgtttttttgcctccatggagaagcctaaacagatacttgctatgtttgatgagatggtggagagtggggttaggcccaccatggacacctatgtcatgctcctcaacaagtttgggaggtgggggtttcttcgcccggtttttatggtgtggaataagatgaagcaacttgggtgtagtcctgatgctgcggcttacaatgccttgatagatgctcttgtggacaaggccctcatagatatggctaggaagtatgatgaggagatgttagccaaaggactttcacctaaaccaaggaaagagttggggacaaagctgttggctgctgatgaatctcaaaataccatacagacacaacactactag

SEQ ID NO: 89254 - DNA, 720 bp, Glycine max
  Peptide Sequence Number=SeqID_206032
atggcggcttctctgcaactgttccaatgcaaactagcgagaccctttcggtccttccctttgcgaaggtcaactccccctctgagtctgaggtgttgcgcttcgcccccttcttcctacagcatcactctcattcccggcgatggtatcggccccgaaatcatctctgtggccaaagacgttcttgtcctcgtgggttctctcgaagggatcaaattcgagttccaagaggttcttatgggtggagctgcattggatgccaccggagtccctttacccgatgataccctttctgccgctaagcaatctcatgccgttttgcttggtgctgttggaggttataaatgggataagaacgagaaacatctcaagcctgagactggcttgcttcagatacgtaaagagcttggagtatttgcaaatcttagaccagctaccgtatactctccgaaaaaattacatatccctgctttgcttgttgtcccttggaacggaagacggacagatcaggaaaatcttagggatgtattttatgatatgttagtggatgcttcaactttgaagagagaggttgctgaaggggtcgatatcatgcttataagggaactcactggaggtatctattttggagaacccaggggctttggcaccaatgaaaatggtgaagagattggctttaatactgagatttatgctacacatgagatcaatgaaggttga

SEQ ID NO: 89255 - DNA, 243 bp, Glycine max
  Peptide Sequence Number=SeqID_206033
atgaaaattcctttttatttctctgtcctgctgcttcttctcctcattgattctggaaatcaagtacacatggcggtggtacctgaacatgtacattgtgagaatttaatattgcgtaatgattattgtgacctagaaaatgatccttgcaacgctcattgcaaactttttctttcctctgcatgttacgtaggccgtgcctttccctctcttcctcgtgctgcattccttaaatgctcttaa

SEQ ID NO: 89256 - DNA, 180 bp, Glycine max
  Peptide Sequence Number=SeqID_206034
atgaaagatggggtggatttgattccaatatcgagccgcaatgcaaagcctccaggtgttgaattgtgggcagttcttgatgtccctattggccctgtccctgaaatcggaaagtgtggttgcctctatgagatgaaattctatattcatcatctgcaaaatttcgatatgcaagaatga

SEQ ID NO: 89257 - DNA, 7113 bp, Glycine max
  Peptide Sequence Number=SeqID_206035
atgtggaacaacggccagattctgccgcctggaacttccgttcctccgattcctccgcctcccgctgcgcaaccctcctacacggtgcttccgccgccgcctccaactccggtgcctatggagaccgaggccgatgcggaggcgcgcctcgaggagaaggctagaaaatggcagcagctcaattccaagcggtacagcgacaagaggaaattcgggtttgtcgagacgcagaaagaggacatgcctcccgaacatgtcaggaaaatcatcaggcaagtgtttttcccttcagaatctgaatcttgttcggatcatggtgacatgtcctcaaagaaatatcgtcatgacaaacgtgtttatcttggagcacttaaattcataccacatgcagtttacaaacttctggaaaatatgcctatgccgtgggagcaggtccgagatgtgagggtcttgtaccatatttctggggctatcacatttgtcaatgaaataccatgggtcgttgagcctatttatctcgctcagtggggtaccatgtggatcatgatgagaagggagaaaagagatcgtcgtcattttaagaggatgcggtttcctccatttgatgatgaggagcctccactagactatgctgataatcttttagatgttgatcctctagagccaattcagctggagctagatgaagaggaagattctgctgtgtatacttggttctatgaccataaacctcttgtgaaaacaaagctcataaatggtcctagttaccggaaatggcatctttccctccctataatggcaactttgcatcggctagctgggcagctactttctgatttaattgaccgcaattatttctacttgtttgacatggagtcattttttacagcaaaggctttgaacatgtgcatacccggtggacctaaatttgagcctctctaccgtgatatggaaaagggagatgaggactggaatgagtttaatgacatcaataaactcattataaggtcaccacttcgcacagagtatagaattgcttttcctcacctttataacaacaggcctcgcaaagtaaagctttgcgtgtatcatactcccatgatcatgttcataaaagctgaagatcctgatctacccgcattttattatgatcccttgatacatccaataaccagtgctaacaaggagcgccgtgagaagagagtttatgaggatgatgatgatgatgattggatattgccagatggtgtggagcctttgcttaaagatacacaactttatacagacacgacagctgctggtatctctttgctgtttgctcctcgtccttttaatatgagatctggtcgcatgaggcgggcagaggatattcctcttgtgtcagagtggtataaagagcattgtcctccatcatatccagttaaagttcgggttagttatcaaaagttgctgaaatgttttgtgttgaacgagctgcatcatagacctcctaaggctcaaaaaaagaagcacttattccgatctctccaagcaactaagtttttccaaaccactgaacttgattgggttgaggcaggtcttcaagtttgtaggcaggggtataacatgctgaatctgctgatacacaggaaaaatttgaactaccttcaccttgattataattttaatctaaagcctgtgaaaaccttgactacaaaagagcggaagaaatcacgatttggtaatgctttccatctctgtcgtgagatcctccgattgacgaaactcgtggttgatgccaatgttcagttccgtttggggaatgttgatgcttttcagcttgcagatggtttgcagtatactttttcacatgttggacagttgactggtatgtataggtacaagtataggcttatgcggcaaataaggatgtgcaaggatttgaagcacttgatttactaccgctttaacactggacctgttgggaagggacctgggtgtgggttttgggcaccaatgtggagggtttggttattcttccttcgtggtattgtgccccttcttgaacgatggctgggcaatttacttgcacggcagtttgaggggcgccattcaaaaggagtggccaagactgtaactaaacagcgtgttgagagccactttgacttggagcttcgggcagcagttatgcatgatgtgcttgatgccatgccagagggtataaagcaaaataaggcaaggactatattgcaacatttgagtgaggcttggcgatgctggaaagcaaatattccttggaaggttcctggcctgcctgttcccattgagaacatgattcttcgatatgtgaaatcaaaagcagactggtggacaaatgttgctcattataatcgtgagcgtataagaagaggtgcaactgtggataagactgtttgtcgtaagaatcttggaagattgacacgactctggctgaaggcagaacaggaacgtcaacacaattatttgaaagatggtccatatgttactcctgaagaagctgttgctatctatacaacaactgtacattggttggaatctaggaagttctcccctattccctttccacctttatcatataagcatgataccaagctgcttatccttgcacttgagaggttgaaagaatcctatagtgttgcagtgagattaaatcaactgcaaagagaagagttggggctgattgagcaagcttatgacaatccacatgaggcattatcgcgaatcaagcggcacttgctcacccagcgtgcattcaaagaagttgggatagagtttatggatttatatagctacttgattccagtttacgagatagagcctcttgagaaaattacagatgcatatcttgatcaatacctgtggtatgaaggtgacaagcgtcatctctttcccaactggatcaagccagcagattcagagcctcctccccttttagtttacaaatggtgtcaaggtataaacaatttgcaaagtatatgggacaccagtgagggtcagtgtgttgtgatgctgcaaactaagtttgagaaattctttgagaagattgatttaacaatgcttaacaggcttctgcgactggttctagaccataatattgctgattatgtcactgcaaagaacaatgtggtgttgtcatacaaggatatgagccatacaaattcctatggtcttatacgtggcctgcagtttgcttcctttgttgttcagtattatgggctggtattagatcttttacttcttggactgactcgagccagtgagattgctggtccaccacagatgccaaacgaattcattacttattgggatacaaaagttgagactaagcatccaatcaggctttattctcggtacattgatcgggtccatatattatttcgtttcacccatgaggaggctcgggatctcattcagcggtatctgaccgagcaccctgatcctaacaatgagaacatggtggggtacaataataagaagtgttggccaagagatgctagaatgaggcttatgaaacatgatgtcaatcttggaaggagtgtcttctgggatatgaagaatcgccttcctcgaagcatcacaacattggagtgggagaacagttttgtttctgtttacagcaaggataatccaaacttgctttttagcatgtgtggatttgaagtgaggatacttcctaaaattagaatgactcaagaagcattcagtaacacaagagatggtgtctggaatctccagaatgaacagacgaaagaaaggacagctgttgctttcttacgagttgatgatgaacacatgaaagtgttcgagaatcgtgtgaggcagattcttatgtcttccggttctactacattcacaaaaattgtcaataagtggaacacagctttaataggactcatgacttatttccgggaggcaactgtgcatactcaagagctgttggatttgctagtcaaatgtgaaaataaaattcagactcgtattaagattggactcaactcaaagatgcctagcaggtttccacctgtcattttctacacccctaaagaaattggagggcttggaatgttgtccatgggccacattttgattccacaaagtgatcttcgatacagccagcagacagatgttggagtaacccacttcaggagtgggatgagtcatgaggaggaccaactgattcccaacctttatcgttatatacagccttgggagagcgaattcattgattcacagcgtgtctgggctgaatatgctttgaagaggcaggaagcacaggctcaaaacagacgtttgacccttgaagatctggaagattcatgggatagaggtataccacgtataaacactttgtttcaaaaggatagacacactttggcttatgataaaggatggagggtgcgtactgatttcaagcagtatcaagttctcaaacaaaatcccttctggtggacacatcagaggcatgatgggaaattgtggaacttgaacaattaccgtactgatgttattcaagcccttggaggagttgaaggaattcttgaacatactttattcaaaggaacatattttccaacttgggagggtcttttctgggaaaaggcatctggctttgaggaatctatgaagtataagaagctcaccaatgctcagagatctggtctaaaccagatacccaaccgaagatttacactatggtggtccccaaccattaaccgagccaatgtttatgtgggtttccaagtgcagctagatctgactggtattttcatgcatggaaaaataccaactttgaagatatcccttattcagatattcagagctcacttgtggcaaaagatccatgagagtgttgttatggatctctgtcaggttttggatcaagagttggatgctttggagattgaaactgttcagaaggaaacaatccatccaaggaaaagctacaaaatgaacagttcttgtgcagacattcttctctttgctgcccatagatggccaatgtcaaagcctagtcttgtagctgaatctaaggatgtttttgatcagaaggcaagcaataagtactggattgatgttcagctacgatggggtgattatgactctcatgatattgagcgttacactcgggccaaatttatggactacacaacagataacatgtctatatacccatctcctactggggtgatgattggtcttgatttggcatataatttgcattctgcgtttgggaactggttcccagggtcaaaaccactacttcagcaggccatgaataagatcatgaagtcaaatcctgcactgtatgtgttgagggaacggataaggaaaggtttgcagttgtactcttctgagcccactgaaccatatttgtcttcccaaaactatggagagatattcagcaaccaaataatatggtttgttgatgacactaatgtgtatcgtgttacaattcataagactttcgaaggaaatcttacaacgaagcccatcaatggtgctatatttattttcaatccaaggactgggcagttgtttctcaaggttattcataccagtgtgtgggctggtcagaagcgtcttgggcagttggcgaagtggaaaacagcagaagaagttgctgctcttgtaaggtctttgcctgttgaagaacagccaaagcaaattattgtcactcgtaaaggaatgttggatccattggaggttcacctgctggatttccccaacattgttattaaaggaagtgaactgcaacttcctttccaggcatgtttgaaaattgagaaatttggggatcttatattgaaggccacagaaccccaaatggttttgttcaatatctatgatgactggctgaagagtatttcttcatacactgcattctccaggctgattctgattctgcgtgcactccatgtgaataatgaaaaggcaaaaatgttgctgaagcctgataaaactatcatcactgaacctcatcacatctggccttctctaagtgatgatcaatggatgaaggtggaggttgcattaagagatcttatactatcagattatgcaaagaaaaacaatgtgaatacttcagctttgactcagtctgagatccgtgatattatacttggagctgagattactccaccttctcaacagcggcaacagattgcagagattgagaaacaggcccatgaagcaaatcaggtgacagctgtgacaacaaagactacaaatgttcacggtgaagaacttatagtaaccaccactagtccttatgagcaagctgcttttggttctaagactgactggcgtgtcagagcaatatcagccacaaatttataccttcgcgtgaaccatatatatgtgaactctgaggatataaaggaaacgggatacacctatattatgccaaagaacattttgaaaaagtttatatgcgtagcagatcttcgaacgcaaatttctgggtacatgtatggcataagtcctccagataatcctcaggttaaagaaattcgctgcattgtgatgccaccccaatgggggacacatcaacaagttcatctgccatcagctcttccagagcatgatttcttgaatgatttggagcctttaggatggatgcatactcaaccaaatgaacttcctcagttgtcgcctcaggatctcacttcacatgccaagatcctagagaacaataagcaatgggatggggagaagtgtattatcttgacttgcagctttactcctggttcttgttctttaactgcatataagctcactccatctggttatgaatgggggcgtgttaataaggatacgggaagcaatccacatggttaccttcccacccattatgagaaggttcagatgctccttagtgatcgcttccttggtttctacatggttcctgataatggtccatggaattacaacttcatgggggtgagacacgcatcagggatgaaatatggagtgaagcttgggactcctagggaatattaccacgaggaccatagaccaacccatttcttagagttcagcaatatggaggaagtggagataactgctgagggagatcgagaggatacattctcttga

SEQ ID NO: 89258 - DNA, 939 bp, Glycine max
  Peptide Sequence Number=SeqID_206036
atgtctgctgcggtgtgcggaagcaagagatctttgttcgaagagcttcccccttccccgccagtatccaagaggctccgctgttcctcctcccctattcgcctctctctcccttctctcatcgaccaccttcgccctctcttccctcatatggatgaccaggtcctcgagagagcgctccaagaatgtggcaacgacctagatgcggccatcaagagcctccacggcctctgtttgggatctgctgatgataattctcaacctgctccacaacctgaccaccctaacctcgtcgtcgacacaggtgcgttggaagagaatggggatgcttctgcttctggggatcagcccgctgctgccaattttcctgccggtggagcagaatggattgacttatttgttagagagatgacgtgtgctactagtgttgatgatgccaggtcccgtgctgctagattgctggaggttctagagaaatcaattactgcacatgcgagttctggggtgacaacggctcttcaaaggggagaagagttgatagtttgtgtgtgtgacttgggtgggcaaactgatgagttggatggttgtggttgtgtgtgggaaggggattatgggggttggaattttgaagcagggttttttgactctgtgcgcgtgagagttggatgtaagtatggggaaaatttgatgctgaaggagcatattgaagctttgactaaggagaaaaattgttttaaaagtgcttttagaatccagcttgaacgcctttctgattatgagaatagaaaccaagagttgcagcaattgaagcagttggtatctcaatatcaggagcagatcagaactcttgaggtgaataactatgctttgcgaatgcatttgaatcaggcacaacaatacagcccctttcctgggtgtttccctcctgatgccttctag

SEQ ID NO: 89259 - DNA, 345 bp, Glycine max
  Peptide Sequence Number=SeqID_206037
atggtgagcaaaggttggagctttgatggagcttcaatggtgaggaagaagaaaggaatagcaacacttcatggagcaggtggcctagcccggagtccaaccttccattgttggggaggggggggagtgaggctcttgaggcttagggcccaactgatccaggtgctgagatggattaggagccaactgatgaggcagatgatgctgatgcaagtgccacggatactgagatggatgtgtgatgtagttccatgtggagcttgtaggccttggatcatcttcatcaatggagtcctttgcttcttgaagatcaatgacaacggaatggagaaggaagaaagatga

SEQ ID NO: 89260 - DNA, 534 bp, Glycine max
  Peptide Sequence Number=SeqID_206038
atggcatgcaagaagaagtgtgcttcctcctctcgccctcaagaatcctatggctcctccaggtttgtgttggaggaggcatgggactggtaccagaccaacgtttatctcaggagcatcctaccggagaggaactccgagttagcatactcccattatgacaagttcctccaacagctagagcgtcaccaatgtcaccgcaacctcacccgccagatggagaatcacatagatgtggctttggtcaagaagttctactccaacttatatgaccttgaggatcgctccccaaggcaatgcaaagtgagggggaagctgatcaaatttgatgccactaccttgaacaccttcttggagattccagtggttcttaaggcgaaggagcgttgcccggagtactcccgctactgtcatacctaccccgaccatagggccataacggccaagctatgcattccagggtggggatttatgctgaatgttgagggagccccctcgaagctgctgaggaaggacctaactaccttggcttag

SEQ ID NO: 89261 - DNA, 327 bp, Glycine max
  Peptide Sequence Number=SeqID_206039
atgaaggtaggcttagcggtcgaaaccaagctagagaatcacagttcccatgaagacaacaacaaaactacaaagcctaggatagaaagaaagaaatggagggaatggggaaacaagagtgaagttggcagaatggtgagggttgggggtttagggcagtttatgaaacttcctgcagttatggattgtgcgcttaccacggccatgcgcttagtgcgtagtctgacaacagtaatggcattaaagtaccaaacgcttagcgaaggcatctcgcttagtgacctgaggacgaagtcctttggtcttccccccaacgtattattataa

SEQ ID NO: 89262 - DNA, 207 bp, Glycine max
  Peptide Sequence Number=SeqID_206040
atgaggctattgtcctttgagacaaacgtgagaggtgctaataccttcctcaaacgcacgagctggtccaaggaagtgggggagctggaagatgccaacggtctaggagggggaggagcaactaggggtgcctctgctggagccctacgggaccccgaaaaagtgataaagggatcatcgaggttccaacagttcttgtggatgtag

SEQ ID NO: 89263 - DNA, 243 bp, Glycine max
  Peptide Sequence Number=SeqID_206041
atggattgttcagccctccatggtaatgaagggttcaaatatacaaaaggtgtaaaagatgaagggatagggaataaaggttctctaagcaacttcttcgcgctgagcggacactctccctctaagcaacacagcttgttaagcgagtttgacgtactgagcatgaactatcatgcttcaacttctctctctatcccttgcctgtatatctgcaaaataaaatcatcaaattgtatgaattag

SEQ ID NO: 89264 - DNA, 1642 bp, Glycine max
  Peptide Sequence Number=SeqID_206042
atggttctggcggagttaggtgggagcatttcgcgtgctctccagctgatgagcaatgcgacagtaatcgacgagaaggtgctcaacgattgcctcaacgacatcactcgcgctcttcttcaatccgatgttcaattcaagcttgtccgcgacatgcagaccaacatcaagaacattgtcaacctcgacgatctcgctgccggtcacaacaaacgcaggatcatccaacaagctgtgtttaacgaactctgcaaaattctggaccctgggaagccctctttcactcccaaaaagggcaaaacaagtgttgtcatgtttgttggtttgcaaggttctggaaaaaccacaacgtgtacaaagtatgcatattatcatcagaagaaaggctggaagccggctctagtatgtgcagatacattcagagctggtgcatttgatcaattgaagcaaaatgcaactaaagctaagatccctttctatggaagctatatggaatccgatccggtaaaaattgctgtggaaggtgtggagagattcaagaaagaaaactgtgatcttataattgttgatactagtgggaggcacaaacaagaagcttctctttttgaagaaatgcgccaagtttcggaagcaacgaaaccagatcttgttatatttgttatggatagcagtattggtcaggctgcttttgatcaagcccaagcatttaagcagagtgttgcagttggagctgtaattgttaccaaaatggatggccatgcaaaaggtggtggtgctcttagtgctgttgcagcaacaaagagtcctgtcatattcattggaactggagaacatatggacgagtttgaagtttttgatgttaagccatttgtcagtcgtctattaggaatgggcgactggtctgggtttatggacaaaattcatgaagtcgttcctatggatcaacaacctgaactgcttcagaagctgtcagaaggaaacttcaccttgaggattatgtatgagcagtttcagaacatacttaaaatgggtcctatcagccagggtaaggctgcgtacaacatccctcccccataccttcgcatagcgaagagcctctgggcaatggggtacgaagttttttctatgcttcccggatttagtgctgaattaatgccaaaaggccgtgagaaagaaagccaggcaaaaattaagcgttacatgacaatgatggattcaatgacaaacgaaggcaagcattatgttttgattgttttggatagttcaaaccccaagctcatgaatgagtcacgcatgatgcggatagctcgaggtgcaggtcgtcagattagggaagtgatggagatgttggaagagtacaaacgtcttgcaaagatatggagcaaaatgaaagggcttaaaataccaaagaaaggtgatatgagtgccctatcccgaaatatgaatgcccaacacatgagcaaagtccttcctcctcagatgctgaagcaaattggtggcatgggtgggttacaaaacttgatgaagcagatgggatccgccaaagacatgatgggaatgggaggaatgtttggtggtggtggtggtggtgattattcaatcggtgttggagtgccatctgcaatagccgcaatgggtgcaa

SEQ ID NO: 89265 - DNA, 2184 bp, Glycine max
  Peptide Sequence Number=SeqID_206043
atgcatatgcactggttgggtcccgacgtacctgtgttcgaccccaatttcacttacaatcatcatcgtccctacttatacgacgatgacctctttccaaacgacgccgtttcggcccgtcgccacgatgccgtttcagcccatcaccacgacggaacctcacctctcccactgggcatggattggagccctccgccgcgcctatgggagggtcgcagcactgtttggccgcgtcatcctcccaccggatggagcttctgcgtcacgcttccttcatgggttaccgctccccaatcccctccttctgatcccgtcgccttttttagggttcaagtcggtgtacaatctccccaagcaatcaccacttctcgactattactacgcagatttagtgatttcgtcaatctcttttctcaactgaaaaaggaatttcccataaaagatctgcctacacctccacccaaaaagatactcagaattaaaagtcacactgtgttggaagagcgacgccttttattagctgattggatggaaaagttgttatcggacgttgatgtatcaagaagtgccccggtggcaatatttcttgagctagaagctgctgctagatcatcatttcatgatgtgaacgagcatgtttcggatgaagcatctgccaatgctactacaccctcacaaatgatccaagatacctcacctggttctgtaaaagctcatggttcatctgcagcaatagttcctggtaacgatgaagtttctgagctgggaacaccacaacatggaatggataaccgttctgatcaaattatggataattcaacattggaacatggcttaattaatccaactgaaacggatgttcattatgccacatccagcgaaaacttcgtttataaggataatattacagacaaagtcactgggtatactgctgatgctatagctcttcacctagatggaactgagtttacacctgctgtacgagattataacttgaatgctcatgttaagagattgtcaacagaaagcattagaagtgacttaagttctctaaggaatactgaaacatcaaatttaactacgaccactttggttcaggatgcttcacataaccttgctgggagccatgaagtctcaagaaattcagatttatttttgacttttccattggatgagcggcacaagttgaacaaaattcttaatacccagaaacagagattggtcactgcaaaagctgatgttgaagatcttatagcaagattgaatcaagaaatggctgcaagacaatatcttgtgacaaaggtcaaagatttggaagttgaacttgaaacaactcgactgaactgccgagaaaacatgcagcaggctgttttgactgaaaaagaaaggtttacacaaatgcagtgggatatggaggaacttcggaggaaatgcctggagacagaaatgaaattgaagttggaagaggatgaaaggctgctagcagaatctacgaaagaatctgtcattcaggagaagcaaatgttgcagcaagagctagatgtagctagagaacaatttaagcacttgcaaaaacatcatgatgagtttgagatgaaatcaaagacagatttgaaggttctaataaaggaggtaaaatcccttagaaattctgagttagaactgaaacagcagctaagtgaattgatgaaggagaagttagatttggagagaatcctccagaaggaaaagcaaagaatggaaaattcacataatgcaaatacaaagttgctgcatgagtgtgcaatccttcagaagaggcttcgggagtgtagtgtaaatttccttgttgaagaggaagataaactaaatatcgacactttgccatctgatgctctggatttattagcaacatcagataatcggattggtctcttgcttgcagaggcacagctcttggcacaagatgtagaagatactgttgttgctgttgaagagacccgggatataaccacagacaatactgggaaaactcatgatgaattgagaaagatgctggcacatatgtttgttgacaatgccagtttaaggaaacaaatcaattctgttattcgttgtgctctaaatgcaaatatcaattccgaagaggacggtgaagaaatccatttgcaaaaaactgtcctaagcaagttcttagaaagatag

SEQ ID NO: 89266 - DNA, 807 bp, Glycine max
  Peptide Sequence Number=SeqID_206044
atgccggagcttccagaggtagaggcggcgaggagggccgttgagtataactgcgtcggaaagaggataacaaagtgcgttgtcgccgatgattctaaggtgatccatggtgtctctccctccgacttccaagcttccgtcctcggcaagctcatcgtcgctgctcaccgtatggctggtgctatatacattaaaggagctgcagtaacaaactataaaagttattgtcatgatttaaagaataagcatgcatgtaggtctgctgtaaaagacgaggatgagtggccctcaaaatattcaaaaattttcattgaggactctgattacacagcggaatttacatcctttgctatgaagttagatgatggtttggagttgtctttcactgacaaaaggcgatttgctaaagttcgtctgctcaaagatccgacatcagtgcctcccatatccgagcttggtcctgatgcacttttcgaacctatgacacttgagaagtttacggagtctttgcacaagaagaaaactgaaatcaaggctttattacttgatcaaagctttatttcaggtattggaaattgggtggcagatgaagtgttataccaagcaagaattcatccgcggcaggtggcttctagcctgtctaatgaaagctgctcaaatttgagcaagtgcattaaagaggtcattgaaaaagcaattgaagttggagcagaaagtagtcagtatcccaccaattggatatttcattcacgtgaaaagaagcccggcaaggcttttgttgatggtttgcttcccaactttgtgtaa

SEQ ID NO: 89267 - DNA, 792 bp, Glycine max
  Peptide Sequence Number=SeqID_206045
gcaataaactatggaacatcaagctcacttttggataaggttcgtcaagttgcaagggaatttttcgagcagccaatggaacaaaagaagataatttctaaaggagtggaagaatttgaagggtatggtgctgatccagttcctgaagaaggccagtctttagattggtcagatcgtttgtttcttgatgtatctgaagacacaaggaagccaagcctctggccagaaaatccatcatccttgagggatgctgtggaagaatacagcgcaaagatgagagaggcaacaaatcttatttctaaagcaattgcaaagtcactggatttagaagaaaattgcttcctgaatcaatttggtgaacaagctctgctgcaaggacgcatttctcaacggggtaggaagacgaaaagtaaaaaaatattatatgagaaatatgctcctaggtcgacaattaaagatggtcaggttgacagtcatttaaatgacaaatttgtccttttttgccacataatgactaatggaattttcaagagtcccgtgcatagggtactagcaaactccaagagggaaagaatatctgttgcgatgttctataccccggagccaaacaaagaaattggaccagaacaaagtttggtgaatgaggaacaaccaagatattatgctgatacacattggaaatactatcagcgaggaatgagagcaatccatgtagcaaaagatatcacagttgtagctagactgctagagtctagagctctgaataaaataaaacctatcgatgctaattaa

SEQ ID NO: 89268 - DNA, 441 bp, Glycine max
  Peptide Sequence Number=SeqID_206046
atgggtaaggctcatatgacggggatcaagggagccccgtatcagagacgtatggatgccctgactgtgactgacgtgtactggatgccctatgctgagcaccggggatttctgggcaggtggcgccaaactacatggagtgatttttttggatttcgcacccgttcttcatgcggaccgaggagactgctaaagccgagacatccgcctccccctcatgatgaggagttcgtcgagccacccatccccgaggtttcaatcgcgtccgatctccctacgcattcagtggttgactgcgaaggatgtcaagggatggctgaggatttggagcgggtcatcaacctcaggatggtcactgaaggcactgacttatatgacatcatgactcgatgtttgaggggaactagaggtgacgccgcagatggaagtcttaggtcgtga

SEQ ID NO: 89269 - DNA, 594 bp, Glycine max
  Peptide Sequence Number=SeqID_206047
atgtccaaatgccctaggtgtggggcatcgtggtacaaggtgaaggaagatgaggactgcagttctgatgaaaacttaaagaagggccctccagcgaaggtgttgtggtatcttcccatcattacaaggtttaagcgtctttttgctaatggagacaatgcaaaagaccttacctggcatgcaaatgggagaaactatgatggaatgcgaaaatacatgatgttgtctatgatgatatcatgcctaagacaaccaggaaatgacattgatgtttatctaagtccgttgattgaagacctgagaaagttgtggggcgaaggggttttagtgtttgatggatttcgcaatgagacttttgaaatgtgtgcaatgcatttttgtaccattagtgactttccagcgtattggaatctgagcggttacagtgtcaaggttcatcacgcatgccccatcttaaaagggtataccaagaatctacatcgttcagaagcatctattgttgaaaggtacattgcagaagaagccattgaattttgctcagactacattgaaaaggctaaacctgttggccttcctgagtctcaaaaacattaa

SEQ ID NO: 89270 - DNA, 286 bp, Glycine max
  Peptide Sequence Number=SeqID_206048
atgcatatgacacagatgcaatttacgaatacgggagcccgagaaattgtttccttcttggatacaacgtttgggggtagcaaagtgcccaaacgtatgtattttaagaaggcgacacggaccctctgtcggtttgctaaagtgaggggatcaaagacgaaacccacgcatgatgcatatgcgaaaggcacaacacggggatgtatcatccccttcgaagaacatactgcagcagtagggactactagcaacaatatgttttcaaagaaaaaagctctagatgagg

SEQ ID NO: 89271 - DNA, 956 bp, Glycine max
  Peptide Sequence Number=SeqID_206049
ggctacacgccctcaccttcagaggactacacgttcttgccttcagagggctgtgcatcctcgccttcaaagggctacacgccctcaccttcagagggcgacacaacctcaccttcagaggactacatgtcctttccttaagaggactgcacgtcctcggcttcagaggactgcatgtcctcgccttcaaagggctacatgccctcacttttagaggattacacgtcctcaccttcaaagggctacacgccttcaccttcagtggactacacgtcctcggcttcagaggactgcatgtcctcgccttcagagggctacacaccttcacttttagaggaccacacatcctcgcatttagaggattgcatgtcctcacctttagagggctacacaccctcatcttcataggactacacgtcctcaccttcagaggactgcacgtcctcacctttagaggactacacatcctcgccttcagaggactgcacgtcctcacctttagaggattacacgtcctcgctttcagaggactgcatatccttgccttcagagggttacacgccctcgcctttagaggactacacgccctcgcgtttagaggatcgcatgccctcgccttgagagggccacacgccctcaccttcagaggactacacgtcctcgacttcaaaggagtgcatgtcctcacctttagagggctacacgccctcgtcaggactgcacgtccccaccttcagaaggctgaacgtcctcgccttcagaggattacacgtcctcaccttgagaggcctacacatcctcgccttcgaaggactatatgccctcaccttcaaagggctacaggtcctcgccttcagggaactcaaggtcctttacctttaatgcttaaccgaggcttgcactcctggttgaggggccagtggtttccttttatcagttcctgggccaccatctga

SEQ ID NO: 89272 - DNA, 787 bp, Glycine max
  Peptide Sequence Number=SeqID_206050
ttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtcaccctctgccctcagtttggcatccctcacacagcctcatactcgcttctcaaaaggctgtctccattttgctcatgactggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 89273 - DNA, 171 bp, Glycine max
  Peptide Sequence Number=SeqID_206051
atgcctaaggaagaactacgtaggtctgatttcctctccaaaggagggtacgtaggagcaaaagccccgcttttgtcgacctcaaaaaataaaaagaggctgttgtctttcgagacaaacgtaagaggtgctaataccttcctcaagcgtaaatacaactcccgaacttag

SEQ ID NO: 89274 - DNA, 1203 bp, Glycine max
  Peptide Sequence Number=SeqID_206052
atgtgtagctctaagaccaaagtgactgttggtttagaagccgttgtcgctgctgcgaagccctcagtggctagaatcaatggaaggccagtcctccaaccaacttgtaaccgtgttccaaaccttgagaggaggaattcaatcaagaaagtggcaccaccaaagtcactttctccaccatcaccaccacttccaagcaagacctcattgacacccccggtttctccaaagttaaagtcccctaggcttcctgccacaaagagaggcaatgacaacaatggacttaactcgagttatgagaagattgtgatccctagaagctccacaaaaactccaactttggagagaaagaagtccaagagcttcaaggaagggtcatgtgtgtctgcttccattgaggcttcgttgagttactcgtcttctttgatcactgactccccaggtagcattgctgctgtgaggagggagcagatggcactgcaacaagcacaaaggaaaatgaagattgcccattatggaagatcaaagtctgcaaagtttgaaagagttgttcctcttgatccttcaaacactagtcttgcatcaaagccaactgaggaggagaagagatgcagctttatcacacccaattcagatcccatctatattgcttatcatgatgaggaatggggagttccagttcatgatgacaagatgctgtttgaacttttagttttgagcggtgctcaagttggatctgattggacctcaaccttgaagaaacgcctagatttcagggctgcattttcagaatttgatgcagaaaccgtggctaacttgactgataagcaaatgatgtctattagttctgaatatggcattgacataagcagagtccgaggagttgttgataatgctaaccaaattttagagattaagaaagactttggttcatttgacaagtacatttgggggtttgtgaatcataaaccaatctccactcaatacaagtttggccacaagattccagtgaagacatcaaaatcagagagcataagcaaagacatggttagaagaggctttaggttcgttggtccaacagtggttcattcattcatgcaaacatctggcctcacgaatgaccacttaatcacatgccacaggcacttgcagtgcaccctattggcagctcgatccctttgtaccatagagccctctcaatag

SEQ ID NO: 89275 - DNA, 498 bp, Glycine max
  Peptide Sequence Number=SeqID_206053
atggatgatctgacagttaactttagaggggctaggaaggtaagggctcgaccagcagatattccttcttcttccgcaccaccagctcctcccacttatgccactcctacaccagctcctcccatttcttccacccatacaccagctgcccaggactctcagcgctttgaagccatgcttcaaagtattcatcaggggcagattttattactgcagagcttgcatgtggtagctcctccagggtccattctgtcgatagagcagttcattgagaaggtatcctggcctagaaccttaccttctactgtaagagagggtgtaggagtagagatgagacctgatgaggttgttcttcttgagccaattgtgccagttatacatgaggttgttgaagcaggtgagtcacagttgagacaggaggctgctactcctgagaggacaccacagaccccagaagattcactctcaccagggatggacttatcttttgctcagcag

SEQ ID NO: 89276 - DNA, 819 bp, Glycine max
  Peptide Sequence Number=SeqID_206054
atgatcgcgcagggcgaacaggcattctatcttgctcatgttggccgccaggtacgggcgatgcagtttgcacggcaggttcggctgcgcgctcaggatctcctccagcagcgggttgctggccagggtgctgagcaggccgctggtggtgcgccagttgagcagcgaacggccgagaaacttcaggcgaaacgcgggctttttccaggcgttgcttggcgccttttcgccattgatcagcgccgtcatcagttgccagccgttaagcggccgggcggaggcgagtggctccgccgccgcaatgggcggttgatattcacaagcacaggcaggtcaattttgacagggtttacaggacataaacgccgctggatactcgttctggcggtcattgcggcgcttgccgcggcggccgtttggcactttcgccatccggcgccaaccgatttcaaaacggtgaaagccagcaaacgcgatctgcagcagaacgtgttggcgaccggccagctggacgcggtgcgcaaggttgacgtcggcgcgcaggtcagcgggcagttggaaaagctgtatgtcgagatcggcgacaaggtgaagaaaggccagttgctgggcgttatcgatccgcaacaggcgcagaacagcatccgcgaaggcgaggcgacgctgcgtgaactgcatgcgcaactgctgcaggcgcaggccgaacagcagctggcggcggtcacgctgcagcgcaaccaggcgttggccaagctgcaggcggtgtcgcgccaggatctggatcaggcggcgacgcagctggcggtgaagaaagcgcag

SEQ ID NO: 89277 - DNA, 237 bp, Glycine max
  Peptide Sequence Number=SeqID_206055
atggatttcgaaatttgccaaattgtgcagcaaaaagctgtcaaatttgtccagcagaatttttcaacatgtgcagaaaatgcttgtgcattgatggttatgggaaaggtagtacatattgagttctggaaattttctagcggatcccaacggtcaaaatcttggaagggtttatggggacccggtgctgagaggaacgaggataagggctacgtaggagtatgtgagctcagttga

SEQ ID NO: 89278 - DNA, 1965 bp, Glycine max
  Peptide Sequence Number=SeqID_206056
atgaatacgacgccgtttatggacaagcagattatggatctcactcacgctcacggatcttcttcttcttcttccactacgcagttgcagagcaaggacttcattgacctcatgaaagaaccgccacaaaaccaacataaccatcaccatcatcatctcgaagatgaagatgaagaagaaaaagcgagtcgtggcaatgggatcagcaaagacgacatcgttcccagctacgatttccaaccgattcgccctctcgccgcttccaattccaataatttcgattccgccgcattctctcgcccttggaactccgattccaactccaacgcttcccctcccatcctcaaacgggaatcgaacccacgcccttgtgaagaatgtttgggaacatggacatgtggtgctcatggaccatacccatttggagttaggtctgccccctttgtcgtttctaccaaatcgccacttttcagcttgggtctgcattcatacattcgtgcattcatgaatcaaaaccactggatgaaaattgatacttgtcttcatgtctgggttccaaatgttgttcttgaaacaaattacaattctctggattcaatggaacctgcgaaagtcattgtagaaaaggaccaaagtgcttttgatgctacaatgttgtctgagattgatcgtaccgtgaagaaacatatggaaaatatgcttcatgttctggaaggtgttagtgcgcggttaacacaactagaaaccagaacccaccatcttgaaaattccgtggatgatttgaaggtatcggttggaaatagtcatggtagcactgatggaaaattgaggcagatggagaatagtcttcgagaggtacaatcaggggtgcagactatcaaggacaagcaagatattgtgcaagctcagctgcaactggcaaagctagaagtgtcaaagacggatccgcaatcagaaacacaaactagcacaattactgatcctgttcagcaagctgcatttgctcctgggcaaactcaaccacagcttcctacccctgcaaatcttccacaatcaatccctattgttcctccccctaatgcacctcctcaaccttccccacaacagggtttgccacctccagttcatcttccaaaccaattccctcaaaaccaaatcccagctgctcctcagagagatcaatacttcccaccaccggttcagtctcaggaaacaccaaatcagcaataccaacttccgttatctcagcagccacatgctcagcccggggcacctccgcatcagcaatatcaacagacccctcatcctcagtaccctcagccagcacctcatctacctcaacagcagccaccatcgcatccatccatgaatccgcctcaactacaatcttcactgggtcaccatgttgaggaaccaccttatcctcctcagaattatcctcccaatgtccgccagccaccatctccttcacccaccggtcctcctcctcctcctcaacagttctatgggaccccaacccatgcatatgaaccatcatcgagcagatctggttcaggctattcttctggatatggtacactatctggccctgtcgagcaatatcgttatggacctcctcagtatgctggcactcctgcactaaaaccacaacaactgccaactgcttcattggctccgagtagtggaagcggttaccctcagctcccaactgccagggtactcccacaagcaataccaactgcatctgcagtgagtggtggctcaggttctactggaactggaggcagggtttctgtcgatgatgtggttgacaaagttgctactatgggattccccagagaccatgtgagggccacggttcgcaagctgacagagaatggtcagtctgttgacctaaatgcagtgctggataagctcatgaatgatggtgaagtccaaccccctcgaggttggttcggtcggtag

SEQ ID NO: 89279 - DNA, 948 bp, Glycine max
  Peptide Sequence Number=SeqID_206057
atgtcagcgctggcggccaaaatcagccagcagttctgccgcaatctgcagaagacccgctatcaggtgagccagcagcagctgcgatggtccattcagagccagcaaaaagtgattgaagaccggctgcagacgtacgccagcggtgagagcaaagggctgtcgccaaaaggtgaatggacggatccggtggaaaccgaaggcgaacattacaccgtggtaagccagattgaggacgcccagacctgttttaacgtgaacaatttactggccgctgatccgacaccggcgacccagacggcgggcgcgctgccggaaaaaccggtcaaagagcgcatcgttgaacaactgctcgccgacagcgggatctccacgggggatgccgaagagatctaccagcaactgatggactatctcgatggcgataccacgacggttaaagaggggctggagacggatgcctgggctggcgtagagccagcgcggcagcccgcgaatcagatgatgcgcaccccgggcgagctaaagctgctgcccgcctttccggcggcggcctacggcaaagtcagtaaggtgctgtgcgtcttaccggacacggccagtaaggtggatgtgaatacattgaccgaagaacaggcgccgctactggccgcgctgttcatcggctcgctgactgaggatgaagccatccggcttatcgcctcccgcccggaagagggctgggagtcgatggaggcattcctgaaagcgcttgagacaaattatccgcagaccaaagacgccctcaagcaggttcaggcgttgcttgcggtgaacagtaactatttccgggtcaacagcaccggcaataccgatgatttaacgctgcgcgtcgtcagccagcttcatgttgataatgaagccgggaaggtgattacctggcaacgtcgctaccgaatggttgaataa

SEQ ID NO: 89280 - DNA, 474 bp, Glycine max
  Peptide Sequence Number=SeqID_206058
atgtgggacaaaggaactaagaccacaaactctaacagcttgattattggcaaactcatcaaggcttacatttgttttgtggcaaatgattatggtcataagagcaaatatttcactttaactaccccaaatagttggttcggagataaaaatggtaataatgtagatattgaggtgtatgatataggatccaatattgattctaagaagatactcgttatcattgaagacaatgtgaatcgggttgtcgcttcaagttcaacaatattaaattccaataatgtcactcaatcaacaagccatggtggaaaaaaaatttatagatatgtgcaaaattcaatacgtaaaaggccacgtaaatatggaaggaataatccacatgtttctcaagttgatggaatttctagcacatggcaatccctaagcaacacatgtagggtatacgcaaaaagggatgaacgcttcatgcaataa

SEQ ID NO: 89281 - DNA, 156 bp, Glycine max
  Peptide Sequence Number=SeqID_206059
atgacgttagaattcagcgggattctaagaaacagggacaaaggttggagagtgggatctgaagagcaagatgataacaatttcttggtaatgggaaaggtgcaacgatatggtaatttcttggatcacaagaactttggcacctcacgttcataa

SEQ ID NO: 89282 - DNA, 2346 bp, Glycine max
  Peptide Sequence Number=SeqID_206060
atggagctgaaagtttcatctccaaaacctgagtctgttgcaccgtctgattgcgccagtgatcctgaggaaaaggaagtgagtgatgatgatgatgatgatcggaatcacaagcatcgaaggagggaagctcgttctcaatctttggagagagatgtttcagatcctgttattagtaggccattcaaaaagcgtaacaaaaattttgggaataggcatccattcagggaaaatgaatctcaagcctttgaaacgctgaaaacttacagtgatgccaccacagataaagaattttacttcaagtttgatagaagacgccctggcttggcttcagctcctcgagcacctctggatatgagtcaaagactacgtgcaaaccaatcttttactggagatcctggtattggcaggggaagaggcagggaatctggtttttggaatcaacgtgagtctaggtttggttcaatggatgttgcttcacaagtggttccgcaggggtccattcctccaagcctttatgctggacgtgggttactcaatgtttcaaatgcacaaaatgcatcatggaatacatttggtttaataccagcggtgcccaatggtggcctagatatgcttcatccgatgggtttacaaggaacgctcagaccacctattaattcatctttgaatgtgaatattcctcgccaacgatgtagggattttgaggaacgtgggttttgccttagaggggacatgtgtcctatggagcacggtgttaatcggattgttattgaagatgttcagagtctttcacagttcaaccttcctgtttcacttccaagtgcacacctaatcggagctcctgctggatctggacctttacattcagtaaatgcttcgaccactttgatgaacaacaaatgtttacctggaaaaatttccaagtctgtagtcaatgatgatggtttgccattggatggtgtatataccggtcctggttgcacaagtggagctgatctttatgatcctgatcaaccgctttggaatgattgtggtctggagtcttcaaatgcactcctaactcttcagtcatccaagattgatgaatccgagcccatatctaatgatgctcccgatagtgattgcccagttggaactgccagaacttctgtcagttcacagggtactagttcatctgtctgggccagaattggtagttcaaaaaacagatttgacatgaaagaaaaaactaactctacaatgagttcctttaattatccagagaatcaattgaaggaagataacgatgaattagtcagtgctcacaatgcttcctttcaagtaaagcaaagcatagccgatgatgctgacccaaaagccttggaagcctctttgaaagcacaaactgatagtatgcgtaatatacgcaagtcatcacaaaaggcattgtgtactctatttgtaaatgggatacctcagaaaaataacaagagagaggctcttcttgctcattttaagaagtttggtgaagttattgacatttatattccattgaacagtgaacgggcttttgtgcaattctccaagagagaagaggctgaagctgctttgaaggcaccagatgctgtaatgggtaatcgttttatcaagctatggtgggctaatcgtgatagcattcgcaaagatagtactactagtgggaatggtgtgattgtaactccccgtgggcaagcacctgcttttgttccatctcatcctgttgtcactgataggggtaaagacatccatcaagctgatgcttcaaagactatgtatgaagtatcatcgcctactgatcaatctaagcctgtcatcacagatggacccaaggttccacctcctttgcagaagaagcttgtaaacttagagaatctaaaggaagaactgcgcaagaagcaggaaatgctagatcaaaagcgcaatgagttcaagcgccagttgaacaaatttgagaaacaagcttctggactcaagggtgaagtatctactgagcaagccgccaagaggctcaaaatgtgtgtgccatctgatgttgccaaactggcttcccctcaatcatcggatgctgatgttggcatggcatctccacacacagaggcagcagctgataagaataaacagctggtcaatcctgtatcccgaagtcctaaagcaagtacagcaacaagactgcaagaatctacaggcttgaagcatccaattcaaccactaatgcctgtaaatagatacaaattggacaatcgtcctgctgcattttgtatcattccacctttgccatctggtctagcaaatcacaacatgtgccgtcaatgttgtagtgtgtga

SEQ ID NO: 89283 - DNA, 309 bp, Glycine max
  Peptide Sequence Number=SeqID_206061
atggagaagggaaatgtcggaacttttgcgtttgaggatgaaagagatgaggctgacaatgttgttggagttttgggtaggaggaagaagggcattaaggctgttaaacaacatctatttcagcacttgcaaactaaggagttaggtcctttgcattgttttcttgggattgagataactcagtcaaggttaggaattgctatctctcaaaggaagcatgctctcgacattttggaggagataagcctcatagattgcaagctggtggatacccttgtcgatcctaatgtgaaacttttgccaaagtag

SEQ ID NO: 89284 - DNA, 237 bp, Glycine max
  Peptide Sequence Number=SeqID_206062
atggtttggagcttacggaaatggaaccaagtgaagatccccagtgtaccacaaggcaagtttcttctcccaaacaatcaccggaggccgagggcaatgcctgttgaggatctactaatggtcagatttgtacagcaaggttgcacggttgaaaatggagaacacgattgcggggttgaacacagtgacaacggtgaaacacaacgtgagggtgtatcggtggaattgagcgcatga

SEQ ID NO: 89285 - DNA, 1254 bp, Glycine max
  Peptide Sequence Number=SeqID_206063
atggagtcacccggtaacgagcatgtggtgggtggcgcagaacccaacgacgtcgttacgcccttttcccacagagaagaacctcacaattcccaacccctcaccggcgacggtgccagtcccggattagatgataacaatgttcttagatttggttctaataatttccctcgacccataatttgcagaaagatatttataggtggtttagcgagagaaacgaccattgcccaatttatcaagcactttggtaagtatggtgagatcacggattcagttatcatgaaggacaggaaaactgggcagcctcgtggattcgggtttataacatatgcggatccctctgtggtcgataaagtcattgaggaacctcatgtcatcaatggcaaacaagttgagattaagcggacgataccgaggggagctgttggctctaaggattttaggacaaagaaaatttttgtaggtggaattccttcaaatgtgactgaagttttacatatatatgagagtaatgtttacgatctgtcagagagatgcacttgtgcagatgaatttagagacttctttacacgctacggcgaagttaaagatcaccaaataatgcgggaccactccaccaaccgatctcgtggctttgggtttatcacatttgaatctgaagaagcagttgatgatcttctgtccatggggaacaaaattgactttgctggagctcaggtggaaatcaagaaggctgaaccaaagaagccaaactcagcacctccatcatccaagcgctataacgactctaggtcttcatacagcagtggtggatatggagatgcttatgatggatttggtggcagctttggaatggggggtggttataggtcaggtggtgcttatggtggtggtaggggtagtggtgcttatggtggctatgcaagtgaatttggtgggtatggaggatatgctggtgcgatggggccgtatagaggagatccctcccttgggtatgctggtcgttatggaggaagctttagcagagggtatgatcttggtgggtatggcggacctagtgagaattatggagcatatggggcaggtgggggttcttcgggtggtgctggtgctggtgccggtgccggtgcctaccaaagtggctatgatggaaacctgggagggggatatggaggggctagtggaggccccttctatgggagcactagaggaggatacagcgctggtcgatatcatccttatggaagataa

SEQ ID NO: 89286 - DNA, 615 bp, Glycine max
  Peptide Sequence Number=SeqID_206064
atggctgaggaggatatctatatgatgacatttcgtacttctcactgtcataacgagtacatagttatgtctttcagcctttgtaatgcattgtcgacattccaagccaccgtgaacgagttgatgaaaccattccttcgtcactttgtggttgttttcttcgacgacatcctcgtctatagaaattcatcaagggttatgcaaccattgttgcccctctcaattttcttcttcgaaaggattaatttcaatgtagtcccatggctcaacatgcctttgattgaagcccctgttctcgcattaccagatttcaaagagccttttatacttgaaactgatgcttcgaggtctgccatgggtgtcgtgcttatgcaaaagagccacctaattgcttttttcggcaaatataagtctaggtctagcaatgttgttgctgatgcgctctcgcgaattcctgcagacctctcagcagcatgttttactttgtctatgcctaattatgtgttcttggatcaactgcgagtttctcttcaagatcattctgattttgcagcgttacttactcacatgggtattacaaagactttacattgtttgcaaggcaattatttctag

SEQ ID NO: 89287 - DNA, 1800 bp, Glycine max
  misc_feature (716)..(716): n is a, c, g, or t
  Peptide Sequence Number=SeqID_206065
atggagtcacctgttaatggagtagattccttatcagaggttcagaattcagtttctggggtacatcatgatcttctttcatctgggactccccgtccttcacggcctcccttgagagcatctagaaaccatcaaaccaagaccatccaccatcaaaacagccatgtaattaatcaaaagcattcctatcaagagggaaacaatgtggagcatgaaaggttgccaacaaaattgtgcagcaagcatcaaccacttgatgattccaagaattgtgagtcaagtgatgtgttagaatctgacaattgcatcttagggccgtcaaaacgagttgtggctaatcatgcaaggagttactgccagtcagaggttactttctgtccaagtcctcagagtagtttctattcagccactgtctattcggaagcgaaacaaagtttcaccaacactgaggtcagtgagtgtgctagtgttgacaagtcttgtgtaagtggagaaatggcaaattcctgtgattttaatgagagcaggaagaccagcatctgtagagcaagtactggcagtgatgctagtgatgagagcagcaccagtagtttgagcagtgtcgtgtataaaccacacaaggccaatgacataagatgggaagcgattcaagctgtccgagctcgagatgggatgttggaaatgaggcatttcaggttgttgaagcaattggggtntggagacataggggtagtgtatctagttgaattgagtggcacaagaacttcttttgccatgaagatcatggacaagaccaagctggcgaatcgcaagaaggttctgaggtctcagaccgagagagagatattgcagtctttagatcacccttttctacccacattgtatacacactttgagacagagatattttcttgcttggtaatggagttctgccccggtggggacctgcatgcactcaggcaaagacaaccagggaagtatttttcggagcatgccgtcaggttttatgtggcagaagttctccttgctttggagtacttgcacatgcttgggatcatctaccgagacctcaaacctgagaatgtgttggtgagagaagatggtcacataatgctttcagattttgatctctctctaaggtgcactgtcagtccaactctagtaaagtcatcaattaacagcttggagacaaaaagctcaggatactgcattcagcctgcttgcattgagccaacttgtgtaatgcagccagactgcatccaaccagcatgcttcacgccacgctttctatccggaaaatccaagaaagacaaaaagttcaaaccaaagaatgacatgcatcaccaagtgacccctcttcctgagctaattgctgagccaacaaatgccagatcaatgtcctttgtggggacacacgagtacttggcgccggagatcatcaagggtgaagggcacggaagtgccgtggactggtggacatttgggatattcttgtatgagcttttgtttggcagaacaccattcaaagcctctacggtttccagaatctccgagggggagggtttgctgccaggggacttgatcaggggcttgcttgtgaaagagcctcagcatcgtcttgcctatagacgtggtgcgacagagataaaacagcatccattctttcagaatgttaactgggcactgatccgttgtgcaaatcctccagaggtgccaagacaggttatgaagcttgctcaaacggaaaaggagcttggtgtgaagccttcgggtaattatttagatattgatttcttttga

SEQ ID NO: 89288 - DNA, 2427 bp, Glycine max
  Peptide Sequence Number=SeqID_206066
atggcttatgtttcaattgcgatgaaaatttccatcacggatacaagtgtgcatctaggtgacactctttatttgggcctttcacccaacccgcctaatgatcataactcaactttggcccagatcaatttccactccctttcaggccaattagctctcgagaccttgtgtttattaggttatattgatgtgcatccagttgtgatcttagttgatgaggggagtacccataactttattcaagagccactagcacagttgttgggcctgtctacccgggccacaactcccctgagggtcatggtgggcaacaaccaacatcttgattgtcatcagctatgtgaggcggtttgcatctcaacccaagacatgtcgttcacagtggacttacatcttctgccgttaagtggtgctaatgtcgtattgggtgtacaatggttcaaggctctcgaccccattctcactgactataatgccctgtctatgaaatttttccataacgatcacctagttgagttaaaaggcaatgctgcatctacctttcacctactttcaccccctcaatttcgccgtttactccgaaaggatggtgctagtgcttatttccatatcgccatcacacccacagtgcttccttcaaaacccaaacttcccgaaattcaacttttcaccaccaaattcatctctatatttcaccctccccaatccttgcctccctcacgacccacaaaccaccacatccaccttcaacctaactcagaccccgttaatgcacacccataccacatgttgcaaaaagaactcattcgtcctagtactagtccattctcttcacctattctcttaatcaagaagcacgatggaacatggcacttatgtgttgattatcgggcactgaatgtgatgacgatcaaggatcattttcccattcccactatcgatgagttactagacgaattgggaggtgatgacgtttgcaaaattgcattttgcactcaccatggacattatgagttcaaggtgatgccctttgacttgtgcaatgcaccatctttgttccaagccactatgaatgccattttccgtccatacctccaccaattcattattgtcttttttgatgacatattgatctatattcgtaccatggaagattatttgcttcacttagagaaagtgtttgaggccatacatcaatggctcgtcccacaatccacatgggccctgcgtagcttcttgggtctcgccagattttactgtagattcattcgcgattatgcctccaccgtagctcctttgatcaaggtcaccacgaaggaccctttcgagtggtccgttgacgctcaacatgcttttcacatactcaaggaagctttgacttcggcttcagttctcctcttaccggattttacacttccatttactttggaaacagacgcattaggcattggaatgggcgtagtcctatctcaaaagggccacccaatcgcgatcttcagcaagacattcagtcacaaattactgcaagcatctacctatgtgtgtgaactgtttgcgataacgacgaccatgaaaaagtggcggcaatatcttttgagccatcgattcaccattctgactgatcaccagagcctcaaggatctcatgaccgaggtgattcaaactcctgaacagcaaatgtatctcacacggcttatgggctatgattactgcatccagtattgttctggtaccactaatgtagtggcaaatgcgttatcaaggattttgaacaacccaacgagtaccatgtttttattgctagtaccctgtttgacatttttagaagagctcaagaaacacttggcccgggaggacatttggttaccgcaagggcttcctttcattcaaacttttataatggagtatcattccacccctaccgatggccatataggggacgtggaatgcttcgtggcagcttgtatcgactgccaacatacaaaatataaaaccaagaaggtagcagggcttttatgccctttaccggtgccctatcgaccacgagaggatctttccttggacttcattactggcctacctccatttccaggcaatactactagttgttgtagatcgtttcttgaaaggcattcacctgggcatgctaccacaccaccatacttctcattcggtagaaatcttattcatggacattgtcgggaagcttcacagcataccgtgaagtctagtttcagattgagactttgggatggcctatttcccgaggatacgacgtgggaggattgggaacaacttcaagttgaatatcaccttgaggacaaggtgattttggaaggcaaaggggatgataacaaacaagaacaaccagtactggcccttgaagccagagtgccttttgctaagatgatcattgtcttgctatga

SEQ ID NO: 89289 - DNA, 796 bp, Glycine max
  Peptide Sequence Number=SeqID_206067
gcttggatctccgttggctactacgatcgccagctcaactttgtcactagcgattgctgcaaccgcatcagggcgcgtggcttttcttcttcgttgttccttagaaggctggtgggcctcatgtttggccttgaagaaggaagcatgggggagggtttttcgtttctcctcgacgtttggtgtaagcgcaaaggagggaggtgaggatgatgacaacaaagttcgaccaagacgaagaaagtccataggtttcaagttgggggagttcgaccacgatggtgccattgatgacaagggacatgggggaaatggagacaacaaagcacggtctgaaagaggtgcaagagatttggattcccctgctgacacgaaagacagagatagactcatgggaagacgcggagatgatgattacaagtggaaagatgagtgtgactccagaaaaagagatgaagacgatggctacagggggaaagatgagcaagactcaagaaaaagagatgaagatgatagctatagagaaaggcgaactagtcgagatgataggagaaacacggattctagccatttggagagaaggaatgaaggagattatagtaagagacctgaagacagtggaaagcaagatatgaagatggattatggacgaagaaaaggaagtccaggtgatgaagattacaagaatggaagggatgatgaagattacaaacatagaagggaagaacgtgggcataaaagacaagatattgtatctgatgattatcctcataggaggcatcatggtgacaggagatga

SEQ ID NO: 89290 - DNA, 1509 bp, Glycine max
  Peptide Sequence Number=SeqID_206068
atggccatgcttctgatctatgcagccataacagcatcattgttctgcttcctatacttgtttcatcgtagaagaagctgcaaacaccctctcatgagggactaccccatccttggcatgttaccaccaatcctcttcaacttgtggcgaatccatgatttttgcaccgaggtactgaaaaaacaaggtggcactggggaattcaaagggccatggttcaccaaaatgcactatttgatcacttgtgactccctcaacgtgcaacacatgctctgcaagagctttgacaactacatcaagggacccgagtttcgcgagattttcgaacccttcggagatggggttgtcactgccgattcagagacatggaagtacttcagaaccgtcctccattccttgatcaaacaaagaaggttcgaaacgttcgtcgataaaaccgttcagaagaaggtgcacacaagccttcttccgatattggatcatgtacaacagcaaggggagatggtggatcttcaagatgtcttcaaccggttcacgtttgataacatatgctccacaatcgtaggacatgatcctaagtgtctttccattgatttcccggaagttgcaatcgagagggctttcaatgagtccgaagagtcgatattctacagacacacggtgccaagcagtgtgtggaagtttcagaaatggctccaaattggacaagagaagaagatgacagaagcatgcaaaacctttgatgaattcatatactcatgcatagcgtccaagcgacaagagttaagcaagtgcagtagagaagaaatggataatgaagctccctttgacttgcttacagctttgattactgaagagagagggcgtgtgcatgatgacaagtttctaagggatgctgcgtttaacttttttgtggcggggagagaaaccatgacttcagctctcacgtggttcttttggcttgttactaaacaccctttggtggaagccaagattctggaagagataaaagataattttgaggctaattatgaaggggttgtaggaattgaggaggtaaaaaagctagtttatctgcatggtgcattgtgtgaagcattgaggctctttcctcctgtgcctattgagcggaagcaggcaattaaagatgacacacttccaagtggtcaccgtgtgaatggaaacacaatgatattgttttctttgtatgcaatgggaaggtgtgaagagatatgggggaaagattgcttggagttcaagccagagagatggatatctgagaggggagaggttgtttatgcaccagcttacaaattcattgcttttaatgctggacccagaatctgcttgggaaaggacttggcctttgttcagatgaagatggtggcagcttctattttgcgaaagtatcgattccaggtggtggaagggcattctcctactccaagccactccattgttcttctcatgaagaatggtctgaaggctaggattatgaaaagattataa

SEQ ID NO: 89291 - DNA, 1208 bp, Glycine max
  Peptide Sequence Number=SeqID_206069
gattacatattgatgactccaatctgatgaatctggtattgcttgaagttgaacagctgttacaggccaatcaaagatcacttaaagactatccttccatgtcatatcctgagaacgcaaatttactaacacatgcagacaacgacctcattttgtctgagctcaatttcaacaacgaagaacttagatcagaattcttgaaccttttttctcaaatgacagaccaacaagcaaaaatttataaccaaattattcaggctgtcaataaaaatgaaggtggaatgtttttcttatatggatatggaggaacaggaaaaacatttatttggaagacacttgcagcctcattaagagctgacaataaaatagttattatggttgcttctagcaacatagcttctttgttattgcctggaggaaaaacaacacattcaaaattaaaaattcttgttccgatatttgaagactcaacatgcaatattcatcaaggaacacaattggctgaattattgaatgaaacaagtcttatcatctgggatgaagcccccatggctcacaaattctgttttgaagcacttgatcaaagtctaagagatgttattaaggcaaaatcaagttctgataaaatctttggtggtaaagttatggtatttggtggagatttccggcagattctgccagtcattcttaagggtagtcggtctgacattgttaatgcaactataaattcatcttatctatggaatcattgtcatgttttgacactattgaaaaacatgcgtttagaaggcaatatagatgcaacagacagagaagaaacttcagcttttgcacagtggatccttgatattggtgatgggattgttgggcagcaaaatgatagtcatggttcaattgaaattccaaaagatctgttaatcacagaatatgatgacccactctatgcaatttttaattctacatttccaaatttatctcaccatcgtaacaatattggatactttcaatctacaacgatattagcttccacaaatgaaaccgtacaacaagttaatgattatatactatcattgatcctaggtgattataacatacctcatctaattctgattatatatcaatctggactgtatgtcattcttatgaaagattctgcaggattagttatcaaatctattcaatattttctctccataatgatcttctaa

SEQ ID NO: 89292 - DNA, 150 bp, Glycine max
  Peptide Sequence Number=SeqID_206070
atggctcgcgtgaggggaccaaagcttttgatgctccgccagccactccgtaaggtactgatcgaaactccccaggatagattaggcatcggacaaagcagcgctttccgcttgtcccgggctaggttaaggacgacgacctattggtag

SEQ ID NO: 89293 - DNA, 1689 bp, Glycine max
  Peptide Sequence Number=SeqID_206071
gtgatgcgacatcggtggtgttcatggctgacctcactgttcgcaagggggagggccgtttggtgccgggagcggacattgttcaggtatcaggcaggccttctctggaagactataaaggttcagatgcagccagggttcgtgctgcatctgagggcaatacagccctgcaattttacgaaaaacagccgagtggctgttataaaaaagttttagagcgccgggttacggctggtctggctattctcggtattcctgtgtcaggaaataaaaaaatcggaatgccagaatcaaaacgatctgtctccaccagattcattcctcagccaaatcatgattacgatatcgtcgtcactggctccgaatttggcggggatagcgtatcggtgagagatctggatccaggcgctaagatagttggatgggaaggcaatttctgcccctccgtcagcgtagcggtgtggtgcgccaggggcctggaagaaggcggagataaagggcgtttagcgaaacgcatcactgagagggaggcgaccgcaaagcgtcacgcagccgcagccttcataactgatcatgcacgtgaggagagcatcatgaaagcagttgtctataacggaccttttgacgtttcagtcaaagaggttccggatcccaaaatcgttcgccctaccgatgtgcttgtccgtattaccaccaccaatatctgcggttcggatctgcatatgtacgaaggacgcaccagcttcgaacagggtcgcatctttggccatgaaaatctggggcaggtcattgaaatcggcagcgcggttgagcgggtcaaagttggcgattatgtctgcctgccctttaatgtcggttgcggattctgtgaaaattgcgagaaagggttaaccggctattgcctgacggcaaatccgggtacggccggtgccgcctatggctttgctgaaatgggcgaatgggatggcggacaggcggagttactgcgtgtgccctatgctgactttaactgtctggtgctgccgccggatgcggttgaaaaagaggaggactacgttttactttccgacatcttccccaccggctggcatgccactgaactggcaggattgcgccccggagagagtgtggcgatttatggcgcaggcccggtcggcctgatggctgctcactcggccatgatcaaaggcgcatcgcaggtgtttgtggttgatacccatccggacagactggcgctggccgaacaactgggtgcagtagcgatcaatggtgtgggcgatgaggccgtcaacaaaattctcgagttaaccgacgggcgcggcacggattgcggttgcgagtgtgtgggatatcaatgctgcaataaacatggccacgaggataactctgccacgcttaacagccttgtcgcgtcaactaaggccacgggcggcatcggtgcggtcggcgtttttgttccgcaggatcccggaggcgcgaccgacctggccaaagagggtaaagtgcctttcgattttgggaatttctggttcaaaggtcagtcaatcaagaccggtcagtgtaatgtcaaagcatacaaccgccagctcgcaaggcttatccatcagggcagggccaatccggcgcagatcatctcccatcgtctcgcactggcagacgctgccgaaggctataagcattttgatgatc

SEQ ID NO: 89294 - DNA, 559 bp, Glycine max
  Peptide Sequence Number=SeqID_206072
atggttaagattgccgcctcgttctatatttcaatcaggcaacacatactattaaggacatcagtcatgctcacgcaacgcacgctcaaaacaacctttgctctgttgattggtttcgccgtttttgttgcaccggcttatgcaaaccctggcaatggcaatggcaatggcaatggcaatggcaatggcaatggcaatggcaatcacggtaataatggcgcgcacggaaataaagagcagggttacgcatcgtcgaaaaacgaacatggacatcgcaagaacgcccggcatcccgatcatgttcaatctgatatcagcttctctcaggcacgagcgctcgccgtcaactatggtttggtaggctatcaatctctgccgccgggaatcgctaagaaagtggcgcgtgggaaagcattgccaccgggtattgctaagaaaaatttgccagcatccatgataaatgcgctgcctcattaccccggctacgagtggcgcgcggtgggagatgatttagtgcttattgcgttgagcacagcagttgtgaccgccgtgattaacg

SEQ ID NO: 89295 - DNA, 282 bp, Glycine max
  Peptide Sequence Number=SeqID_206073
atgaagtcacaggtgcaaggggagctgatgtacggatggctttgcttgaactggctgccagcagaaccttcagcaccttatatcccaggctacgctcaccttgcttttacagttgaggatcttgatacgctgttgagcaaagcatcggactatggctggaagacgccgggtaaacctcagacagtgtattcaggaccgatgaagggaaccagagtaatatatttacaaagccctgatggtcagacgcttgaattaatggagcttagtcatttaagcccatag

SEQ ID NO: 89296 - DNA, 1089 bp, Glycine max
  Peptide Sequence Number=SeqID_206074
atggcgctgcagcacgttacctcggctcactctattgtcttcctcggtctgctacccatggcgacggctattttcggcgttgtcagaggaggcgaaaggcccaggctggctttctggattttttcagtcgccggcagcctgctggtgatgggatttgccctactccagaaaggttctgtatcagtaaccggcgatcttctgatgctggcttccgtgattgtgtgtggcctcggctatgccgaaggtgcaaagctttcgcgtgaattgggaggatggcaggttatctgctgggcactgattatgtccctgccgctgatgcttgttgccaccctggagaccttgccggagaacatgggcgaaataagcctgcaggcgtggctttcactgggatatgtatcgctgttcagtatgctgattggtttcattttctggtacaggggactggctgcgggcggcatcgccgctgtgggacaattacagttgctgcagccattctttggtctcggactttcagcaacgttactgtctgaaacggtaaggccgatgatgattctcataacactggccgtgatccttgaaccacaatatgcgacgatcagcctgattcttaataccggtacagttcatgctataaacgatgaaacttttcattcaccgacgattgagggaattttcatgtttgcggttgaggaaataaaaaagaagtatcctggcgcagatgcctggcaaatgggtgacagtgcggaactggccagcaagctggcggaactggtaaaaaaaggcatcaaaacagcttcctgcggatcgtttaccgcttaccagcaggaggagtctgctccgaagattgggagctataacattattcttgatgaagagtttgcccgcaaagaaggtgaaggcgatttaagtcttgaattctggcagaaagaacaccagcgcttttttagccgtgaaggtcatttttcagaagatatggagttgattgctgaagaatttgaagtggtggaagtgctgcacatttttgtagcggcgcaatttattgcgcgaagcattgatgggcacggtgctgctattagtaggcgcgattaa

SEQ ID NO: 89297 - DNA, 1632 bp, Glycine max
  Peptide Sequence Number=SeqID_206075
atggactttgctcacatttccatcacatctgcgcgaaaacctatgtacggtgcatgtgtggtttcagcgtgcatgttattcacaacaccctcattcgctgccaaaccttacgatatcgccgtggtggccaaagttaccggtattccgtggttcacacgcatggaagtcggcgtaaaagaagccgcacagaaactggatgtcaacgcctatcaggttggcgcctcgacgcccgatccggcgcagcaggtcaaggtgattgaagatctgattgccaaaaaagttgacgccatcattgtggtgccaaacgatgccaaagtactggagccggtactgaaaaaagcgcgcgaccagggcatcgtggtattaacccatgaatcgccggaccagcaaattggtcagtgggatgtcgaaaccatcgacagccagaaatatgcggaagccaatatggacgagcttgcaaaagatatgggtggcaaaggcggttatgccatttatgtcggctctttgaccgtgccattacataatgcgtgggccaatgcggcaatcaaatatcagaaagaaaaatacccggacatgcatgaagtcacgtcacgcctgccggtggcagaaaatattgataaatcatactccaccacgctggatttaatgaaaacctatcctgatctgaaagggatcatcggtttcggctcgctcggtccgatcggtgccggccaagcggttcagcagaagcgcgcgaaaaataagatcgcggttgtcggtatcgctatgccggctcaggctgcgccatatctgatgcgcggtgacatcaaaaaagtcctgctgtgggatccaaaagatgccggttacgccctggtttcggttgccgatcagctgctgcagggtaaagaagtcactaaagacctgagcattgaaggtctgggcaaagccgacgtcgatatggataagaaagatttgtcgttatttcccaatctgtcagtcgctgaaaatatcgttattcaccgctatttaccgggcggtgatttctgggtacatcgcgagtcaatgcgcaaaaaagcgctggcggcgatgcaacgggtcggcgttgctctggatccggatcgtaaagttgaaaagctgtcgatcgctgaccgccagttagtggcaatatgccgtgccatcgctgctgatgccagtctggtgattatggatgaaccgacagcgtcactgacccgcagcgaggtgaatggtctgctgcgggtggtgaatgaactcaaagctgccggtatctgcgtggtgttcgtcagtcaccgtctcgatgaagtgatggaagtggccgatcgtatcagcgtcatgcgcgacggcaaactgccatctgccgcaccgggcgcccgccgatgtgacgccactgctggaaatcagccagctgagccgcaaagggcagtatcacaatatttcgctgtcgctgcgccagggagaaatcacgtcgattatcggcctgctcgccagccggacagcggagagatccgcattaacggcaaggtggtgaaattccactctaaccgcgacgccattcgtcacggcatcgcctatgtgtcagaagaccggctgacgcaggggcttatcatggatcaatccatttatgacaacacgctg

SEQ ID NO: 89298 - DNA, 1509 bp, Glycine max
  Peptide Sequence Number=SeqID_206076
atggccagtacaccggcaattgaagcgcgtgaaaaagtcagaaaaaagggatccatttcccgcactgctatgcgtgttgcgggcaaagagccactgaagatgatcacgccggtcagcccgttcagccaacctgatttcaggccagaatgtgtattttttaccctgatacaattcatgaaagctcgatacaaagtcatcgtggatgaattcgcttccgcgatacgaacaggcgcgctcctgccgggcgcccgcctgcctacccacagagcgctgtcggctgaaaagcacgtgtcactggcaacggctacccgcgtttacgctgagctggaagccatggggctggtgagcggagaaaccggaagaggaacatttgtcagggaaatttcgctgcccgctgggctgggtctggatcagtacgcagtggcgtctgacgtgctcgatctgaacttcaactatcctacgctaccggaccaggcggaacggttacgccaggcaatgcgacagctggccacatctggcgatctggcttcactgttgcgttaccagccgcacgctggcaggcaaagcgacagggagacaatcgcgttatggctcaatgcctccggcatgaccgcgtctgctgatgaggttttgattgtaaatggcgcgcagcacggtcttagcgttgctgttatggggctgctgaaacccggggatgtggtggctgtagatgctctgacctatcctggcttcaaagccctggccagcctctatcatctggaactggtggcgatacccactgatgccagtggaccggacctgacggcattcaggcaaatctgccaacgccggcgcctgcgcgcggtatataccatgccaacactgcataacccgcttggctgggttatgaatgatgcccagcgcagggagctggcccggattgccagaacgttcgatctgcttatcatcgaagacgcggcctatgcatttcttgtccgtcgtccaccgccgccgcttgccacttatgcgcccgaaagaaccgtttatgttaccggttttgctaaaagcgttgccactggcctgcgcgtcggtgctgtggtgtgtcccgctgaaatgcgaattgccctggagcgagccatcagggcaacgacctggaatactccctccctcatggtttcgattgtctgcgactggattaaagatggcacacttaaacgctttgaggcgctgaaaagacgggacgcgcgtcagcggcaggcgctggcgcgcaaaatacttgtgaacagtgaatgggtaagccatgccaacgcttactttatctggttatcactgcctcaggaagtgagggctgacaggcttgtacatcgattgatgcagcaacatatctctgtttccacagcagaacccttcagcacctcaaactgtgtgccgcatgctattcgtctggctcttggctcagtcacgatgaatcagctgagcgaggccctggcgaaaattaaagaggctattgagtatgagattgatctttga

SEQ ID NO: 89299 - DNA, 297 bp, Glycine max
  Peptide Sequence Number=SeqID_206077
atgtctggacccataatcgatgaagtcacaggtgcaaggggagctgatgtacggatggctttgcttgaactggctgagcagccagcagaaccttcagcaccttatatcccaggctacgctcaccttgcttttacagttgaagatcttgatacactgttgagcaaagcatcggactatggctggaagacgccgggtaaacctcagacagtgttgtcaggccccatgaagggaaccagagtaatatatttacaaagccctgatggtcagacgcttgaattaatggagcttagtcattga

SEQ ID NO: 89300 - DNA, 249 bp, Glycine max
  Peptide Sequence Number=SeqID_206078
atgaggaaaagattgtttggagttcaaaacagaaagatggatctcagagaaaggaggaccccgaacttgcttggggaaagacttgtccttcattcaaatgaagctggtggcagctgctattttgcagaaggtttgaggagcaagaacgagattgagttcgaaatggaaatgttgtggttgtacatggtggtggggtggcatgatgtgatgacaacgatggggtgtcgcaatagggttttcaagatttga

SEQ ID NO: 89301 - DNA, 606 bp, Glycine max
  Peptide Sequence Number=SeqID_206079
atgcagccgcaggatgttcagaccgagacgcgatgcggcgtcacggttgctgcccatggcgtaaatctggcggcccacgcgggtgcgattcatcaggacgccggtaacgatgatcactcccagcaggcaaagcagcggcagggtcaggccatagtcgtaaccgtcggcggcggtgaacgagaaccagctgatcccgttcataaaccagtcggggaaaccgtacaaccaggtgccgttagtcagatacaccagcaaaccgtaaaacaggttcagcgtcgcgatggtgataatgatggccggcacgcgcagccagtacaccagaaaaccgttgaccaggccgagcagcaacccaatccccatcgacatggcaaacgccagcggaaagctgccgccgtgatgaatgatgtagctcgccatcacgtactgaccgatggaggtgacggcgggaaaggagatgtcgatgccgccggcaatcagcaccacaaacagaccacaggccagaatgcccagaatggcatagctggtggcgacgtctgtcaggttacccagcgtcataaattcactgctgctggcgctcagccccaccaccagcagcagcaccagtaa

SEQ ID NO: 89302 - DNA, 466 bp, Glycine max
  Peptide Sequence Number=SeqID_206080
atgacgacgttaaaccgattcttcccccggcgaccgcatcatccgtttgcagttgctaatcattgtggccgttgccgtgctgttttcctttacgctgggtggcagtttttacagcgtcggcaatttccagtcgatctcctcgcagttaccgattctgggcatgctggcgctggggatgggcattaccatgctgaccggcgggatcaacctttcgatcattgccggtgccaacgcgtgttcgctggtgatggcggcgattctggtggcgcatccgaaccagccggaatatgtcgcgctggcgctgcttgcgggtctggcggtggcgctggtgattggggtgctcaatggcgcgctgatcgcctttatcggggtttcaccaattctggcgacgctcggcaccatgacgctgatcgccgggctgaatattctgctgaccaacggcgcggtcatttccggtttcccgccg

SEQ ID NO: 89303 - DNA, 552 bp, Glycine max
  Peptide Sequence Number=SeqID_206081
atggcgggagaacccgagaatattgccttcctgaccaaagacattcatatgctgccttatttccatggcaaccgctcaccgcgtgccaatccgaccctgaccggcacgctgactggcctgaaactgtcacgcacgccggaagacatggcgctgcattatctcgccaccattcaggcgctggcgcttggcactcgccacattattgagaccatgaaccagagtggttactgcattgataccattatggccagcgggggcggcaccaaaaatcccatctttgtgcaggaacattccaacgcgacgggctgcgcaatgctgttaccggaagagagtgaagccatgttgctcggcagcgccatgatgggcaccgtggcggcgggtgcgtacgactctttacccgaagcgatggccgccatgagccgcatcggtaagaccatcacgccgcagaccaacaaaatcaaagagtattacgaccgtaaataccgtgtattccatgagatgtaccacgacagcatgaaataccggcagctgatgcagggaaaagtcgaataa

SEQ ID NO: 89304 - DNA, 525 bp, Glycine max
  Peptide Sequence Number=SeqID_206082
atgaaactgaccgataacaccatcttcatcacgggcggcacttctggcatcggccgcgcaatggcagaaaaatttcatcagctgggcaaccaggtgattatctccggacgccgcgaggcgctgctgcaggaagtcaccgccgccagtccgggcatggactatgtagtgctggacgtcacgcgcgccgacagcattcaggccgcagcacaccacgtgctggaacgctatccggccctgaacgtggtcatcaataatgctggcatcatgccgtttgacaacgcggcgggcgaactggatgacgcgcaggcggtgacgctactgaacaccaacattctgggcccggtgcgcgtcagtgcggcctttatcgaacaccttaagcagcagccggacgcggtgctgattaacaacagctcggtgctggccttcctgccgctggcgaccaacgcgctttactcggccaccaaggccgcgattcactcctataccctgtcgcagcgcttcctgctgcgtgataccggcgtgcag

SEQ ID NO: 89305 - DNA, 1095 bp, Glycine max
  Peptide Sequence Number=SeqID_206083
atggccgcctgtttaaaaccctatgcctggcgaactgcccgatcgggtactcttaacataaaacggcgcagaagatccgcagcaggtgataccgctgaacgaaatcgggccggacacagtgtggcagacggtgccggacgactgaaggagacgatgatgcaccgggtaggtttactgatttccgatcatttccaggttctgggattatccacgctgagcatttttgagtttgccaatcaggtaaacggcgaaccgttttaccactgcacggtttattcagagcgcggtggcgcggtgcagtcctcttccggcttcggcgtcgacagccagccgatccatacagatatggaaatggatacctggctggtcgcaggtgtaatgacaccgctggagttgccggccacagcgggcatcgttgattttctgcaggtgcaggcgccccgggcccgccgggtggccgggatctgtaccggcgcattcgtgctggggcaggccggtctgttatcggagcgccgcgccactacgcactgggtacatgcccagagtctgcaactgctgcacccgacgacgcggatagaagaagaccgcatcttcattattgacgatcacatctggacctcggcgggactcaccgccggactggatatggcgctgggaatggtggagaaagatctcggtgccgaagtggcgcgcagcgtggcgcacctgctggtcatgcatcaccgccgctccggcggacagacgcagcactctgagatgctgatgctctctccgcgcagcgaccggctgcagtcggcgctggaatatgcgcgcaacaatctcagcaaagcgctgaccatcgaagaccttgcggatgcggttcacctcagcgcgcggcagctcagccgcctgttccgttctgagacgggcaagtcgccggccaaagctattgagggattacgactggaaaacgcccgcttgctgatcgagcagagcaggctgccgatggaggtgatagcccgtgaatccggcttccgcgatcgccgccatatgcgggaagtgttcattcgcggttacggcatcccgccgcagtcgctgcgcaccggtaaagcctga

SEQ ID NO: 89306 - DNA, 816 bp, Glycine max
  Peptide Sequence Number=SeqID_206084
atgacgcagcagacacacaccaaccgcggcactgccgttgtcaccggtgcctctaccggtatgggcgcactgtacgccggccgcctggcacgcatgggctatgacctgatcatcgtggcccgcaatcacaaccgcctgaaccagctggctgaacacatcaccaccgacagcggccgcagcgtggaagtcatcaccgcggacctggccgatgccgcacagctgaacgcgctggaagagaagctgcgtcaggacgcgagcattacgctgctggtgaataacgccggcatcggcacccataccccattgctggacagcgacgtggcgcagatgaacgccatgattaatctcaacgttatcgcgctgacccgcctgacctatgcgctggtgccaggcatggtggcgcgcggacgcggcgccatcatcaacatcgcctctattgtcagcattgcgcctgagctgctgaatggtgtctacggcggcagcaaggcttacgtgctggcgttcagtcagtcgctgcaccatgaactggccggtaaggggattcaggtgcaggccgtactgcctggcgctaccgcgacgccgttctgggataacggcggtctgccggttgaccagcttgacccgaacatcgtcatgagcgcgcaggagatggttgatgcggcgctcaccggcttcgcccgcggcgagctcgttaccattccgtccctgcaggacgaagcgctctggacccgctatgagcaggcgcgtcaggccatgatgccgcacctcggcagcgacgcgccggctgaacgctatcggcccgtctctgtgcactga

SEQ ID NO: 89307 - DNA, 1023 bp, Glycine max
  Peptide Sequence Number=SeqID_206085
atgccgttgaacatatttcaggacaaagatggattgccacggattatattgactgagccaaagggttcatcagctgaggattttgagaaagtttttcatattctggacttcattaataatctatggccatctgaagcagtgagtgctaacatcttattagatcttctgagtacagaatctatgcttaggcaggttcttctttatggagggcagattatttcttggaagaatcatcgaaaggaagaacttctttttatgagcagtaaggctaacaagaaacagcataaagcaatcagaggaggaatatcagcttgcctagcacggtttggtgatctcagttcacttgaacaacatggatttgcaagaaacaggatgtggtcattggatagggacccttcacctcttcctcccttagacaatcagtcatctgtggatctaatattgaagtcaacagaagttgacttaaagacaccctgtagttttgagttccggcttcgcatctctctcaatgctggcaagctaattttgattccacgagtcagaaacactgctaacaaagcgttttctttttcctttacactatgcaactatttatctgtatcagatatcagtgaagtgcgtattgagggattggagacactggattactttgacaatctgttgaacagatcaaggttcacagagcaggcagatgcactcacttttgatggagagagtgcagtggtatggaatccctggggtaagaaggccaaggctatccctgatttgggagatgatgattacaagatcatgatgtgtgtgaattctgcagctatcgatacccctattctcttgaagccctctgaagagtggatgggatatcaggaactctctacggtttcatcaagctattgcagtggacaattggatcctcgcaagaaaggtcatatcttgaaagcctcacaagggatgcgacgggcttgcggaggacaaagcgaagtaaccatggaagggtgctttgatggtgaaagtgctgagacatga

SEQ ID NO: 89308 - DNA, 2384 bp, Glycine max
  Peptide Sequence Number=SeqID_206086
gggcaagtaatgaagttcatccagctttgatgaacactgatttactttctagagaagcagattgtatctctcttctcctaagtttgttggaagaggatgatttctatgtacgatattatactctgcaactattgactgcccttctcaccaattctccacagaggttacaggaagcaatattgactatccctcgtggtataactcgactaatggacatgcttatggatcgtgaggtaataaggaatgaggcattattgcttcttactcatctgacccgtgaagctgaggagattcaaaaaattgtcgtctttgaaggtgcatttgagaagattttcagtatcataagagaggagggaaattcagatggtggtgttgtggtacaggactgccttgaactgttgaacaatttgcttcgtagcaatgcatccaatcaggtactactaagagagactgtaggacttgactcattgatattgattttgaagctgagaggaagtagtttcacttttaatcaacaaaagggaggttctgagtctgatcctgggaaagatatgaataaacagacaaataagactactctggttcagaaaaagatattggaccatttgttaatattaggggttgaaagccaatgggtacctgttcctgttcgctgtgcggcaatgcgatgcattggtgatttgattgctggagattcaaagaatcgtgatcttcttgctagcaaagttcttggagaggagccacacgttgaacctgctctgaactctatacttagaatccttttgagaacttctagcatgcaagagttcattgctgctgattatattttcaaaagcttttgtgagaaaaatgctgatggccaatcaatgctggcgtctacgctaattccacagccatattccatgaatcatgcattcctcgaggaggatgtcaatatgtcttttggcagcatgctattacacagtcttactttgggtgaaaatggtgatcttgagacttgttgcagagctgctagtgttctatctcatatgttgaaggaccatctccaatgcaaggaaagggttttaagaattgaaattgaggcagcacccatgcaatctttaggagctccagagccactaatgcatcgaatggtgaaatatttggctgttgcttcttccatgaaattccatgatggaaagtctagtacatcaggaaactcttatgttcaggccattatcttgaaattactgattacctggctagcagattgccccagtgcagtgcactgcttcctagatgctcgcccccaccttacttatcttcttgagctggtatcaaattcttctgaaacagtgtgtataaggggttttgcggcagttgtcttgggtgaatgtgtgatctataacaaatccactgaccgtggaaaagatgcatttgccattgttgacacaataagtcagaaaattgggcttagttcatactttttaaaatttgatgagatgcagaaaagttccattttttctagtttggagtcatccctgacccacagatcattcgctagatcttcagcagctagcatggcagatatagaagatgtagatgggaatgatttgtcagaaaagaaaaatctggaccatccaattctatcttcaatcttggattctaacttcatgaaccttgtcaaaagtctagaggcagatattagagaacagattgtggaggtttatagccgtccaaaaatgaaggtggcagtagtgccagcagaattagagcagaggagtggtgaaagtgatgctgagtatataaagcggctgaaggtttttgttgagaaacagtgctctgagatacaggatcttgttcttcgaaatgcttctatggctgaggacctggctaagacaggtagtactttgcagcctgagcaaagagtgagtgggggctcagatagagtcccaattgagacactgcatagagatctccaagaagcatctcaaagattggagatgcttaaggcagaaaaggctaaagttgaatctgaggcgataatgtatcggaatttagctggaaagacagaagctgatctaaggagtctgtctgatgcctacaatagtctggagcaatctaacttgctactggagaatgaggtgaaagcactgaagagagaagggcactcaacattcccagatgtggatgcaataaaagctgaagcaagggaagaagcacagaaggagagtgagggtgagctgaatgatctgcttgtttgccttgggcaagaacaaagcaaggtagaaagacttagtgctagattgttggagttgggagaggatgttgacatactgcttgaaggcattggtgatgatgctggggctgctgaagatggtgaagatgaggaagatgatgaataa

SEQ ID NO: 89309 - DNA, 255 bp, Glycine max
  Peptide Sequence Number=SeqID_206087
atggatttgatgtctggttataagggggttgttgggcttcttgttggcaacgagaattcctcaaatgaagatagatatgttgagcgcttgcttgaccggataagcaatggtaaactaccagaggacaggagaaatgctattactgagcttcaggctgttgtctcagaaagtcaagctttccagttagcatttggggcaatgggctttcctataatgctaagtgtcttgaaggaagaacgtgatgatgttgagatg

SEQ ID NO: 89310 - DNA, 1161 bp, Glycine max
  Peptide Sequence Number=SeqID_206088
atgtctactatgtctgaagggtattataattccaagaagagtggtgatatatatggccagcagggaactcgcgcagcattgagcatgtcaaggcttcgttgcattctgcgagggttgaatttcaagacctatatgtttttgtttcttgttgttccaatgggaatcttcagtctgtattttcatgggctgaaaatctcatactttctgagacccctgtgggaatctcctccaaagcccttccatgaaatccctcattattatcatgagaatgtgtcaatggagaccttgtgcagacttcatggttggagaattcgcgaatcgccaagacgagtctttgatgctgtcttgtttagcaatgaagttgacatcctcaccattcgctggaaagaaatgtatccatatgtgacacattatgtgatcctcgaatcaaactcaacatttacaggattgcccaagccgtcgattttcgcaagcaatagggacaattttaggtttgttgagtctcggttaacgtatgggatgattggaggaagatttaagaaaggtgagaatccttttgttgaagaggcataccaaagagtagccttggaccggcttttaaagatagcaggaatagaagatgacgatctcttgataatgtctgatgttgatgagattccttgtgctcacacaattaacctcttgaggtggtgcaatggtatccctcctgttcttcaccttcaaatgaggaattacttgtactcgttcgagttctttctagacaaccaaagttggagagcgtcaatacatagataccagactggcaagacacgttatgcacactataggcaggctgatgtcttgttggcagatgctggatggcattgtagcttctgtttccgccgtataagtgaattcgtattcaagatgaaagcttacagccataacgatcgggtgaggttcgcgcattacttgaactgtaacaggattcaggatgtgatatgcaaaggggatgacctatttgacatgctccctgaagagtacacatttaaggatattattgggaagttgggacctattcctcattcttattcagcggttcatcttccatcatatttgttgaataatgcagagaaatacaagttcttgttgcctggtaactgcagaagagaaagtggctga

SEQ ID NO: 89311 - DNA, 327 bp, Glycine max
  Peptide Sequence Number=SeqID_206089
atggtaaagtttcttgtgaagttacaaaccaactttcgagaagatccaacggttaacgaaggctgggaaacgtttctaccgaggcagcttcatttagtttcctccagaagcttcattaagaggcttctagcatactccggacaacttctcaacgatcccaacggtcagatcatggaaaagtgttttgtgaagttgcagaccaaatttcgagaagatccaacggttaatgaaggctggaaagcgtttttaccgaggcagctacatgtagctttctctagaagcttcattaagaggcttcctccagaagcttcctcgtggcttctttga

SEQ ID NO: 89312 - DNA, 1827 bp, Glycine max
  Peptide Sequence Number=SeqID_206090
atgtcaacttccaaaggtaggagtatgcgcagcaaggtggaaaggcgaatgcagaaagagtctggtaagactttaagggagattcggagagcgaaaaagttgaagaagaaactcatgactgaggaggagaggctcatttacaatctcaagagagccaagaagaaagtggcattgcttctacagaaactcaagaagtatgagctaccggagctgcctcatcctcggcatgacccagagctcttaacacctgaacagctacaggcgtataaaaaaattggattcaggaataagaactatgtcccagttggtgttcgtggtgtctttggaggagttgtacaaaatatgcatctccattggaagtttcatgagactgtgcaagtttgttgtgacaacttccccaaggaaaaaataaaagaaatggcttcaatgcttgcaagattgagtggtggaattgtgataaatgttcataatgtgaaaacaatcattatgttccgcggcagaaattatcgccaacccaaaaatttgatacctattaacacccttacaaagaggaaggtaggcttgcattgctatattccttatttgactgtgccactttctgggtatctaaacagaggtgatgctttgcatgctcttttcaaggccagatttgagcaagctcttgagtctcagaagctaaacataaagaaaatagaacagcagcttcgacggatgggagtaaatcccgaggatccagctgccatggccagcatccagagagttgcttccacattcttcaatgccatagaccagaaagaaggaagcccttatgtcttccgtgaaggcaagcagtcaataacagaacctgctgaaggttttgaagagtcagagcctatagctgatagtgatcaggaagagctagatcggttcattgctgagatagaggatgcagcagataaagaatatgaagctgaagaggcaaaagaaaaagaagagtttggaagaattagatactggaacaaagaagaatttggtggaagatacagaagatcagatgcttctacaaatgatgaccgtgatgttgaggctagaggctcaagggtttggcagactacacatcctaagcgccatgctgtcgatagtgatgatgaagagaacactcattctgacaatgacgatgatgatgaggaggaggagtggcatttcaataatagtgcagatgctagtgatcttgacagcaattctgaaggatctgatggaactagacgtaggttcaaggaaagtaggaggaaaagagagaagcagaataatcctggtattggtcgggccagagataacgaaagttcaagtagacatgctggagctaaatttagggggaatatgactgtagaagattctgaatcagaaggcatgcttagtgatgttgaaaatgcaatgtgggagtctgaggatgaggagcaagagaataacgactcaggatatttgagaaagttaagtgatagctacaagagtagtagcagtgacgatgagtatgcacatcaaacaatgagcaacaagaagagtggtgcgagggatcatgagggtaaggttggtggttctgctcaatatcatgatagttttgatgcaccaaagagtgtgagaggaaagaagcatggagttaataaaattgattctgaatccatagatgaatttagctgttcagaaaactggctgtggccttcagatgctgctgaggagactggggactaccctacaaatcaaaatagtaataatgtgatcaaaagtgatatccctaagagtcagaggagaacactaaaagaggcagatgaggcttgggacagtgactag

SEQ ID NO: 89313 - DNA, 909 bp, Glycine max
  Peptide Sequence Number=SeqID_206091
atggcttgggaagcaagtagccacagaggtggtaataaggtaatttaccacagtgtctctgtttcgctcggttttcggggtgacaagacagcttctgtttcgcaaaggagctggcttattgacattagaggatttgcaaagaaagtgaaagatactactctgtcaacagatgatcaaatgaaggactgtggaacatacagcgaatgcccgaaatgtcattatcatattgataacagtaatgtttctcatgagtggcctggctttcctgttggtgtaaagtttgatccttctgatgttgagcttttagagcatttagcagcaaagtgctgtattggaaacagagagccacacatgtttattcatcagttcatcccaactctagaaggagagcaaggtatttgctacactcatccacaaaatcttccaggtgctaagacggatgggagtagtgtccatttctttcacaaaacagctaatgcatatgctactggacgaaggaagcgtcgaaagattcatcatcaagatggtttgactgaggagcatgtacgctggcacaagactggtaggaccaaagctgtgacagaagatggagtgcataagggttttaagaagatcatggttctttatataagatctaagaaagggaccaagccatataaaaccaattgggtgatgcatcagtaccatctagggagtgaagttgagaaggatggtgaatatgtggtttcaaaaatattttatcaacagcataagcagaatgagaagaatgaggagaatacaatggttgaagattctaacgtagcagcacaagcaggtccaagaaccccaaaaccaaatccccctactcgaccttgtacagccaaatgtgatgacaattttgatgaaaatgaacttctgccattcatccag

SEQ ID NO: 89314 - DNA, 510 bp, Glycine max
  Peptide Sequence Number=SeqID_206092
atgggatctgggaatgagtggctggtagatccgaaacaactatttattggtccaaaaattggggagggtgctcatgccaaagtatatgaaggaaaatataaaaatcagaatgttgctgttaagattatcaacaagggagaaactccggaagagatttcaaggagagaggctcggtttgccagagaggttgctatgttgtcgagagttcaacacaaaaatctgtttattagggcctgcaaagaacctgttatggttatagttactgaacttcaattaggtgggacattgcgcaaatatctcttgaatatgcgtccaaagtgcttggatatgcctgtggctgttggatttgctcttgatattgcccgagcaatggaatgtttacactctcatgggatcattcaccgcgatcttaaacccgataacttgatcttgacagacgatcataagacagtcaaacttgctgattttggtctagccagagaagagtccttgacagatgatgactgctga

SEQ ID NO: 89315 - DNA, 177 bp, Glycine max
  Peptide Sequence Number=SeqID_206093
atgtcattgcctagcgctgttcatgtgtcctccattatcaagcgcggagcctccggtgactgggaaaaaaaagaaggagtagagacgaaagtcgtcatgagactaatcacggaaagggcaggacgaacaaaatcagtgtcttatctttgctttcctcatatctccggtaagaggtaa

SEQ ID NO: 89316 - DNA, 243 bp, Glycine max
  Peptide Sequence Number=SeqID_206094
atggatcaacctggtgaggaaagaaagtggcaactgagtgagttagatgaaatccacctagaagcttacgagaatgccaagttctccaaagaaaagaccaagaagttccatgataacatgatagttaagaaggatttcatggtggggcaaaaagtgttattgtataattttaggctgggactcatgagggatcaaaagcgactccccaaacaagagcttcaaggccaatggacatcgacttaa

SEQ ID NO: 89317 - DNA, 491 bp, Glycine max
  Peptide Sequence Number=SeqID_206095
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataatttgcgtcgttgtgcctggactgtgagggctctcagccacatggatagtttaatgtgctcatcggcgcctgaccctgagatgtggatcatccaaggcacattagcatggcgtacttctcctgtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggg

SEQ ID NO: 89318 - DNA, 303 bp, Glycine max
  Peptide Sequence Number=SeqID_206096
atggataagcggcatgaaaataacatgcaatatgatctcattcataaaatcaatctatatgaatatctgaacaacataaggcatatatacaacataaatgggactcccactaagctaagtaaagaactgttgagtgtggaagcaatgcttcccaagattattttgatgatgccaaagactcaattcaagaatcaagagtcaagcaagtttcaagaatcaaagagtcgttcaatcaaagcaagtttcaaaaatcaaagagtcgttcaatcaagattcaagattcaagattcaagattcaagtaa

SEQ ID NO: 89319 - DNA, 207 bp, Glycine max
  Peptide Sequence Number=SeqID_206097
atggatgaaagaagcttcctttctgcacagtacccaagctctaagcttctccaatggtggtttcttggagaagaggaagtttatgagaggtttttggtgactctcttgcttctttctttctgcacttcggcttctactaagtacacctacctctcttatacatcaaaaactcattcctttaagttcaaacaccccaaaactcactaa

SEQ ID NO: 89320 - DNA, 945 bp, Glycine max
  Peptide Sequence Number=SeqID_206098
atgaccacagtaagacttgtgttatcactcgctgcttctcagggttggcatctccatcaacttgatgtcaacactgcctttttgcatggtgatttgaatgaggagagatctttgtatggcttaaagcaagccagcggacaatggaatgccaagcttacttctaccttacttgattcaggattccaacaatccaagacagattattctcttttcactaaaaggtctcccactagcctcactgttatccttgtttatgttgatgacttggtgcttcctggcactgatcttgctaaaatccaacaattgaagcactctctggatgcaaaattcagcattaaagagcttggaatgctcaagtacttccttggttttgaagtagcccgatccaactcaggtattgccttgtatcaaagaaaatattgccttgatcttctacaagacactggtctgcttgctgccaagccctgtttcacacctatggatctcacactgaaacttcacaaatcctctggtgtccctctctctgatccaactgtttacaaaagacttgtggggcgattattgtatcttactcacacaaggcctaatatttgctatgtcgttggaggattgagccaatatttacaatatgcaacagatattcatatgcaagctgcacaacatactctcaaatatctcaaaggaaatgctggaaaatgcctgtttttctcctcttcatcttccacttctttaactggcttcagtgactcagattggggagcttgtcttgacgcccgaagatccataacagttgttctatattgtgataatcaagctgccctgcacatagcagcaaaccctgtattccatgaatgcaccaaacatatagaaatagattgtcatgtggtaagagataaagttcaatccaacatgattcaccttcttcccatctcaactcatgagtaa

SEQ ID NO: 89321 - DNA, 298 bp, Glycine max
  Peptide Sequence Number=SeqID_206099
atggatccattagctttgaacttgactttgaaaacccatttgcagccaattggctttttattgggaggtaaaggagtaagttgccagttcaaaataggatacctgatggtagaggagattggagagtctgaattggagagggttaaggtgaggttgattaatggtgtggatcaagtggatggtttgatattggtatctcaagtggggaagggtctggtggatgaggcatatcaagcaaacaatcagatggagatgatggaggaagacttaataggctgtgtggagtcagcagatagtg

SEQ ID NO: 89322 - DNA, 792 bp, Glycine max
  Peptide Sequence Number=SeqID_206100
atggctaaaaaagatgttgtcaataatgcagctcttacaaacttgttgaatccctattatactcatccaaatgagaatcccggtgtggcaattattgttcaagttcttagtggtggaaattaccactcatggtcatgtgctatgcttcttgctttgaagaccaagaaaaagatccaatttatggatggttctttgcctcgtcctgctcttcatgatcccaatttcgctctatgggatcattgtaataccttggtggtttcatggcttcatcattctcttgatccagaaatcttgcaaaccatcatgtggatggagaatgcatcagatagctggaatactctcaagaaacattattaccaaggagatgtatttcggatcagtgacttacaagaagaaatttatctgcttaaacaaggtgatgccaatatcactacttactttacaaaattgaaaggtgattatgtgattagattcttaaggggcctcaatgaccaatactctacagtaaggtcaaatataatgatgatggaccccctccctgatttagacaaagttttctctatcatcattcaacaagaaaggcaactggttcttcaatttgatgattctagagttttagctcaattggataccaacaatggtacttatggtagaggcagaggttgtggaggccatacatcaggtggaagaggtagagatagaagcacaaaaatatgcatttattgtaacaaatcaggtcatatggtagacacttgctacaagaacacatggttatcctcctcacttgcatag

SEQ ID NO: 89323 - DNA, 138 bp, Glycine max
  Peptide Sequence Number=SeqID_206101
caagcaggggttgttctcgttcttcaacttgccaaggttgctcaacttgttactgtgaagggtgcatcgagtgccactttgaggattgcaattgccaagaatgcagagactttatgctatatgttgaaccttaattag

SEQ ID NO: 89324 - DNA, 195 bp, Glycine max
  Peptide Sequence Number=SeqID_206102
atgggctcagaaatctaccctaaggagtccaactaccctctgttagggggagacacctctaacgctggtaatgattatgctgcaaatgctggagctgatggtgattatgttgcggacatcgcaactgctcaaagagcttgggatccaagaccaactcaggatagaggcccacttttgatcaagactttaatttag

SEQ ID NO: 89325 - DNA, 210 bp, Glycine max
  Peptide Sequence Number=SeqID_206103
atggggatggaagaggaagagggatggctaatggaggagaaggggagaatggctaaagatggagggtttcccttattagagatgcttaggctttggatgtattcaatagagagctctgagtctcagtgtctttctcctttgcttcctactccatttataggcctaagcgggtatgacggtgatcaagagcttagtgcgggattgcgctaa

SEQ ID NO: 89326 - DNA, 177 bp, Glycine max
  Peptide Sequence Number=SeqID_206104
atgaagcttaacgtcatcgttaagggacatgacgtcaacaccgtttgccacgatgttgcttggactgcctgggcagtccaagcatggtggttaggagtggtggtgacagtggtggaagttgaattggaagagggtttcatgggaaaaaaaatctgtgcgcacatttgcaatgagtga

SEQ ID NO: 89327 - DNA, 1089 bp, Glycine max
  Peptide Sequence Number=SeqID_206105
atggatccctacgatgaaaagaggctaagagacgaagtgatttaccttcactatctctggcaccaaggccctccacgcccaccgccacaaaaccccatcacccaccgtccatttccctcaccttcgcaaccctacatcccccaacacacgtggcacgcgcgtcctcatcaacagcaacctgcgcccgcccgcaccagatcactccctccagcaatccccaccaccaccaccacctccttcaagaagaaaaagaagcataaaagaaatacccccgaaaagaatgtttcacaacccgacccgggcccagaatggccgtgtccggttcggcctgagccaagcccaaccaccggttgggcccagcccaagcccaagcccggttcggcctctcctcctcccgaggtggctccagaagagaaggagaggctggtggcaatgcaggctcagcacaaagcgtgcaaggctttgaaggagtttctttctaataactatgatgatgatgatgatgatgatgatgatgatgatgagagtgaatgcgaggagattgaggagttctttctggtgctcttcttagaggatcatgaactgagagggtactaccagaggtgttatgagaatggattgttttgctgcttgcattcgatgtcgattttgaggaccatgaagaaaagggtgcacagagggtttgggatggccctgtgcaaggttttgggttgggattctgatcggtttccggccatcgtgatgaaggggacgcctcttgggatggagatgatgacgccggtggaggcagagggtgagcctaaggagaataatgctgctgatgacaatgatagaaaagatgattcccacgaatcagatgataaagtcttgtctttggaacatggtgatgttgcagctgaggtgccagcacaaagggttgatcaaagtatgaataagggtgagcatgatggaaaagatggtgaagatcatggagaaaatggtgcccacaaatcaggtgatgaagttgtgtctttggggcttggtgatgaaccagttgaggagcatgcgcaaggagatgatcagagtattaacaaggttaactgtttataa

SEQ ID NO: 89328 - DNA, 1380 bp, Glycine max
  Peptide Sequence Number=SeqID_206106
atgggtaagaacgtcgtcgtactgggcacccaatggggtgatgaaggtaaaggtaagatcgtagaccttctgactgaacgcgcgaaatatgttgtgcgttaccagggtggccacaatgcaggccatacacttgtcatcaacggtgagaaaaccgtcctccacttaattccctctggcatcctgcgtgaaaacgtcaccagcatcattggtaatggtgttgtgctgtcgcctgaagccctgatgaaagagatgaacggtctggaagcgcgcggtgtgccggtacgtgaacgtctgctgatctctgaagcttgtccgctgattctgcaataccatgtggcgatggacctggcgcgtgaaaaagcgcgcggtgccaaagctatcggtaccaccggtcgtggtatcggcccagcctacgaagataaagttgcccgtcgcggtctgcgcgtcagcgacctgttcaacaaagaaaccttcgccgtgaagctgaaagagatcgttgatttctacaacttccagctggtgaactactacaaagaagatgcagtagactacgataaagtgctgagcgatgtactggcggtggccgacatcctgaccggcatggtcgttgacgtgtctgaactgctggacggcgcgcgtaagcgtggcgatctgatcatgttcgaaggcgcacagggtacgctgctggatatcgaccacggtacgtatccgtacgtgacttcgtccaacaccactgccggtggcgtggcgaccggttcaggtatcggtccacgttacgtggattacgtgctgggcatcgtcaaagcttactcgacccgcgtcggtgccggtccattcccgaccgaactgtttgatgaaaccggcgagttcctgtgtgagaaaggtaacgagtttggtgccaccaccggccgtcgtcgtcgtaccggctggctggatgcggttgcagtgcgccgcgcggtgcagatcaactccctgtccggcttctgcatgaccaaactggacgtgctggatggcctgaaagaggtgaaaatctgcgtcggttaccgtatgccggatggccgcgagatgaccaccacgccgctggcggcagaaggctgggaaggcatcgagccgatttatgaaactctgccgggctggagtgaaaacacctttggtgttaaaacactggaaggcctgccgcaggcagcacgtgattacatcaaacgtgttgaagaagtgactggcgtgccgattgatattatttcaaccggtcccgaccgtagtgagaccatgattctgcgcgatccgaaaaaagcgctccgggttttccacactggtttatcatcaatgttaatcgaagcgctcacgggcgttataacaacaatatcgatgattcactga

SEQ ID NO: 89329 - DNA, 327 bp, Glycine max
  Peptide Sequence Number=SeqID_206107
atggcgacattgccgcaaggtcagcagaccaacattaccgaagtcaccgatacctacggggtatcgcgtaaccatatggttaaaatcatcaatcaactgagccgggccggctttgttgccgcgacacgcggtaaaaacggcggaattcgtttaggcatggacccggaaaaaatcgtcattggcgatgtcgtgagaaaaatggagcctttgcagctggtaaactgtaaagagtgtgcgataaatcccgcctgtcgcctgcgtagcgcgctgaataatgcagtccagctattcctgcaggaactggataaatatacgctcgccgacctg

SEQ ID NO: 89330 - DNA, 798 bp, Glycine max
  Peptide Sequence Number=SeqID_206108
atggctaactggctggaacagaatgagaaacagtctgagctgctgggcggtgcgggcgatctgctggcgaacagccaggccgatccctacctgagccaggcggtgctggatctgcagtttggccattcacagcgcgtcggctatgacgtggcggttaaagtgctgcagcagctgcgcggcgtaacgccgttgcacaaacgtctgccggaacatgccagcctcggcgtgctgcgttcgccggacatcccttctttactggttgaaaccggctttatcagtaacgccggggaggagcggctgctaggcagcagcgcgtatcaggaaaagattgcccagtcgatttacaaaggactgcgtaactatttcctcgcgcatccgctgcaatcggtcccaaaggaggaaaaacggccgctggatcgcgcaccagcggttagcgtcgccagcaacccggcgaccggcaccgtgcagtacaccggtgctacccagcgtcataccgtgacgcgcggcgagacgctgtccggcatcgccgcgcgatacggggtcagcatggcgacgctgcgcgagctgaataacctgaagcgcgatgtggtgtgggtcggccagcggctgaaagtgccggccggttccggcgtcagcaccgcggccagccgtccggcgcggcacaaagtggtgcgcggtgattcgctgacggcgattgccgcgaagtacggcgtcagcccgaaagccatcatgcaggcgaataacatgaagtcgagcaacgtgatgctggggcaaaatttaaagattccacaatcctga

SEQ ID NO: 89331 - DNA, 1434 bp, Glycine max
  Peptide Sequence Number=SeqID_206109
atgaaagacattgatgccctggccagattgctggggctggatacggcaccggagatcatgcttgatgcgcaggaacagctgtacttgcaaggctttatgaccggtttgcgctcagaggagtcacgcaaaatgggcggcgtacccatgttacccgaaggcgcgccgctagcgccggccaagcacttgctagtcaatggaatattggctggaatatttggtcgcagctggttacccaatggcggccaattacccgtcgggatgccagacttttctgccaaacctgcgtccgccacgtccaccgtcgcaattctgtgggcctcacaaaccggcaatgctgagagctttgccgagaaatgtgcacagcgtatcaaagccagtggcttgcaggccgctgtgttaaccatggacagtgtcaatatggctgacctggcaaaacactcccaagtgttactgctcgccagtacgtttggtgatggtgacgcgccagataatggcagccagttttggacccgcctgcaagcagacaatgcacccagactggaaaacacccgtttttcggtattggcattcggtgactccaactatgaccagttctgtggttttggccgtaagctggatgccagactggaatcgcttggtgccgagcgtttactgggacgtgcggagtgcgagccagactttgaagaaaccgcgaatgcctggctggatcaagccgtgacagcattggcaaccatgcctgtgactgtcactgagccagagatggcgatggcaagtgagattgtgaatgccccaggcattcataccgaaacaaggtcagcgcccttatatacccggctatcccctttacgcacaaaacttgtgattaaccagcgcctgaatgctgatggcgccgaaaaggaaatccgccagtttggttttgatttaaccggtagcggcttccaatatgaggcaggcgatgcgctaggtgtttggccgagcaactgcccagaactggtcggcgaaatgctgcgtgcattgaagctctcggcctctacgatggtcaccgtcaaagatcatggtgaactggcactgggtgacgcgctgttgcatcactatgaaatcgcacgcatcaccccggacctgttgaagtttgtgcagcaacgcagtgccagcccgactctggcattactcatggaagatgaacagcggctaaaagactggttatggggcaaacagatcatagacctgttgcatgatttcccgatcaaggtcaatgcgactgactggttggctgcattaaaacgcctgcagccacgcctgtattccatttcatccagtcccaaagtgtatcctgaccaggtacatttaaccgtatccacggtgcgctatggcgaaggcatgtcacgtggtggcgtctgctctacctttatggctgaccgggcacaagactcagag

SEQ ID NO: 89332 - DNA, 636 bp, Glycine max
  Peptide Sequence Number=SeqID_206110
tatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaa

SEQ ID NO: 89333 - DNA, 1090 bp, Glycine max
  Peptide Sequence Number=SeqID_206111
gcactgaaaaaggtggcactgagtgaaaagccgatgctttgggatgctgatgcgcttaacctgctggcaatcaatgcagataaccgtcagaatcgcatcattacgccgcatcccggcgaggcagcacgcctgctcggggtgaaaaccgcagagattgagagtgaccgcttacacgccgcgcagaccctggcaaaccgctacggcggcgtggtggtgctgaaaggtgccggtacggtaattgccagcgcggcgggcgacatggcgattgcggatgtcggcaatgcaggcatggcgtccggcggtatgggcgatgtgctgagcggtattatcgccgccctgctgggccagcaggccaccctgtttgacgccgcctgtgcgggctgtgtcgcgcacggtgccgcggcggatgcggcggcaaccctgaatctgggtgcgcaactggcccgcgtttgcagcagcgcggtggtgatctatctgtatggcgatctgggtgccggtaaaaccaccttcagccgcggctttttgcaggcgcttggccatcagggcaacgtcaaaagtccaacctatacgctggttgagccctatcagctgggcgaccgcagcctgtaccatttcgatctctatcgcctcgccgacccggaagagctggagtttatgggcatccgtgactacttcagcggcgacgcgctgtgtctgcgcgcattcgccgctcggcaacacgctgctgcagcagtttcagcagggcagggaaccggcatgatgtcacgcgttaccgggatgatgctcgccctgctgtgtctgttctcctcgtcggcgctggccgcgacactatcggatatcaaagtcgataacggcgacagccaggcgacggtgaccctgagcttcaacggccagccggtgtatggcttctttccgctacacaacccgaaccgggtagtgctggatattcgccagagcggcaatattcaggggctgccgctcaactttagcggcgaaaacatcgttaaacggattcgtaatagccagccgaaggataagcagagcatccggctggtgtttgagctgactcaggcggcaaaaacgcgcgcca

SEQ ID NO: 89334 - DNA, 231 bp, Glycine max
  Peptide Sequence Number=SeqID_206112
atgcgaatgaaattgagagtgagtgagggagtgagcgatgaacacgagagtgagggagtgagcgatgaacgcaaacggagaagtgtaaacctaaccttaaagaacccgaagaacaaagccttcgaaaaaaaaattcttcaagcggttcctcttctccgatcgcacctcaaccttcggagtcccattcctcttctccaatcgcgcgggagagcgagagtaactgaagtgtaa

SEQ ID NO: 89335 - DNA, 294 bp, Glycine max
  Peptide Sequence Number=SeqID_206113
atgaccccaagtctcaatttatatcatgtcctatttttttcctctcaggaaaagggggcattggatgctgaagagcagattgggaaggctcatagtgggaaaaatagtgatgactgctactgcaaaacaacaccagttgtgctagagcttggaggaaaactatgctgtgatggcagaggatgctacaacatgctatgtctaggttttgcacaagttgataaaacttttcactttggcacaagtataagagaaagtatacgagatacatctacctatttggctggtgttcaatga

SEQ ID NO: 89336 - DNA, 741 bp, Glycine max
  Peptide Sequence Number=SeqID_206114
atggcagcaacaacccttatgttcaaatttcccctcttcacaccaaccgtgagtgttatgatctcaggtccaaagccaatggatacggtgtgtgatgcattaaaccgctgcagcaggaaggttggaaaagcaactagaagagctgagaccatggctgacaatttctggaatcatatcagaattggttctagtcttgctgatgcagcagtggctagaatcgttcaaggaacaaaggtgcttacactaggaggacctgatatattatttcaacaatcatttgggaattttccaggagagaagctcataaagtcatttgcttgctacttatcaacatctactggacctgtaattggaacaatatatgtatcaactaaaagagtagccttttgcagcgactatccactgtgcaattatccactctcgctgcagcaaaaccagagtgtgcattataagttcaaagtctgcacaagatataaagacattacagagctgcaaaacaaaagcagtatatccctcctatatttgttacatatcgctaccaaaaaggttgcctctatacaacaaccaaagaccataacctgtaacactaacaacaatcagaattctaaaaaacaagttggtagcctggcgagcagcaacctccacgagaaaacaaggatctttgaaggaattatagaagcccaaaagattgtctggatgaggataagtggttctccatggcataaacagagccatacttaa

SEQ ID NO: 89337 - DNA, 945 bp, Glycine max
  Peptide Sequence Number=SeqID_206115
atggagaagcttcgaggagtggtgcgggactgcgtgagcaagcacctctactcctccgccatcttcttcgccgacaaagtggcagccttcaccgccgaccccgcagacatctacatgcaggcccaggccctcttcctcggccgccactaccgccgcgccttccacctcctcaacgcatccaaaatcgtcctcaccgacctccgattccgctacctcgccgccaagtgcctcgaggaactgaaggagtgggatcagtgcctgtcgatgctgggtgaggctaaagtggacgacgatggaaatgtttatgatatgaaggactctaatgtcatgtacttggataaagattgtgaagatcgtgaaatcaattatgacaaagaaaatattgtagtagccaagttcagagatcttgagaatgaaagctgtaaaagtgaccaatcagattcttcttttttgcggacactgaaatccaatactgatctattggcctgcaaagctgaatactaccatcagtgcggtgaatatcagaaatgttttgagttaacaaatgatttgcttgagaaggatcttttccatctaaagactacgctagtacatctggcagctgctgtggagcttgggcattcaaatgaactctatctgatgtcatgcaatttggtgaaggattatcctcagatcaaggcaactagtctagatggaacatttccccctgcatggataggctatgggaatgcttatgctgctcaagaagagggagaccaggctatgtctgcttaccgcactgcagctagattgtttcctgggtgccatttagcaactctttacattggaatggaatgcatgcggacccacagttataagcttgctgagcaggccaagtcaatttgctcctcagatccacttgtgtataatgaacttggagttgttgcctaccatatggaagagtaa

SEQ ID NO: 89338 - DNA, 258 bp, Glycine max
  Peptide Sequence Number=SeqID_206116
atgaaagagaacttgacatatgaagcacaaccactgaggatcgacgatcgtatggttaagcagctaagggggaaaaagatttggggaagtgcttcaagcaaggatgctacctgggaactaaaaggtcaaatgcgtgatgcatatcctaccttattcgatacagaaagtgaaggaacccgtactggccaaatagagcttgatttccttgctgcagtgcttttgatgtttgagactttgtgcagttttaatacatattaa

SEQ ID NO: 89339 - DNA, 285 bp, Glycine max
  Peptide Sequence Number=SeqID_206117
atgacatctacaattgatccttttctttggaaacaacaccttcatagatatgaagaagtaactaatgatgtaatcaagtcatatgctcagacaatgccctctttagatcccaaaattgaacctttgttggttcaagttgggttttcagatgttgcaaatctcggacaagttaaaatcaatgacgctttagtgactgctttggttgaaaggtggagacttgagtcacacacgtttcatcttcctgttgatgaatgcacaatcaccttggaagatgttgctctataa

SEQ ID NO: 89340 - DNA, 309 bp, Glycine max
  Peptide Sequence Number=SeqID_206118
atgattgtgagtttagaggattattcaaagggtgtgataaaagccaaggctagggaagaagctggcagagttttaataagtatgaagcacatgtatgaaccttatgcaacatttgcattggcaaattcatcaagaagttctgctaaagataagagcaccatggcagctgagccactggcttcaagcacttgggatcatccaatcttctgtcttagcgagccatcctctgagcgcaacactcctttggctgagcgcaaggaagaatctagaagaaggatgagttatgcatgttcgctgagcgagggctaa

SEQ ID NO: 89341 - DNA, 1302 bp, Glycine max
  Peptide Sequence Number=SeqID_206119
atgacacccctgatacttatatttgggatccagcaaccgacgatgtttataacactcgatccacctacaagtgaatttgcaaggaggctaacgttcaaattttcattcaaggaagttggaactggatttggaagagccatttaccatagaatattaaacactttctttggattgcctatcacgaaaatcttcctactaactccttccatgtgtggcgctttggaggaggatattcttcatgtgttgcgagattgcaatgaagctaaaatcacctggagaatgcttgaccttgaaaacaaccaagactttttcactctcaatttcttctttcctcaggccttttgtttgcttgtgcttgctgatagctttggagggctaggaatgacacgattttttaagacaagatccaacctcagtgcatggggacgcctgctaggtggcgtcccctgtttctggtactacacgggatgggtacagtcagaggacgtcgttgacttattgggtaggacaaaccaagacaaggacgacggccttgaggtggtaggaatgatgcctgaggaggaggatgaagaggaggcaaaggagattgaagagattgatgccttgtggaagtgttgcaaaacgtttcggaggttgtgtgaggtttcgttctcggggagtgtgaagaggatgtcgtgggaatggttgtggaggttgttgttcgaagtggcaatgataacgaggaaatggaaggagtggagacgttgtgtgcagcggcacgtgatcgggaacgccaaggaagcattccgtggcggagagttttcggttcgagaaacagttcaaaccgaatggacgcaaatctcgtggtctccccctcatccattcaaggtgaaactcaaaattgatagcagctccttggataacccgggaccattgggatttggaggaattattcgtgattattttggcgcttggcttgcgggatttttcagaataatagattgtgaatcagattcacttgttggtctcaaccacattgctgaagataacggacactgtggtgtgaccgccagcctcaagacagagttgtttgcccttatgcatggtctccgcaaagcttggaacctgggataccgtaatatcatgtgccacacagattcgaagttggcactggatctattagagacttcctcacgcttgactggaatgtcacccttcatcatacgttgcgggaagctaactcctgcgccgactgcctcgccaaatatggtgccatgcatcacaatgcaatgctcacttgggatcattgtcctccacctctag

SEQ ID NO: 89342 - DNA, 1774 bp, Glycine max
  Peptide Sequence Number=SeqID_206120
atgtcttcatttttgtctaattctgccattggcatgggtggcagtgattttgggggctcgattgagcaacccataatggattggaagagggtgagagccttgggtcgtattggtggaggcatttctcatccttgtgggagggcgtggccttcagctgctatcgaggagcttgtcccgatcactgtgatcctccctttttttgtttctggtggtgtgaggataggtagtggcggtggagatgtcagggcatctccccgcgtggacgatgttctgaagtacaagtcctctctgacctcggcagcaagtttcgctacgcttcaacgccaggtgaagttggcaaagctagtaaagcctgaggactcttgtaagttggtcgttcaaggttgtaggagtgatgacttccctttcttgagggcggtgcctggtatcattctcctgttgaacgttttccaatgtgctctacttaagcacttgaatatgtccccttctcaattccacccaaatagtggtgcaatagaccgtttctttaaggtcttggctactggtgtcgtggttgatgctatgccactgatgttcaacagggacaaggagcctcgcttcccttatttaggagcaactatcggcctcattggacacgcaggccattatgcctctttcttcggcaagcgatcccctcactatcttggatggtcactcgtgaagcaggtcggacctacaggtaggactgtgccactgtctgaggttgttgctactactgaagaaaagggtcaacttgctggtgaggtcacccccaatgctccttcctctgttttagcaaagaggaaacgagatgatggtactgggtcgtctagccgtaagaagttaaaggcctctatgagccttcgtaccctgaggcaggctgcaaggttgacgctcgatgctggtcgcccttcggctgctcctacagctactcctgctccttcacctccttctgcggttactattcaagaggctacgcttgttgttgttgaggttattgtgccagcttctttggctggttctgccgtggcgctatcatccaccgtcgtggcacctttgctgagtgccgatgtggtaaccactagtgctccttccttcctcttcggctccaatgattcctcccttgatgttgattcactgtggggtgcaacttacaagccaaagcaaaagaccatggctggctttgtgtcagcctttgataagaaccttattaggttagctggggagtttggaaattctagaggaaaatggatagcaacaccaagaggctttgcagaaggtggcatccttggaggcggagttggtggtgtgttggctaagttactgcgcaccaggctagatggtgatgagttgttcaaacgctgcaaggacttgcaggtggagataaagaacctgggcgacaagttggagaacatggtggctgagagggacaaacttgcaaaggtagttgttgatttagatgcccggcttaaggagtcgaagtccaggctagaggagtccaagttgcaggctaccaaggagagagaggctagcaaggagcttgaggaagagctactcgtttacaagaaggaggtcatggagcagcatggaaaaagatttcagaaggctgtcaggcaggctgatttctttgcgaaggacctttacttaggtctcttcgatcccttcaaggatgtgaaggatgatgtcctgcttgatgaggaagacattgttgtagaggaggaggttgctgatgaagggcagggtgttggggagcaag

SEQ ID NO: 89343 - DNA, 471 bp, Glycine max
  Peptide Sequence Number=SeqID_206121
atggagagaagtatgatagatgctgccagtggtggagcccttggagacatgacccctgctgaatccaaaaatttaattgagaagatggcttccaactcccagcaatttagtgctagaagtgatgctattgtcattagaggagtgcatgaagtagccaagaattcatcttcatcagccgagactaagaagcttgaagacctccttaacctcagcagcaaaatcagccacaacagaacaattatgacctctccagcaacaggtacaatcccgggtggaggaatcatcccaaccttagatggtcgaatccttcacaacagcaacaacagccttattttcaaaatgttgctggcccaagcagaccatacgttcctccaccaatccagcagcaacaacagcaatagccccagaaacaggaaacagcaaccttcccttgaagaacttgtgaggcaaatgactatgcaaaacatgtag

SEQ ID NO: 89344 - DNA, 309 bp, Glycine max
  Peptide Sequence Number=SeqID_206122
atggataggttgacgaccatgatgagtgcactcctgtcagcccagaactctcaagctgccgccgctactgtagagcagcccttggtgagcacaaccccgctatctacggtgacttctccacccctctttttgcctccaggttgtacatggggaatgccacctccagtctgtggaagcccccagcccgctgtatctgaagttccaccgccttttgctcagcagtcagcaccagttccgcaacccagtacctctttcccccaagctgcaatgacttattcagctccactgattcacactattcaacaagag

SEQ ID NO: 89345 - DNA, 300 bp, Glycine max
  Peptide Sequence Number=SeqID_206123
atggaactactccttttaagagttggacatagggaggaggaaagagcaagcatagctaggttccttagtgggcttagtatggaagtgagggacaaggttgaactccttccatataaggacctagatgagctagtccaactttgtataagagtggagcaacaacttaaaaaaagccttcttcaaaatcttatggctctctctcttatccaaggaaggaccaagcccatgcaattcgtgaagttccgtgacatgccggaactcaaaaggaagcatcgttgcacaattcgtgaggttccgtaa

SEQ ID NO: 89346 - DNA, 1234 bp, Glycine max
  Peptide Sequence Number=SeqID_206124
actgtcttggtggcgacaaagcgctcgccgcggcccgggcgcaggtaatcgacgcgcatgtcgatggtgcccatgcgcgacaggcgctgacgcagctcctcttcgctgatgctctgctggcgcgacagcgcatggctgacggcacaccagcccggcggcaacatccagcactgaggcaatcacgccaccgtgcagaatctgctgcgcggcattacccaccagcatggttttattggcaaagccgagttcggcgtaatcggcttcaaggcgatccagctcaaggcccaaattctatgcgtaagcagtacgccttgctggccgcggcatttatggttcctgcgctggcgcaggccgatgaagccaccgtgaaagaggttcatgacgcaccagcggtgaagggcagtattatcgctaacctgctggaaaaacacgataacccattcgtgctttatccctatgaaaataactatctgctttacacctacaccagcgacatgaataaagaggcgatttcctcttacaactgggcagacaaagcgaaaaaggatgaagtaaaattccagctcagcctggcgtttccgctgtggcgcggcattttgggtgacaactcggtgctggccgcgtcgtatactcagcgctcctggtggcagttgtcgaaccggggggcttcatcaccgtttcgtgaaaccaactatgagccgcagatttttctcggctgggccaccgactattcgctgggcggctggacattacgcgacgtcgagctgggtctgaatcatcagtcaaatggccgcagcgatcccacgtcacgcagctggaaccgcgcttacgcccgtctgatggcggagaacggcaacttcctggcggaaatcaaaccctggtatcgtctgccggaaagtgccagcaacgacgataacccggacatcaccaaatacatgggctactaccgcgcgaagctgggctatatgctcggcgacagcattttcagcgtggaaggcaactacaactggaatagcggctacggcggtgcaaccttcgcgtggagctatccgatttctgaacacgtgcgcttttacacgcagctgttcagcggttatggtgaatcccttattgactataaccatcgccagacgcgtcttggcgtcggcgaaatgctggcgcagcaggtattacaggataccttcggctatcagcagttccgtccgggtcagcaaaccatcatcgaaaccgcgct

SEQ ID NO: 89347 - DNA, 1203 bp, Glycine max
  Peptide Sequence Number=SeqID_206125
atggtcaataccaccaataacgtcttcagcaacaaacattatctgaatctggtcggatttggcgcggtcaatggcgattttattcaagtggcgcgcggccaggccgagtcgaatgattatcttgcggtaaaagatgcgcaaacagatcaccatctgacggcgtatagtcacctgacggtgaactcattggaaaaagcggtgcttgcggattatcaaataacgcagcgcgaatggtatgcggcggttgccaaagaccagcgtccgcactggacaaaaccctttcgcgattatgaatatgaaaatgaaattggcgttgcgttcagctcaccggcattcaatcgccagggacagtttgttggcgtcgtcgccagcgagttgcacctcaacgaactaaataaaagtctggaaaaatttaaaccccatcctgaaagtattctgctgattgttaatgaaaaaaatgagctcatttcttcatcagtgccatcattgacgcgaaatatgctggccgggggaaaacactcacggctgaatctacaaacgcttgaaaacactcatttaccggttgttgtggcagccagtcgcacgttaaaagcgaatcaccatacgggattgcagtttttcagttccggcaaagaagaatattatgttgatgcttttccaatcaccgaccgagatgacatattgcactggacggggattgtgattagcccggcgagaatgattacccataccatcattaaatatatagccattaccatgatcatgctgtttgtcatttttgtacttggtctgctggtggttttctatggcctggcgaaggtggtaaaaccgctgcgagatattgtccgtaaagcggatcagcttgcgacgcaccgctggacgccgccagataataagcgtcatttcccggaaatagcctctctggaaaccacatttatggcgctatcgcataagctggcagaaagtttcgacgcccaacggcgtgaaatagaggaggataaaaccaccgggttattctcacggacagggttactgcgtcagacatcgctatatcaaggtagaaacctgctcgcgctggacaaactcagccaaaagagcgtcagcgctacagagaactgctctcctcactatttatcgacgtcaataatgaagcgtctcctacggcaagcaaatacgtttataccggcaatattggccttgtga

SEQ ID NO: 89348 - DNA, 238 bp, Glycine max
  Peptide Sequence Number=SeqID_206126
atgggtgaagtagaagaggtacaagagcggatgaaggccgacatggaggccatgaaagagcaaatggacacaatgatggaggccatgatgagcatgaagaagataatggaagtctatgcggctgtagtttccgctaccagcaccgttgctgtggtggaccggaatcccctatctggcctcaaccaaataaatcctctagccttggatatgatagctcaaggaggcaaagagttaggaa

SEQ ID NO: 89349 - DNA, 693 bp, Glycine max
  Peptide Sequence Number=SeqID_206127
atgccggcgccggcctcgaccatgcggcacacggcctcgaaaactgcccacgtgcacgcgctggcagatgcgcttgcccaggccgctggcgatgtcctccaggaaggtctggatggcgctgtcgggatggatgccgacgaactggtaggcatcgatcaggtcggcgaaatgggccgacttcgacgccgccagcggatggtccagcgccgtgaccacggtgagctcatcgcggaacagcggcgtcacatccaggccctcgacgtcgatgttgccggccaccagccccaggtcgccggcgcccgcgcggatcgcgatgacgatgtcgcccgagatcttctcttccagctcgacgtccacgtcgggattctcggccaggaaggtcgacagcgcgtccgccaggaaggaattggtggcggtggtgttggccagcaggcgcagccgccccttcaggccgctggcgtagggctgcaggtcggcgttcaggcattcgagctggcggaacaccgcgttggcgtgcttgagcagcacctcgccggccggggtcagcgccacgcccgtggccatgcgcaccagcagccgcgccttgaaggcctcttccatgtgcttgacgcgcgcgctggcggcgggcagcgacaggaaggtgcgttcggccgcgcgggtcagattgagcgtttcccccacgttcacgaatag

SEQ ID NO: 89350 - DNA, 195 bp, Glycine max
  Peptide Sequence Number=SeqID_206128
atggggcaaccccgtaaaccatacggtttgacgcggaactgtttcccacgcggcgcgcgccgcggcatctggagcgcgggcggcggcatcggccgcggcatcgcgctggccatggagcaggcgggcgccaaggtggtggtcaacgacatcagcgtctcgctcaccggcgagggcggcggcgaatgccccgcgtag

SEQ ID NO: 89351 - DNA, 126 bp, Glycine max
  Peptide Sequence Number=SeqID_206129
atgtcacctgattggtgtggaaattctattgatctagaaattgtcaacgatattaaagacatgcttgatcaacacaatgtctttgcaaaaacattcagaatggctaaggaaagttttgatatctag

SEQ ID NO: 89352 - DNA, 285 bp, Glycine max
  Peptide Sequence Number=SeqID_206130
atggcaggagctggtgatggtggtggtgattatcatcagctggacggatctcagcgtttattattggacgtaatgattatagagatgcaacgattgttgaaccgtaataatgaagagctctatggaaaaatagaaggtatggagaaccaactaaatcagaatactggaagacattatggtggtaacagacagaaccatgcgacaaaaactccagaggctgtcccaaggaagtttaactgtggaggagtactacaaggagatggagatggcactagtgagggctaa

SEQ ID NO: 89353 - DNA, 372 bp, Glycine max
  Peptide Sequence Number=SeqID_206131
atgggaaggaggttggctctgcacatgttcgcgaagggttggaagataggtttaggggaaacgatcacagtcaaggaagtgggggccttggagacggaggagaaaggtttttgctctagtatggctaggcattcatacaagacattttgggcatatgcgaatgaatttctcatcagggtgacgatcacaagaggtggagaggctaacttagcagggaaaagcttaggttggaacaatgaggaggaagataaaggagggaggttggctctatatatgcttggtggcaaagggttggaaaataggtttatgggcaatgatgacaatcgaggaagtgagggccttggagatggaggaggaaggtttttgttctag

SEQ ID NO: 89354 - DNA, 447 bp, Glycine max
  Peptide Sequence Number=SeqID_206132
atgttggctactggtaatcgattactgccttctggtaatcgattaccaaagagtaaaactcttggatggatgaaaggttgtgatcatgacaaattccaaaagttgcatatgccttgttctcatgttgttgctgcttgcaagcatgttaatcatgagtacagaaactacatacatcccatgtatacgttgggaagtgtctctaacatatgtagaggattatttgaagaattgtgcaacgaagcctattggccaccgtgtcacgagctaatgatctcccctaacccagaaaagaaaagaagtactaagggttgtcctgtctccactcatatgcacactgaaatggatattcgagaatcgagtcaaccaaagcgatattttgtgtgtcacatcacaagtcattcaaagaaaaattgccctcaccatgtaggttcaagccaacaactttga

SEQ ID NO: 89355 - DNA, 252 bp, Glycine max
  Peptide Sequence Number=SeqID_206133
atgcagggcttcgtcaggcatgcgggttttggcgtaggctttgaggagagtgaggggcatgtcctctgggaaggggtagcgaatggcgacgacgatgcgcggcgcgtgggagagaaggagggcgggatcggcggccacgtggcggagggggctgatttttcggctttgaggagcttgagaagatggtggggtgagaggcatttgggaatctccaccatgacaccagacagtggggagtggggcaaaatttaa

SEQ ID NO: 89356 - DNA, 178 bp, Glycine max
  Peptide Sequence Number=SeqID_206134
atgcctcacgtgtttgggtgctccccaaccatttgctcctttaacaccctcctcaatgcgttcgtggagtcacaccagtgggcacgtgtggagaacttcttcaagtacttcgaagctgcatgtgtgacgtcgaatgttgaaacctataatgttctgctgaaggttctgtgtaagaagg

SEQ ID NO: 89357 - DNA, 342 bp, Glycine max
  Peptide Sequence Number=SeqID_206135
atggaggggttttacaaagatgggaactgcaaaatggcatcaaagatttgggctcacatcttagaggacaagcttcaacccgacatcatcttgtataatattactcttatggggctctcttcttgtggtagggtgacagatgcagttgggtttctagatgatgctttggggtgtggtgttctgccaactgccattacttggaacatactagttagagcggaacatatggtatcaggtacctgggtgcaatacagttttcctctagggtacctaaagtttggagttgctgaacagcaaaggatgtgtgttttggtttctgggatatttgtctgtctcatgtaa

SEQ ID NO: 89358 - DNA, 345 bp, Glycine max
  Peptide Sequence Number=SeqID_206136
atggtaagctcccaaggcctcctcatctgctccttgatttacattcagcttgacatagggtgtatcaggctaagaagcacggacgcggctcatcaccggcgtgttccgcgtcggactcgcaccagacacatatgcgggtacgactccagtgtgacgtggtgtccgttgcctctgctgtcactgaacacggttgaacaaataactcttctacgtcttttccttgctgctcccgcaagcgcctccattgctgcacagtgccacgtctgtttccttcctcgcgcagagatgagtgtttctagtcctagtcaagctaaagaacaagatgatgataccaaacctttatga

SEQ ID NO: 89359 - DNA, 790 bp, Glycine max
  Peptide Sequence Number=SeqID_206137
atggaggcgcttgcgggagcagcaaggaaaagacgtagaagagttattcttttgaggcaacggacaccacgtcacactggagtcgtacccgcatatgtgtctggtgcgagtccgacgcggaacacgccgcttaccatctatcatgcaccgcgtgaaaggaataccgtaactgatcaacttgcagctttaggagcaaataacactttgggcatttatgtagtgccacctgatgggatgattgcactcaaatcccttcatcctttcttcactcctaccaatatcaaatatggtatcaaccgaagcagatgcctcaacacaaaaggttctgttttgtgcctctgcaagtccaatgaatctgaatctcaagctccccaaccaggagatattcgtaaacaagaactgctagcccaaattgccatgcttcaaactcagaaagtccgtctcacagattattttgatgagagatctgaatacttaacccagtttggtgaagaagccaaggccgagtttgacaagattggaaaagatgccctccaaggattagatgaagctagtgccattataacagcaaacatagagagccagatggtggagtttgaggaatctgcagaacttaacagacaagagattcaggagcatgaaaaagaactaggtgaatttgaagttcaaatggaggatggaagaaatgaagggctgttctttaagaacctcagaaggaggacacctgttgacaaatcaaaagccaaggaggaggcagagaaaatcaaagatgtagccagagaaaaagctg

SEQ ID NO: 89360 - DNA, 225 bp, Glycine max
  Peptide Sequence Number=SeqID_206138
atggactttcacaaaggttttgtaccactttcaacagcatacaaccaaccaccaacgagctcttgttatcatccaccattacttactcaaatacatgacataagtcatgaggatgaggaggaagacgatgataacaataccaacaataatgatgatgaccatgatggtgatgatgttcctcaacaacaacaaatagttacacgttaccatcatagaacaagataa

SEQ ID NO: 89361 - DNA, 312 bp, Glycine max
  Peptide Sequence Number=SeqID_206139
atgagcaaaggagattatccaaacaatccaagattgatttatgtaaaacgagaccacaatacacaacaactaaaagatgaattcccaagcttatttggttctttgacagttgcgtcaagtggaatagcttttttattactactcggaggaagaattgcacactctaaatttgcaatacttgttccagccttacaaaactcaacttgcaatattgggcaagacagtgaattagtcgagcttttgaaggtcatcaagcttataatatgggatgaagctccaatggcccataagttttgtttcaaagcattataa

SEQ ID NO: 89362 - DNA, 351 bp, Glycine max
  Peptide Sequence Number=SeqID_206140
atgaaggtcacaaagaatggtatcattatcagagatctacgctggggtagtgcttttaacattgtttggctagatttggtgataggtggtggtttggacacggatctggtgataggtggtgatggtcgaggaattgtgcatggcggtgcggagggcaggttgtcatgcacaggacggtgggtgttggcacgtagtgaggggttggaaggtgtggtggttcgaagagagatggcggttgttggtggctatggtggcggttgttggtggctatggtgtttagggcaaaggagaagattgagggagaagattatgtgttgtgttgttaaaggcaactctaacaatgcgtttgtt

SEQ ID NO: 89363 - DNA, 480 bp, Glycine max
  Peptide Sequence Number=SeqID_206141
atgctccaaccatatagaatcaacataggcttaaaggagcactcaaaccgtgtgacccccaaggcctacactccgaagagtccgtcagggcctcttcctcctgattcagttattcctccgactgctccgatagaattctcaaacgttagagagacggagaagagattgaaacctctacttgtactgtcttcatgcgattcctttttctccctccacgaatattatctcaaaatcctaacggtggaagtgtgcgcaactgaatttcaaacaacatatccaaatttcatgaaaatccaacgatatgattttgaaattcccaacggtaagaatgttggaaattgggttgcgaacgtggtactcaaatttcacgacgatccaacggtgaacgagtctgagatcgtcatttttctgagacaggatgttacatttggcggtggcggcgatagagtaggagtagatggctacgaagcaccgatatga

SEQ ID NO: 89364 - DNA, 231 bp, Glycine max
  Peptide Sequence Number=SeqID_206142
atggagcgtcctgagctgaagttggtgtcacacaggaggaaggtggcgttgattgggaggccagtgcatgcgattgaagggctggttgtcgccacaggattaagtccattgatcgagtgttcagttgtaaccgcgcggtcctggacttatatctgcatttgtggagaggtggcacagggagaccagcacctttcaccttccagtaagagagttgacgatcacactagatga

SEQ ID NO: 89365 - DNA, 1212 bp, Glycine max
  Peptide Sequence Number=SeqID_206143
atgaaaaccactgcaatcactataaatccctcactctctccacccttttgttccaaagccactacccctccttcttgttcttcatcatcttcttcgttccctcctagtttcccacgttttcacttgtcgggagcaaaacccatttctctttcttgcagaggaacacgattgtgcttcttgaaagggtctaaaactctttggggtagaaaaagttttgtgcttggggctggaaacatgaccatggcagaggttgattctcatgaagagggggagaacgagggtgctttggttggctctgagaatgagaacaattcaaggcctcggagaattgctctctttgtcgagccttctccctttgcatatgtctcaggctacaaaaaccggtttcagaactttattagatgcctacgtgaaatgggtgatgaggtgatggtcgtgacaacacatgaaggagtgccacaggaattttatggagccaaattaattggatcttggagctttccctgccctttgtatcagaaggtacccctctccttggcacttagtccaagaataatttcggaggtagcccggtttaagcctgacataatacatgcatcatcgccaggcataatggtttttggagctcttatcattgcaaaacttttgtgtgttcctattgtcatgtcctatcatacccatgtaccagtgtacattccaagatatacctttagctggctggtgaaacccatgtggttgatcataagtatgtacactttcttgcttactccttccaatttggactcaaatattgaatttcttcacagagcagctgatctgactctggtgccatctgctgccattgcgggggatctcctagcagctagagtcacagcagcatttgaaaatacgcatttctcggtatgcctactactatgctgcgaatttttgagtaagtttttctcctgttggtatccagctaacaagattcgtctttggaacaagggtgttgattctgaaaaattccatcccaaataccgctcccatgaaatgcgattaagactaaggtgtggaccttttctcattttgtcatataatcaagttttggcaataatgtcatttcatcatgttcttaaacatttgtcatacagcaatgatgaacctgacaaacccttgataattcatgttggacggcttggagtagagaagagtttagattttctgaaaaggtag

SEQ ID NO: 89366 - DNA, 444 bp, Glycine max
  Peptide Sequence Number=SeqID_206144
atgaatgtagactgtgaactagcacactatgtaccaacgtgtatcacaatggaacaatatcaaaacctattggctttgatatcattgttgggtactagggctaatggtggtgttgaaggtcacgacactttgcccatgcaagggccttctttgtttggtttttgggacaggctaacggcggttctgaaggctaacgacggttctgaaggtgacagtgttttgccatgcaagggccttctttgtttgatttttttcgctttggttttaatattgctttggacgggaaaaaggttaacggcggtgctgaaggctaacagcagtgctgaaggtgacgacgctttgccatggaaggactttctttgttcgatttttttcgccttggttttaatattgctttggacgggaaagagtgacttttgggacaggctaacggcggtgttgaag

SEQ ID NO: 89367 - DNA, 1224 bp, Glycine max
  Peptide Sequence Number=SeqID_206145
atggcagcaaaatatgagatagaacagttcaatgggagtaaattatctctttggaaattaaagataagagcaattttgaagaaggacaattttgaagaggcaattgaaggaaaacctgtgaatgttattgatgaaaggtggaaagagatggatgacaatgttgtttccaagtcacttcacactatccatattgaggacaattttgacaaactcaattttgtcaagtgttatggagtagaagactgcgaaggagatttaggatactctccatattacattgatggagatgtggaaaggaaaaccattattcctccttacatgtgtttgaatgggtatcgcttatgggatcccacttcccacaaggttgttgttagcaaggatgtagtttttggagaaaatgaattggaaagtgagcagaaaaatgacaacactaccaaagacactactataatgcaaatagagaagacattaggagaagataactcttctgaagcagaacagggggacgaagaacaagaaccaaacgaggccaatggtggacaagtcaaaaagccattggaagcaaatgggtttataacatcaaatgagatggcagatcaagtggagcgatatcgtgcaagattggtggttaagggatatgctcagaaagaaggtagcaacctaaccccgacacttgcgatggtcgccgctatagcctcttcctttgaattaatgccaaggagacataacacatcattcagagtgatggtcatctcttcgataggcaagtggaaggatgagatctctttgtgccacctctacacaagggcattcatgaagcccctatttgcggtaaggtaccatgtcgtaactagggctaataacctcgaccacgacacaaaggccctcaccgttggctcaatggggaatggtccaaagatcttgttagatagacatgcctctgcctatgactctagttttacctctgtcggtggatgttgtctgtcggagaacgaaagggttgaagagaagaaggaaaagggttcgtttaggttgggttggggaggaggaagaaggaaggagaaggaaaaaaggaaggggcaccgatacgagaaggagaaagagaagggtaagaggcgtcggtttgggacaaagatggagaaggagaaggggaaagaggtgctaggaaggggaagaagaaagagggaagagggagggatgaggaattttgaagttggggggtag

SEQ ID NO: 89368 - DNA, 198 bp, Glycine max
  Peptide Sequence Number=SeqID_206146
atgaatcgattacgagggggacttggggatgcgacgagcctgggcaatggagaggtggtaatggatctcgttgaaaccttatttctgcatgccaagattttcggcgttgatggtgtcatgaaggacaatgatagtcaggaaaagacggaggatgttggcaatgttgtgttttccgacgccaacattgttgttttctaa

SEQ ID NO: 89369 - DNA, 813 bp, Glycine max
  Peptide Sequence Number=SeqID_206147
atgcaacctcaatgcccttccacctcatgtgcccgccacctagaagagcaattcaccggcttttgcccatcttgccttcgtgaacgcctaatcatacttgggcatgagtctttatcatgttttcacaagtcattgctatcattaccatcattatcggtgcatcctcatcgccctttcgcctcctgtgatcgccaccctgaggagcagttcactggattttgctcatcatgcctctatgaacgcttaaccattcttaagcatgactcttcatcctccatcttcaagcaccctattacctccactacgtctcccaaagctatttttcgatccttcaccaccatgcttgatgctaactgccttcctaggtcttcctccttcaccttccaacctatgctccgtcgttccaagtcttgccccattttcaaaactaaaggcctttcttgtgccttagatttgcgacgaaaatcatgtgatttcatggcctatagcaccattttttccatttttaacccatacgacaaacagggaattcccaaaaaggaacccaaagttgaatcacataaccttgcttccccttccattattcgagatagagttcaagaaaacataaaagaggaaccaagtatagaacttgaagctaatgaggaagcagaaaagaccataaaggcaatggaggatcacatggatatagattctcaagtgaagaagagttgtggccgtgattcgaaggaatgcatcttgtttgctacatcaatttttacgaagaagtttcgaaagtggaggcaaaagcaaaagatgaagaaaaatgagtga

SEQ ID NO: 89370 - DNA, 174 bp, Glycine max
  Peptide Sequence Number=SeqID_206148
atggctcaaaaatatgatctctgtggagtgcactttcaattggatgagatcgtgagaactttgagaaagtacagcatcagccatcttaccaagggaactacgatcctgcttcacaaagtgcagtttttacaagtttcttcactgctccctgtgtcacaaccatgtgttcaatag

SEQ ID NO: 89371 - DNA, 339 bp, Glycine max
  Peptide Sequence Number=SeqID_206149
atgggaacagaaacatgcttcagagagaaacatctagcttacctcgaacccaacagcgaaaattgcagtgagactggcagtgagatcaacaacactggcaatgaaacgtacctcaggtcaccacgagttccccaatccttacagcagaaaccaataaaggtccttgggttaaccacctattcccgaaacagacttaggtattcaatagaacaacacaggttagacgaaatgtacctaggtaagttggcgatggacaacataaagcgagttgtcacgatcttcggcgcgatggagaacaacaagcttagatgcagaactagagagggtacacggagatga

SEQ ID NO: 89372 - DNA, 153 bp, Glycine max
  Peptide Sequence Number=SeqID_206150
atgagggagtcaaggatgtcgaagcttcatgtctgggccaacttgatggttagcgaagaacctataataagagataatgttagcgacttcagtgatgacgagcaacaacacaattttcatgaacatggtgaaccaaacaatcaaagtgagtaa

SEQ ID NO: 89373 - DNA, 357 bp, Glycine max
  Peptide Sequence Number=SeqID_206151
atgtcgttcaacacattcaacgagacattgggggggagggggggagtagagctttggaaagtgttgaagaagaattcaccaggtgtccacgtgtccgtgtccgtgtcgtgttcggtgtccgtgtcggtattggtgcttcataggtcatgcgagctacgtacacaaaaaggacagacatggatagctaccgaggctgctattgttgatccttgcgacgttgtgctagtggtgtggcagaattcttggcagatctcggacttagtaatgggtggatgggttcaacggtgtcattttagtggtcttgttattttccacggaagggattttgggtggggttggatgttggagggtttgtaa

SEQ ID NO: 89374 - DNA, 318 bp, Glycine max
  Peptide Sequence Number=SeqID_206152
atggaagttaagaactatagattttgggtttgggacgatgatttgaagaaatcattgaaccaagactatgaaagtaatggtggcactggaactaatgtggacaatgtgggttgtggaagtaatgtggatgtgaatcatttgttgtcacaaatggatgagctaaagttgaaggttgcaacaaatgaagaaagaatttgtttgtatgaggaacaaaacatggagttgaagaagatgttaactaaagaagaacatcaatctcaagcaaattttgaagttgttgttgaactaaggaaaaaaaattacaaagcaacatactaa

SEQ ID NO: 89375 - DNA, 240 bp, Glycine max
  Peptide Sequence Number=SeqID_206153
atggctcctcagagtgcaatacatcaactatattacactgccctacccctcctagccgtaggatatgccggacgtgcagcttcataccaaagatcattggagtcacgaattaatagacaaatcacatacgaagagctgtgggagaacatctataagggactaaagattatggctgtaattatttgtaactacagaattataatagcgaattataaatttcttggtggcgtggccacttaa

SEQ ID NO: 89376 - DNA, 255 bp, Glycine max
  Peptide Sequence Number=SeqID_206154
atgtttccatttcaagttgcaatgctcaacaagagcaactatgacaattggagcatcaagatgaagactctccttagcgtgcaaggtgtttgggagatagtagagaaagccaacgaggacgaggtcatggtggacatcgcacaagaggatgaggtcatggacaaggacaaggttggaggcctaatgatgacaactacaacttccaaagaggaggaagctcaacaagagactgtgggcaaggcaactcaagattga

SEQ ID NO: 89377 - DNA, 249 bp, Glycine max
  Peptide Sequence Number=SeqID_206155
atggaggaaggtgaagatgagtctcctaggctgattcttaatcgtgtattttgggcatttaacctatgcattgaagactttaaatattgtaagccacttgtgcaagtagatgggacatttttaactgacaaatatcatggatatgagatgagaaaaccacaatttgagacgaagttactcgcaatgcgagcaaagtttctacaagcagcagattggttggatcaaattcccaagagtaaatggacttag

SEQ ID NO: 89378 - DNA, 468 bp, Glycine max
  Peptide Sequence Number=SeqID_206156
atggtcctctcgatcccttctgcttctgccacatcaccccctgatgctgtagacaacaaccctttagtggagcccttagctattttggacacaaaactaaacaagctaattttggtgcaatggcttggtttagctcctgaggacacttcatgggaaaaatgggatgattttgaggctctttatcaccttgaggataaggttgttttttcgttgaggattgatgttaagatgttggaaacatgcatattattttcacgaagtctctctactagagtccaactatacaccactgctggcagcactgtgaacggcaaaaaatacacatcctggtcatggctaagagctaaaaatgagagtttcaaatgcacattctatgagtggtataaccaaccaaagcactgccttatatatagctatgcaacagtcagagaggaaaacactaggccaccaacgtactggcgggagtaa

SEQ ID NO: 89379 - DNA, 243 bp, Glycine max
  Peptide Sequence Number=SeqID_206157
atggaaattgagaagcagggattccaccggatacacatggctgaaggagacattcataagacatcatttcagacctaccatgggcattatgaatatagagctcttaagtgcaccatatctaaagctcatattctagctcctcttgatttcacagagcctttcatgcctgaaactaatgcatcaggggctgctacgggtgttgtgcttatgcagaagaaccacttcattgccttttttagctaa

SEQ ID NO: 89380 - DNA, 243 bp, Glycine max
  Peptide Sequence Number=SeqID_206158
atgaaagttatggaagttagaagagatctcgaaatttcaaaaccatggggcaacatcggagcctggactgccaattctgagttggtcaaggccgatgaggctgaggcccaggctgcagtcgtggccatggtggtcaagccccaaagatttcctagcctcaaggaggccatgaactccaagcccatgaagaagaaaggaaccaccatcacactttctgagttcaactgtggcagtttcgactag

SEQ ID NO: 89381 - DNA, 366 bp, Glycine max
  Peptide Sequence Number=SeqID_206159
atgaagcacttcactgacaccctcatcagtgccaacataggaacaaaagctggtaccgggccccccctcgaggtcgacggtatcgataagcttgatctagcgttgctggtgctagcggtggtgctggtaataatcgtagcggtgaagccaaagaagctgcagtttgatctggagcaactgggggtgcagtacatgggtatcacacacaatcccccctcaatcgcttccctctctctcaccattcacctcctcttcgctgccaccaaccccaacaaggttgggatcaagatcgaattcctgcagcccgggggatccactagttctagagcggccgccaccgcggtggagctccaattcgccctatag

SEQ ID NO: 89382 - DNA, 419 bp, Glycine max
  Peptide Sequence Number=SeqID_206160
atgtgtcacaaaatttccaaatcatctaatactttacaaagtaaccatcattgttatagtacccatgatttctttcaagctgctcaccataattattgttggtaccaagaaatggtttatccaagtggtactagacacgaatcccttaagcatgtagtaaagggtttgaatcctgacgaatgcatatatggagaaaatcttgttgagagggagatcccacttatgagtgccaacagaacattctataaaaaggttgaatatgtgcttgaagattgtaatgaggttctcgtcaaaatcaacaaatttgtcatcaacaaagaaggcttagtatgtgtggaaacgttgtgtatgcctgttactaaaccagaaagatttgagttggatgcttttgagttagatgaacctgaagatgctggcag

SEQ ID NO: 89383 - DNA, 267 bp, Glycine max
  Peptide Sequence Number=SeqID_206161
atgatgacacatcacctcccagaagggtatagagtcaacaccacttttaacatttctgatttaattccttttgcatgtggagttgatattgaggaggaggaactaacagatttgaggtcaaatcctcttcaagggggaggggatgatgtaatcctccctaggaagaaaccagtcactaaagccatgagcaagaggctccaagaggattgggctagagctgctaaagaaggccctaggattctcatgaaccttaggatagatttctga

SEQ ID NO: 89384 - DNA, 279 bp, Glycine max
  Peptide Sequence Number=SeqID_206162
atggcagaatcgtcaaagaaacgaaagggttcttccgcctccgcttcggcttcaagagctcatcgttttggagccactagtgcatccacaacaccaattccaccctcattgtcctcttccccagtgttttcttccgacgaacagcagaaacggtactccaatcttttctcatctcgttccattatcgaccctaagtttattgatatggaattcttttctgttgaaacctttgattgcattcaagcctttcagaacttaggacaacactctgatttctga

SEQ ID NO: 89385 - DNA, 1077 bp, Glycine max
  Peptide Sequence Number=SeqID_206163
atggtgaaagatggaacctcttatgtggagataaacgtgtcattttcgcccaaagtggtcgcacagcttcgtcgtatcaaccgggccatcaggatttattcattggccaagcagatcgccactgcggtgttgtgggataccgccacgggccgcgcgctggtgccggccatggtgtggcaggacacgcgttatgtcgatgaactcgatcgcctggcgcccgcttggaacccgctcctgctggagcaggtgggccgcccggccggtgtgcgttcgcagtatctgtgggcggcgcgccacctgcgcgattcaccggccgtggcacaggcctggcgcgagcgccggctggcgttcggtaccgtcgacacctggctgctgtggcatatgtcggaccgccgcgaatgcgtgacgacgcccaccaatgccacctcggccggcgcctatgttttgtccgggcaccgctactacctggactggatcgacgcgctggagtttccgcgcgagctgctgccggccttgcgccaggaagccgacgatttcggccagacgcgcgaggacatcctgggccttgccgtgccgatacgggcatcggctggcgaccagcatgcgggcgcggtggggctgggctgcaaggatcgcgggcaggcgaagtgtgtgcatggcacgggcagtttcgtcgacctgatcatcggccccgaggcgcccgtcaatagtggccgctacgaaggttcgttgacgatgacggcgcggcgccaggaccaggtgtcgcaattcgcggtcgagacctttgtcgccaccaccggttcggccttgaactgggtctgcgacaagctgaagtggttcaggaacgcgcaggagatcagcgaactggccgccaccgcgcaatcggcgggcggcgtgacgttcatccctgcgctgaccgggttgcgcgtgccgcgcatggcggccggcgcgcgggcctcgctcacaggcatctccatggccaccacgcaggccgaagtggcctacgcgatcctggaaggcatcgcccattcggttcccagttgcatcgaggcggacgaggaggtatcgggcgtgcag

SEQ ID NO: 89386 - DNA, 234 bp, Glycine max
  Peptide Sequence Number=SeqID_206164
atggtgaaagcatgttccaaaatagatccttccaatattgattgcaatgatgctacacaagctgaatgtcaatctctgtctgtcacagctgaccatgatccggttgcgggattgcctttaacacccaaaaagcggatgtcatctgatgaagccgatgatgagttagggagctctcaaatttcgccagcccaactatcgtctaacaaattaacaagacattctcataagagctaa

SEQ ID NO: 89387 - DNA, 477 bp, Glycine max
  Peptide Sequence Number=SeqID_206165
atgactaacgctacggccaggaaaggggaagagcatgcagagattgaaatacatcaagaaagcatttgtcaagttacctccatccatcaccaattgagtaatgaagaggaaaagcctgaagtcttcaatactccagaatatccctacttggccattgttggctatgttggagggaaagataaaggtagattggaactcagcatggaggatcaaaagatctcttttgacctctttgaagcaatgaaacactcagatatgggtgatgcctgtttcgaagaagaagaggtggagcaggaaatagcattattagcctcaaccatggtactacagtctcttttggaaaaagaacctggctataggagagatttcttagctcgtgatgaagagcttgatgattcaaaagacagttgtgttgaacaggtggtttttgtagaattggaaaaactgagaccagcgaaaagcccaaagcataattga

SEQ ID NO: 89388 - DNA, 636 bp, Glycine max
  Peptide Sequence Number=SeqID_206166
atggaggaagcttcgccaagtattcccattgaaaaaccattattcaaacctttcaaagtaagtgataaagctaaacggaaaattagggaacttagaaaatctaaatccttaattgaaggagtaggtgacaaccatagtgaattactaaacaagattggtagtttactaaaggtcattccagaaactccccaaacttcggaaaacacttccacgatggtaacaagaagtacctcaaaaataattaatgttattaatgaagatagtgaccaaaactcagacaatgcaactgagataggatcagtatcagaaaagaatataaatccaattaattccaaacactggaaaacaccctccaaattatattatcaacgtccgactgctcctgatcttctatttgaggaaataggtgaaaacaattttaagagttttagtgcaaacaacatctatgaatggaacatagatgcacaaacggagtataacatcatgaatacactccaacatatgaccatggtagctacagcttaccaaacctcccatgaatattcagaagagaccattatagatatcttagtggtaggattttctggacaactgaaaggatggtgggataattatctcactaatggagagaaataa

SEQ ID NO: 89389 - DNA, 376 bp, Glycine max
  Peptide Sequence Number=SeqID_206167
atgttttttaaatatggtattgacaatgtctttgtacataggtttcaaccaacatatgcaagttggttgaaggtgtcagttgaccttcgcgataggtggtttggagagtttaagttaaaggagtttcaaagaccaccaactgcttggaaggtgatgaagaaaactaagaaattgaagtcgagagaatgggtcaatgacaagtcctgcgaatttgctgagaaatatcaacatcatcgagatgaaatcttacaacattcgacagaggaaggcacatctacacaggattcccctaacactgctacttttgttaatgataatgaaatatatatgaatgttgttggaggtccaaattacaaggagaacgtgtacgggctag

SEQ ID NO: 89390 - DNA, 321 bp, Glycine max
  Peptide Sequence Number=SeqID_206168
atggctaagtttgaccctgaggtagtcctggagttttatgctaatgcttggcgcacagaggtgggagtgcgagacatgcgttcatgggtaaggggtcagtggattccctttgacgtagatgccctcagccagttcctgggtgacccgctagtgttggaggaaggacagcagtgcgagttcagccagaggaggaacagggccgacaggttcaacgaggaggccattgcccagctgttatgcacaccggggcaggatttcgcccggaccgctgcagggaggcgagtgcggatcatgcacaccagcatgaccactttgacctag

SEQ ID NO: 89391 - DNA, 395 bp, Glycine max
  Peptide Sequence Number=SeqID_206169
gtgggtgtggaggaggttaaagatccagatgctcccgttcctgtacctactgatgaggcaactacgtctccggcaaaaccacctcaaaagccagatccggaggttgatgatccactttatctgatgacattgaccatcccagagcttttcttgaggccttaccaggttacatgggatgccaccatgttcaggatctttaatccaaacttctcgctctacataaagcatgaagacctctccgaaattgcacacggtggtcaatgtctcagcatatcagtgttacagttgcatttgactgaaacaagtatgcgagtggggaattctgatctgtatggattcctcgagccacggtccattcagaggccagacaactaccttaaggggataattaacag

SEQ ID NO: 89392 - DNA, 141 bp, Glycine max
  Peptide Sequence Number=SeqID_206170
atggtggtgattctgggtatcgcttcagtgagattgttcccaggtctccatgctcatatagtaaacacatcggcgatgacaaatttgaaggatagggatttggtggcgattgcgaagggggataggggaggaggaagatga

SEQ ID NO: 89393 - DNA, 360 bp, Glycine max
  Peptide Sequence Number=SeqID_206171
atggtgatgctgactggctttgcgagtgagaagcataagggtgactccatcaatgattatggaggtgaacacggagcaagaaaaggaaggaggctaacaggttttgggcggattctggcagcattgtggtggtgcggcaagagaattccaatggtgattgttgggttaagaaatttagaggaactagctgttgtctttccaatcacatggaaaaacttcgttcttcagattataaacaaccagtcaagcacacacccctcctcttcttttgataacacaacatcaacatttgttcctcttgcttatggaacaccaatacaagctcttgggttccgataccagcttgataaagattggtag

SEQ ID NO: 89394 - DNA, 594 bp, Glycine max
  Peptide Sequence Number=SeqID_206172
atgaccttggctaagactatgatccaatatttgcctatatatcccatgatgacttccttgattccaaaaatacaggagattcaaaagtttcaaagggcctttcattttgagggagtggaacaggaactaaaagagattgaatggcttccatttgatgcatgcacaaaaggctgcttacaagagctagaacaactaaatgggggcttggaaccttcgtcggaagggtgggtaaccattaattctgatgattttgttaatgagcaagatggtttgaccgcatgtggagggtgttttgaaaggattgcaattagctctaaggaaagctttagtcaagtgtttgggagtaatgatgcgagtaatggttttggtgggaaggtgattaggagattgatgagttctatcatggggattcatttttgtcatatctaccatgaaggaaattcatgtgtggactctttggccaatttgacttatgatttggagaggaattttgtgatttttgagcaacctctcacttatttgcaagtgttactcttagttgattgtggagatttatgttggaccattgtgcctattactaacttattatattaa

SEQ ID NO: 89395 - DNA, 267 bp, Glycine max
  Peptide Sequence Number=SeqID_206173
atgtacaaagataagtggacccaacattggcccatgggctcaaaaatctaccctgaggttcatgagaaccctcgggccttcttcaacagctctagcccaatcctcttggagcctcttgctcatggctttggtaactggccccttcctagggaggattgcatcagggaagtcgacaagggtgttgcccttgctcctacgtatccccagatttattttatttgtgaacaaagagtcattaaggcgttggaccttgaaatgacattttaa

SEQ ID NO: 89396 - DNA, 273 bp, Glycine max
  Peptide Sequence Number=SeqID_206174
atggatctagaaggacaaggtcttagaaagtggcactcatgttctgttgaaactgaattttgctggtggccatttgcttcattaactcttccaagattggtgtggactactggaattgctgttgttgttgtccgaatggaggagcttgatgctgacaaaggtgatgacaaaaagctcaaagatcaatcaaagaacaactcaagtgaatcaagaacaattcaagagttcaagataaaaatcaagaagaattcaagactcaagatgaaagtttag

SEQ ID NO: 89397 - DNA, 153 bp, Glycine max
  Peptide Sequence Number=SeqID_206175
atgagttaccacacaatcggcaacccgacactatcactctcaccgagaagacaccactggtggcgtgttagggtgttccatccttgcaaggatactccaacacatgtgatcaacatgagcttaaaggacattccaaatcgttgcaaccccaag

SEQ ID NO: 89398 - DNA, 108 bp, Glycine max
  Peptide Sequence Number=SeqID_206176
atggctcagagcgaggcaatctcatggattgtcacactggtgctaattaggacagacaggaatgctcttgtaggcaatctcatggattgtcacactggtgctaattag

SEQ ID NO: 89399 - DNA, 273 bp, Glycine max
  Peptide Sequence Number=SeqID_206177
atggaagcaattttgtatgcatcagttgttgggagtattatgtatgcttatatttgtactcaactagacataagctttacagctgaaatgaggtttgatcatcttaaggtgattgagtattcagactcaaacttcactggaagtgtggatatgagaaaatccactattgactatgtatttcttttagctggaggagcagtattgtggaagagtgcaaagcaattagttgttgttgcatctatcatgaaagctgaatttgtagcatgtttttag

SEQ ID NO: 89400 - DNA, 633 bp, Glycine max
  Peptide Sequence Number=SeqID_206178
atgacaccaccttcgatggatttccccttgtcgtcgtcggagaatactctgtttgcaccatctagctcttttcggtggccgaatcaagtgcctcaccagtgtgaggatcactccctgacaatcgcaggtgaagaagagccaaattgcagttgcgaagctctcaatatcatggcgtcatattcgatggtgggtgtgatgcatagatatggtttgggattggtgggagggcgcgacatatgcaatgaaaagggagcagcccccaagcataggcaagtgttgttcagtgttgagagtggtaaccttgacaagtgtgagaattgtaggtctgtcaagcttatcaagcccccgagcctagacaaatgttgtttgggctgcttttgtcaagttgtacggggtaaacatccttttgattttgaagtgtcgacgctctctaataccactgaagctggaaaatcctggggctcctgcaaggtagccgtcaaggcttgcgagagtgatgaccttcttttcttgagggcagggcctcttgtgaagcagatcgaacctgctggtgggactacgccatcatccattgtccctcctattgctgaagaagggggtcaacctactggtgaggttggccctgctgctaag

SEQ ID NO: 89401 - DNA, 168 bp, Glycine max
  Peptide Sequence Number=SeqID_206179
atgaaccatgtcttcatagggccacgagcgcttctcggcatcatggagtatgtggctggtgaactggatagggagccgatgctcacttcctcttgtacaagggctgagctaacgtcttcgtcagctactgagagatataagagtaagggtactcctggcttaggttga

SEQ ID NO: 89402 - DNA, 525 bp, Glycine max
  Peptide Sequence Number=SeqID_206180
atgaagggaagcagggcaagaatcatcctcgaaggcactcacaatgtcactctagagaaatccctcaagctaaacatcaaagccttaaacaagcagaccgagtacaaggtgctcattttaggtctaaaactagcaagagaagtcagagccaaaaggctacgatgctacaaaaactcgcagtttgtccagggacaagttgccaatatataccagaccaaggagacaatgttgctcaagtactatcacattgccaaaactctcattaacgacttcaattactttgagatgtactacatactaagggagagcaacaccggagtagacctactctctaagctggccagtactaaaaaaatcgagcaccttaagactattatccaggagacgctccaagatcccaccatagacactgaagaagttatggccggagaagagaaggaaccagattggatgaccccctttgagaatttcctaatttgggggctgttgccattagatgagcatgaaacccgacgccaaacatga

SEQ ID NO: 89403 - DNA, 1651 bp, Glycine max
  Peptide Sequence Number=SeqID_206181
gaagcgagatgacaacgctggggcattgggccataaaaagtcgagggccctcttaagccttcgagccctgaggcaagctgtagggtttacacctggtttgggtcaccctctgagtttgcaagatgtacgtccgactccagtggtcgtcgaggctcctgcttccactgttgttgctactgttactcctgctcctccacctcctcttgttgtacctgttcaggaggttactcttgttgctggagttgatgtgttggctactttagctggttctattatgacatcttcgtccatcattgccacactcttgttgagtgccaatgtggtgaccactagtgctcctatgataacgctagtaattctaccaaagtcttcctctagagaagtttggcgattctggaagagaatggacaacggcaacaagaagctctgcacaaggccaaaccaccaattgtcctctaaggttggcattgtcttggtcaaattgatgcgcacaaggaagagaaaaaaagacttggttgccaaggtggaaggcattgcagtggagatggacgagcttgccaaggagacggaggccgacaaggagcttgaagaggagttgataatgtacaagaagaaggatggcacggaggatgatgttttgcttgacgaggaagatatcgttgctgaggaggaggtcgttgaggagcaaggtggtgatgccaccgaccctgttgatgtgaaggtcttgccaaccattatggtggcagttcatcttgtggaacctggatctttgactgtggtcgttgaggagtgcgtaccaagggtggaccttgcgtaccttgagttcctgtggagatggaacttagcaaaagaagggctcaccaaggcctttggagaattgaccagagatgcatctgtcctagattttggtgagactcaccaaggacagaccttggatttaacaagcctaggaattgtctgtctagggttttggagagactcaccaagggcggacctagggtttgacgagcctagtatatgcagcgcatatgccgtgctcttgcatgtgtcacttcgtggagtggcatgtactggagacgtggtgtcgtgctcttgtatacctgtcactcgtggagtggcacatattagagatgtgatagatgtagtgtcgtggttttgcatacatgtcactcgtggagtggcatgtactagagacatggtggcacgtgctcttgcatacgtgacacttgtggagtggcacatactggagatgtggtggtgtgttcttgcatatgtgtcactcgtggagtggcacatactggagacgtggtggcttgctcttgtatacatgtcgctcatggagtggcacatacaggagacacggtggatttggagagactcaccaagggtagaccttgggtttaaggagcttgaggagctgaccatggatgcttgctgtgaccctgaatgggccttcccagttaggaccaagttttcttgcttgggagtcttttctggcttcgccatacgaggtcacatgggccctaaggatgactctgttggcagcctttgcctgactattggtctgggaagttcaacaaaggtgcatttctccgcctcgttggccataatttcttgcaatggtcttgcctcaatccatttggtgaagtag

SEQ ID NO: 89404 - DNA, 276 bp, Glycine max
  Peptide Sequence Number=SeqID_206182
atggctattggtggagggttggagcctccaaaagggatctcacgtatgaagccaaatcgggtgctaaccatgggtgaaaaagagagagagatgatgagagactgcggggtatattttatcgcggccccacgatgggcgccaaatgtacttactacaatccagaattggcacacatcagggtgggcctggctaaggaggacaagaggggggacctacaaaataaaagactctgacgctcaaagtatgagggaacctgatacttataggagtgagtga

SEQ ID NO: 89405 - DNA, 1084 bp, Glycine max
  Peptide Sequence Number=SeqID_206183
atggcgacaaagtttgaccttgagaagttcactggctccaatgacttcaagctatggaagatgaagatggaagcaatcttgattcaacaaggatgtgataaagcgttgaaaggggagtcaaacatgcctctaaccttgatgcaggaagagaagaagagcatgattgataaggccaaaagtgtaatcatattgtgtcttggtgataaggcaccgagggaggttgcaagggagaaaactgcggctggaatatgggcaaagttggaactgatgtacatgaccaggtctttggcccataggttgtgcctcaaacaacaactctattcattcaagatggcggaatcaaggacgatcgaagaacaacttacagaattcaacaagaacattgatgatcttgagaatattagggtgaaactagaagaagataatgttgttattcttctaaatgctttacctaaaaccttcgaacactttaaagatgctcttttgtatgggaaggatcagttaattaccttagaggagggaaaaagaaagaagggagaaggtaaatggaagaagtcgaagcttgaaaccaagaagcaggcttctaaaggatatgaatctgctggggtcttggtggcttcatctaacgattcacagaagagttgggttatggactcaggatacacataccatatgtgccctgtaaaggattactttgaggatcttgaacagaaggagtatggaatagcactccttggaaacaacaaggcttgcaaggtgcatggcattgggactatcaggccgagaatgtttgacaacagggaaatgttgctgcaagatgtgaggtatgttccagagctcaagagaaaccttatctccataagcatgttcgattttataggatacactacaaaggttgagaatgggatgatgaagagaacagaagataagtccaaattatggcacttatggctaggccacatcagtgagaaaggcttgatagaacttgaaaaacaacacttgttgatgggtgataaactccataaattggagttttatgaccagtgtgtcttggggaaatctcacaaggtgaaatttgggacag

SEQ ID NO: 89406 - DNA, 600 bp, Glycine max
  Peptide Sequence Number=SeqID_206184
atggttgttctagaagggttgaggtggaggttaggtgatggcaacagaatccatgtttggtttgacccgtggcttagagggggtaccaaaaaattaacaaaacctattgtgaatagctttgatccaaatcttttgctcaatgatctcattgatagggactctgaggtggatgatgcaattgaagcaaaacccatgccattgattaacttacaaggagaggacaagcccatttggaggtttagcaaggatggaacgtatacagtccgaactacataccacatgttcatggaggacaacaagaatcccatgtcaagcaatatggtgcacaaagcaaatgcttttctatcagaaaagaggcaagctcaagaggaaggcttatctaaaccgacaaccaccacaagacaggcccaggatgacaaatggcaacctccttcaactggtttgatcatgtgcaatttagatgccacattttttaacgttgaaggagaatttggagcaggcatgtgcattagggatgacttgggacagtttctcttggtagcaacaaagctttatcctatctttcctctaatgaataaaggggaagctttggttttgtga

SEQ ID NO: 89407 - DNA, 308 bp, Glycine max
  Peptide Sequence Number=SeqID_206185
atggaacaacctccacctcatgagaggaatcttaggcagatggctgcacctgatttcagttatgaaagtttgtgcattcaatatcctgatgagggtgttccatatgttctcaagactggactaatacatttcttgcccaagtttcgtggtcttgcaggtgaagattctcataagcatcttaaggagttccatattgtttgttccaccatgaagccccgtgatgtccaagaagatcatatctttctaaaggcttttccttattctctggagggagtggcaaaagattggctatactaccttgctctcag

SEQ ID NO: 89408 - DNA, 423 bp, Glycine max
  Peptide Sequence Number=SeqID_206186
atggctaaaggatttactcagattgaaggtgtggattacaatgatatattttcacctgtggtaaagcattactctgtcagaatcttgatgtcaattgtcaaccaatataatttacacctagaacaattagatctcaagacagccttcttgcatggtgacttaaaggaaaccatttacatgaggcaactagaaggctttgctttggatgatatgaggaaccctcaaggtggagcaatgatcgaagggtttgtggatggagattttgcagggtgcttgaatacaaggaaatcattgtcaggatatgtgtttaccttgtttggaactgcaatcaactggaaatcaaacctccaatcagttgtagctctatctaccattgaagttgagtataatgccttagctgaaggagtgaaggagggtctatga

SEQ ID NO: 89409 - DNA, 2901 bp, Glycine max
  Peptide Sequence Number=SeqID_206187
atggcactacccttttgggtggtggatggccaacaatggccagttcactttttggcctgctttcatccaggcactccaaacctgcttcacgtcttcctactacgacaacccactggaaccctcttcaagctacagcagaccgacaccgttgctcagtatctttcagactttgaggacttagccaatcgaatagttgggctaactcctcaatttcttatgagctgcttcattttggggctcacgctcgacatctgccgcaaagtacagacattgcaacccctgaccttggtgcaggctgtcgggcttgctcgtctccaggaagaaaagctcctggacacacgaccccccttccgcaaccgtgctcctccgatcttgcccgtgccacaaccacgcccaactccctcgcttgcgttgctctctcctccgattccacgcttgcctccaccccgtccaccgcccaccttgaagcacatgtcgccagaggagattatctctcgtcgcgaacgaggcctgtgcttcaattgcgacgagaagtaccatagaggccaccgttgtgcctctagggttttcttcttagtcacggaaaaggacgaagctattgaccctaatatagaaggacttgacccgggcccagaaccacccgatatccatttggcctcggaaacactccgtttgatcggcatggtcgtcggccactttatggttgtccttgtggatggtgggagcacccacaacttcatccaagaggaattggtggcccaacttggattacagactcgggatacaagcccactgcgagttatggttggaaatggccaacacttagtttgcactcgctattgcgcggacatttctctcaccatccagcactttacttgtgtggtggacctgtatgtgctgcccattgctggcacgaacatcattctcggtgtacaatggctaaaattgcttgggtcggtgctcactgactatagtactatgagtatgaagttcttctatgatggccaactcatagaacttcacggagatacgaagcccatgttgactatgttgaccccaccccagtttcgccgcttaactcgtaaatcagatactagctccttctatcatattgtggtgttagcagaggcccagtcttcggactccagtatacctcttcctcctcgtatccaagctttagtggatcactttggtgccttattccaaccaccatccttattgccgccggagagggtgactgaccaccacatccacttaattttgctagtcgcaccggggcttattcgtccgagtacaagccctttctcatcaccagtgctgctcgtcaggaagcaggatggctcttggcaattttgtgtggactatagggcacttaatgcggtgaccatctgtgaccggtttcctatccccaccatcgacgagcttcttgatgaattgggcaatgcttgctggttttcgaaattggatttattgcaaggctaccaccaaattcggatgcattcgccagacattgccaaaacagcatttcggatgcaccatgggcactatgaattcaaggttatgccttttggcttgtgcaatgctccttcatccttccaggcgactatgaatatgattttcaggccgttcctccatcgctttattatcgtcttcttcgacgatattttgatttatagcatgaccttcgaggaacatgttggcacacgtggagcaagcctttcaggtggaataccttggacacgtggtttcgcaaaagggggtggaaccagtttccacaaaggtggaggcggtacaccaatggccgttgagacaaacgcttctggtgtaggcatgggtgcaatcctttcccatcacggcgacggtcaagaagtggcggcaatatcttctcggccaccactttaccattcttacagatcaccgcagtctaaaggggctgctcatgcaattctttcaaaccccatagtagcacatgtaccttgctcgactgatggggcaattcaatcgtttctggccaagtatcctgagttcaccatagccaatggcctgatactccgcaagggtcgtatttggctgccgccgcaattgcccttgatcacgacactccttctagattaccatgccacaccgacaagaggtcatctaggcactacgaaaaccatagctcgtctgatggataatttctttagggaagggttgcaagatgatgttactaagtttgtcgagagtttccttgattgtcagcacaccaagtatgagacaaagaggggaaacactattattctcgtagttgtggatcacttttctaagggtatccatttggggtccacaccttacgaggttacctttgggtggaaaccttttaactttctgaagtacctcaccggaaattccaaggtggatgttgttgatgagatgctaactaattgcgaggaagctttcctgctcatccgcaagaagctcattaaggcacaaggtcttatgaagaaatatgctgaccagaagtgtcgggaggtggtctacatattggttctggatcgcgtggggcccgttgcctatcgtttgaaacttccaaagggcactagtgttcatccagtattccactgttctcttctgaagccgtttaaggggtcgtcagagacaacagacacaactcctctgccagaccaaattgttcataatcagccccttatatctccattagcaatccttgactattgtcaagcttcatctggggtggattctcactgggaagttttagtccaatggtctggcctctcccctgatgagacctcgtgggaaagctggccccaattgtgtcgggattatcaccttgtggacaaggggtgcaagaagcaactagtagtgagcctagtagagacattaacaatggggtgcaactag

SEQ ID NO: 89410 - DNA, 123 bp, Glycine max
  Peptide Sequence Number=SeqID_206188
atgaagggtagagttaacctagggttagaaggtgagagtatggtgttgacttatgagaagcttgggttgtgcaagagagaaaaacaaatgaccaaagtgaacaacgagccatttctagggtaa

SEQ ID NO: 89411 - DNA, 192 bp, Glycine max
  Peptide Sequence Number=SeqID_206189
gagatcaaaatacaccaatgaaaagctagaaagcttagggacggaatacttacttgttggtgatgaacaaaagcgcaaaacggaatcaaaaaatgcgaaaaaggatgaccctagggctgcaaattcgggaacattaaccatgtcccctcccttctcatggattagcattttgcctaacttgaacttacttag

SEQ ID NO: 89412 - DNA, 336 bp, Glycine max
  Peptide Sequence Number=SeqID_206190
atggtagtagcaagttcaaatatggacgagatacaaaacttgaagatacagttgtcaaaagaatttgacatgaaggacttaggttcaacaaagaagatccttggaatgcaaatcatgagggatgagcaaaaagggatttttgcagttatctcaggcaaagatcagttacctcaaacagaggaagaaagagggttcatggctaagattttgtatgcttcagccattggaaatttaatgtatgcgatagtttgtacaaagccagatattggccatgcagtgagagttgtaagcaggtttatgtcaaatccaggtaaaaactcattgggaaggagttaa

SEQ ID NO: 89413 - DNA, 423 bp, Glycine max
  Peptide Sequence Number=SeqID_206191
atgaccatgcgacgcgatttgatcaaagccggcgtcgatccctcagacatcgtgctggattatgccggtttccgtacgctggattcgattgtgcgcacgcgcaaagtcttcgataccaacgacttcatcatcattacccagcgcttccactgtgaacgcgcactgtatatcgcccagcatctgggcattcaggcgcagtgctacgccgtgccgtcaccgaagaatatgctgtcggtgcggttccgcgaggtgggtgcgcgtctcggtgcgctggcggatctctatctgatgaagcgcgagccgcgtttccttggcccgctggtgccgattccggcggtgcatgaagtgccggaagatgcgcagagctacccggcagttacaccggaacagttgctcgagctggaagagaagctgcggaaatag

SEQ ID NO: 89414 - DNA, 231 bp, Glycine max
  Peptide Sequence Number=SeqID_206192
caaaccgccattgccaatggcgagtttgctgagcatctcccacgtggcaaggaaaacgccactggtgatggcgatttcatagcagcttcaagtcgccagctctattggcgagtctgggcacgggattctagtttgcttttcaggagggaggcacgtttttcagctttttcagataaaggggaagacacgtttttcagcttaggggagttgcaactgccattggcgagttaa

SEQ ID NO: 89415 - DNA, 480 bp, Glycine max
  Peptide Sequence Number=SeqID_206193
atgaagctactgaaaagacaactaggtgcacccagcaatttattgaatgggccattttgcccttcatttagaaatttaaaaaagttttcctcctcttccggaacctctcagtctctcgctgcttgtttacttcttctccgcgagcccgactgcttgttttcttcttcagactcaaatccttcgaggaagacctgcaaaggcttcttccggaacttccggaagaaggtgttccggaaaatttccggaagaagggttcttccgaaagtaaccaaaggtcatccggaagcacacttctttcgaaaatattccggagcaccttcttccggaaacttcccggaagaagtagttctttcggaaagtttccggaagaagggttcttccagatgccctttgaatattccggaagaacttttcggaagagcaacttttttcggaaagtttccggaagaactacttcttccggaagttttattttcttaa

SEQ ID NO: 89416 - DNA, 552 bp, Glycine max
  Peptide Sequence Number=SeqID_206194
atgccaatctccccctgcagatggatcgtgcccacaaatcgcccagtgggcccgaagaagtccaatagggccctggggtttccagctctggttatgggcctctatcagtcctacagggtgcccattcccccagcgaggtcatgccatcgtgacataggaatcgcacccacaaagacacccagtggacccgaagaagtccaacagggccctggggtttccagctctggttacgggcctctgtcagtcctacagggtacccgttcccccagcaagggatcgcgcccacaagacacccagtggacccgaagaagtccaacagggtcttggagttgccaagctctaattacgggcctctgtcagttctacggagtgcctgttgcccccagcaagatcatcaggccccctactaatcgagctttcatcaagaagtactgcgtccccaggcaggcgcagggcgaaacaccacagcagcctggggatgaccggcagcgggcaacagacgcaccgccatcacctctagagttcacctcagctcatccacaaaaaggttag

SEQ ID NO: 89417 - DNA, 474 bp, Glycine max
  Peptide Sequence Number=SeqID_206195
atgggtattttgagttggaattgtcacgggataggtcaacatcgggcaactcctacactcaaagacctggttcggtctcacaaggttgatgtagttttcttgtgtgagacacttgcaattgtgagtaagattgaggagtgtgtgattgaagattttaatgatctccttagcatggatgataagagggggcaggtagaccatccattagggcttctaaatggttttaggagtacagtcatgtgcagtggtcttagagatgttcgcctagagggttatcaatttatgcgggcgagaggaaggggtattgaggaattggtggaggagaggcttgataaggcactcacatctcatgaatggatagatgttttcctaaattgtaagttgcagaacttgatagcaatgatattttatcactttctaatatggctttgtggcgtccccaaaataatgactggtttaatagtaatgatttaa

SEQ ID NO: 89418 - DNA, 1110 bp, Glycine max
  Peptide Sequence Number=SeqID_206196
atggaacgaagtggcggaatggtaacggggtcgcatgaaaggaacgaacttgttagagttagacacggttctgacagtgggtctggtattggtaatgaaaattggtcgttaactgtgagtgattttctgatcgtgatgcatatcaaagatttcatcactaattttgtcaaaatcatgtctaaacccttgaagaatttaaatggtcagatttgtcaaatatgtggtgacaccattggattaacggctactggtgacctctttgttgcttgtcatgagtgtggcttcccactttgtcattcttgttacgagtatgagctgaaaaatgtgagccaatcttgtccccagtgcaagactacattcacaagtcgccaagagggtgctgaagtggagggagatgatgatgacgaagacgatgctgatgatctagataatgggatcaactatggccaaggaaacaattccaagtcggggatgctgtgggaagaagatgctgacctctcttcatcttctggacatgattctcatataccaaacccccatctagtaaacgggcaaccggtaatgtattttgctgattctgagtttctctacttgggtgaaatcgcaagtgtaccagcaaaaatgtgggaacttatgtctggtgagtttccatgtgctacttctgatgctcaatctatgcaaactacatcagatcctatgggtcaatccgaaaaggttcactcacttccatatgctgatccaaagcaaccaggtcctgagagtgatgaagagataagaagagtgccggagattggaggtgaaagcgctggaacttcagcctctcggccagatgccggttcaaatgctggtacagaacgtgctcaggggacaggggacagccagaagaagagagggagaagcccagctgataaagaaagcaagcggctaaagagggcatttgaaaatggaaataggctactgaggaatagagtttcggctcagcaagcaagggagaggaagaaggcatatttgattgatttggaaacaagagtcaaagacttagagaagaagaactcagagctcaaagaaagactttccactttgcagaatgaaaaccaaatgcttagacaa

SEQ ID NO: 89419 - DNA, 180 bp, Glycine max
  Peptide Sequence Number=SeqID_206197
gaggatcccgaggagctacctcctgagcctgctgtggatgctcttgactttctagagggtgatgaagacccactccctaaggtggattctcccgaggacgtcatgtcggcatctgaggcagactctacggaggatagtggtcctggagagatggcgatcagtggaggctcttcatcatag

SEQ ID NO: 89420 - DNA, 213 bp, Glycine max
  Peptide Sequence Number=SeqID_206198
atggtgaaagaaaatgaatgcaaagagaagaaaaaatatgattggtatgcttccaaagaggagaatactgatgcggagagaatcatcgacgtgagaaaagagttgcgagttcaagaacgaaatttcggaaactttcaggtggaaagaaggatgaaggttgatagttgtttcatcttacaaaaacatggctcaattaaagctcataaaaactag

SEQ ID NO: 89421 - DNA, 198 bp, Glycine max
  Peptide Sequence Number=SeqID_206199
atgaaaggccttaagagtgtgaatttcatagagcatagagcagagcaaggggccaagttttcatcttttagggagattagtgagtttttgagagattgtgagattcctagaggtggaggagacatccctactcctttggactttagcattgggaaatgtactatttccttagaaattgatagagcagggactgaataa

SEQ ID NO: 89422 - DNA, 540 bp, Glycine max
  Peptide Sequence Number=SeqID_206200
ggcacgaaggatgaagattgggctcttcttgatagacaacccctcggagttatccgattgacgttatcctgcaatattgctttcaacattgcaaaagaaacaaccacaacgggtcttatggcggctctttccaaagtacgagcattgacacttttgtcttctctaccaaaaagttggaatgctattgtcataactgtgagtatctcgttgggaagtaataagttaaagttcaatgatgtccgtgatctggaagaaattcaaccagaggatatgaacgttgaaaatcaaaagaccacaggaggtccaaatccaagaatcatcgaagttccctcaactcgaaaactatcgagtgttggaattgtggaaaaatcgggcattacaaaaatcaatgcaacattgcaccaaataatcaagaggaaaaaggcagaggcaaatgttaactccaccttaggaggagacaatgcattgatacgttctttagagaacaagaaagaatcttgggtattagattttggagcatcctttcatgctacttcgtag

SEQ ID NO: 89423 - DNA, 834 bp, Glycine max
  Peptide Sequence Number=SeqID_206201
atggctgaaaatgagacaggattggagatcaaaaggcacagaactgacaatggtggtgaatatgtagacagatttaaaaagtttttctatgagcacaaaattagaagggagaggaccatgccaggaacacctcaacacaatggtgtagttgagcatatgaaccaaacattgacagaaagagccaaaagcttacatgtacagtctagcttaccaaatgttttttgggtagaaacaatcaacatgtcaacttacttgatcaaccaaggtccatcagtaccattggagcatggaataccagaaaagatatggagtggaaaagaagtgaaacttacacatcttagagtttttggttgtgttgcttgtatcaatgatcaaggtaggaataaacttgatcccaaatcgaagaagtgcactttcattggttatggagaaaatgagtttggctaccatctttgggataatgaaaaccaaaagatgatttgtagtagagatttgatcttcaatgaaagagtgatgtacaaggataggaacgacacacatactagcaacccagaaaaaagtggaccaatatatgtagaggtggatgatgttccgaaaactcctatagttgagagtcctcagctagaggaatcaactgaacatagtagtgacaacaacttaatagaccaaaaccttttactccaggagcttgccatgaaatacgagatgaagcctttgatctttaatcaaacatggaaactagctatgttagctatgggaaagaaagcacttcacaacaaatggatttaccaggtgaaggaggatcatgatggctccaagaaatataaagcctga

SEQ ID NO: 89424 - DNA, 361 bp, Glycine max
  Peptide Sequence Number=SeqID_206202
atgggtagcttttatcaagtggcagatccagaaggacatggtttgctggcaggtcatcatcttccttcggaatcagcaagaaaaacttggaagcacacttgtgacctctgtggtactctcatcacaattgaagcagaggcccatttcacgggaaccaaccttgtgagtcacaaaacttcttctcttggagatgagctagggccaccacttgaaccaagcggggtacctccagcttcatacggtggggaagaagatggggagtgtacgttgagtggtctcgagaagggtcatcctttgaagaagctcatccagcttggtagacatattattttgagtagttgtaagggtaagctggttggag

SEQ ID NO: 89425 - DNA, 210 bp, Glycine max
  Peptide Sequence Number=SeqID_206203
atgtcattgcttagcgctgttcatgtgtctccattatcaagtgcgaagcttctggtgactgggaagcacgttattctgttgttttccagatcggttccttcgccaaaagaaaaaagaaggaatggagacgagagtcgtcatcacagaagggcaggacggacgaaatcagtgtcctatctttgctttcctcttatctccgatgagaggtaa

SEQ ID NO: 89426 - DNA, 261 bp, Glycine max
  Peptide Sequence Number=SeqID_206204
atgactgcttattgtgaagttacaaaagtatgtgttagtaaacaacccacaattcagaaattcaatagtgcctgtttcagctgcacatcaactggctgcaaaccacaattcagaaattcaatagtgcctgttccagctgcacatcaactggctgcatacctttcaggcagcacccactactgctggcgaacagagtcaaatagtagaaaagaaaagtttaccttggttgtcaaaacttacatcttaaatcctttgtgctga

SEQ ID NO: 89427 - DNA, 336 bp, Glycine max
  Peptide Sequence Number=SeqID_206205
atgaaaaatcatgaaattcattttggtaagaactactcaatagaaaactttcaagggggacaagaattacaaccttactaccaaaatgaagcagaaagaggttccaatcgggataaactattgatgcaattcatggaaacaactaaatcaactcaactagcactccaaagcgtagaaattcaggttggtgagctggcagaagcagtaactcaatttatgttcagacaagaaaaatattttgtagaggttgaagctcaaaagaaaagccctgtaaaagagcatgagtcaagagaaaaagatgaggagaaagatgaggaacaagcacaacaacaatga

SEQ ID NO: 89428 - DNA, 510 bp, Glycine max
  Peptide Sequence Number=SeqID_206206
atgcagctgcctcaccaatccaacatcatcaccacatgcaatgatcacgcccgacaatgtaaacccgtcaaggccgaaacgaagctctctaacttctgcaaagagcctcaatgctggccgacactcacccctatcagcataggcagctataagggtgttgtaagagacaatgtctggttggggaatttcatcgaacacctggcgggcgaggtggataagggagtgtttggcataggcattgatgagggtgttgtaggagaagacattggggtattgggtgaggtcgaaggaagtttgggcattgtggagggagccacatttggagtagaggagggtgaagtgattggacaggtaggtggagggtgggatgagggacttgaagtaaagggcatggagggttttgccagttatgaggtccctttgggctatgcaggctttgagaaggttgcggaaggtgttgtgtggttgtggctcatggtggtgttgaagtggaaacaagggcctcaatag

SEQ ID NO: 89429 - DNA, 1311 bp, Glycine max
  Peptide Sequence Number=SeqID_206207
atgggggagggtgggggcagggatgaggtttcgtggaacgcgatgatcgtggcatgtgggcagcaccgggagggattggaggctgtggagttgtttagggagatggttaggaggggtttgaaggttgatatgtttactatggcgagtgttttgactgcgtttacttgtgttaaggatttggttggggggatgcagtttcatggaatgatgattaagagtgggttccatgggaattcacatgttgggagtggcttgattgatttgtattctaagtgtgctggtggcatggtggaatgtaggaaggtgtttgaggagattgctgcaccggatttggttctttggaacacgatgatttctggattttcacagtatgaggacttgtctgaagatggtatttggtgtttccgggagatgcagcacaatggttttcatccggatgattgtagtttcgtgtgtgtgactagtgcttgttctaatttgtcatccccttctgtgggaaagcaggttcatgcattggctatcaaatctgacattccttataatcgtgtttcagtgaataatgctcttgttgccatgtattccaaatgtgggaatgttcatgatgcaagaagggtttttgatacaatgccagaacataacatggtgtcgctgaattcaatgattgcaggctatgcacaacatggtgttgaggttgaatcgctcaggctttttgaactgatgctgcagaaagacatagcacctaacaccataactttcatagctgttctttctgcatgtgtacacactggaaaagttgaagagggtcagaaatatttcaatatgatgaaagaaaggtttcggattgaaccagaagcagaacattattcatgcatgatagatcttttgggtcgggcaggcaaactcaaggaggctgagaggattattgagacaatgccatttaatcctggttctattgaatgggctactttgcttggtgcgtgtaggaagcatggaaatgtggaacttgctgtgaaagcggccaatgagttcctccagctggaaccttataacgctgctccatatgtgatgctttcaaatatgtatgccagcgctgccagatgggaagaggctgcaacagttaaaaggctgatgcgggaaagaggagtgaagaagaaacctggttgtagttggattgagatagataagaaggtgcatgtctttgtggctgaagacacttcacatccaatgataaaagagattcatgtgtacatgggggagatattaaggaaaatgaagcaagcaggatatgtaccagatataagatgggcattg

SEQ ID NO: 89430 - DNA, 150 bp, Glycine max
  Peptide Sequence Number=SeqID_206208
atgaccttacttagtgagagtgacctgacaaacccattgtgtggtgtgtcttgttatgtactcctaagcgccccagggtggtttttcactgacatggtggatgactatgaagaacatcatgctagagggcacgggaacacaacgctctga

SEQ ID NO: 89431 - DNA, 1308 bp, Glycine max
  Peptide Sequence Number=SeqID_206209
gaagatgatcttgcaaatcttacaagcttgacggagtttggtgcatcagggaacaatttcactttaaaagtgggtcccaattggcgtcctaattttcggctttcctatttggatgtgacatcatggcagttaagtcccaactttccatcgtggattcagtcacaaaacaaacttgaatatgttggactatctaacacggggattttcgattctattcccacacagatgtgggaaacacttcctcaggttttgtatttaaacctctctcataatcacatccatggtgagagtgggactacattaaagaatcccatatctatccccgttattgatctaagctcaaatcacttgtgtggtaaattaccctatctttcaagtgatgtgtctcagttagatctttcaagcaattcaatctctgaatccatgaatgactttttatgcaatgatcaggacgagccaatgcaattacaatttctgaatcttgcatcaaataatttgtcaggagagatacctgattgctggatgaattggacatttcttgtgaatgtaaatttacaaagcaaccattttgttgggaacttaccccaatccatgggttccttggcagagctgcagtctttacaaattcgtaacaacacactctcaggaatatttccaaccagtttgaagaagaataaccaattgatatccttggaccttcgggaaaataatctttcaggaagtattccaacatgggttggagaaaagctcttaaatgtgaaaatcctcctccttcgatcaaacagttttaccggtcacattccaaatgaaatatgtcaagatgagtcttcttcaggtatagttagtgtgctactatggctaaaaggaagaggagatgagtatggaaacattctgggtttggtaacaagtattgatctgtcaagtaacaaattattaggagaaattcctagagaaatcacagatctaaatggattgaactttttgaacttgtcccacaaccaattgattggtcctattccagaaggtattggtaatatgggatcgttacaaaccattgatttttcgaggaatcaaatttctggtgaaatccctccaaccatttctaatttgagctttttgagcatgctagacgtgtcttataatcatttgaagggaaaaattccaacaggaactcaattgcaaacctttgatgcctcccgctttattggcaacaatctatgtggtccaccactgcccataaactgcagctccaatgggaaaactcatagttatgaaggaagtcatgggcatggagtgaattggtttttt

SEQ ID NO: 89432 - DNA, 613 bp, Glycine max
  Peptide Sequence Number=SeqID_206210
agaagggaaagccagtgactggagcatctgataatcttcgtgaatggtggaaggacaaagtccggtttgatcgaaatggtcctgctgccataaccaagtatcaagctgataacgctattccggggaagaatgatggatgcaatccgatcggtccaacaccacacaccttgcaagagctgcaagacacaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccggtgcgtcagcagaatatgtgatacaggatatattcccgcttcctcgctcactgactcgctacgctcggtcgttcgactgcggcgagcggaaatggcttacgaacggggcggagatttcctggaagatgccaggaagatacttaacagggaa

SEQ ID NO: 89433 - DNA, 615 bp, Glycine max
  Peptide Sequence Number=SeqID_206211
atgacaatagtatgttgtgacttgtctcgacccccatcctcttgtggctataaggggaaggagaaagcaaagctgaagaagtcacattatgtaattaaaccaccatcatcaattgttgcaaccataccacccccaattagaatagccacaacaaaatcacatgctcaatgcttacaagactcaccatcacaacatgatgttccatcatcctctaaagataatcttgagaacttgtctgacaatgaacatgatttagacggggaaatggaagaaccctcatccgctgatcattctatgattatatctagaggtggagggtttgaaccaagtaggattgcgtcacaagctatttcaatgaccatcagtgtccagtgcatgcaattactgctcttaaaagaattattggtttcattgaagttgccactattggtggtgatgtgcttgctagtgtttgggtttatggttttgatcatggccaagcaaggagatttagaaaacataatggaagtgatgatgcaatccttccaagaaggagacccatcaccagagccatggttaggagactccaggaagattgggctagggatgcaagagaaggccttaggattctcataa

SEQ ID NO: 89434 - DNA, 561 bp, Glycine max
  Peptide Sequence Number=SeqID_206212
atgaaatggaagaacgtctcagtagcagaatggaatcaagatttgtcgagctcgctgcttccatgcaataaacaatacacgaaatgttttagcagaggcaacaagattctccagcagcaagcaatccacctagagccaaattctgttcgaaaggcttattcccttgcaaagatgtatgaatcttccttctccaatacacaagccaaaccatttgtcaagaaccagaaatcttcctttgttcctaaaccacccctacttccaaaccctcctagatcaaccaatcctttaaccatcaatccctctaccaaaccacaaacacctaagcacctaactcccacatacatggctgaaagaagatcgaaaggcctatgctacttttgtgatgaaccatttacacttgaatatggccttacgcataagagattgcagatccatgtgttggaaattgaagatgaagaagaaggccctggacctcaacaacctgatgctaatgtggttactgaacctgattcagaacctttaatttctgtgaatgcattaactggagtagctaatttttga

SEQ ID NO: 89435 - DNA, 1521 bp, Glycine max
  Peptide Sequence Number=SeqID_206213
atggcggcacctcctcctcctcctcctcctactacgccgtcgtttttgtcgccgacgcagaggtacgccgcggccgcattgttcggcctggctcttcacgaggcccacctcaaccaaaccagcccatttccgttacccgcttcggaggactcgctctcagtttcggaacaacgaaccagtaacagtagcagctccggcagcgactccgtttccgatgacccggatctctgggtccacagcaattcgggtctgctccgccccgttttcaaatttctagatattgattccgctgcgtggtctggactggaggaaaccgctggttcttcttccgctacgcatcatgtgggacccttcttgagattactttcacaagaattggacgatggttcttctcaaaggttagatcaagaacgtgctttgtcaagtgcggttgatggtatagcacttgacatgcagagaaaatccgagtcttctgagtgtaaaagagagaagcttcgtgaatatgagcatcaatgtcgtgagaagatttcaattgatgatgttcagcctcattgtgaaaaggtggatgcacatttggaagttcagaaggagacggatgctgctcctttacttgactgtaaagagacgcagcagggatctgttgattggaaaattgatgagagaccgattgaggaagtaatgatgctgagtgatcagaggaaggtgacagttctgtatgaacttctgtctggttgtctatcaaatttaggtgaagatattgggcggagaaggaagggctatgatgctcgacatcgtgtggctctgcggttgctggcaacatggcttgatgtcaagtggacaaaaatgatcatgagatatgagtgccatggtttatgctggattgtcgtgaacattgccttcatttctaagctacttgaattagagttgaatgtgattgtaaatgaggccattgagaccatggttgcttgttctgcgatggcttttcttaaagggcaagaatcaaagaacgaagaaactcaatcaaaagacagcaagtgggttaaattgaagcgtggtggtataattggtgctgctgcattaactgggggagctttgttggctattactggtgggttagctgcaccagccattgctgcaggtcttggtgcattagctccaactttgggtactctgatccctgtaattggtgcaagtggatttgctgcggctgctggtgctgcaggaactgttgctggctctgttgctgttgctgcatcatttggagctgctggagctggacttactggaagcaaaatggctaggagagttgggggtgttgatgagtttgaattcaaggctataggagaaaaccataaccaaggcaggctaggggttgagatcttagtctcaggatttgtctttgagaaggaagattttataaggccatgggaaggacagaatgacaacttggagaggtacaacagtgaacatctaccttcaataatactagtaccattggtcaaggaaggtggtttcacctag

SEQ ID NO: 89436 - DNA, 753 bp, Glycine max
  Peptide Sequence Number=SeqID_206214
atggaattttttgtccatggaaaaagacatgtcctgagaggagctactcctaccaatctggccattgcccaaaaacaacatcttcataaaactatctcttatggtgtccacctttctctgattagtttgcaatctgcagttgaaggctccctgctccactctttgactactcatgctagtcaacaggaaccatctggtcttcccccttgtcgagttggccatgatcacaagattcctttaatgcaaggagataaccctgtcaacaagaggccctataggtatactaaacaacaaaaagacattattgatggattgattcaggactatttaaagtcaggaattatacagaagagtgacagtccttatgcaagtccagtggtgttcgtgggaaagaaagatggggcctggaggctttgtgtggattatagggatctcaataaggcaactgtcaagaacaaattccctataccattagtagaagaccttctggatgagttgcatgggtcaaccattttttccaaaattgacctaagagctggttacaatcaagttcaaatggatgcaattaatattcacaaaactgttttcagaacttatgcgggccactttgaatacttggtgatgccctttgggcttaccaatgctcgtgccacatttcaagggctgatgaattcaatttttcggcattacttgagaaggttcttacttgttttctttgatgatatactcatctacaacagaaaaagcagttag

SEQ ID NO: 89437 - DNA, 273 bp, Glycine max
  Peptide Sequence Number=SeqID_206215
atggtggcagctgttggagctggacttactggaagcaaaatggctaggagagttgggggtgttgatgagtttgaattcaaggccataggagaaaaccataaccaaggctttactcacgaaaggattagctggaatccaacctgtcgatattcttgggatttcgaaaatgagaaaccgggagaggaaggagtgttctccaagcaagttgaggcgataatctccgtcaatcaaaaactcagttatggcggaggttattgcctcgacttgctttaa

SEQ ID NO: 89438 - DNA, 861 bp, Glycine max
  Peptide Sequence Number=SeqID_206216
atgaacgtggatcacgatcagcctccctcggcgacgaaggcccaggcgctgcagaccctaacggcgggtcctctatcgtcgtcggtggcgaagctcgctgcgtcctcgcggtgcatcccttccgacaaggacttccacttctaccgcaacttcgaggagttcaaggtccccgtcgaggaaatcgctcgggagtcgcggtcgatgctcgaggccatcggcgctgcggcagcgcatgcggcgttccctgacaacgacgtcgacgacgacgccgcatacgactggctggtaaacgcgaatgacgacgttttggagcggttcgacgcgtcggtggacgagttccggaaggttcggcaggaggaagaggagactgggcgtccggcgatgcatccgatggaggaagatgggtttcaattggtgacggggaagaagaagaaaggggggaaagggaatgtgactccggcagcgacgggttctgaggtggcggcagtggcgccaccgggagttacggtggcaactaaggataagaagacgatggggccgaagtcgaaggttccgtttcatataccaacgattaggaggccgcaggatgagtataatatagtggttaataatgcaaacatgccgtttgagcatgtttggttgcagaggagtgatgatgggttgagcttcattcatccactggaaaagctatctgttttgaattttgttgatacaaatcttggggatgttgtgcctgtgaagcctccctcgatagaaagcaccccttttaagctcgttgaggaagtcaaagatttaaaggagttggcggctaagctgcgttctgttaatgagtttgctgtaaaacatgattactattcataa

SEQ ID NO: 89439 - DNA, 609 bp, Glycine max
  Peptide Sequence Number=SeqID_206217
atggaggatattatgaggagtactgtgttgtttagggtgcttcttgtggtggttgttgtgatcgcaacaagaccttgtttggctaatgtgaaaaatgattttcacgagacaaatggtggcaatatttgcaactataccgctcaagtttctcgtggtggtttgggtggaggaggtgttggtgtaagtgagaaaaactcgtcggggatgttattaggtgaaaggaagttcagtgggggtaatggtggaaaaggaggaggtggaggtgggaatggaaaaggtggaggaaatgggggtgggagtggaaaaggtggacatgaagggcgaaaaagaagagggggaggtggttcaggtggtggagggggaggtggttcaggtggtggtggaggaggaggaaatggacaaggccatggaggtggtggtggaggtcatgggtggggaggagggagtggaagtggtggaggtggaggaggaggtggtggtagtggtgagggttggggttggggtaggggtaggggtggaggaagtggcaatgttaaatgttgggtgtggggatgtgagaagaagttagagaaaagaagtgaaattcgttcctccaactcaaagggataa

SEQ ID NO: 89440 - DNA, 1413 bp, Glycine max
  Peptide Sequence Number=SeqID_206218
atgaggattaagttatttgccttgtctaaggagtctgaaagttctgagtcttcagacactcctctggtggaggtctacaaacgcagttatgatgtctgcattcagctatatgagaaagaacttttgacagagaactcctatcttcatatatatgggttgcaaggggccggtttcaatgctcagcagcttgccattgtttctgggctgtgtgaatggagggacattgttgcccgtgcagaggatgaaagtacaggatatgtattgccaaataaatctgttcttgaaatcgctaagcagatgcctcttactacaagcaagctacggcgattggtgaagtcaaaacacccttatgttgaacacaatcttgatactgttgtcagcatcattaggcattcaatccagaatgctgcttcatttgaggaagctgctcaacagttgaaagaagcacaagctgtcactgcatcagatgtagtacctgttacagatggaactgaagatcccccatctcatacacggcattctaaggaatcttctcagcatcaagctacaagtgtaccaataaaaattaagtccaatagtcttatttttgagccaccaaaggatagtctcacaattgcagagcagaatagggatgcaaatgttggtgcactttctacagcaaaggggaatggagcagctgttcaggtgcttaaaaagcctactggtgcttttggggcactcctggggagttctgcttcaaagaggaagcttggtcctggtaagggcaaggaagagatcaagctagagcagattagatcttctgtcagtcttcctttccattcatttttgggtagcagtgaaaagtcagaacctacagaagaaattcctagtgtagcatctgaaatgtcagaaccgcagaaacctgtttctgatgtagtttctgcctctccagtagatgagattataatgctagaatcagatacgggtgcaaaggatatggagcagaataacctagaaaactccaatgaacacagggagaaagattctgttgtgtccacttcgggaaaagaggatgaagatgagccagtatcactgtcagaattgtcatcgaatttaaaaaaatgctttcattcaaatgatcaaaataataaaatcagacagcccaagaaaactgaacagcccagtggcttagtgcagctgaagccatttgattatgaagctgcaaggaaacatgttaagtttggagaacataaaaagcatgcatcttccaagggttccgatggtcatatggaggtagtagaggactccggtagcaagaagcagcgttcgacaacaggacagggacaagctagtgatttgagtaaacaattgccacaaggtagaagacgtcaggcgtttcctgcttctgggaatcgtagttcaacattccgctga

SEQ ID NO: 89441 - DNA, 390 bp, Glycine max
  Peptide Sequence Number=SeqID_206219
atggccatcttcatggaaccatcactaataagcatcacccaacaaccaccaaacccaatagcaaataagcctcacaccacccacatacttgtcactagtgttaaacccaccatgacaaccattaccaaccacaagcaaaaagcatcaatggagacttatcccgcaactcatcactcagattgtcatttccttttcgctcattgcttctttatgtttctcatggtctctttcttcaagaaagagaaagaggacaagaggaaggggaaggcgagggatgtgcgaagaaaggatggtggtggcagtttaagcacgacaaagggggctcaatctttgacgagaaagtttgtgtggaagagtgagagggaaaacgcgagagagttgaagaggtaa

SEQ ID NO: 89442 - DNA, 519 bp, Glycine max
  Peptide Sequence Number=SeqID_206220
atggccaacaatgtaaaaatacgcgttttcacctccctctctctcaattcacgcccaaaaaccctaacacctcctctttcagcacccacgaccaccggtggccgccaggagccgcagttgcttgtcgtcggaacacaacacgaagatgaacgctttaatcagagtgaaatcttcagaatgcacctcgaggatttggtagagaacagagctctcagcccttctttcgtggtttcttcgaggtttggtatatacagctctgcgattggaccgacaaacatgaacgtgagagacctccgagcgacgcagagaggagctgatggagagatatcgataggtgataggagtttatttttgtttttcatgaggaaaaaacttgtacttgggggatgtcacttggtttggaacttccttaagactcaggctgatcaccatggggaggaagttgcctatgcacgacagggtgacctcgacacttgctgcctagctttcctaagtaagagtgtcgcgtggaaacattga

SEQ ID NO: 89443 - DNA, 901 bp, Glycine max
  Peptide Sequence Number=SeqID_206221
atggagtgtttggaagcagcgttgaagagcagtttcaggaaagacatggccctcaaacaaacgttgttcctagaggagttctcgtccgcctctaacgttcaaaacgtcgtcgcttcctccgacgacttgttcgttgacgacctcctcaacttttcactcctcgaaaacaacaccaacaacaataacaacaacgaagaacccgaccaacaactcaacaaccacgactccaccacccctcagaacaaccaggaaaattacaattataacccctccttcaacgacaacaatttcaacaccgaactcaccgttccggcggaggaggaagttgcggacttggaatggttgtctcgtttcgtcgaagattctaatttctcggaatattctcttcccttccccgcaaccgtgactgagaaagtgaaagtgaaatcaccggaaccgggaaataccgctttcactttcaaaaccccggttccggccaaggccaggagcaagcgaacgcgaaccggtgtccgggtttggccgctcaagtcaccctctttggccgccgcgtcttcaacaacaacctcgtcctcgtcctcgtcttcgccctcgagtccgcaacgtgcggactcgagggcgaagaagcgtgccgctgcggacggcggcgcggcgcgacggtgcagccactgtggcgttcagaaaacgccgcagtggcgcaccggaccgctcggggctaagactctgtgcaacgcgtgtggggtccgctacaagtcgggtcggttattacccgaatatagacccgcctgtagccctactttctccagcgagttgcactccaaccaccaccgaaaggtcctcgagatgcggcggaagaaggaggacgtgcctgagcccgacaccgcttcgccaccgtcgcttcccg

SEQ ID NO: 89444 - DNA, 135 bp, Glycine max
  Peptide Sequence Number=SeqID_206222
atgaaggagatgtgggatcttatacaagtgactcgtgaaggtactccggagcaaggagaaactattggagatgtccaaaagagattcactcatatagtgaatcatctcaaaggccttgggaaagtgtttgagtaa

SEQ ID NO: 89445 - DNA, 312 bp, Glycine max
  Peptide Sequence Number=SeqID_206223
atggccaatggtggcagagaaatccaagcccttgaaatttacaagattgccaatgctattaggaatgttgccatggaaattgttttggtgaatatcaagcctagtgggaaacaccatgcttccaatggaagaaggggaatcctcccagaaaacttgttcccagatagaccaagttctgaaagagacttcaatgaggcaaagacagaagaagaacattaccagataagtggttgttgtcaaggtacaagttttcgagccgcgaaaggttttggaatgtttgctggaatgccaccattgaacttgtttgagtag

SEQ ID NO: 89446 - DNA, 933 bp, Glycine max
  Peptide Sequence Number=SeqID_206224
atgcaaaatattcaagtagtgagaaagaagatatggctcaatatcactaaattagcatcaagattattctcattagtccataatttggtttgggagtacaagcgggttttaggggttttgctatgtgtttatcctgagactgcagtgttggttggccatacttactactatcattggagcaacgctttacattatgttgacatgccggatttcaagtgtaacaatgaatactgcagagactgtcatgattcttacaaacgtaaacataggtgtgttagtggagcaatatacaacaatacaatgcaacttaaatcagctgatgaaagcacttcatctgaatttaacttgtgggatgacttgattattcactctactctaaaaatattctatgattctgatctttctattatgatacaagccattgaaaggaatactacatataattggccaaatgatgtatcaatttgggaacattgtgccaacaaccacacagcttgtccaaatcggtatgcttctgaaagcattagcttagcatgcaaatttgcctacagaaatgctacaccaggaagcactttggaagttttacacgtacacacatgccatgcgccactaccaaaaaggctcaatatgaagaggattaggcatatgacaagactcttcatcacttgtagtgatgacggtgcactttacttggaaaccaagttgaaccttaacatggttgagtttctcacaccacctaagctagaatttctaaacaaatttctcccgtgtaagcctaataagatgcattcacatagagaaaccttgccccaagtacttgtacaagtgaacatattcaattatgctagaatagctataggcatatgcaatctccatactcttcttcatgctatatgtcgtggctctagggaggaagtagcatttcctgattga

SEQ ID NO: 89447 - DNA, 112 bp, Glycine max
  Peptide Sequence Number=SeqID_206225
atgccaacagtctctcaggctgagccagttaatgcaaacataggacatcgtatagaagatatgatgcacacgatcttgggcaagacatttttcaacaagcacatggacccat

SEQ ID NO: 89448 - DNA, 1259 bp, Glycine max
  Peptide Sequence Number=SeqID_206226
atgtgttctcttcgtcttcacctattccttttagtggcagcttcaacaagctcattattcgaatccgcaacaacacactggagcgacaagcaggctctgaaagacctaaagaacaacctcgacccttcctccataactccaggctcgtgcctttattcatgggacttctccctcgacccctgcgacaacctcttcagcgacaacttcacctgcggcttcaggtgcgacgccgtcgtttcgggagccacccgcgtcaccgaactcgccctcgacccagctggttacacgggcccactcgtcataaaccaccacaacaacctcccattcctccaaagcctcgacctttccaacaactacttctcaggcccaatccccgactcactatccaacttaactcgcttaactcgactcggtctgtccaaaaactccttctcaggcccaatcccttcttccctcggttcccttataaaccttcaagagctctacctcgacaacaacaaccttaacggaactctccccgttagtttcgacggcctcacaaatctcaaacgcctcgaactccagtccaactccctaaacggtgtccttcccgatctaacctctctgaaaaatctttactttttggacctcagttttaattccctcaccggaggttttccctcgaacttgccagattcgttggtgcagatttccatccgcaacaacagcttaaacggtgcgtttgaatctgatgccttgaaaagcttctcctacttgcaagtcttggatttgagctcgaacaggctcaatggctccctgccgttgagcttgttcgagctcccgtccttgcaacaactgactctatcattcaacgggttttccgggatcaaaccgccatcgtttgcttttgacggtggcgtcgccgtcccaagcgagctgatagcagttgatctgagtaacaacgagctaggggggtttctgccgatgtttttctcgttaatgccgaagctttcgtctttgtcgttggagaataacaagtttgtcggaatgataccgacccagtatgcgttgaagacggtttttcccgaaccgggggtggaaccgttcgagaggcttttgttgggggggaactacttgttcggagggattccaagtgcgctaatggcgcttgaaccgggttctgccaacgtcaggcttgtggataattgcttctataggtgtcctcttagtttcttcttttgtcagggtggggaacagaagtcttacgaagagtgtaagag

SEQ ID NO: 89449 - DNA, 1935 bp, Glycine max
  Peptide Sequence Number=SeqID_206227
atggaaccctggcttccccaagacgattttcttctcaaaaatgccatcgagggcggagcgtcgctggaatcgctggcgaaaggagcggttcggttctcgcggcggttttccgttaccgaattgcgggatcggtggcaggcgctgctgtacgacccggacgtttccgccgcggctctagccgcgatggcgcatttggaggccgcgaagtacggcggagccgcggggaccagcgaaggtggcggaggtgggaagaagaggaaatctgaaagtatccggaagcattactttgcaatgcaaagaagacttcgcgggtgccggcattccgatgcaaagaacgcgactgaggggtgtgaagttagtgatgttcctatgtggaaaactattgaggatttttctttgcctgatatgcctgttaatgttgaaggtaacggtcgtgggttggaagtgagagtgaattcgaaaggtgagtgtggcaatggtgggttgagaataaatgctcctgatgatgctgtgttgagagatgatgctaagaacgatttggaatgtctcttgaactcggcaaatgaggatgggcttgtctttatggatgtagataggaaggaggtgacggctgtggataaggataagcctagttatgataattttgatttgattctgtcgagttccccttgtgatgttcagggtgatagtgatggccgtgagccattaggtggcggttgtgctgatcaacattgtgtttctgagtctggaaacgatgctggatcctctggtgctgtgcaaagtcctctccctgaacgcggtgagggttatatgatctgtgttcttaacactgaggacactgacatcccgagcaatgaccctacagatatacccattttatttcctgagttgatgcctctgaaatcccaaccagttattcaagagttgggttgtttggaatcttccataaataataaaagaagaaatgagtcagacggaagcctgaagatagaagccgttctttctcagtcttttgcagctttgcaaacagtttggcaggggttgatgcctaatgtgaattcaagtcaccgacctcttgttcttggactgaaaagtgaaaatcctggaagaaactctacatctgcagtttctagacagaataacaatgtgaatgccaacatcaacccaagtcatggtagattagttcgtgcaactgtgatgcctgcctcagatggacatctgaaacaagaggaaactaatgctcctgcttctgcacattcaaaggctgaggaacatacggctttatctaaatcagaagtaaaatcattatctctcgatcaggaaggatgtgatattaaagacgacgacgatgaggataatgataatgaacttcctaactttgctgatgttgaggaaatgttatttctcatatacttgatgttgcctggtcagattcttgaaatggatttatctccagcagatcaagatacaaatgcaagtagagaagtcttgcaatttcaacacgaacaaagtaagaggactataatgagattggagcaaggtgctcagtcctcaatgggaagagccatttcatctcagggtgcatttgctgtagtgtatgggcgcatcctgaagacatacattactaaaagcaaggttatacttggcagagaaacacatgatgtacatgttgacattgacttggggagagaagggcaagaggctaccagaatatctagaagacaggctgtaataaagttggaagcagatggttctttcattattataaatcttggcaagagatctatcttcttgaatggcaaagaaattgccacaggacaagcgcggggtcttagtgctggtagtttgatcgagattttaggcatttcactcatctttgagaccaataatggttgcgtgaggaagtttttagaaaatgagaatgagaagagatga

SEQ ID NO: 89450 - DNA, 210 bp, Glycine max
  Peptide Sequence Number=SeqID_206228
atggcggctttggttgttcgtataagcaacacaccaaagctgtcatattggattggatttggaagactaaaatgccagctagctggaatagaagagaagactgccaagttgaaaggaagtgagaaggctctagttgcacggcatgaagctagtcatgctgtagtaggtactgcagtagcaaaccttcttgctggacagccacatgttgag

SEQ ID NO: 89451 - DNA, 552 bp, Glycine max
  Peptide Sequence Number=SeqID_206229
gtcaacaaaagcggggctgttgctcctacgtaccctccatcgaagaggaaatcagacctacgtagttctttcttaagggtgaatcaagcgattctttttacttggaaggtggtcattttaaggcgttggaccttaaaaatgatcctttttacttggcgagaaaacgacttaaacaatcagttaaagctcgtcaaaaacggaagaaaagaaaccgaaattgaacgaaataaaaatgaaaaccaagaaacaagaaatgaattaaaagtcacggatttggaaacttatccgttgaagaacgaagaacagatgaagaacgggggatccgggacccttagaacagcccccatcaacctatttataggaaaaaaggggaggaggttgccgcccaactcgcccaagcgagctgggttgcttcctccagaagcaatccagcttcaaaaatactatgggaggcccaatttcaaaatttcaaaatttctatttgcaccccccatttttgataagttcacccccttctttcgtaatttacggaaaagttacggaagcccatag

SEQ ID NO: 89452 - DNA, 1509 bp, Glycine max
  Peptide Sequence Number=SeqID_206230
atggatattggtggtggagtggaagagccagtgagagagttgaggcaatacttcaaaactggaaaaaccaagagtgtaacatggaggaaaaaccagctcacatctctcatagaccttgttcatgagaatgaagatgctatatttaaggccctccataaagatcttgggaagcaccctgttgaggcttaccgtgatgaggttggaggggtagaaaaatcagccagcaaagctttgagctgcgttgagaaatggatggcccctaaaaagaacatcacttttatcgtcaaaagctccaaatcagaattgtatgccattaagagtgatatcccttttcttttcttcccagctaaaggagaagtgttgtcagaaccacttggtgtggttctcataatttcttcttggaacttcccaatcatactggcattggatccaataattggggcaatatctgctggaaatgttgtagtcattaaaccttcagagcaagctccagcatgctcttcttttcttgccaataccattcctcgctacttggactctaatgccatcaaggtgattgagggtggagaagatgtctgtgaacaattactgcgacaaaaatgggacaaaatattcttcactggaagtccacgtgtggcaagcgtagtgatgtctgctgctgcaaagaatttaactcctgttactctagagttgggtggaaaatgccctgccatactggattcccttcccaatccttcagagtttgagttggcagtgaaaagaattgtaggaggaaagtggggaccttgcagtggtcaagcttgcataggaatagactatttgcttgttgaggagaagttctcatctgctgtgataaaactattaaagaagttcataagaagattttatggtgaaaacccagtggagtcaaaggtaatttcaagaataataaacaagcagcactttgagagattatgcaatcttctcaaagaccctcttgttgcggcttccatcgttcatggtggttcagtcgacgaagaaaacttgttcattgagcctacaattttgttagatcctccactagattctgagataatggcagaagagatattcggcccactgcttcctataatcacattggataaaattcaggaaagtattgagtttatcaatgcaaagccaaaacctcttgccatttatgccttcaccaaagatgaaactttcaagagaaagattctatcagaaacatcctcaggaagtgtcgtatttaatgacacaatggttcaatttttatgtgatacgctgccatttggaggagttggccagagtggtttgggaaggtaccatgggaagtactcttttgacactttcagccatgaaaaagctgtaatgcatagaaagctgttccttgaaattgagccaaggtaccctccttggaataagttcaagctagagtttatcagattagcatacaggctgaactactttggactagtactgcacatgctgggcttgaaaagatacaactag

SEQ ID NO: 89453 - DNA, 721 bp, Glycine max
  Peptide Sequence Number=SeqID_206231
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggtcctcatgccgacaaaaaattgtccccaaatgaaattagggtatgacacaaaggttcacttttaccttgaatggagtcaagagcttctaagattgctagccaaagctaaggctatggtggacgtgtactcgacccctgaggaacttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 89454 - DNA, 423 bp, Glycine max
  Peptide Sequence Number=SeqID_206232
atgggtaaacctattgatcatgtcccctccacctttgatagagacgtggtgagcattttgcttattactcaccttggtattccgacagaggaagaggctatggtgatgaccactataggtggcaggatgaggtcgatgtggttggcagagctatatcatcgatatgtcgagttagggtcacgcgtgtggactattatgatatcttctgcacttgggaatcgttgcactatgtacctatacgaccatatcccctatgcacaccagtacaccagaaagcagtcatgggcgtttgctcattttcctaatgctggctatctagagcatgggacaggtgctctggattacctaatagccagcagttggaagccaacaagaggttttgggtttgccttttcgttcagggagaagctagatgagttgtag

SEQ ID NO: 89455 - DNA, 132 bp, Glycine max
  Peptide Sequence Number=SeqID_206233
atggagttgcagcggaagataaaggagaagagataccacaagcatggaaagtgtgactctagcacatgggaagcttccttgagaagtaagaaaggtagcttccttgggaagcaaggaagaaagcttccttga

SEQ ID NO: 89456 - DNA, 465 bp, Glycine max
  Peptide Sequence Number=SeqID_206234
atgagctcaaaaatctatcctgaggttcatgagaaccctaaggtcttcttcagcagctctagcccaatcctcttgaagcttctttctcatagttctggaggtagatgctacaacatcatcaggaaacaaggtgcttctgagtttgttaaagagccttatcacaactacgtttctagtgagttgttcgtctattttactaggctaacatatgcttacaagtataccaataagcatattaaaggttatatgactctactcatgcatgggtatttgagcattttgttaccattccttgtagtgagtaggtgttggattatgactacaaacactgcaacaaatcggcttgtgactacttggaagccgttgaggagtactaacaaggctgctgggaccagggagttgttggatcaattgttggggactagggagttgttggatcaactacaaatgactgatgttgcctag

SEQ ID NO: 89457 - DNA, 117 bp, Glycine max
  Peptide Sequence Number=SeqID_206235
atggaaattttgatcgccaatacttcaacaacatttcatagggatgaaagactcaggaatacgcatgctatgcatggaaaatgggaaaacgcaagggtcacgcatgagcaaacatga

SEQ ID NO: 89458 - DNA, 435 bp, Glycine max
  Peptide Sequence Number=SeqID_206236
atgtggtctctgggttcccaatcaagtgcaatttcagcttggacgggaaaaaactcgcttctggctcttcagattgttctatctacatttatgattatcagttgtgaagaaaatcaggcccatgaccaggcatgcatagatgttgccttccaccctgttatacctaatgttattgcttcatgttcatgggatggaaatttaatgtctgattcacttatattacaagtttacaactatagtgaatcatggtgtgaattgtataaaaagcagtttaaaggaatgatcttacaatgtgtaaagctgcacagagatttgtgttggccattagcatctaatttggctaaagagtcaaacctgcttccaccactatggaataataaaaagcatcgaaatgaaaatataggctacatgactatagagattctcaagacctaa

SEQ ID NO: 89459 - DNA, 261 bp, Glycine max
  Peptide Sequence Number=SeqID_206237
atgcagtggtacctaatgcttactcgcaccttttgtcaaccagaggcaagcgagcccattgacacgcagagactaacgttgtcttttgcacctttgtcatcaagagacggcaagcccggtgacatgcggtggtaccttatggttatcagcaccttgtgtcaacaagaggaaagcgggccagttgacacgcagagactaacgtcgtcatctgcaccttttatcaacaagaggcaagcgagcccgttgacacgcagagactaa

SEQ ID NO: 89460 - DNA, 570 bp, Glycine max
  Peptide Sequence Number=SeqID_206238
atgcattggtcatcaactcattgtaagttctctttgttgacaaactgttcccctgagttagcttacagctcacctccttgcatctgctgggatggatcatgcggtttgcatatggaatgtatggagcagaaatcagaagaaagcatgcctgctaaacttccagtcttccacaatgcagcagtcaaagatgtgaaatggtctcagcaagggcactttctactttcttgtggatatgattgcacgtcaaggttgattgatgttgaaaaaggattggagactcaggttttcagacaagatcaaatcgttggagttataaagttacatccagacgattcaaatctcttcctttctgaagggtcaaagggccagatcaaactttgcgatgccagaactggcaaagtagtgcatgactataatcaaaatttaggtctgattctggatgttgagttcactatgaatgggaagcaattcatttcttctagtgatgtatctcaaagtaatgcaagtgagaatgctattattgtttgggatgtgtcaagagaggtaccattgtctaatcagcattactga

SEQ ID NO: 89461 - DNA, 627 bp, Glycine max
  Peptide Sequence Number=SeqID_206239
atggaggaaaatgagaaagggagggaaacgaacagggggtggcaaggaagaaaggagaatgttggggtgcctacatctttgtttatttatttcaataaaatggttcatttcaatatgattgctctctgtatttgtgtttctgttgctaaatcaattgagtttgtacttcaagtacaattcggaatatataggaaaactgttactagcacaacggtaaaggctgcgtacaatgaccctccccaatatctttgcatagtgagaagcctccgggcactcggtccctattctacaattgctgaagcatccacacatgattcaagggccacctctagaatagatcctgttggaaatactgtcatcaacttgatgaaggggatacaaacgcaactgcttggcaatgttgttgcttgcctgaagtgcccaaaggatgtaagtaaagagctttggcgatatgtagcaaataaaaagaacgtaggcactagtgctactgtggcaaatagagattttgatttttctcccattggatatgataaaagtgaagatgagtttgaagactctatcagtgccgtcactgctacaaacaaaaagaatgtcactaaaaaaggggccaatggacatgttttgtaa

SEQ ID NO: 89462 - DNA, 297 bp, Glycine max
  Peptide Sequence Number=SeqID_206240
atggtggaagtgtgcggaattgaatttcgaacaacatatccaaatttcacaataatccaacgaaaaaggctacaatgcgaagggtttttctctcagttcagacatgatatcgaaattcccaacggtgagaatgctcggaattgtgttgcgaacatgatactcaaatttcacgacgatccaacggtgaacgggttcgagatcgtcgtttttctgagattggtttggtgggctgcgggaaaaagaaagggttttgagagaaggggaaaaacgaaaatgaggccaaaaggaggcagctga

SEQ ID NO: 89463 - DNA, 664 bp, Glycine max
  Peptide Sequence Number=SeqID_206241
atgggggatcccatcagcagactctccttccctgaaaacaacgagactttttcaagtctcacaagttatccagaactacgtaggtctgaattcctcattggaggatacgtaggagcaagagcctcgcttttgtcgaccataccgccttttgttgccatgactcaagagctggtagcccgcggagacaccttacggttatccgcacctcgtcattcagagaccccaagtgtgattgacgagcagagaccaaagaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaaagaccaagtttggtcattctgcacccatgatacgcggagataccttacggttatccgcacccttttgtcatccagaggcggcgggcccgatgacaagcagagaccaagtttggtcattctgcacccatgatatgcggagataccttacggttatccgcacccttttgtcatccagaggcggcgggcccgatgacaagcagagaccaa

SEQ ID NO: 89464 - DNA, 490 bp, Glycine max
  Peptide Sequence Number=SeqID_206242
atggacacatatttacactgtgaaccagatcacaagtcaatgtcagctcatgactcacttcaagggatcttcctccgcaagagacccacggactttggctctttggactctatggtcactatgatcacactacgaacatgcatgttgagctccttactatcctcaatgggatgcaccatgcatggaataatgagtttatacatcatcatagagacatatttcttagctgctatccacctgattaagcatcagtcaccttcatttcattcgtttgtgacgatagttgcatctattaagtcactcttggccctccaatgggagattcatatcatccacactctgcgagatacgaatgttggcactgatattctcgtgaagaaggaagcttccaccaatgtgtcattggtcatgctagaactttgccccgatgatgttttgccttgtgtaattgcttatgcacttgaaagagttttgtacgcttgcaattctt

SEQ ID NO: 89465 - DNA, 396 bp, Glycine max
  Peptide Sequence Number=SeqID_206243
atggtgcatcccattgaggatagtaaggagctcaacatgcatgttcgtagtgtgatcatagtgaccatagagtccaaagagccaaagtccctaagagtcccacactatacctccataacccaatggccttgggttacccaaagaacttccatcaatattcaacaaggggaaaggagaaataggtgcagactatatgacgttacgtgggtctcttgcggaggaagatcccttgaagtgagtcatgagctgacattgacttgtgatctggttcacagtgtaaatatgtgtccattcctcactctagaaacaacgatggttacgacatttccaaatgatctagcttggagtcccaaagagttgagaattactccccatggtattctagcccaaccatag

SEQ ID NO: 89466 - DNA, 207 bp, Glycine max
  Peptide Sequence Number=SeqID_206244
atgttctctactggtttctttgctgatggcgaaaatgcatattcctttgggtcctcgggtttctactctctgttcttcgacaatgacaacattctccgtcttctttacgatggtcttgaagtttctgcctttactggccacatccatggctggcatcttggaaagctcattaggacgcagtgcatgcccgacggagtagtgaagtga

SEQ ID NO: 89467 - DNA, 151 bp, Glycine max
  Peptide Sequence Number=SeqID_206245
atgtcattatcatcatcaagcaatgcctacaacgtgccatgggtagaaaagtatcgtcccatcaagatgatttgctccatggttgaactcactgttcaacaggtggagaagttgagggaaatgagtccactttatgaatttgtcaaggaag

SEQ ID NO: 89468 - DNA, 351 bp, Glycine max
  Peptide Sequence Number=SeqID_206246
atggatttcaaaatctgccaaattgtgcagcaaaaagctgtcaaatttgtgcagcagaattttccaaatgtgcagaaaaatgcttatgcattgctggttatgggaaaggagtacgtgagctcagttgaagatgggcaacgggggatggtgggttcatgtttgatttgtggatgtgggagagttgatttgcaccatcgcccgatcgccacctatggtacctggagatatgtcgcgggggtcaggagaccttggggacgtcaggcgagctcctggcagtcatccaataaaagaacaaagaccacaaagcaaggaggcttgtgtggtggttggccagctatggatcttgagtga

SEQ ID NO: 89469 - DNA, 876 bp, Glycine max
  Peptide Sequence Number=SeqID_206247
atgggatcaagtcaaaagccttcgcttaaaaagaggttctatcaagtcaaaatcaagagcttagaggtcaccagtttacgaaagttggggcaattaatgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggtggtgaaaatctcagcacaagagttggaccgtgtaaagcaaaacaggaatggggtagtttggaggacagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcatcgccattttggccatgtatgacacgttcgactggggatgtgaaaggagcagcgcaagaattgtttgttgtgcactggctctctatgtgtggctggtttcacacccttttctccaagaaggtaggcccgtctatccgctacaaggtcaccgctcgtgcgtcgaaaaaggaaaggcgaattgggaccaactcttggctagcatggaggggcgtctgttaattggttccctcgctagaaggaaggaagaatcaggattctatcttcatgcgaaggatgtccaaatgttctcttga

SEQ ID NO: 89470 - DNA, 1407 bp, Glycine max
  Peptide Sequence Number=SeqID_206248
atgccttactggaattgcagagaatctgcttgtggatgtgaaggagaaccaaacttcagttctgaacaagattttttactttcaatctttcatacagagcaactgcaatcctctgactctaaaacccttctaagaattcaacagcaattgaactttccaccagttttaagcagctggaacaaaaacacagacttttgcagcacagattcaacatcttctcttactgttgtgtgctatgaaggcaccataactcagctgcacatagttggtgaaacaagagctctactcctccctagaaatttctcaatagattcctttgtcagaacactggttaggcttccaagtttgaaagtcctcactttggtttctcttggcatatggggtccattgccgggtaagattgctcatctgtcatcactcgaaatagtcaatgtgagttcaaattttctgtatggttccatccctttacagttctcattactgtcacatctccaaacactcattctagatgacaacatgttttctggccaccttcctgaatggctggattcctttccagccctgactgtgctgagtttgaaaaacaacttgttcaacagctccctcccagattcgctaaatagcttggagaatctgaggattctttcactttctcataaccatttttatggaccggtgcctgatttgggccgtttggcaaatcttcaagtgctggaattggatgataatgcttttggacctcggtttccacagcttggtgacaaattggttactatagtactaagaaacaataagttcaggtctagtatccctgatgaagtgagttcatattatcaacttgagaaacttgacatctcagcaaacacatttgttggcccattccagctagcactgttatcacttccttctattacttatgtgaacatttctggaaacaaattaacaggaatgctttttgagaatctgtcctgcaatcctggacttgaagcagtggatttatcctcaaatcttttgactgggagcttaccaaaatgtttaatgtcaaattccaatgacaggactgtcttgtatgctagaaattgtctagagacaaatcaaaatcagcatgcactgcccttttgccacactgaagccatagctgtgggaattgtgcctgagggaaagaagcacaaacgagtatctaaggaagttctctccattgggatagtatgtggaacttttggaggagtagcaattgttgcactgcttttctttattatcagaagagaaagtgtcaaaagcaaaatcaagaatcctccaacaaaattaatatcagagaatgcagcttctggatacacctctaagttaatctctgatgcaagtaactccctcactcctcaccctgaaatgcacatgccctctaactaa

SEQ ID NO: 89471 - DNA, 498 bp, Glycine max
  Peptide Sequence Number=SeqID_206249
atggaacatggacttttagttaatcttctatcatccataactgttattggttacaagtggcattttaggctcattctttctcttgtcatttctcacaaatggcctcttcaacaattagatgttaacaatgcctttctcaatggtatccttgaagaagaagtgtatatgtctcaacctcctaggtctattgtctacatcttggtctatgtagatggcatttttcttactagtaacaacatcaagatcatttcttgggaattgaagttcaaaaacaaaaagatagatcactcattctcaattagtctaagtaaattagagatctcttggctaagactaattaatcctatctcttctcctatggttggagggtgcaaattgactaagcttggctttgaagattttattgatccttccttgtacaagtccatagttcaggccttgcagtatgctaccataacaagaccagaaattagcttttctatcaataaggtgtcttaa

SEQ ID NO: 89472 - DNA, 696 bp, Glycine max
  Peptide Sequence Number=SeqID_206250
atggtggaaaccattcttttaatggtcgtggtggtcgaaactctggtcgtggaggtgctagttgaggtagatttgcctatgtgcagcatcaaatctgttgattctaaacaagttctactcaaagaagttgtgggaaaagatggtctctatcagttccctcaattacttgtttctatgtctcagtccaagaggtattcaaattctgattggggaaaagagttcagaccctttaccaagttcttaagtgatcatggaattcaacacatacttacttgttcccatactcaccatcacaatggtgtagtagagcgcaagcacaagcatattgttgaattgggtctcatattgctttctcaagctaagctacctctccactattgggatcatacctttgtttccaacatctatttaatcaaaaaatttccttcctcagtgtcatttttgggttattctccttctcacaaaggctacaagtgctttgctgctaatgaaagactatacatctccaaagatgtcatttttaatgagctaattttcccttacccaactttgtttcctaagccatcattaatcacctctaatgttcttgacagtacacctacctttactattttgtccaataatcagccttttcttgcatccaatcctacaccacaacctttcatcccaaatcatacctatgtttcatctagttaa

SEQ ID NO: 89473 - DNA, 477 bp, Glycine max
  Peptide Sequence Number=SeqID_206251
atgccaattaacttgaaagatgagtattggattgatgatggtgttgaatctaacaatgaggaatgttttgaggatgaatttgttgaaggagagcaaggaaatgatgtgtttcatgcaattgaaagtggtggcatagactgtatgcaagacattgcagatctcaaccttatcagtgtgcctactgaagaattaaccaagtgtcattttccaaatatcaaagtttcttatgagttttacaattggtatgcaagagggaagggctttgctcctcgtaaagtcaagatactaagaaatagcaaatttgtttcaaataagattgaagagacatatgtctggctctttgagcaacttttggaggtcatgaaaagaaaagtgtccacttatgttataactgatggagacttggcaatgagaaatgccataaagaaagtgtttacaactactcatcaccgactttgtgcatggcatttgtattga

SEQ ID NO: 89474 - DNA, 231 bp, Glycine max
  Peptide Sequence Number=SeqID_206252
atggttatgtacttatgtagattgaggaagagaaagaagaagaagaattttgcaattctattctcccctgttgatggaggtgttgttttttacgtagatgccatgcatggcgccaccaccactggcgccttcgacagggacgtggcacgtggcgctggtgtcgccattcccaccagtgcctccccttttgctgacgtggctttggaagcgccaacaacaatggcgagttga

SEQ ID NO: 89475 - DNA, 171 bp, Glycine max
  Peptide Sequence Number=SeqID_206253
atggggaggatttggggtgattcagaagagggtggtgaatatggaggacagtgttcatggagtttcttaactgggaggaaaagggtcgattcttcatctaagagcaattctcaaagccaacttgccaaggagttaattgtgcctcatctcatggcaattggaaaattatag

SEQ ID NO: 89476 - DNA, 321 bp, Glycine max
  Peptide Sequence Number=SeqID_206254
atggataaagacgccatcaagctcatttgcatcatgtgggtagcgttagcaggtacgacgcaccaatgcaaagtggatgatggggagcatgtcaagatgcttggtctaaaaaatgagatcgtacatggagatgatgttcttagtgaaggcctcctcgtcgtctatgttaccggtgcaagtctttcccttggtgtgattgattactttgctgaggttgcgacaatcacacatttaagggatgatcgtggtgtggatgacaacccaaagtatgacaaaggtgaagagagagtgaaagaaaaagatattgatagtgttaagtag

SEQ ID NO: 89477 - DNA, 219 bp, Glycine max
  Peptide Sequence Number=SeqID_206255
atggctccaaagaagcttccagccaagaggtccaggaaggatgccactagagagggttctagtgcggccctgcaggcaggtatggactttgatggacacaagtttcggattgtggaacaccagcaacggtttgaggccattaaaggctggtcattcctaagagatgggcgagtccaactaagggacgaggagtatgcagagttccaagaggagatttga

SEQ ID NO: 89478 - DNA, 623 bp, Glycine max
  Peptide Sequence Number=SeqID_206256
atgattaccgctggtggtggtggtggtggtttaccttcgccaaacggtggagatgcactgccgattcagtcttccccgatgaatacaaacttcatatattccattatagagaagcttgatgcagtaaagtaccttttatggaaatcgcaggaactacaaattctggagcgttttgcggcactcgctgatcgagatgttggtcgcgtcattgaggcctattgcgcctgggagcaacatgatcaattgttgctctcattgcttcaatatactatttctactctgatgctttgcaaattcatgacctctaatcagaatcaaatccctaatcagaatcagtttttgaattatccccaaactggtcagaaccaaaatcagcagtccaacttcagtggtggtcgtggtggttgctatggtgaccgtggtggtcgtagctcaattcaattcaatgctctatctgcttcaaatttggatatgatgctgctaattgctggcacatgccttcctcctcattctatggtgcttaacctatcttatgttcacaccaatgacacaacctatgtttcctacacaacaacaatatgcaccatcccctatgcagtatggtgctgtgcctatgcaatatg

SEQ ID NO: 89479 - DNA, 606 bp, Glycine max
  Peptide Sequence Number=SeqID_206257
atgattgtgagaatgtgggagtctcaagggtattttaggccgagctttgaccggggaagtgatccttttgtgataccaatgccgccacccaatgttactggttctctgcacatggggcatgccatgtttgtgacacttgaggatattatgataaggtacaatcggatgaaaggaaggccaacactttggcttccagggactgatcatgctggaattgctactcagttggttgttgaaagaatgctagcttctgaaggggtaaaaaggactgaattgagtagagatgaattcacaaaaagggtttggcagtggaaagagaaaaaatattttcagaaaaaacttgttagtctaggaggggctccgtcggagatgagtttgcttcttgctttcaccataggacgcatgaaggattatttcgtgtctatgcgtgctcagtcggagagaactcaggaaacaagcagtgataacaatggaggcagtaaaggttcgggaggcaaaaaggactcacaatatggaggatccatggttcctcattattccaaaatggaattccccacttatgatgacactggggattcattgggatgtctgaaacattgtgagtga

SEQ ID NO: 89480 - DNA, 1385 bp, Glycine max
  Peptide Sequence Number=SeqID_206258
ggagaggaaaacagagggaaggggagagaccgagagtggatcccaaaacgaattatgacaacaataagcttggacaatctcaaagatatcaccatgttaactggagggataaggatgccatcacaacgttttacttcacacgcttccatgaacacataacaaaaaaggatctctgggctcagttcaagaaatggggggacgtgagggagattttcatccccaaagacaggaacaaaggtggaagacgatatggttttgtgaggtttaaaggggtatccgacgaactcagattagaaaaacagcttgataacatcatattagacggactcaagatgtatgttaatgtcccaaaatacgggagagggaaggtgagggtcgaggagcgtacctccaaacccggaatcttgaaggaagggcatagcaaggaaatgactgctgcgcgacatagagcaatgcagaacagcaaaagacatatgccaaggtggtctccgctacccaaagggatcacggatgacatacgttgggagttaggcgtgaacgtcgtgctgaaatatctcggtgatgacatggtgctcctccttgggatggcgggcaataaagcggaggaaatcattgccgaagagtatcaacacggaacatctccgttccactcgctagagaggtggaatccgacgatgagaccgggacacagacttgtttgtgcccagtgttggggtattcctatcgaggctggacaggatgatgatgatgttgaagacatgagaaggctggacagggctagaatcctcatcaggacaccatggaaaccgttcttccaccacactgttgcagttaccattggcggggagcttcaccaagtgaacattgtcgaggagggggcgagcgatgatgggaggcgcaatttcttgggtcgaagaccgtcagactcatcggaagagctagattctgatggtattgatggagagtcactgatagccttgcactcgcctctgtacgagctccggcgtcaaccaaacaatccagatgctgatctggtgttcgctgtcgacaacaatggagatcccctcacaggcaccggaactctcattggaagatcggccaatccatcggacgttaatcacttcgacgatcttgacggcggtcctccgatcgcagttcaggtgcagctgatctcgcgttgggggaagccattcacccctgacggagatacggttgcgggggaaggtgaatcactgacaggaatagacgtacccttagaagataaacaaagggaagtagctgttggggagtgggcctccctcaacattgtcgatccagcccacttcaccaagctagggacagtgacctcattataccacaaaaagggatccgagactcccaagtag

SEQ ID NO: 89481 - DNA, 2369 bp, Glycine max
  Peptide Sequence Number=SeqID_206259
atggagttgaaagtgtttgccagaagaaaggggtgtaaacagcaggtggcccaaaaggatcttaacaggggaaaggccatagagtcaatccttacgggatacaactctcacacagaatccaggggaagagccataccaaaacgatcaaaagaaaccaactcacagatgcatgtaaaatccattggacctgatgaagggcagatcgaggaggcattaacccaatgggaacttgcaaaaatcatgggggtgtctatagagtcagagcagacaacaatcatccataaaattaaggacatggagaccagagacaagaaagaggctgaggaattggggcttgggagaggggtcaaatgggctgcagttaggaggctcgttacaaaacacaaagtagacattttgtgcattcaagaaaccaagaaggagcaaatcgacaaacctatgtgtcaagctctgcggggagacacggatgttgcttgggaattccagccagcagtaaatacagcgggtggcttattgtgcatgtggaatgatcaagccttcaaagtggaaagaagagtacagggtagaggttacattctattggatgggatctggacacacgaaaatcagaggggccatgaagaaatgtggtgcttactgggagacttccataacattagacacccttctgaaagagaaggtgtgtttcataggggagtggaagcagctagtattaatgagtttaatgaatgggtatctgacatggagcttgttgaaatcctgagcgtggggaggaaactcacttggttcaaaccaaatggggcttcgaagagtaaactagatagattccttgtatcccatgagtggcttcttaaatggccagactacactacctccatcttggacatgaattttttttatcattgtcccattctccttagaaccaccaacactgattgggggccaaaaccatttagggtgttcgattgttggttgaaggataaatcctttgatcagacagtcagagagtgctggagaaatgctcaaccaagggggtggggaggttatgtactcaaagaaaaaattaaaaacctcaaggagtcattgaagctgtggaacaatgtgcactatggagatacactcaagaagacagttaagctctcaagagctaataactcgcaagaaactacaggaggaactttggacagcagcacactcacacgagtccttgatgaggcagaaggcaagagtgaaatggctcaaagaaggggattgattggacagcagcagaatgacatgctggtgggagctttcaccgaggcagaaattagagtggctcccgaaatcagacggttcattactgcatttcatgccaatgggatattcccgaggggcaccaatgcatctttcattgccctgatcccaaagattgtgactaagctcctagcaagcaagctgaaaaaggtgctgccacatataattaatgagaggcagtcagcttttactgctggaagacagctgttgcacagcgttttgatagctaatgaggcggtggaggaagcaaaaaggcataataaaccatgcctagtgtttaaagtggactacgaaagagcctatgactcggtctcatggaacttcctatcatatatgatgtacagactaggtttctgccctaagtggattagatggatagagggctgtctgaattcagcctctgtgtctgttttggttaacggtagccccacaaatgaatttaatcctcatagaggccttagacaaggtgacccattagcgtccttactcttcaatatagtcgcggaaggcttaaccggcctaatgagagaagcactggacaaaagtatctacaacagcctccttgtgggaaaaaacaggattccagtcaacatattacaatatgcagatgacatcattttctttggtgaagccacaatgcaaaatgtgaggactataaagtccatgttgagaagcttcgaacttgcgtctggtttaaagataaactttgcgaagagcagctttggggtaataggcaaacctgatcaatggctgaaggaggcggctgattatcttaactgcagaattttgtccttgccattcttgtatctgggtatctccattggggataacccaagacatagtgaattttgggatcccattatcagaaaattcctatggggtggaggacaagagcataagaagattgcatgggtagactggaagacagtatgcttaccaaaagacaaaggtgggctaggcatcaaagaccttaggacttttaacgcagctctgctggggaagtggaggtgggatctgttccacaagcaaaaggaaccatgggccacaatgatctactcgaaatatggtgggtggag

SEQ ID NO: 89482 - DNA, 258 bp, Glycine max
  Peptide Sequence Number=SeqID_206260
atgaagaagatagctacaaaggagacgatgacctcaaggagggttgaaggttgtgcacgtagtccagtagtgagtgagggcacgagccaattggtttcatgtcgggcaagtctaagacggtgctttccaaaaacatggtggaaaagcagtgttcaaagacagtcttttctagcactgtctttgttgacgaagttcttaattacaaaaatatcaccgcttaagcaactacgacggtgtagcaatcaaacgtcgttgtag

SEQ ID NO: 89483 - DNA, 360 bp, Glycine max
  Peptide Sequence Number=SeqID_206261
atggtttgtaccaaccaagcggatatgaccggaaggcttcttgccggatcattggcattcgaatgccacatcatgcacaacttgattgtgcgtatcctacttcctagatcatccaaccttgcacaggtttctgaggaagatttgataattatgtgggttttcttaaccggtcatcaaatcgactgggcccatcttggacaacccttcccttgtgttcaggaatcctttacaacaagagaccctcggtctcttaatcccttttcagaagtaagaagaagagaagaagaaatctctcttgaaagagatagattgtacaatgaagatcaatcacaattccttattgagtatgcaagtgtttga

SEQ ID NO: 89484 - DNA, 528 bp, Glycine max
  Peptide Sequence Number=SeqID_206262
atgacatatgaacaaacatcaatttacaaccagattgttgaagttgttaataaagatgaaggtggtatgttttttctctatggatatggaggtacaggaaaaacatacatttggaaaacacttgcaagttcactaagagctgacaatgaaattgtaataatggtagcctttagcggcatagcttctctgttattgcctggaggtagaactgcacattcaaaattcgaaattccagttccagtttttgaagactcaacttgcaatatccatcaaggaactcaattagctgaactattaaatcagacaagtctgatcatttgggatgaagcacccatggctcacaaattctgttttgaggcacttgatcacagttttagagatatcatcaaacacaactcaaaggacaataaaatctttggaggtaaagtcatggtctttggtggagatttccggcagatcctgccagtcattccaagaggcagccgctctgatattgttaacgcaacaattaattcctcttatctatga

SEQ ID NO: 89485 - DNA, 853 bp, Glycine max
  Peptide Sequence Number=SeqID_206263
atggctaaaactaaaggcaaaaggatgaaaagcattagacatagagctacaaccccaaaaatgaactcgaagaagaagaatgagcctacaaagggccgctcttccaataagggcaaaaggataacacggtctccatcaccgacaccttctccaaacatcactccatggttttcaaaggaacactatgaagcgtcctatatgtacaattatgctaagaaggattttatccaacccaagtttctaaacttggaatggctgaagactcaaggttttgtctttccgaaactccttgagtatcatggtttgaagaagcatatggagatgaagggcacattttatcctgagttgattgtgatgacccttgaagtttgggaagaaactgttggattgtcgtcagtagggaggatgcttaatgataaagatttgaaagatcctggacaaggaaagatttggcacatgccccttgttgttggaacacaaacttctggcttatgtgattgcctagatcattactcccaagaggagcaaacatgcataactgacagagaaggatcttcttctcatcagccttatgcaagggaggatgaagttggactggagctaaagtttgaagtgaattccaaggttctaaaacagatgggctacttatacattgaagtagatgaaaaaggaggaggctggattcagaagcctaaggaaggtgaaggtacaacaatagtaatagttaaagaaaaactaatgagtccttttgagctgatgatggtggcaaagatggaagagttcatgcggatgcacaaagaaggctatggggagctaaacgagtgttttgaaacaatttcagagagcctagatg

SEQ ID NO: 89486 - DNA, 1429 bp, Glycine max
  Peptide Sequence Number=SeqID_206264
accttttacctcctttttacagcaagaaggcatcatgcatagagtcatttgtcctcatactcatcaccaaaaaggtgtggtcgagagaaaacatagacacatagttgtgcatggcctcactctcttggctcaagctattcttcctcttacttattgggaccatgcctttctaaccagtgtatacctcatcaatagactccctacttcttccctcaatgtggttttctggggatattcacctgctcacaaaggatacaagtgcctttcagcagatggaagaatttacatttctaaggatgtcgtgtttaatgagtctaaatttccatatcctgatctttttttttcttctcctacttctcacccctctttagagtctcatgtacctaatactactattcctcttgtttctgtccctcaaccccaatcacctactccttcacctgttgactctccagccaacacctcacactccagtcaatctcctcctttacctattgaccctcaacatgactctcaaccagcacctcctacacctactaattcatcttcacaaagttctgtcttaccacaggcacctcttattccatccattcctcaaaacactcatccaatgcaaacaagatcaaaaaacccagatggctcagtcaacaagtacaaagccagattagtggccaaggggtttcatcagcagtatggaaccgattatacggagacttcctcacctgttatgaagcccataacagtaagacttcttttctccctagctgtcacatatggctggccacttcaacaactggatgtgaaaatgcctttctcaatggcattcttgaagaggagggggattgaagtgaaacaccaatctgatggctctattgctctcactcaaagcaaatatattaaagatttactggccagaaccagcatgtcagttgttggagcacttcaatatgctactataactagaccagagatcagcttctctgtcaacaaggatcctaaggtacctcaaaggtactctcgcatggggcttcatctgaaacctgcttctgcccccttctccatcaatgccttctgtgaggcagattgggcctctgaccctgatgacagaaggtccacatccgctgtggcccgctctagcacagagtcagagtatagaagcttggccctagtcactgctgaggtgtcttggcttcagtctcttttgactgaacttgcagttccacacaagctgccagtcatccattgtgacaacactagcactgtgtcacttgctcctaacccagtccttcatgctcgcaccaaacacatggacttagaccctgttttttgttcgggaaaagatatggtggaactatcgcaaatcagatcaagagactcggtgcttcatgtgattggtctagagagcactttacacttgatgaacagctaa

SEQ ID NO: 89487 - DNA, 2484 bp, Glycine max
  Peptide Sequence Number=SeqID_206265
atggatacctctggtaatacatgtgagatagtggaatcaagggaagagataatttctgaattcaaaatggatgaaaagcctgagagtagttgtgctcacaaatcaggaaagaagtattcgattgaggatgatattaatcagctttttcaggctattgaaattaaaagctcatctagaagtcgtagttcatcacgtttacaaaagagtgctcttaaaaggccaataaaagttacttcatctcaggcatcaggaattggcatctcagagcctgtaagtttaaagcaggcacttagagggttgtgcatctctcaggcctcagaaatggctgctttgaagagactgactaagccatgcagttcatctagagtatcagaggcgggcaccatcaaaaggttgtacacggcagtggtagatgaggggaaagggaacttggttgaaatttctcttgtgccagagatatctgcaccttctgataaattgtccggtgtaactatatcaagttcaagtgataatcatgctagtcctttggttgatgcgacaaaaccaaaagaaatgataactgggtttgcatcccaatatcagattgttcctctaccattagaggttgagggtgaggaattaatcacgggaactggaaaaccaatacttgcaaatttgtcaccagttgcctctgcaagtgaagaagtgccagaggccagaatgcatcatgcttcctcaagcaaagcttctcttggttcttcattgccagataaggggcatgaagcaaatttaccttctgcatcttgtcctcctagctctagcactggtaatggagcggataaatccacaagcagtaatacatgtttgtcaaagccaatattcaataacttgaacttccttaagaaaaaagtaaagcaagatttaagttctgcctctagttgctctactccttgtacaagtaatttggacaaggagggtggcaattctgatttgaagcatgatgtgaaacacaatgagaaacagtcgcctagcagttcaaatcatagcattgaagttaactcaattaatggtggtacagattcaagcaaatctggtttcagcttgaattgcaataagagaactaagtttctggtgacaaaagttgatgagaaatcaagatcaaaggaaaagggcgagtactctcaaagctcaaaaagtagcattggtgaatatagtagtagcacaagcatcagtgaggaaagcagtctaagtggttccagtcgcagtggccacaggcctcacatgtcaaaacacttgagatgggaagctgttcgtgctgttcagcagcaacatggtagtttaaatttgaagcactttaagctgctaaggaggcttggtagtggggacattggaactgtttatcttgcagaactaattggtaccagctgcctttttgcactcaaagtgatggacagtgaatttttggcaagtcggaagaaaatgttcagggcccaaactgaaagagagatccttcagatgctggaccatccatttcttcctacactttattcccatattgcaacagataagctctcttgcttgattatggagtattgtccaggcggagatctgcatgtgctgcgacagaggcaaccatacaagagtttctcggaacaagcaactaggttttatgttgctgaggttcttcttgccctggagtatttgcacatgctgggagttgtatatcgagacctaaagccagaaaatatcctagtacgagaagatggacacattatgctgacagattttgacttgtcactcaggtgttctgtcaatccaatgttagtcaagtcatcttcacctgacacagagaaaacatccagtccctgttctgaggctagttgcatacaccctttctgtctccaaccagattggcaagtttcctgctttactcccattctgttatctgccggagtgaaatctcggaagatgaaggctgacatagcttctcatgttggtcctctgccacagcttgtggtggagcctaccagtgcacggtctaactcctttgttggaacctatgaatatcttgctccggagatcatcaaaggtgagggtcatgggagtgctgtagattggtggacttttggtatatttttgtttgagcttttatatggtaagactcccttcaagggccaatcaaatgaggacacattagccaatgttgtttcacaaagccttaagttcccgggtactccaatagtcagtttccatgcaagagatttgatcagaggattgttgataaaggatcctgaaaatcgattaggttctgtaaaaggtgctgctgaaataaagcagcaccctttctttgaaggcctcaactgggctctaatacggtgtgcagctccaccagaactccccaagttccgggattttggaagtacagcgccatctgtggctgcaaataaggagaatgcaaatgatttagaggatatagaagactgtgaagagtttgagctgttttag

SEQ ID NO: 89488 - DNA, 192 bp, Glycine max
  Peptide Sequence Number=SeqID_206266
atggtaaactggtcacctactctacaaactgctgtttctgacttggaagttgagtattcagaagagtctggatatctttatcatatcaagtatcgtgttgccggaaggagtgatttcttgactgtggctactacacgaccggagactttatttggtgatgtggcattagcagttcatccaaaggtaggatga

SEQ ID NO: 89489 - DNA, 282 bp, Glycine max
  Peptide Sequence Number=SeqID_206267
atgaccactcttacatggatatggatgacgttgctatttagcaacattctgcccagcgaccataatgccaatctccccctgcagatggatcacgcccacaagacgcccagtggactcgaagaagtccaacagggccctggggtttccagctctggttacgggcctctatcagtcctacagagtacccgtccccccagcgagggatcgcgcccacaagacacccagtggacccggagaagtccaacagggccctggggtttccagctctggttacgggcctct

SEQ ID NO: 89490 - DNA, 2157 bp, Glycine max
  Peptide Sequence Number=SeqID_206268
atggcgactagtaagtatttgactgctcttgaggcctttggtagtggtcccaatatgtttattccctacatagcaaatggaaaaggggagctcggacttaatagccagcacacaccacctttgttgcaagggagcattctcttgcattttaaaaagggtgttgtcaaccctcttttgaatagctcaccatcgaggatgactgtctatggtgagagcttggagcgtctcctggatgatagtcttgaggtgcctaacctttttggtgctggcttgcttggagatcaggtctactttggtgtttctctccctgggtatgtagtacatttcaaagcattcaaaattatcgatgagagttttggcaatgtggtagtacttgagcaacactatttccttggtctggctttaaagttgagcttgggggcttgctctagagtgacattatcagggccttcgaggatgattcatgtcccgcttccctttacattggacacaccgtccacgtcgaattatgaaagttcgacggaccatgccaccattctccctatgagtttaggtttccgcaaaacctgtttgatgggcgtcatagagtatgcggttggtgaagtagatggggagcatgtacttcccctcctcttgagtaggggtactcctggcctgggtcagcttaaaactggtggtgtggctatggtcttcttgaaagtcaggaaggcttgttcaccggtctcatcccataggaagggctcacttttcttgagcaatttcttgaatgttggtcgggctgtgcatctccagtatggcaatgcatttgttgtggttggcttcaatcccccgatgaatgatcatgaaactaaggaatttgcctccgcctacctcgaatgtacatttttcaaggttgaggcgcatgtcatatttgcggagttccctaaagacttcttccaagtctgtcatgtgctgggctatgctttgagacttgatgaccatgtcatccacatatacttcaatatttcatccgatcagttgtttaaatactcggtcaatcagtcgttggcgtctaggaagctccatcgactagcctatcgatacaaggtgaaatacctgacttctctgatgaagttgtctttgaggagtttgttcacttcttctttggcagctttgtgctgttcttctcccatcttccttttttctgataccggcttgcacctcggctataagccagtgctgatggctggtgaggcccttgtcagaagtgtcgttgcacggatctatatcgagttcatcgtccaaacttgcttggtagacggctccctagtggcaggctctttgcatagcattgtcgtgcttactttgatcttccttgacggttacaatcttctcggtcaggctcctggaaagctggccttgaccgaaagtgctgccttggtcgatgaggactttgaacaccttgaagtttgcaatgatgatggagataaccatggattcgtcctggttaatgggattgatacccttaaagtccctatccgtgaaagtgttgatgttgatgtctcgaatggcgtgaaggtggcattttcaggattggttgtcgcttgtgttgctactggtgtttctgtgtacctcaatcttccactttatcttttcttatgtctgcttagtgattcctatgttactccttttggtgtcctccggtatttggtcgcttctaaccctggcctggaaggtttcgtcgagggtagcctgatgggtacctccaagttgaaagcttcctccaggattgtaatgcgattggtcgttagggtgagccttggtgcttccttctctcttgtcgcgcttatgcccagcttgtctgacttcgttcctgaatctggacatttcttccatctggatggcgaggagcatggaatgcaatgcgacctttgggttaagattttggatctggacgacgatgcgcccaaatttgttcatgaattttctaagagacttgtcatctgcgtgtcacagattggccaaggcagtagaggtcaagcaatgagacctgttggttgcgtattgtgcactaaagcattcaacgaaggtgtcgaagctatctatggatcttggtgggagtccaccgtaccagatcaatgtcgcccccttgagggacattgggaagacacgacatag

SEQ ID NO: 89491 - DNA, 258 bp, Glycine max
  Peptide Sequence Number=SeqID_206269
atggctactggtggagggttagagcctttgaaaggggtctcgcgtttgaggcctgaccgagtgcaaaccatggcaaaagagagagatatgacgagagattgtggggtatgttttatcgctgcctcacggtgggtgccaaatgtacttaccaaaattcggggttggcacacgtcagggtggacgtggtgggctcccagacttcacacatcggctttgagagatatctttgttaagaggacaagagggggggacctgtaa

SEQ ID NO: 89492 - DNA, 915 bp, Glycine max
  Peptide Sequence Number=SeqID_206270
atggcctattcccaacttcacccgaacagttgggccatgattggtaagattggttgggtctccttaaatagcgtatccaagaagctgtttgagtttgactcaaacatctttcaccgtttcaaggaccatttcttcaagatcttggctactaatgtcgtggctgataattttccacttatgttcaacaaggacggggagctccgcttcccattctactgggtcgacaaagctattttggaacagctgttagcctcactggacacacgggccactttgtctcttcctttggcaagcgatctcttcgctgccttgaacggtaaagtgtctaaccttgttctcttttgcaatgaggagcgaggtcttgtcactcatgtggtggtgcttcctttcactttgcggaacttctcctctgatgctttttctcctttgatggttatgaggaacatatttggcttgcccctggttgaaggtcttaccaaccagcctggggtaggcattcttaccaatggtggatcttgggtttttgatagacttgtatttcggcacagggtgaaccttgggtttaacgagccttggactagggatgtgtttgccctgggttttgacaagcctgtagagctgcgtcgaggcttaccaatgatagacttcaggtttgattaccctatgagactcaccaagtgcagagcttgggactcaccaagggcggaccttgggttttatgtgccctttggaggatcgactaaggaattttacgacctaggctttgggtgtcgtgctcttgcatacatgtcactcgtctgcgtggcacgtactagagacataatggcatgctcttgcatacgtgtaactcgtggagtgacacctactagagacgtggtggcgtgctcttgcatacatgtcactcactgtgggtga

SEQ ID NO: 89493 - DNA, 236 bp, Glycine max
  Peptide Sequence Number=SeqID_206271
atgctcaaccccaataacaaaagagaacactctgatggacagatacaaatggtaattcgcagtgctttgagaataaatcattacagggtgatagcagctggaggtggggcacagctttgcatgagattttttttagtttcttcagacatggttgaaaatgtggtggccactacaagtggctgggttcaatcttggatagtgtttacagcagagaaaaaagaaatcacaaaacaaag

SEQ ID NO: 89494 - DNA, 621 bp, Glycine max
  Peptide Sequence Number=SeqID_206272
atggcaattgtacctcagacatttggccgtcatgttcctatcattgctgacaagcatgtggatagagaatttggaacaggagtattgaaaattagtccaggacatgatcataatgactatctacttgctcgaaagcttggtcttccgatacttaatgtgatgaataaggatggaacactaaatgatgttgctgggttgtacagtggtcttgatcgttttgaggctcgaaaaaaactatgggcagagcttgaggagacaagattagctgtgaaaaaagaaccacacactttacgagttcccagatctcagcgtggtggagaagtgatagaaccacttgttagtaagcagtggtttgtgactatggagcctcttgctgagaaagctcttcaagcagttgaaaaaggagaactgaccataattccggaaagatttcaaaagctgaactcacatgtattaaacgacaacaaggccattaaatggttgcattttgacttggaggctgctggttcaagtattagaaatagtcattgtgtggtaaggccatgtacatctccaccctccctgaaactcaccaggtggcagtattgtacactaggtcatcctatcacatgggcttggtag

SEQ ID NO: 89495 - DNA, 177 bp, Glycine max
  Peptide Sequence Number=SeqID_206273
atggtggaatttgaggagaaactaagaatcgatgaagctgaagcagaatttgaaaacgaagatgaagcatcatctccatgtggaggatgtgtatggaacagagttgcacaaactggaacttcggtattgttggcggcagccatgaaaaaggatcaacgtgctctgaataccatgtag

SEQ ID NO: 89496 - DNA, 183 bp, Glycine max
  Peptide Sequence Number=SeqID_206274
atgtgtcacgcatcgtgtgcgtcaacttctctcgctggaaaggggtcactgtggcagtgtgttgagttggctgcgcacgtggatggcgtggtgttcttgaaagaagcaaagtccaaaggaatctcagtagccatgaagggagaggcgacggtggtcgctggtggtcgtttttcgataagctga

SEQ ID NO: 89497 - DNA, 957 bp, Glycine max
  Peptide Sequence Number=SeqID_206275
atgaagtggcagatggcgacacatgggaatacgccacaggacccttttcatgtcttacgcaaaggtggtgtctactaccaaaacagacgtcgggcagaggaggcacctccacaccccagattcgtcgagtcccatttgtcggttcacctcaaagttgcagagggggaaaggaaatggtacacaaacacatgggtgggccggctaaagaatctaggggctttcgaaagagttgaggaagacataccctgggagctaggagtatatgtcgtgccgaaatacatcggtgatgacatgatactcctcctcgggctatcggtctccaaagcagaggagattatcttggaagaatcccaacacggcacatctccgttccaatcgctagaaaagtggaatccgacgatgaggccgggtcatcgactggtatgggtccaatgctggggagtccccctagaagtatgggacataaggaactttcgaaaaatcatggttgcagttggagaccttatcgaggttgacaatgatgttgaagagttgagaaggttagatagggccagaatccttatcagaactccatggagaccactattccaccacacagttgcagttcatatcagcggggaggtccacacggtgcatatagtcgaagaagggtggagcgacgccggaacgcgcatcccccttcgtcgaggcgtgacggactcatcggaggagcttgacttcgacgacaacaacagcggaatactgtgcgcagcgatggcgacaatctccgatatccggcaccggccaaacagcctcaacggcgactggattgttgttgccgacaaccaacagctctcgcctttacccgatggtcctcgtgtcatggagaatccagtgggtaatgcacaagacagctgggcacatctccccaatatcgacatttgtgcgcggtcagaaacggagaaggaaaagaagtag

SEQ ID NO: 89498 - DNA, 585 bp, Glycine max
  Peptide Sequence Number=SeqID_206276
atggcagagtctcctcttcctccttctgctactcctttctcttcatcttcagctttctcgcactcgatttctaagaagctcaccgattcaaacttcttgctgtggaaacaacaaaagctaactcgagcaggagctcgtcaacttcgtgcagaattgcggtccactactcttaatagcaaaaatgtttcagaattcctcttgcgcatcaaagccctagctgatgcgctagcttccgtcggagatccaattacaccagagcaacatgttgatgtcatcctcgaaggtttgtcttctgacaacaactctgtaatttccgcaattgagagcaaatttcaactgatgcaaattgaggaaatggaagctcttcttgcgcatgagatgcgactggaaaaatcacagaagaagctcgcctctgaaaccgcttcactcaatctcatggaaattccctcctcgaagtcgcaacagcaacagtcatcttctgctcaagcgaatgttgcatctgaaaatgctaattcgaactacaactcatattctgggtattgcagctccagacgtggtcgcgatggtcggaatggttgtggctga

SEQ ID NO: 89499 - DNA, 327 bp, Glycine max
  Peptide Sequence Number=SeqID_206277
atggctgaggcaaaatccatttcttctcctatggtgactaacttgaagctctctaaaaatggtaatgatcttctctcagatcccactatgtacaggtcactggtgggggcccttccatatgccactatcaccagacctgaaattagctttgctgtattccgcactttggactcagatttgtaccagcctctcttcatcagcctctcagtctgcatgcttactgtgatgctgattgggaagttgaccctgatgatcggagatccacctcaggcagagtacagaagtttagctcagactttggctgatattctgtggcttcaaacctaa

SEQ ID NO: 89500 - DNA, 942 bp, Glycine max
  Peptide Sequence Number=SeqID_206278
atgtccaaaacattgggaaatgtaatagacccccttgacactatcaaagaatttggtacagatgctttgcgattcacactagctttaggaacagctggccaggaccttaatctgtctactgagcggttgacctccaacaaagccttcacaaacaaattgtggaatgctggcaaatttatattgcagaacttacctaacgagaatgatacttctgcttgggaagaaatattgtcatataagtttgacagtgaagtcactgtggttaatcttcctttaccagagtgttgggtggtatcaaaacttcacttgctcattgactctgccagtgcaagctatgacaaattttactttggagaagtgggacgagaaacatatgatttcttttgggctgattttgctgattggtacattgaggctagtaaagagcgtctttaccagtctggagctggaggcaagtctgttgcttcagtggcacaggctgttctattatatacttttgagaacatactcaaagtgctgcatcctttcatgccatttgtaactgaggagctgtggcaggcactcccttatcgaaagcatgctcttattgtatcgccttggccagagactcaacttccaaggaacacctgctctgttaaaaagtttgaaaatttccaggctttggttagagccatcaggaatgctcgggcagaatattctgttgagcctgcaaagcggatatcagcatctgtggttgcaaacaatgaagttatagaatatattgctgtaagaaatgctgatcagtcagttcatcttgtggctggagagggactagaggcttatctccctctggccgatatggttgatatttccgcagaagttgaccgtctttcaaagcgcctttccaagatgcagaaggagtatgatggattgatagctaaactcaattctcctcaagtatga

SEQ ID NO: 89501 - DNA, 252 bp, Glycine max
  Peptide Sequence Number=SeqID_206279
atggaggtgaaggtcaaaaggaaaactaatgaaggcgatgactcgttggagatggaggtagagaatgacaaagaggagggtgactcgtacaaggaaaaattgctagtagcaaagggagtagttcctttttctgcctttgatggaaggtgttatgacaatcctgataaggaggtacctccagcccctatcatgaaggaggatgtggaacactttaaagagttgcctatatttgacgaggaatttagtgattga

SEQ ID NO: 89502 - DNA, 809 bp, Glycine max
  Peptide Sequence Number=SeqID_206280
ggcgcgggggtgacggtattccgattggcggcgacggcaaactgggggaacgagtgcagcattttccgttcacgcccggctccggcgtcgtgcaggggcgccaggaagggggccatgcgcactccaccaccttcagccgcgatggccaatacctgtacgcggcggatctcggcggggataagctgcgcgcctaccgctatcgctcggacaacgcgcagccgttgcaggcggatgcttcgcgcgatgtcgccttcgcacccggcgccggcccacggcacatggcgttctcgccagaaggggaatacgcctacgtcatcactgaaatggcgagtgaaatcgaggtgtttgccgtcagcgaccatcgattgacgcggcaagggaaggtgaaactgaacggcgggcaggattcagcggaggcgaaaagcggtggggcaataatcctcagcccgagcggcagatatcttattgccaccaatcgcggtgccgataaccacctgctggtattaaaaattggcgaggatgggctgccgggcgcaccgacgcgctatgaggccggcggtattgaaccgcgtgcgctcgctttcgatgccggcggtaaccatttctatgtgacgaatgtgtttaccaataccgttatgttgttcgatttcgatgatgagaagggcgagttgcaggccagagggcaggcgacgacggcgcgccgcccgatttttggcgctcaaatcgttgcggatctgcgcgtggcttatcagcgcaaagataaaggtgccgccgatgatgttgcccgccagcgtcggcagggcgaacgg

SEQ ID NO: 89503 - DNA, 129 bp, Glycine max
  Peptide Sequence Number=SeqID_206281
atgatcatgccatgtgcatggtctgaggttgcatcatctattggcaaatcagagactagccctcttgaccttgctttggaggagagtattaagactttagggactaaaaaccttgctcgtgattattga

SEQ ID NO: 89504 - DNA, 141 bp, Glycine max
  Peptide Sequence Number=SeqID_206282
atgaagaagacaattgttgatggggtcaccatcaccaaagagatcactggagaggagggaggaaagggggttcttgggaggggggtaaggaaatttggtgttaaagtcaacgtgggaggttcaaaattttacaagtcatga

SEQ ID NO: 89505 - DNA, 627 bp, Glycine max
  Peptide Sequence Number=SeqID_206283
atgaagagagaggtgactcaccctcagaccctccctgacgaattgatccatgaaattctattgcgtttcaaaagtgtgcataaatcatggctttctctcatatctgaacccgggtttgctaaatcccactttgatctagccgcggcacccaccaccgacttcttctcaagtgcttcaatattgatcctgaagttgataattcttatgttgatatggtctctaacattccacttccattatctgctatgggaagcatgcatgaacacggacaacaatgatttctttgattttgtcataaccggtcagcgtatacaaagacaaactaatcatgtgtgtatccatcctccaatgtccggcattgggaatgattcattagctgatgactacgtcgtggcgattctacaattgtcactagatcaagattggccgtcatatcccaaggtcgatttattttcttcgagaaccaattcatggagtcgcatcgagggaacccttccttgttatttttcagggcagaaaaatgtcaggcataagttcgtgcacaagttcatgcacatgttcttgaatggagctcttcattggatgattgaatcttataatgatattggtctgattattgagttggat

SEQ ID NO: 89506 - DNA, 405 bp, Glycine max
  Peptide Sequence Number=SeqID_206284
atgatcactgaatatgcacaacatggccgggccaagaaagcattagtggtattcgaggggatgcagaaacaaaatttggagatgaatgctataacatttaccggtgtcatttctgcaggcactcatgctggcctagtcgacaaagctcaacactacttcaatggaatgatcaatggtcatcaaattaagccaacaatgaagcactacagcaatatagagcttggaaaacttgctgctgaaaaaattatttcacttgagccacaaaactcagaagcatgtcacattatccaatatgtatgctgcagcaggaaactgggacatattgttgtaagagataaaaacggtttcaccactttaaaggtggtttgtgctcatgtggggactactggttatgttttgggctaa

SEQ ID NO: 89507 - DNA, 1557 bp, Glycine max
  Peptide Sequence Number=SeqID_206285
atgtcgagttctcttagccaattcaagaaaaagcaaaatctacccattgaaaccacatttaagcttcctgctgatataccagtttggccaccaggtggtggatttgcaaccggcatcatagaccttggtggtgggttgctagtgtcacaaatttcaacattcaacaaggtttggactacctatgaaggtggaccaaataatctaggggccactttttttgaaccaacaggtctatctgaagggttctttatgctgggatgttactgccaacccaacaacaagcctcttcatggttgtgttcttgtggggaaagataactcttcaacctctaatggagctttagccgaaccagttgattacaaattggtatggaacaccaagtctcaaaaaataaagcaagacggacatggctacatttggttaccaatatcccctgatggctataatcctgttggccatgttgtcaccacctcaccagagaagccttcccttgacaaaatcaggtgtgttagatcagacctaactgatgaatccacaacatgccattcaatgaagctttggagaacagaaaacaagaggttcaatgtgtatgatgttaggccaatcaagagaggcattgaagctcaaggggttagtgtaggaaccttcctagctcaaagtggaggagggacaaattccaaagcttttcctattttttgtttgaaaaataccaagggtagcttttcttacatgcccaatttatcccaaattaaggcaatgatcaaggcttattctccatacatgtacttgcatcctatggaagagtacctcccttcctctgtggattggtttttcaccaatggggcagtactaattgagaaaagaaagggtgtcataagggagagttcaatagaaccaaatggtactaaccttccacaaggcagttccaatgattatgatgatgctacctattggttggacctgcctttggatgaaaccaagagagttagtgtcaagaaaggagatttggcaagttcacaagcttatgttcatgttaaaccaatgcttggtggaactttcactgacattgtcatgtgggttttctacccatttaatgggggtgcaagggcaaaagtggcatgcactaacattccactaaggaccaaaggggaacatgtgggagattgggagcatttgacattaaggataagcaacttcaatggagaattatggaaggtttatttctcacaacatagtaagggtcaatgggaggatgcatctgagcttgagttccaaaatggtaatagacctgtggcttattcttcattgcatggccatgccttgttcccaaaacctggcctagttatgcaagggatgagagggttaggtgtaaggaatgatgcagcaaaaagtgatgcagtcatggatatggcaacttggtttgaaattgttgctgctgaatatttggggtcacaaattagagagcccccatggttaaatttttgcatgaattggggtccaaaggaagggcccaagggtccaaagcagaaggatatgtggaaaggagatgaacggtaa

SEQ ID NO: 89508 - DNA, 378 bp, Glycine max
  Peptide Sequence Number=SeqID_206286
atgagttcctcagcttcagaggctcagacacacgctatggtttttctggcaatctctacaaggctcttcatgacagaggaattcacactttcattgataacgagaatcttcggagtggacatcgttgtgctctctaacaactacgcttcttccttgttttgcttagatgaacttgcctacacccttgagtgtcgtgagagaaaaaatttattggttttgccgatcttttataacctcaatccttctcacgtgcgacaccagaaaggtagttatgacgaagcattggctaagcatgcaaggaggttccagcataacccggaaaagttgcacaaatggaagatggctctgcgtcaagtagctgacttgtctggcttttga

SEQ ID NO: 89509 - DNA, 162 bp, Glycine max
  Peptide Sequence Number=SeqID_206287
atgttggcttgtgagtgggaagaagttcgcccagatattgtgatactagggaaagcattgggtggaggagttataccagttagtgcagttcttgcagacaaagatgtgatgctttgtatacaaccgggacagcatggaagttgtcaaacttctggattatga

SEQ ID NO: 89510 - DNA, 926 bp, Glycine max
  Peptide Sequence Number=SeqID_206288
atggctttcaaaactgatgagcgttacaaaatttcaaaatgttatgaccatgaattattacacttgcaccctgatgaagaattctttccatcttctgtggagtggtttttctccaatggtgcacttctatataagaaagggcaagagtcaagtcctgtcccaatatcaccaaatggggctaaccttcctcaggatcctaatgatgatggtgcctattgggtggaccttcctgctgattcaaccaacaaagatagggtcaagaaaggagacttgaaaagtgccataagttatgtgcatgtgaagccaatgcttggaggaaccttcactgacatttcaatgtgggtcttctacccattcaatggagcagcaagagccatagttgatttcttaactattgacttggggaagataggtgaacatgttggtgattgggagcatgtgacactaagggtgagcaacttcaatggtgaattaaagcatgtctatttcttacaacacagaaaaggtgcatggtttgattcatctcaattagagttccaaagtgggaacaaaccattgtactattcttccttgcatgcccatgcatcataccctcatgctgcccgtaacatcacggataagataggcataaggaatgacactgctatgagtgacagtgtcatggatttgggggcatttcaattggtttctgctgagtatttggtttccgatgttgtggagcctcctccatggcttaactatttcagggaatggggtcctaagatttattacaatgttgatgaggaattgaagaagcttgagaagtttttgcctgggaagctgaaatctactttggagaatattgtgaagaatttgccaagtgaagtgttgcgacaggaaggaccaacaggtcctaaggtgaaggatagttggagtggagatgaaag

SEQ ID NO: 89511 - DNA, 198 bp, Glycine max
  Peptide Sequence Number=SeqID_206289
atgggtgccaatgtgggcattatctgtgttttgtttctcttggcaacacagacagtaggggttcctgcatttgcaccatggaagaagctgcatgtgccatggaagaagcattctaaagatctctgttttgataagaacataataggagaaaatggagaggaattacaggtggtcttggaccactatggtttaagctaa

SEQ ID NO: 89512 - DNA, 198 bp, Glycine max
  Peptide Sequence Number=SeqID_206290
atgcacacaaaatgtaataattttggaatactcttaaaaggacaaagtgctcacaattctgtcaaatttgttaaagaaaaggtcatggatgaaccaaaatttatcccgtctagtttttatactcaactggtttcacaaaggtgtttagaagctgttggagcttctaatggaatcaccgaaaaggtgcttagaagctag

SEQ ID NO: 89513 - DNA, 258 bp, Glycine max
  Peptide Sequence Number=SeqID_206291
atgacatttcctaatctgaagaatttgaaacttttgctaagactggaattgaggaattgcttaataactggtcccattccaaactacattggagaaatagaaagtttgaaaagcatagatctgagctccaacatgttaacaggttcaatcccagattcatttcaggatttaggaaatctaaattacttgtttctgactaacaattctctaagtggaccaattcctgattggatactgagcataaaaaggcatatgtaa

SEQ ID NO: 89514 - DNA, 294 bp, Glycine max
  Peptide Sequence Number=SeqID_206292
atggcagactcaaatagtgcaagactaaaagaattctttcctcggaaagtctttgaactcactgggaattatttcaatggctcaattccaaaaagccttggacgcctctcatcagttgtcactcttacaattgatacatgcttcaggaaccttttgggaaatcgacttactggttcaattccctctgaaattggtgacatggctagtctgcaagaactgatcttggaagataatcaacttgagggacctcttcccctgagccttggaaaaatgagcaacttgctgagattgtga

SEQ ID NO: 89515 - DNA, 240 bp, Glycine max
  Peptide Sequence Number=SeqID_206293
atgtggctttcaaaagccaatgaaccggcaagtagccttctggtcatatccacttggttggtgcaaaccaactggcgggcatcatgcacagagaaatcaaatttccaatcatcattcagtgtaccttcaaatggatcaataatggaacgagaggagaaaaggtttatgtaccgtatccgttgttcttctgatgagaacaacgaggaagaggaaatggaagagggaatctgcgtttcctaa

SEQ ID NO: 89516 - DNA, 300 bp, Glycine max
  Peptide Sequence Number=SeqID_206294
atgtcttatgccgggggacttaaagatgaattgggtcaatgttgttgcggaaaacttgttgaagaccaaaaggattggatccttcatgtgccctatgcaatattgatctccaaagtccttgatcacttcaaggttgatgtccattatgagattaatgactttgtcaagctagagtttgagctcaagacaaagcccaagaagactacaacagaggaaactgaagataagcctatgagtccttttgagttgatgttgatggcaaagatggatgagaacatgaggatgcaaaaggaagactag

SEQ ID NO: 89517 - DNA, 5868 bp, Glycine max
  Peptide Sequence Number=SeqID_206295
atgttgtgggtggacaaatatcgtcccaaaaccctcgaccaggttatggtccacaccgacatcgctcgcaatctcaagaaattggtaacggaacaggattgcccccatttactcttctatggcccatctggctccggcaagaaaaccctaatcatggctcttctccgccaaatgttcggacctggtgccgaaaaggtgaaggtggataataggacctggaaagtggatgctgggagtagatctcttgatttagagctgacaacattatcaagtgccaatcacattgaaatgagtccgagtgatgcaggctttcaggacagatacattgttcaggaagtaatcaaagaaatggctaagaacagaccaattgatactaaggggaagaaaggatttaaagtacttgtgctcaatgacgttgacaaactctctagagaagcccaacattctctccgcagaaccatggagaaatacagtgcttattgcagattaattctatgttgcaatagttcttctagagttacagaagcaatccgctctcgatgtctcaatgtgcgaataaatgcaccaagtgaagaacaggtcccgtgtctgaacatcgaccgtaaaaacataggaaaccatcacagctacatgcgagcaaattggagagacaagcaggatgtaacttccttctacttcactagatttcccgacgacgcaacagaaaaggatatgtggattcacttcaagcaggtgggagacgtgagggagattttcatatcccggaaacgaaacagaaatggaaagcgatacgggtttgtaaggttcaaaggggtgaaagatgtgcatcagatggagaagaagctagacagtatgatttttggagggttaaagatgtatgccaacactcctaaatttgggagagcaagatgggacaagtcacaaacaacggctaggggacgcgctgagtctaaccaacaacaggaggtaaatagagacacgtacctcagtatgaaaccagacctgaacgtgggagcacagcaagggtcgtatgcggaggtcgtaaggagacatatcccaataacaaaacagaggagaacaccagctaaggagctgtatactggagacagctcgcggtcaacaatgatcctcgacatctcgctgaaagggcagcaatggcttcaggaggcttgggtggggagattaaaaaacttggctatgtttgatagaatagaggatgagatgttatgggatatcggagaaaacttatcaccgaaatacattggggatgatatggtcttgatcctgggtcttaatgaagaaaaagcgatgaaagtcatggaggaagaagacacaggatggggcgatctgttcatttctttggagaaatggaacccaaagttgcggcccggttacagactgacatgggttcattgctggggtatacctttgatggcttgggatatacctcatattaagcagatagtgtcgtccatcggtgaaatggtggaggctgacgacgatgtagaggatctaaggaagttggacatggcaaggatactaatcaaaacgccgtggaagcctctcatacagcatgtggtcaatgttcagatagaaggggagattttcacggtaaacatagtggaagaaagtggggtttcatgcgccagatgccagtgctggcggcagaatgaatttagctcttctgaggagatccaatcggaggaaagcgaaggtggaacgtcgcgtgaagctaggttgaaggcatggaggaacatgatgcgaaccctgagcatagcgggtaccttcggggaagttagggggggtgtcagtgtgtcgggggaagggaaggtggatgatctcaggtcggcgagcgcaaaaacaccgccgaacggcgatatgcaacgatcgtccgaaactccaacagaggatcgcgcatcgaccatggggggagatgaatcacaaaagcggtggaacgacggcttgcaaggggtgttggaaaactcaaaagaaggcctcgcgacgggcaagaacgaagaggacgcatcgaagtggatgaccgccgcaatgcaacagtcaccagaaaatctggccgacggtactaacctgggcatggtgggagcggatacacagaagggaaccagtggatattgcccaaaggacaacggtgatgcccgtcaggtgtacgcacagtctgacacagtgcggcctgattttgtagtgtcgcagatgagtgataggatggaggcggagaccaaccaaacacccttgcacctaaatgggggaagctggcacaatgagaagtgtggcatctctgataactcagagaactttcacgaaaagggaaataggagggcgcagttgaacgttgaagacaagagaagttttaaatctgttgctgaccagtcacgtgacaaggaagtgggaggagtagcggatttgggctgtgatatttacacccccactaagatatgttctccccaccaaccaagcccaaaaagtcacttaacaggccaaaacaattcgtggctggtgtattcacgaaagcgtggtgacaaaaagattttagcccataggggagctgcccatgaactacggcctgtcataaactcagcggacacgctttcacacccaaagcagcaggagaaagataaaaaagaagcaagagcccaaggccttggaaggggggttaagtggccagcaatccgaaggctggtcaatgagcatcatgttgacatgttatgtttacaagaaacaaaaaaggagaatgttgagaagtcaatgtgccaagcattatggggggatacagaaatcagctgggaagcatacccagcatctaatgcagcaggtggaattatttgtatatggaatgacagacattttaaggtagaaagcagaattacaggtgctggatttatattgctgattgggaagtggcgccaggagacacaaccagtacatgttaacatctactcaccgtgcaatctccaaaataaaaggatactgtgggatagtgttaagcagctgaaggatcaaaatcctggaggatactggtgcattttaggggatttcaacaatatcaggtcacctgctgaaagattgggttcatgtcaaagggggtcgatggatggaagtatcagggagtttaatgaatggatcgcggacatggaggttgaagaagtgccatcggtgggaaagagattcacatggtccagatcaaatggtactactaagagcaagttagatagattcttggtttcccctgaatggatttctaaatggcccgggtcatcccaacacacactacataggaacttctcggatcattgccctaaaattaaaactctcaaagataagatcaaggtgtggaacaaagaacaatttggggataccttcaagaaatacaagaagattgaagatgatttaaataagctggaagaagaatcagatgacagacagctagatcacaatgaattgatagtcagaaagcagcttcaacaggagttatgggaggcagctcaggcacacgagtctttactaagacaaaaggcgagatccaagtggattaaggagggtgactgtaacactagatattttcatctgctgataaactccaggcgtagagctaattgtctgaatggagtgctgattgatggatcacggaaggatgagccggcaatagttaaagaggaaatcagaaggtttttctcacaacgtttccaagaaagtgtacaagaaagaccaaggctggatggtatttgctttcagtccatgggcagtcagcagaatgacatgttggtggagcgtttttcagaggatgaggtcaaaagggcagtatggagttgcggaaatgataaaagcccgggcccggacggtcttaattttaaattcatcaaacaattttgggatatcatcaaatcagacttcctaagattttttgatgagttttatgtcaatggagtttttccgaggggcttgaatgcatcttttatagcattaattccgaagctagcggatcctcaagtgttgaatgattacagaccaatctctttgatagggtgtacctataagatacttgctaaggtcctggctaacaggctgaagaaggttatgcatctcatcattagtgaaagacagtcagcattcatacaaggtagacatatgctccacagtgtgctgattgcaaacgaggtggttgaagaagccaaaagatgtcaaaagctatgcattattttcaaggtcgattataagaaggcgtacgattctgtgtcttgggagtttctgacttatatgatgacaagaatgggtttttgcaccaaatggatccaatggatagctggatgtctaaaatccgtatcggtctcggtcttggttaatggcagtccttcatcagagtttctaccccaaaagggactcagacagggggatcaattatcacctttactattcaacattgttgcggaaggacttaatggattaatgtccaaagcgatagagaaaacgctatacaggggattcttggtgggcacacacaaagtggacattagtctcctccagtatgcagatgacacaatattttttggggagacatctatggagaatgttagaactattaaagttatcttgagggcctttgagcttgcttcgggtttaaaaattaattttgctaaaagtagttgtggggcttttggagtgtcggatttgtggataagtggtgcagccaattacctccattgtagcgtgatgtcttttccgtttacatatcttggtatacctattggggccaatccgcgaagatgccagacatgggaccctatcgttactaaatgtgagagaaaactagtgagatggaaacaaagacacttgtcggtacctaaaaaggtggaggataagttaataaaactacagaggaattttctatggggaggggcgtcggagcaaaataaaattgcttggatccgatgggaaacgggagagctgtgggctagggtaattgagtcaaagtatggggggtggaggaatctaagtgaagcaaggtcagccaataatgaatctacatggtggagggacttgaagattgtagctcagcaccctcaacagggtcaagtgctgaatagatcgatagtgtggaagcaagatcatttcattcagcaaatgggagatgtcaaagattcagggtgggaatgggattttaaatggaggagaccattgttcgacagcgaaatagatttggcggtatcattcttagaagatatccaggggcacagaattcgggccaacagtgctgaccagtgggtatgggtggcagatcctagtggccagtacacggttaggagtgcatacactgtgcttagagaggacttaatgcaggaggaccaggatggtgagttcaaggagttatggaaggtgaaggttccatctaaagtagctgtgtttgcgtggaggttacttaaagataggttaccaaccaaagacaacttgaggagaaagcatgttgaattacaagattttacatgccctttctgcagaacaatggaggagagcgcaaaattcattggtaagaaggaagggctgcaacttcctcctggttttgctgctcgcattgtggagaaatcaaatcgaaatttaaggagggccatattgtcatttgagacttgtcgtgtccaacagtatcctttcactaacaaacaaacaattcctccaatggactgggaagagtatatttctgaaattgcatctgacataatgaaggaacagagcccaaaaaggttgtttcaagttcgaggaaagctctatgagctgctaatcaattgcattcctccagagataattttgaagaggcttctttatgagctattgaggaaactggatgcagaactaaagcatgaa

SEQ ID NO: 89518 - DNA, 2259 bp, Glycine max
  Peptide Sequence Number=SeqID_206296
atggaagaaggttcttctatcaaagaacatgtttctttgttcacaaaggcagttcttgatttgaaaagtgtagatgtgaggatagacgaggaagatcaagcagtaatgctattatgttatcttccatcatcctatgaaaatttggaggacactatgctttttaggagagatacactcaccttggaggaggttaaagctaccctgaattctcgagaattaaagaaaaagataactgaaaataaaggtgaagttggagatcccaaggcattgatggctagaggaagatcagaaaagagggattcaaagagtaagaacaagaggaggtccaaatccaggaacaaggactactgcaagaaagagggtcatttcagaaaagaatgccctgaaaggaagaagaagaacaatggtaaatacaatgatgaatctgatatagcagtggtggctaatggatatgaaagtgctgaagtgctctccatctcaactgaaaagcacagtgaggaatggattctagactcgggttgctcattccatatgacacccaatctggaatggttaagctcctataaggagatagatggagggaaggttctcatgggaaacaatatggcatgtaatgtcattggcattggaactgttaaattgaagatgcaagatggatctgtaaagctgctccctgatgtgaggcatgttcctgagcttaaaaggaacctactctctttgggaatgctagatcaatctggatgttcattcaaaggagaaggtggaactttaaaggtattcaaaggttcattacaagtaatgaagggtacaaggcagaatggcctttacaaactgcaaggtaacactatcttgaactcagctggcctagtttctatctctgaaccaaatgcttccaagctttggcattatagcttaggtcatgtgagtgagaaagggctagaagaactacataaacaaggattgatcggtaatgggaattatcaaaagttaaatttctgtaaacattgtgtatatggaaaacaaaagagagttagtttccataatgcaactcacataactcaaggtatcctagattatgtacactctgatgtttgggggccagccagggcttttaagtgtttcaaaaaatggaaattgtttgttgagaatcaaactggtaggcatgtgaagctgctcaaaactgataatggccttgaatacttaagtgaggaattcaataaattttgcaaagacaatggaataagaaggcacaaaactgttagattgacccctcagcaaaatggccttgctaaaaggatgaacaggaccattttggagagggtgagatgcaaacttgaacctagagctaagaagggaatcttcttaggttatctggaaggagtgaagggatataaagtgtggttattggatcctgcaggtactaaatcaattatcagtagggatgtcttgtttagagaagaagacatgataacaaattatcaacagaagtctgattcagttcaaaagggtgttcaagctgagcaaaacagacactctgatcaaggaattaggttggagatagagaagcttgcacaaacatcaagtccagtagaggacagaaatgaagcatctcatgatgaacctatgatttcatcaattcttgaacctgttgatacttcatataacctggtcagagacagacaaagaaggcagattaaagctcctataagattgggttatgctgatctcatagcttatgctttgagtatagaatttgatgatcaaggctcagaaccaatttcttacaaagatgcaatttccagaaccgacagtgatcagtggagatcagcaatgcaagaagagtttgactctttaatgaagaatgatacttggaaacttgttgaaaagccagtaaagcagaaagttgttgggtgtaaatggattttcaaaaggaaaccagaagaaacaggaatggatagctacagatacaaagcaaggcttatggctagggttgtgaagcatacaagcatcagaatcatcttggcactagttgcagttcacaaccttgaattggagcaaatggatgtaaaaacaacatttttacatgggaatctagaagaaacaatctatatgagtcaacctgaaggatatgaggtaaaagggaaagaggagatgtccccaaggcagtggtacaaaagatttgaatcttttgttgtgtcaaatggtttcagcagaagttcctatgacagttgtgtctacttcagaaggttgaagctgtga

SEQ ID NO: 89519 - DNA, 162 bp, Glycine max
  Peptide Sequence Number=SeqID_206297
atggcgcttgcggatttggttgtttcacagatgcagatggggcagttgcatcaagtgcttgacctggttcttgacgacggtgacttcgtcactaccatcacagagcttgcttttaggaactccgacaaaaattttcaaatattagggacccaatccgaatga

SEQ ID NO: 89520 - DNA, 588 bp, Glycine max
  Peptide Sequence Number=SeqID_206298
atggagtctgactttgatggctggtttcatattggtttgggtggtgtgttggtggatttctcttcatggatgggatgcaaaaaatataacgaagattgtgaacgggatcagagagttacaacattcattaatggggtcgcgtacatgattgagattgtagaggaggtatgttgtgggtctcaaagctgcaattgtaatagagggggtcatggtgaatcatctaaagaaatatctttagagtggagcgacattggatgtgacatccagtcagaggaagatcaggtggacgacgaaactccgacaccaaacactatctcagattctgagggagacgcaagggctgggactcgtgggaagcaattattacttgttgtatattacccatactttgcaacaacggtcaacaatgttgagaacatggactactcaccaaatagtggacccacccactacagtttaggtgagactttagttgtacaaaaaaagattgacactaccaaacaaaacgagaagggaaaggaggataagaggcagcaaaatctggcaatagaaagtcaccatacaggggaggcaaatgcattgatgtga

SEQ ID NO: 89521 - DNA, 462 bp, Glycine max
  Peptide Sequence Number=SeqID_206299
atggagctcaaactccacgcattaatggcttccattccacatgcagtcttcacccattcttctttctctattcttttctgtacctacgcggttctcgatgctagtaggcgtccaaacggaaacaccagcagtcgttccactcacaaaatccctcctttgtgtaaggagaaacatcttaatgaacagaaattaaagctcgaccatcaaaaccaaaacaacttgaatgtgggcttggtggccctgtgtggagagggtaaccacgatcaacaaatgaagcaagcaggggtgccatctgatggggaaacttttgagttattttttactgcatgtgcacaggcaggtggaggaggactggtcagtgtcagaggaggagtggtggtgggtggaaccgtagtcacgaaggaggtgggagaggttattgatgaggtggcagtgccacgtgtaatctcattcaagcaataa

SEQ ID NO: 89522 - DNA, 252 bp, Glycine max
  Peptide Sequence Number=SeqID_206300
tgtgaggctacctcaactaccctaggaaggaatatgtgcaacactatgcgacaggtacaaagccaactaggggggaatggaagaagtaacaattggagggatgctctggacatcctctcgttatacttcacaaggtttccagaaaacatgggtgaaaaggatttgtgggtagcttttaagaaatggggagatgttagggaggtcttattgcacggaactagaatagaaatggccgtagctatggttttgtga

SEQ ID NO: 89523 - DNA, 816 bp, Glycine max
  Peptide Sequence Number=SeqID_206301
atggaagccatcaaagaattgaagaatctgttgcaatctgagtttgaaatgaaggatttaggggctgcaaggagaatactgggaatggatattatcaggaaaagaaatgaagaagatgaaatcaaagatatgagtagaatcgcctactcgaatgctacaggttcacttatgtacgctatggtctgtacaagactagatttggcatactccgctagcattgtaagtagattcatggaaaatcctggaaaacaacactggagtgccataaagtggatcttaagatatctaaagggttcaaagtctgttggtttggtctatggaagaaatttagaaagaatcaatggtctgtcaagctatgttgatgttgattatgcatgtggcattgacaaaagaaggtccttaacaagatacttattcactttgtatggaagtgtcataagttggaaggctaatttgcaatcagttgtggctctatctaccactgaggcagagtatatagctctcattgaagctataaaggaagccatatggcttaaaggtcttgttcatgagctcgaaggaaagactggtcttgttgaagtatggtgtgatagtcaaagtgtaattgatctctctaaaaaccaagtttttcatgagaggacaaagcatattgacattaggatgcattacatccgagacatcatagcacaaggtgaagttgaagtgaggaaagtggctagagcaaacaatcctgcagacatgctgacaaaagtagttccatgttcaaagtttactcattgtttaaacttagtgaacattggaacttgtgacacttga

SEQ ID NO: 89524 - DNA, 1833 bp, Glycine max
  Peptide Sequence Number=SeqID_206302
atggaaaagaaggtcaagggaaatggtttcatatatttggaaggtacttgggttggtgatggtggaaaagtgactataatcaatatttactctccttgtgacataacttctaaaagaattctttgggatgaagtcaaacaacttagaactgccaacaatgggggtttatggtgtattttaggagacttcaatagcattagaaggaaatttgaaagagtaggattgtgtcagaggattcagaatggaggcagcctgaaggaattcaataattggattgttgacttggatgttgaggatgttcctagtactcatcttctccttaaagtggcatctcctctctctcttccttctccattccgttttcattcatcttccaaaaggcaaaggaatccattgatgaagaagatcataggcctacaagctccaatggagcttacatcagataaatcattcaagaaggtagttcaagatgttggagcgacaactatgtatttggctgggggatatgtcctaaaagaaaagtttaagaagttaaagcagaggtccattgatccgcaacataatgaattgttggtggctcatttcaaagaggatgaagttaaggcagcaatatgggattgtggtagtgccaaaagccctggaccagatggactgaattttaattttattaaacaattttgggatctcctaaaatcagatgtgcttagattcttgaatgaatttcatgccaatggagtctttccaaaaggaagcaatgcatcttttctagctttgattcctaaaggtaggcagctgttacatagtgtggttgtagctaataaagttgtagaagagcggatggggttctgcgccaaatggatcaagtggattgaaggggtaaatggtagccccatagaggaattttgtcctcatagaggtctaaggcaaggagacccactggttcctttcttgttcaacattgtagttgaggggctgtccgcatcgttggagaatgtaaaagcaatcaagctcttgctgaggaactttgaattagtgtctggtttaaggataaattttgttaaaagcaaatttggagcaattggcatgtcacatcattggattcaaaatgcgacaaattaccttagttgtagagtgttggccattcccttcctatatttgggtatccctattgtggcaaacccaaggcatagtatgatttgggaacctatagttgagagatttcctaacgaaggtggccatcaaattggtgaggttatagcgatggttcttatgggtggaaaattagaccaaaggaagattgcttgggaaaaattagagataatttgtctcccaagggagaaaggtggattgggggtgcaggatataacaaagttcaattgtgctcttcttggaaaatggtggtggaaccttttccatcataaaggagaattatgggcgaggcttttagagtccaaatacgggagttggttaaatctagatgcaacaagaacaaatagtgctgattcagtttggtggcaagatctaaggcatgttgatatagttgcaaaattcatggaggacattgaggctgtgacagtgcaagtgaatcagcaggatggttgggggtggaggttagatccttgtggggtttacacagtgggaagtgcttacaaagtattgatccgggagagacttccaaccaaggttaacttgaaaaggcgaaatgtggagctgaatgatatcttgtgccttttctgcggatctaatgaggaggagaccatttccttcaacatggccatggttatttcaagggctttatctatcagcgatggcaaatatggtggacttccttaa

SEQ ID NO: 89525 - DNA, 543 bp, Glycine max
  Peptide Sequence Number=SeqID_206303
atggacagcatgcttaaactgcacaaggaagctgtgagtcatttaagtcagtatattgataatccgacttcaatgcattttacagcagctggtagagtgcttagatacatcaagaagtctccagctcaaggattatttttctcagctgaatctgataacaagctgaaagtaagaagcaatccactgtgtccagatcttccttcagaagcagaatatagagctttggcacaagctacttgtgatgctgaatggctgatttacttgctaaatgatcatcgagtatacactgtatcccctgctgtactttattgtgacaatcaagaagccatccatatagctgcaaatccagttttccatgaaaggaccatgcatattgggctggattgtcactgtcagggaaaaattacaaatggaacaattcatttgttgcctgtttcttctcagtctcaattggctaacatcttcaccaaatctttggttctaggacctttcactaatctgcagtccaaggttggaatgttggacatccacattccagcttga

SEQ ID NO: 89526 - DNA, 777 bp, Glycine max
  Peptide Sequence Number=SeqID_206304
atggtagatgaatcaatggcaagtcctggatctatccttgacattttactacagagcttcaaatcaggtgaagggaccgaaagattgctgaatcacttggtgatcatatccatggacccccaagcttttgagtactgcagttccttgcacccctattgcatccatccctccatatttccacgtcccattatgacaaccccagatcataatttattcacttggacaagaaatgatgttttgtatgaagtgattcgattgggttacaacataattttcacggatgcagatgtactgtggcttagaagtccgtttataaacttccatgcggctagtgaactcacaatttcatgtagtgatggacaaagtggaagtgacctgcaggatggggggatcttcttcttgaaagcaagtgagaattcccttgaattcttcaagtattggaaattgaccaagttcctgcatccaaacaatcccgcagaagagtccttgtgtacaacagtaagtgtaatgcaggatgcagttagccggtatagctttgatgttcagcttgcaaatacaagctcttttggtgatttttgtcagctaaatatgaacacgttaagggaggcttataccattcaagctaactgttgtgatgatctcaaaagcaaagttcatgacctgaggattgttcttgatgattggatccgcttcagaaaacgtgcatcagagggcaatgctttggacaaaatggatttgaggtggccacagaagtgctccataagaaactatacttag

SEQ ID NO: 89527 - DNA, 450 bp, Glycine max
  Peptide Sequence Number=SeqID_206305
atgatgacagttgaagagaagcctgatgtgacatataatgatgttggtggttgtaaggagcagattgaaaagatgcgagaagttgttgagcttcccatgcttcaccctgagaaattcgttaagctaggaattgatcctccaaagggtgttctttgctatagtccaccagggactggcaaaacacttttagctagggctgtggctaataggactgatgcttgttttataagagttattggaagtgagctagttcagaaatatgttggtgaggatgctcgaatggttcgtgaactatttcagatggcccactcaaagacggcatgcattgtgtttttcgatgaagttgatgcaattgggggtgcacggtttgatgatggtgttggtggtgataatgaggttcagcacactatgcttgaaattgtgaattctaccggtaagagcaccttctaa

SEQ ID NO: 89528 - DNA, 495 bp, Glycine max
  Peptide Sequence Number=SeqID_206306
atgtgttggcattgcaacattatcaaaccaaaactaaaactaagggcttcaagctttggtctaacattatacgggctgaaacaatctccttgggcatggtttggaagattcacaaaaccaatgtacctcaaagccactctatgcaaaggactcttgttcaaaagaggtggaagcttgactattgatgctcatattgatgcaaattacgtaggtttaatgagtgataaaaggtccacttcaagctattgcacattcttgtgtgagaaccttgttatttggagaataagaagaaaaatgaagtggctcgatcaagtgctgaggcagaatttagatctatggcacaaggaatttataaagtatgagggttccatgaagttgttttgtgacaataaatccgctatttgcattgcacataattgtgttcagcatgataggacaaaacacattcagatagacaccggtacttcatcaaggagaagctggatagtgaattga

SEQ ID NO: 89529 - DNA, 444 bp, Glycine max
  Peptide Sequence Number=SeqID_206307
atggagaagccatctaaaccagagttgccacccaaattatggaaactaagtcatgagactagaagctccaagttgtctgaagaggaaaaagttaaaatttcttctaatggcattggatgcacaaggtctaaaggatgtgggcactacaactttgataatgtgattgcatgtgcaacaaggaagaatttccacccaatccatggtgttgaaaccttcctagtcctactctttagcaaaattatgtatagaatctacaactttgcaatgtaccctgttgcaaatagagtaatggagatggtgttggtcaatgttgaaagtcacttcaaggagttagaggaagcaaaacaaactgaaagagatgttggtacattaaacattagtgatcatccaacaataggaagatactatgaaacaataggaagtgatcatccaacgaaaacctaa

SEQ ID NO: 89530 - DNA, 171 bp, Glycine max
  Peptide Sequence Number=SeqID_206308
atggagaataaagttgaggttgatcataggcttgctggtatcgtggaaccaacgattatttatatggatagtaatgttgattttgccattgttggaaaaataagagtggttatgttagttgttgattatgtggtggcggaatgtgttggagttatgaaggaaaatttgtga

SEQ ID NO: 89531 - DNA, 1149 bp, Glycine max
  Peptide Sequence Number=SeqID_206309
atgcgggtgcaaaagggttggagtttcttacccatgaaccttgttttcaaggtggcaattgcaaatggggtcattagaagcggtgaattgataagactataccataatccctcttttgtcggtttcacaacatgcatagttgctgatgtcaaacaagaagagcagatagatcaccatgaggatcaagcttcaatcaaacagttcctagtttcatcctataagaagaacttataccctcttctgaaacaagagattcaacagaatcatagagaactagcatttttaaattcaggaacacctagaagttctgagaaccaatggaccactagctggtgggagcaattcatggttctgcttaagaggggtttaaaggaaaggaggcatgaatcttattctggtttaaggattttccaagtcttgtctgtctcaattctctcaggacttctgtggtggcattctgatccctcacatatacaagatcaggtaggcctgctattcttcttctccatcttctgggggttcttccctctcttcaatgccatcttcgcttttcctttggaccggccaatgctgacgaaagaaagatcatcaggcatgtaccatctctcctcctactatgtggccagaacggtaggggacttaccaatggagcttgtgcttcccaccatctttgtaaccatctcttattggatgggtggactcaagccttctttggttacgtttgtgttgacactcttgatcatgcttttcaatgtgctggtttctcaaggaataggccttgcacttggagcccttctaatggatgtgaaacaggccacaacattagcttcagtgactatgttggtgtttcttttggctggaggttactacattcagcaaattccattctttattgcttggttgaagtacatttctttcagtcactattgttataagcttcttgtaggagttcagtactcagtaaatgaggtctatgagtgtggacaagggttgttgcattgtaagagttgtggcttatttagctttgaggatggggctgcatcattgactagagactgcatagtagatcaaggattcatggccataatattgattgacatccttgttgtttggatcattggcctcagtagaagggtaattcgattctag

SEQ ID NO: 89532 - DNA, 1064 bp, Glycine max
  Peptide Sequence Number=SeqID_206310
gtgataagtcaatgattaagaaacgatacatgtacttaaatgaagagatcctgaaggagaatccgagtgttggtgcctatatggctccttcattggatgcaaggcaagacatggttgttgtggaggtaccaaagttgggaaaagaggctgcaacaaaggcaatcaaggaatggggtcaatccaagtccaagattactcatctcatcttctgcacaaccagtggtgtggacatgcctggtgctgattatcagctcacaaaactactaggacttcgtccatcggtgaagcgttacatgatgtaccaacaaggctgttttgctggtggcacggtgcttcgtctggcaaaagacttggctgaaaacaacaaaggtgctcgtgtgcttgtggtgtgttcggagatcacagcagtcacatttcgtggcccgagtgacacacatcttgacagccttgtggggcaagccttgtttggagatggtgcagctgctgtcattgttggatcagatcctctgccagctgaaaagcctttgtttgagcttgtgtggactgcacaaacaatccttccagacagcgaaggcgctattgatggccaccttcgccaagtaggactcactttccatctcctcaaggatgttcctggactcatctccaagaacatcgaaaaggccttggttgaagccttcaaacccttagaaattgatgattacaactctatcttttggattgcacaccctggtggaccagcaattttggaccaagttgaggctaagttaggattgaagcatgaaaaaatggaagctactagacacgtgcttagcgagtatggtaacatgtcaagtgcatgtgtgctgttcatcttggatcaaatgaggaagaagtcaatagaaaatggacttggcacaactggtgaaggacttgaatggggtgtgttatttggttttggccctggactcactgttgagactgttgtgctacgcagagacaactgggtcgaggtggtggttcgagtggttcgaggagtagtggatcctgtcgaaagcgaccttgaggacgatgtcggagtataa

SEQ ID NO: 89533 - DNA, 162 bp, Glycine max
  Peptide Sequence Number=SeqID_206311
atggaggcgataatgatgtggtggctgtggtgtgatggtgaggtgacaatggcagattgtggttgtagtgatagtaacaatgacaatggtgatagaatgatggtagtggtagtggaagcagtgacaatggcaaggacggtggtagtaatggaagtgtgttaa

SEQ ID NO: 89534 - DNA, 2910 bp, Glycine max
  Peptide Sequence Number=SeqID_206312
atggtgggcaatggtcagcatctcgattgctattgtctttgtactgacgttcccattgaaattcaatcaatgatcttcaccgcggacctccatgtccttcctatatcgggagcaaatgttgtgctaggagttcaatggctcaaatctcttgggtctatgttaactgattataacaccctcagcatgcaattcttctatgatggtaggttgatcgagcttaagggggacaatgatgctcaccttcgtctagtttcttctccacaattccgccggttatgtcaccgtcagggggagggatactgttttcatatttccatgatcatggataccgccatttctctagataattccacgttggcccctgaactccaatcattacttaccaagtacgccgtcctatttcaacctcctcattcattaccaccagcgcgaacgactaatcatcatattcacctgcttccccaagctactccggtgaactcaccggtgctgctggtccgcaaacacgatggaacatggcgattctgtgtggattacagggatttaaacgcagtcaaggataggttcctcatccccaccgtggatgaactccttgacgaactaggcagtgcacgttgcttttcaaagctcgatttgcttcaggggtaccatcagattcgtatgaatcctgaggatgtgcccaaaaccgcatttaggatccatcatggccattacgaattcaaggtaatgccatttgggctctgcaatgccctatcctccttccaggaaaccatgaacctgctattcggaccttatcttcgacaatttatcatcgtcttctttgacgatattcttgtgtatagcagcaccttcgaagatcaattgcgccatttagacactacattccaggtactgcttgccaatcaattcgtccttaagttgtctaaatgcttcttcgcgcagcctcaggtagagtaccttggtcatatcgtgtcacataagggagtggaaccagtcgccgcaaaggttgccgcaatccaacaatggcctgtgcccaagtccaccaaagctctacgaagcttcttggggctagttggcttctatcgcaggttcataaaacattatgctaccattgcagctccactcatgaaggtgaccaccattgacccgtttaagtggacccctgaagctcagagtgccttcgccaacctcaagcttgccttatccacaacacctgtgttaacacttcccaacttcgataacttgttcaccttggaatctgatgcctcgggggcaggcatgggcgccgtcttgactcagaacggccaccctatcgcatttttcagcaagccctttagccccaagcttctcagagcctccacgtcatcgctttacgatcctcaccgaccaccggagtttgaaagaacttctctcttagatgctttatcaaggttactagaacctccgacgaacttgcatatgattttgtctgtgcctagtttgatcttcctcgcagaattacgccaacaattggacactaatgatgattatcgccacaaacgtcaggctatcatggactttccggcagagcaccctgagtattcagtaactcagaatttagttctcaacaagaatttccactggcctggtatccgcgaggatgttatccgttttgtggcccaatgcttagaatgccaactcactaagtatgaagctaagaaagcatccggttttctctgcccccttccggtccctcatcagccgtgggtggacctctcgcttgactttattgtcggccttccggcataccagggtaacacggtgatcctcgtagtagttgataggttctccaaagggatacaccttggtatgttacccatatcccacacggctcacatggtggcgtcactattcgtcaacatcgtggtcaagctgcatggtcttccccagagcttggtctccgaccgggatccactttttatcagccgcttttggcaagagctttttctcctaagtggcactctgttaaggatgagttcggcttatcatccacagagtgacggccagacagaggtgttaaatagagtgatcgaacagtatttactcgccttcgttcatcgtcggccggggctgtggggcaaattgctaccttgggttgagtggtcgcacaattcttcgtggagtgtgagtacagaatacattgtcggctcttctaatatcgcggcagtagatgacatgcttggagagaaggacaccaccttccaagctattcgctggaagcttattaaggcgcaagagaacatgaagaaatatgctgatacgaagaggagagaggttactcatcaagtgggggactgggttctccttcgactccgcccttaccggcaaagcactgccaaaggcactcccacttcctcagtcaaactggccaagcgttattatggcccgtttaagatcctggaacgtataggcgaagtggcatatcgattagagctccctgaaggtgttcggatacacccggtgttccattgctctgttctcaaagcattccaaggctctcctgattcagtcccgcaagttcaattacatcccgaagcaatcaatggtcaacccttagtagttcccttggctattctggactatcgtcgtagctctacagatgatgatgctccatgggaggtactggttcagtggcaaggcctttccccagatgaaacctcctgggaagattggactcaactgtgtgaaactcaccaccttgaggacaaggtggtgttccaagggctggggagtgttagcatatcagaagcagcaaacagaacaccagggaacatggacacgaagcaacagaagaaagtacaagtggtgcaaatagcaaagaagcccaaaaggaaggttacgagaccagcttacttgaaggactatgcgtaa

SEQ ID NO: 89535 - DNA, 765 bp, Glycine max
  Peptide Sequence Number=SeqID_206313
atgggtgctgccaccgtcaatcagcagcaccacttggtggttgtcaatagttcccaccaaatgcagcgtttcaggggctatgtggccttccagagaattgaggctaatttgggttgggcttgggtcatgggtatcggcgacgaagagaaaaaccctagaggcacaacggtgacctctatggtatttctcatcgcaggtgaagcagaggcccttctcacggcgggaagcgatctcctccggggaaagggggaaggcaaggtggtcgaaattgtggacaagggttgtggtgcggtggtgagggttcgagggaaggttgaggacaagggcaatgtgtggggtgtggtggtggaggaagggcgagaccggcagcctgagcgagagtcagaggttgaaggatctgcacctcgcgacgaatttccggcgacaagcccgccacaaagcacgagtctagtgatagtcaaagaattggttgatcttgaagatccagccattggggtttgttccatcaaatcgtggttgcggttgagggataatgggattgggagaaggaacaggggaaacaggattgtggtgtgggttaatgtgagtgagaagggcatcaagtttctcgcccaaagaaagttgttgaatggagaggcgggtgaggatttcttcaagtttcaggggaggttcaggcggggtggagttggccataacaatgaaagcaccagaatgttaggtgcagaattgagctggcttcgagggctagtacctccagaagcttaa

SEQ ID NO: 89536 - DNA, 531 bp, Glycine max
  Peptide Sequence Number=SeqID_206314
atggtgaagttctcaaagcaatttgaggggcaactcattccagaatggaaagaggcctttgtggattactggcaactcaagaaggacctcaaaaatgtccattattttattaataacaccaacaatacacccaacaatacttctttacctaagtacatcttttcatcaataagaaactactctctatttggccaccaacatagagagcctggaccaattcaagtccataggaaacttgcttcatcatcttttaatggggacatgtacgagactgaactgttagagcaattttctgacactgatgctactaaagaattctttgcatgtctggaccagcaactaaacaaggtcaacaagttctatagaacaaaggagaaagagttcatggatagaggagattccttgaaaaaacaaatggacattctcctaatgctcaaaaccacattcaaggagcagcagagcaaagcaggctcttcccatggctccaaggaagatcaatctatctcatgcacattctctaatggtacataa

SEQ ID NO: 89537 - DNA, 3897 bp, Glycine max
  Peptide Sequence Number=SeqID_206315
atggctgaccatggaaccaggaagacaaccacgaaccatctggaagacgcaatcccacgcctcactaacagccaagcaaatctcaccgaacgttacacgaacctctccgatagggtcgattcgatcctggaccaccttaggatatgtgatgcgcaccaaaaccagccctcctctaacaactcgaacaaccaccgcaactctgttaagcttgatatcccgcgctttgatggccgcgatcctctaggatggatattcaagattaaccaactctttcagtatcagaacacgccggaggaagagagaatcaccgtagcctcactctacctcaatggtgccgccctcagctggtaccagtggatgtttagcaatggcttcataacgtcatggcaaggattccttcaagctctagaatcacggtttgctccgacgttctacgacaatcccaagggagctttattcaagcttgtgcaacgtggttctgttaacaactacttaacagaattcgagaaattggctaaccgcgtggtaggacttcccccaccatttttgttaagttttttcatctctggattaaatccagaacttcgatgcgaggtgttggctctccagctaatctttcttctacaggccactgctctcgtcaagctacaagaagataagttgtgcgacaaacgctcttcgttccaacgacccttccaaccttccccatccagttcctcaaccagcctcaaccctaaatctaagccaccatacgttcaacgtacaccggaggacatggcgtttcgtagggagaaaggtttgtgttataattgcgatgataagtggagtcctaaccatcgctgtaagggacgcatactactgttcattgcttatgacttaccaccgaacgatggtgaccccaactccataacaccaaactcttgcttggaagacaatggaggtgattctgaaccagccatggacaccagctttccccacgtcagtcttcacgccatgtctggcctaccatcatcagagacattccgcatctatggtactatcaagaacgcacgcctcaccatcctcatagacagtggaatcaccttccacttacttcaaatcagtggggcagatgcagtgcttggcatagactggttaaaacaatttgggtcggtcacgactgactatacctccttcattatgaggttcacccatttgggccaggaaatatccctgcaagccgatgtagctattggactagaacctgcttcaacagcccaagttaaacgcttgatccacacagcttccaccgtgagtcatcttccccctctagccgaacttgttgcaaggcttctccgccgatatgataagctctttcagtccccgacacaccttcccccctcacgcgaccataccgttatcctcactcttcttcctaccacgacaccggacgagcatgagtccatactcttctccagtccttttggtgaagaagaagcacgacacatggcgcctctgggccatgcatcgtggttttccaagctcgatctcaggcagggatttccccatgggcactacgaatacctcgttatgccctttggcttgtgtaacgcaccttcgactttccaagcagccatgaatcacctcctcgtgccgttcctgtgtcatttcacaactgtgttctttgacaacatactcgtctatagcgactcactatcatcccacgttcaacatctcgacataaccttccaagctcttctacgatgtcagtattacttaaagcaaacaaagtgtttatttgctcaaacccagctagagtaccttgggcatgtcgtttttggcaatggtgtagctctcgagccgtccaagattcaggctatcatccaatggccaactccgacatcagccaaggaacttagagcatttctcagactcacagggttttacctgaaattcattcagaaatacgcagctatcacaaccccactcaccaatttgttgtgtaaggacgcatttgaatggtcactagagtcgcaggatgcctttgacaaactcaaaaccgccatgaccagtgtgccggtgttagctctccctaacttcaacgagccttttacggtggaaacagacgcatctggcaccaccatggggctttatgcaatcatcgcggcggtgcgcaaatggcggcagtaccttctcggccgtccatttactatcctcaccgatcacaagagtctccgagaactcatgtcgcaggtgatccaaacccctgaacaacactactatctctctaaactgcttggctttgattataccatacaatataaggctggtgcaactaacgttgtcgcagacgcgctctcacgtaggccacctgattcaggccaactgctcttcctctctgtgccgcaaatggatttcatgcgtgatattcaacaaacgcttgaggatgatcctagttctcaggagttggtacgcaacattaaggcgaatccttcagcacaccctcagtttcgccttagtaagggatatttgctgttcaacggtcgtatttggttgaataaaaccaacccttatattccttccttattactggaattccatgccacaccacttggtggccatctggggatagccaagaccacacatcatctcgaatcaagcttcttctggcagggaatgaagcacgatgttaagcaattcattcgagaatgcaaggtttgccaacagaataagtccagcactaggcgcatggcaggtcttctgcaaccgctaccagttccgacgggggtatgggaagacatctccatggatttcttcacccatctacctccatccaacggcttcactgtcatcttggtcgtggttgacaggtactccaagggggtgcatctcggagcattgcccacggggttttcagccttcaaggttgccacagtattcatcgacatcatctgtaagcaccatggattccctaagagcatcgtttccgatagggatcccgtgtttctgagtgccttctggagagaactattttggctctgcggcactcgtcttcggctaagcactgcgtatcaccctcagtcagatggccagactgaggtaatgaatcgcttcctcaagcagtacctcaggtgcttcgtacactcccaaccgtcgacatggctccgttatttgtctctcgaagagtggtgctacaacacttctctacactccagttcggggctcactccgtttgaggtcatatatggcaaacctccaccgtcaatacctcattacattcccggcttaacgaacaatgaagttgttgagtcactagttgaatcccgtcaaactatgcacgctaagttgcagaaaagactgaaaaaggctcaagattccatgaagaaatatgcagatgctcgacacgaggatataacattttctgtgggccaatgggtctacgtaaagctttgcccaaatcgccagcgatcagtcgccggagtcaaccattcgaaactgtcaaaacgttactttgagcccttcaagattctggcccgagtaggtgaggtcgcgtaccgactagaacttccggctgaagcacgcattcatcctgtgttccattgctccttgttgcgccattatcacggagctctgccctcagccactgaaccttggcccctggagatcatcggccataaacccctacaacgccctctttgcatcctggacagcaagctggatacttctacatcccctccaactcagctggttctaacccaatggactgggcaacctccagaggacacttcctgggagccatggcccgaactacaagaggcctaccaccttgaggacaaggtggtgtctgggggagaaggtattgttagcacccacgccgcctgctaccgccacgacgaggcctactcgcgcagtaactaa

SEQ ID NO: 89538 - DNA, 1083 bp, Glycine max
  Peptide Sequence Number=SeqID_206316
atgatgagtaattatgtgtatctcaaactctgttcactgcaaacagaggaagactctgttaggagcagagcacaacaagaagaaatgctagacactactagcacagatgattttgagaaaaatgaagctccattttcagatttccctcgtgtagaagaacttgccaagtctatgcagattaaaagagaagatggaaaactgagaacactttctggccgtgtaatcaattgccaagggaagaatctgaggataaacattcctttgacgacgccgtcgcgaaccttctcagccataagctaccttctcagggaagattttctcaatcagtcttcaaggaaatgtggtccagaaggtgccaacaacattcacctaaacaaaactaatttgcaccatgctgaaaagatgatcaaaggaggtttcattgaactctacaaaggactagggtatctcaaagtttacaggaacttgaacttgcttgcatttataaagattctgaagaaatttgataaggtcactgaaaaacaaattcttcccatctatatcaaagtggttgagagttcctatttcaatagctcagacaaggtgatgaagttagccgacgaagttgaggaactgttcatcaaaaattttgctgaagacaaccgaagaaaggccatgaaataccttagaccgagccaacgcaaagaatctcatgctgtaactttcttcattggactatttactggaaccttcttggcacttcttgcgggatatgctataatggctcatgtgactggtttgtatagaccacatcaaaattcagtgtacatggaaactgtctaccctgtgcttagcatgttcagccttgtgttcctacatttctttctttatggttgcaacactcttgcatggagaaaaactcgcataaactacagcttcatttttgagcaaacccctaccaaggaactcaagtatagagacatattcttaatttgcacaatggcaatgagtgctgtggttggtgtaatgtttcttcatttgactctactgacaaaagggtattcatatgccagggttcaagacattcccgggcttcttcttctg

SEQ ID NO: 89539 - DNA, 468 bp, Glycine max
  Peptide Sequence Number=SeqID_206317
atggctgatcaactttgtagtcaggtgccaatgctcaggaaccttgagtacgtggcatgttactatataactggtagctacaaaactcaggactatggatattgcatgaggacaaagcactatagagatctagcttatgcagtgtcatttctaccctattattggagggctatgcagtgtgctaggagatggtttgatgaagggcaaacaagccaccttgtgaatctaggcaaatatgtatcagcaatgttagcagcaggagcaaaagtggcttatgagaaagatgggagtgtaggatggctttgtgttcttgtggtcatgtcaagtgcagcaactatgtaccaattgtactgggactttgcccctctctctttcttcactaaggagcctatggtgtgggccattggcatgcaattggcaccccaaaagctagtagcttcacttatcaaaattagacaaactagctaa

SEQ ID NO: 89540 - DNA, 882 bp, Glycine max
  Peptide Sequence Number=SeqID_206318
atggcggcaagcgcactgtatagttcccctatattccttcctcctctctggcaccctaaacctatgcaccccctctgctgcttcaaccctcctccttccattagcctctccaggtcaaagttttctggtgcagcagtggcaccccaaaagcttccccgtcgggtgtttagagtacgcggcttgctgggtcacgattctgggactgccccacaaccagaaacacccaattctgaagcgttcatacactcgcatataaaggacacaactgggatgtgtgagagacttggtgatggtgctggtgctgtgtctgattctgctgtggaatcaggtggtgctgggggacttttgcgaataattgttggagctggagctggcgctggagccggtacctctatcactggcgctggcgctggcgctggtacctctatcactggtgctggtgctggagttgcggctggcggtggaggaacaggtgatggtgttggtgccggctttgtgggtgcgggtgcaggtgctggtgttgcctttgctggtgcaggggatggaggtgttttagctggtgttggtgctatctttggtggtggtaatggtggtggtgacgcaacaggtggtggtggtagcgggggtggtgagaccggtgaaggttttggtggttgtggtgcaactttgggagctgatggtttcacaggagcaggtttgggagctacatttgcaggtggctgggatgtggttggtggtgtactcgtggtgggaggggatgccaccactgtgggtggttgtgttaccgccagtggcgtgctggaagatggagatgttgcagttggggttgtaggtggcaaagttgtaggtggcaactttaccggcacagttgctggtgcttga

SEQ ID NO: 89541 - DNA, 410 bp, Glycine max
  Peptide Sequence Number=SeqID_206319
atggagaactacactaagcaatcactaagcatggctccaacctcagtggttgagaatggagaattgcaccaagcaatcactaagcatgactccaaactcgtgggtggaggacgcatgaacgaaaacgcaattcatggggctccaaaaaagggtagagaatggagaattgcactaagcaatcactacgcatggctccaaactcgtaggggtagagattggagaattgcactaagcaatcactacgcatggctcaaaactcttgggtggagcatgaatgaaaacgcaattcatggggctccgaaacagggtagagaatggagaattgcactaagcaatcaaaacgcatggctccaaactggtgggtggaggatgcatgaacgaaaatgcaattcatggggctacgaaaaagg

SEQ ID NO: 89542 - DNA, 327 bp, Glycine max
  Peptide Sequence Number=SeqID_206320
atgcgaacatgcttagtaaagagacaaaacttcctactaatcagagcaacacatgcttttcggatgaaaaacaatgtgtctaccgaggaaggggaaggaaacactgggttcaacaaaaatagaagaaaattactcaaagtgtatcaatctcacacagggcaaggattgacattctcaccctgggtcaaggtttatggtgagttgggattttggcttaaggcttgtagaacagctggacatgatatatgtcagggtgttggtttggccagcgaatcagggataagggagatgtcccacattatttccatgatacacatgcaacaatga

SEQ ID NO: 89543 - DNA, 571 bp, Glycine max
  Peptide Sequence Number=SeqID_206321
atgcagcatccgggcgcacgctttatcgccggcggtaccaatctgctcgatttgatgaagctggaaattgaaaccccgtcgcacctgattgatgttaacggactggcgctggacagcattgaacccaccgccgggggcggcttacgtattggtgcgctggtgcgcaataccgatctggcggcagatgcgcgcatccggcgcgactatgccgtgctgacgcgcgcgctggtggcgggtgcttcaggccagctgcgcaatcaggccaccaccgctggcaacctgctgcagcgcacgcgctgtccctatttttatgatgttaatcaaccctgtaataagcgtcagccgggtacgggctgtgccgcacgcgaaggattcagccgccagcatgcggtggtgggggtcagcgaagcctgtattgccacccatcccagcgatatggcggtggcgatgcgagtgctggatgcggtgattgaaaccgtcagccctgatggcagccagcgcgctattcccatcgctgaattctactgcgcaccgggcgacacgccgcatatcgaaaccgtgctgcagccgg

SEQ ID NO: 89544 - DNA, 415 bp, Glycine max
  Peptide Sequence Number=SeqID_206322
ggctgttcatgtgtcctccactttcaagtttggagctgagtttcatgaatgcctaagtgcggactctcaaggcaatcctccatactccacctttgttccggagccacatgaatgttattgcctagcgctgttcatgtgtcctcccttgtcaagcgcgaagtctctggtgactgggaaacacaagaaaaaaaagaaggagtggagacgagagtcgtcatcacagaaagggcaagacggacgaaatcagtgtcctatctttggtttcctcttatctccgatgagagggggtgcaaatagcaaccaggccgacttgggccctccagaagattcctccagaaggctgttgcttctggaggaagcaaccttgctcgcctgggcgagctgggcggcaagcttctcccctattttgctataa

SEQ ID NO: 89545 - DNA, 1215 bp, Glycine max
  Peptide Sequence Number=SeqID_206323
atgactaatagaaaagcattacctgttccatcctttgttagtggtatttgtttcagttaccatagttcccaaaagaagatgagagttagggagttatcaccctctgatggcaatggttcctctactaatggagatgaacctttacctcaggatgcagattatagtaatgttctaagtcttagtgatgagctagagacttcaatcttggcaaggtttccaagatcacagcactggaaactgtgctttctcaacaagcggttcttggcccttgcgaggagtggcgagatctacaaaataaggagagagttaagattcaaagaaccttcagtgttcatgctggcaagtggagagagcaattggtggggaatggagtggcctttcaactcaagcaagaagctccctcctattcaatcagattacaattttgagtatggagataaggagtcattttgtgcaggttcccacctattagtctctggcaaggagattgatggggctgttatttggaggttcgattcaattaaaaatgaatggctcaaagggccatctatgatcaatccaaggtgtctttttgcatcagccacatgtggtgctattgctttcgttgctggggggtttgatgcaataacttacacacaagtcttggattctgctgagaagtacaattccgaaagccagtgttgggagccccttccaaggatgaacaagaagaggaagttttgctcaggttgtttcatggacaacaagttctatgtccttggagggcaagatgagcatgggaaagacctcacttgtggggaattctttgatggcaagacaaatagttggaacttgattcctgacatatggaaggatattcctctatttgattcacagtctccacctcttcttgctgttgtgaataatgagttgtactcacttgatgcttcttcaaatgagttgaaagtgtatgtgaaaggaaccaactcatggaagactttgggagtggttcctgtgagagctgatgcacaaagaggttggggtgtggcttttaagtctcttggtgatgagttacttgttattggtgcaccttctgtgtcacacacagtgcatgccttgtctatgtacacttgctgccctgatcctgatgatgagaaattgaggtggaggcaaattggatgtggcagcattcagctcaatcactttatccgcaattgtgctgtgatggggacctga

SEQ ID NO: 89546 - DNA, 315 bp, Glycine max
  Peptide Sequence Number=SeqID_206324
atgccaagaaagagacaaggaccacagattgatttagaagggaaagtgaagaaaagtgaggattttgagacatggaaatgtcccatgaggcaacaacgcctacatatatataacataacatacaaagaccaaagaaggaaagagagagaagagaaggaaaaaaaaaaactcttgcaaaggaaggaagccaagtcaaaggaagcaataaatggaatgcgagcgttacaatattgcaatcaaaacaaagagaaaagagacgttgggagtgagttcaagctaataacaacacaacaccataacccatgtgaggtttga

SEQ ID NO: 89547 - DNA, 861 bp, Glycine max
  Peptide Sequence Number=SeqID_206325
gtgaatcttcttgagatcatcttctcctattggttgcaggcatttaaggataggttcaatcccaagccatcgtctagagcaacccaacttaaaggtgtgacctttgtaaaaatggggatagctgaatcgtttcctaactacgtcaagaaacatatctccaaaaaggtcaagaaggagtccaaggaggaaccacaatctgtgctagccaccaaaagaaaagacccacctccaccttttgaacctaaaccccccacctcatctaagaaacagaagaaacaactaccttctaaccctaaaaagagaagaccttcagactctagatcagattttgaattattttctaaaccaaaaaccaaaaagccaaccataaggattaagccttatcaacctcaacctcaatctgttatatcctcacctcctaagcctcaagaatcttctattatgattcttgaatctccccaaaccaaaccagcctcaccatcgtctgaggttgagatcaaaaaggcagccatgcttcagtctgatattgaagcctcattcaatgagaataaatatgatgtgattaagactgatcacggtgctcttagagttcatcctttttcttcaactgagtctgtacctttcgatgctatgaagttcaaacttgagataaagaagagaacaaaacccaaacctcagactcaaccagatataaccattgaacctgacaccaaagtcagattatttcatggttctagagttatggagtgccaaacatgcaataaggcatggaaggagaaaatgggtattggttctcatattctagatccacagatgcagaagctagaacttcagatgctgaatttggtcatagtatcatga

SEQ ID NO: 89548 - DNA, 1280 bp, Glycine max
  Peptide Sequence Number=SeqID_206326
gcgctgttgatcgccagcccgcttaccgccgccggaggcagggtatcgacgttcaccgtcgccgtgatgttgccggtgctgacgttacccgccgcatcggtcaccgtggtgctcagcgtgtgcgcgccgttcgccagcgtggcggtggtgaagctccagctgccatcactccccgcggtcacagaaccaatggcgctggtaccgtcgtagatggtgaccacggcacccgcttccgtggtgccgcgcagcgttggcgtggtatcgcgcgtaaaggcgccgttcgccagcgtcaccggcgtaccgctgatgtcatcaatgatggtcagcgtactggcgaccggcaccacggtgtcgacgatcagcgtggtcgacacctgcgggctgacgttgcccgccgggtcggtctgcgtcacgttcagcgtgtggctgccgttgctcagcgcgttacctaccacgaagctccagctgccgttgctgcccaccgtggtggtgcccagaaatgtggtgccgtcgtacaccgtgatgcgcgcgcccgcctcgccattgccgctcagcagcggcgtgctgtcgttggtgacgccattattcggaatggtcaccgccgtgctgccgttgttgttgagcgccagcagattggtgatggccgccggtgccgtggtatcgatgatcaccgtggccgcggtggtaccgctgacgttacctgcggcatccgttaccgtcaccgtgatcgggtgcggcccgacgctcagcgctgccagtggcgtgaagctccagctgccgtccgcctgcacaatcgccgtgcccagtgccagaccgttgtccagaatggtgacgcgtgccccggcctccgctgcgctgacgctgccgcgcagcgttggcgtggtgtcgttggtcgcgccgccgttgacgatggtggcaccggtcgcatcattaataatggtgagactggtgttcgctggcgccaccgtatccacggtgaggttaatcacctcagagcggggactgacgttgcccgcgctgtcggtcaccgtcacgctcagcgcatgggcggcattgctcagcgtcggcgagacgaagctccagctgccgctggcgttagcctgcaccgttccgagcagcgcgttgccatcgtaaaccgtgacaatcgcgttcgcttccgtcgtgccctcgtcagtccggttgccgccatcggcggcgcggtgtcgacggtcagcgcaagggacgctgcgggaaccgtaattgccggccgcatcggtggccgtcacgctgaaagagtgtaa

SEQ ID NO: 89549 - DNA, 1509 bp, Glycine max
  Peptide Sequence Number=SeqID_206327
atgggaggagcattcatgatcctcctttcccttcccttctccctcatcttcctcctcatcctcttctacataaccctccccgcaacaacggggcgagggaagaaaatctctggccccgctggtccggcaacctatcccctcataggttgcctgatatccttctacaggaacaggtaccgtttgttggattggtacactgagctactagctcagtccccaaccaacaccatagtggttcaaaggcttggtgcacgtagaaccattgtgacaacaaacccacaaaatgttgagtacatgctcaagacaaacttcaacaacttccccaaagggaagcccttcaccgagatccttggcgatttcctcggccaagggatcttcaacgtggatggagagtcgtggctcgccagtcggaggctggcaagccacgagttctccaccaagtccctgagggagtttgtcatgcacacgttggagaaagaagtgtgtgagaggcttgtgccagtgcttgatgaggcactgtgtggtgagaacaaggtggttgacttgcaagagctgctaaggagattctcattcaatgtgatctgcaagttcacattggggactaataattataataggtgctgtttggacccttctgttcctacttgtccccttgcaagggcttttgatgtggctgcagaggtgtctgctaaacgtggagcagcacccttgttcatgatctggagggtgaagagatggttttgtgctggatctgagagattgcttaagattgctgttggggaagttcagactcatgtcatgagaatgattcaagagaggaagcaaaagggtgagataaactattatgaagatgatctcttgtcaaggcttatatgtgcaggtcatgaagaggaggtgattagagacatggtgataagtttcatcatggcaggaagggacactacttcagcagctatgacatggttcttttgggttctatcacattattcccatttggaggacaagatagtggaggaggcaaaaggggtgttggattatgagtcactaaagaatttgagtttcttgaaggcatgtttgtgtgagtccatgaggctgtatccaccagtggcgtgggactctaagcatgccactgatgatgatctgttgccagatggcactgtggtcaaagcaggagatagggtcacatattttccctatggaatggggagaatggaagacttgtgggggaaggattggtttgaatttagaccaaatcgatggtttgtggaaccaagaaacagtgaaggaatagtgttgaatgaggtttctccttttttgtttccaatttttcaggctggtccaagggtgtgtctaggcaaggaaatggccttcattcaaatgaagtatgtggtggcttcaattcttagccgattcacatttaaaattgttagtccagataggcctatattcgtgccactgctcacggcacacatggctggcggcttaagagtaatgatttatagacagtga

SEQ ID NO: 89550 - DNA, 1200 bp, Glycine max
  Peptide Sequence Number=SeqID_206328
atgtctatgaacaacaacaacaacagcaacccccatggaccctcttcctccgggccagtaccctctttcccaggcccacgggctcacactcaacccgaacgccaaacgtttccctccaaaacccccaattcacacctccaaacggaacccgctcccaccgccaccgccgccgccgcaaccgctcgaaggaagaagcataaaccaaatgagagacagcttcgtgagaaagccttagcaattcttccagaatcggagatttacacgcagcttctcgacgtagaagcgcgtgtggacgctgcacttgctagaaagaaggttgacatacaggaagcattgaaaaacccaccccgcattcagaaaaccctgagaatcttggtgttcaacacgttctctaaccagaacaatgcggattcttccgctcccacaatgggaggggctgttgctgcccagaggatgccccctttgtgtccgaaattctgttcctcggtggctcatgaaggttttgaggtgaagaggaagggggatagagagttcccggcgcagattcggctggagatgaattatgtgccacctgcgttgagagaggtgcttggggttcaggttgatacgcggtcaaggattgtttccgccatctggtattatgtgaaggcgaggaagtcgcaaaacctgaatgatccttcattctttcaatgtgatcaggccctgcagagggtgtttggggaggataaggtgaagttcacgatggttttgcagaagatttcgcagcatttgtttccttctcaggttatacttttggagcatatgatcaagctctcggggaatagtccggttgggtctgcttgttatgatgtgatggtggatattccttttcctattcagagggaattgaatgctttggtgcccaatgttgaaaggaccaaagagaatgatgtgtgcgatgagtccatatgcggaatcattagaaaaatacatgagcaccacaggaggcgagcgttcttggttggttttagtcaatcttctctggaatttattaaggcattggtcgaatctcaaaacaaggatctgaaagttttacttggagaatctggtcaaaatgctgaaaaggaccgtaaatcagatttttttaagcaaccatgggttgaggatgctattgtgtgctatttgaatcgcaaaccagctgcaggaagtgttgtaaaataa

SEQ ID NO: 89551 - DNA, 225 bp, Glycine max
  Peptide Sequence Number=SeqID_206329
atgcagagtaggtacaatgaaagcacaacacagaaagtgcaggatgcaaaggatgagatttcgactacctcgcttagcgcaagtcactcactaagcgagcactcaatgacttttgagttttcagaattcaaactcacgtgcttagcgagcagactcgctcaacccaattcaaaaattataaaatctagagaaggatttgggcttagcatgaaggatcacgcttag

SEQ ID NO: 89552 - DNA, 288 bp, Glycine max
  Peptide Sequence Number=SeqID_206330
atggcttgcatctgtgcatcacctttcctttcctctatccaatctctcgttagctgttacaaccctagcacaactcttctcccatgtctctctcgtctcatctcaacagtacaatgtcactcctttcccttgcctctcttgtctcagcttgacactgctacattgctcttacctctcagtcttagcctctctaccctctcacgaattaatgaagcattgggcttgaatctagaattgggcttgagcttgaatccagaattgggtttggacttgaagagggcagactaa

SEQ ID NO: 89553 - DNA, 375 bp, Glycine max
  Peptide Sequence Number=SeqID_206331
atggctgaagtagcaaaacttgtcaacaatgctgacgcttccaaccccacgccaccaactgcaacctttgccaagtcgctgcctaacatctcaaaaattgaggtcttcactgttgtcttcgctctttctactcccaaacctaatttcagtgatgatgccagtcaacttcaacaatgggttcaagccaataaggacgtggtcagacagagatttatcattgccaactactactgttggaccatgaacaaagaaaaagacatcaaggtacaaatcagtgaataccacaagctactggaagacctaaagattgaaaacatctctatgcctgacgagttcgattctgaactcctgattgagaagctaccaaagtcctag

SEQ ID NO: 89554 - DNA, 321 bp, Glycine max
  Peptide Sequence Number=SeqID_206332
atgtgtcgcgctaagcggatgacctccaggaagagagaagccatagcttcccaacctcgggaaccatatgacaccacccgtttcatttccgaggtcgcttgggagcgatattcacagaaggttcacttccggaacatcctttcggagaggaacattaacctctttgtgacaaaatatgatgaatttagaagagagctgatcagaagaaactggcacaaggccttgacccaacacatggacaggcacattgatatgggcctggtcaaggagttctactcgaacttgtatgaccatgaagacaaatcaccaaaacaaatttga

SEQ ID NO: 89555 - DNA, 192 bp, Glycine max
  Peptide Sequence Number=SeqID_206333
atggtggctcaatccaaattcgccaaggtttcacgtccacagaaagtaaacattgatatgaccgaaggtgctatcaacatcatcatagttcctacccatgaaatgatcactatgagacaagtgaagacagttgctatgcctattcagacgcacctaccgtccaaacccatgtttgtttgtgtagatagataa

SEQ ID NO: 89556 - DNA, 183 bp, Glycine max
  Peptide Sequence Number=SeqID_206334
atggagaagagattgaagcctccacttgtactgtcttcatgcgattcctttttctccctccaagaatattatctcgcaaatcccaacggtaaaggaaaaggctataatgagaaaggtatttctctcaactcaaacatgatatcaaaattcccaacggtgcaaatgctcggaattgggctgtga

SEQ ID NO: 89557 - DNA, 237 bp, Glycine max
  Peptide Sequence Number=SeqID_206335
atggaagagagtgtgctgtgcggattatgtgaggcagccgaagaagtggtaggcggcaggaagctaaatacgaagtggacacagagaagagggacagggtttaagaccatgtctgatacaatcctccctaggaagggaccagtcactagagtcatgagcaagaggctccaagaggattgggctagagctgttgaagaaggccctagggttctcatgaaccttggggtagatttctga

SEQ ID NO: 89558 - DNA, 1011 bp, Glycine max
  Peptide Sequence Number=SeqID_206336
atgccaagaatgtggttgacgaactccaaccttagcaaggtgggcagtttgtttgtgtcgaggaggtaccaagtcgaattggttgacaacatagttgagatgcttcagcccgtcattaggatcgacccaaaggaagggctaaagccagagccacatggaccatatgtagagccacaactagtgggcattcttggacatctatttggaggaggtccagttgatgtccttgctttgaccttacagggaccattgtgttggtcatgtatggatctaccatgtgcggtcagagctgaagcttgtcagccatggtgcccagggcttcttgaatgcccttgtggagaagtgacactaggagacgtccttcttccacctgcttgtcagagagatgagagactttgtgaagattttgctgatgacccgccatggcatattgatagaggaaggactatggtgttgaccaccgcaggtgctagggtgaggttgacgtggatgacagagctatatcactgctacattgagtcaatctcgtgtgtgtgggatgccatggcttatcttatgcacatgcacttggtctatggtacgatatttatcgacaagtcttcgatccacgtccatcttgcctacctcctttacctcgacaacctggatgcttgccacgagtatacatgggcagtcgctgttggaggttatatggcaatactcatgtgtgggaccggtgctctggatgaccttgtagccagcagatggaagccaaccaaaggttctagctttgcctttccaatcagggagaagctggataagctgcagatggatgctgttgttgatgtgtggccttatcttttggagagggtgctaagacaatttggccatcatgtcattcctctcgacgatgtcgtgccacctaggggtcctaccaggttgagactactcttgctagctgggtgtagcctaaaggggcaaaggaagagggaaaccaaggttgccaagggtggcaaaggtagaggcaaatga

SEQ ID NO: 89559 - DNA, 1089 bp, Glycine max
  Peptide Sequence Number=SeqID_206337
atggatacattcgagagtctggtgagaagacttgctttctccctcggcaatcaagccttatctaggctattgcttcagaggggatgctccgtaggtctgaccgtggccattgttgtgcttttcttcactgccgaggccgcacccggtcttggaaatcaaatagcggcgtcgtctggagcggaaaatcgggtgagtagttggcatcaatatctaacctcaaatatggaaggggagtccgccaacgaaccatccacctcatcctcgtggatgggtgcccttctatcttcggaaacagaaatggggggcacgggcacgtccgtcaatgacagagttgcatggcctgtgcctctcgctaatccagtcgcttccggggaggctgaagccggtcaatctcatgtcgtgccctttccatatgatgagaatgaggtgattggtggggattatgtactttccatacagaggagactgttagccaaatacgagtttccttctgcggaagaaataaaaataaccaagataaaggcggaagatcttttcgaggtcaaggtggatatcatccggcaaatgacaccccaggaccccgaagaagattggctgaaccgtggagcgcgggccctggacaatccccgcgcggcctcaggagagacgtcgctccgtattgagattgaattgaacgtaggactgggacacacctctatgtgccctggccgggcgaaccggtttttggcgccaaaaagtgagggagaaagagatctcgttagtcctggtattgtagctgtgggttgtcgtcggcccgacggacttggggagggagggaaagttgactatggttggaagaagacaggcggggatgagccgaacgagagcgaggctacttacgcgaaccaagctgcgaaaaagacttattgggtagccttccatgccaagccagcacatggaccggattggtactcgaattcctcggaccaagaggcttggactatgagcccgcttagcaaacgggggatgcggagtcctggagacaggacggacgtgcttgatcctagcagttcccacatgggtcccatggcggagggcctgacaaaatag

SEQ ID NO: 89560 - DNA, 354 bp, Glycine max
  Peptide Sequence Number=SeqID_206338
atggatcgaacctggatgaaagcatcacacataagtgacgtatacgagaatggggttgaagaattcttgcaatttgtgcaacaaaatacaccagtaatgggtggaaagtatttctgtccatgtgtgaaatacacgacaacactcccccacactcaggtcatcgatgtacacatcaaagatcgtataaaagacatgatacccgatcttggacaagagggttttcgccaagcaaatgcaccttattatgataatttacaaagtgattctaagaagccattgtattcgggatgcacaacctttacacgattatcggcggtgttagctttggtgatcttgaaggcaggatttggctag

SEQ ID NO: 89561 - DNA, 333 bp, Glycine max
  Peptide Sequence Number=SeqID_206339
atgacaaaggaacacgacggcagagcggcatgggagatggcagggtgggttgcaattaacgaagggcacgatctcagtcatggtatgggcatggtcgggttatcggagctgattaaaagttccatccattgggatagaccgaagcgtgtccatgaggaaatcatgaagaggcttcaataccctttgattcacaaagttacctatggcgactatctcttaccagcgccagcctcggtagattgcgatagtctaccaggggagcctgagtcaatagactcactgaagtgtttagacccgaaagagagtggatggtactctcagcggtctttgtag

SEQ ID NO: 89562 - DNA, 186 bp, Glycine max
  Peptide Sequence Number=SeqID_206340
atgcgcaaatgtcctacatgtggggtatcacactacaaagtgaaggatgatgcctgtagtgacaatgcaaccacaaacaacgaccgtccagcaaagttggtagaaaaaggtgatggatcgcttcgacatgccgtcgattctccccaatggaagacaattaattgtttgtatccagaatttacatag

SEQ ID NO: 89563 - DNA, 489 bp, Glycine max
  Peptide Sequence Number=SeqID_206341
atggggaaaaaaggaagttggttttctgcagtgaagaaagttttcagttcagattccaaaaaagacaagaaaaaacagaaaagcgacaagtcaaagaaagcaagcagtgacaaggatgcagaagcagctgttgttcttccaccaatagaagatgccaaattaattgaggcagagaaggaacagagcaaacatgctgcttctttggcttttgccactgctgttgctgcagaggctgctgttgccgctgctcaggctgctgccgaggttgttcgtctcacaagtatgccacattacactggaaggactaaggaagaaattgcagccatcaaggttcagactgcattccgtggatatatgtcacaaatggttctatattgcagttcgcatctgcaattgcaaccgcaatgtagaggtttttggacttgttgcaagtgcattgcaactgcaattgcgtctgcatcagccgcatctccccgtaatttcccataa

SEQ ID NO: 89564 - DNA, 423 bp, Glycine max
  Peptide Sequence Number=SeqID_206342
atgacccccaccgcaaccaccaccatgatcgtcaatcgatgtcaccatgaccaccgtcgtcatcaccaacatgacttttattgtcattaccaccatcaccatcatggttgtcgtgacggtagcaaaggtgatcatgttggtggcgataatgatagttacgacgtcgatcacggtggtggtagtgatacattacctaaagaggcaaccttggaaaaaagtccacaaatccgagacccactaagatattccaccattcggctagccgagtaccctttggagaaaaagaaagatcattcaaaggatacaaacaaggaagaaatttacctacctaccccttggcagatgccccatagtagcgcaatcaaacaaaacatagcagattttacgtatcacgattttgccaaccatgagcgacataaataa

SEQ ID NO: 89565 - DNA, 243 bp, Glycine max
  Peptide Sequence Number=SeqID_206343
atggacaactggagaagaatccataatatagtatataatccaaaaaggagaaagaaaggaaactatgaaacacagtacaaaacttccaattttgaaggccaaacaacaacaacaaaaatggacaaagtgcaagagaatgaggacccaaatgaagtgggaaaaacattccgagacctttgcatgagaatcccagaatcctgcaaatcaaattcaaaggtacacttacttggtgtggcagagtaa

SEQ ID NO: 89566 - DNA, 501 bp, Glycine max
  Peptide Sequence Number=SeqID_206344
atgaataggaagataaaaaaaaaagaaaaactgcaacaccttcatgtcactatcgtcacgttgaaaccaccacaatgccaccactactccaccttgttgtcatggccgcaactcaaatctgtaatagatcctagttgtgttgaagctcgcaccacctttgttccaccgcaacacctccatgttgctaccatagccattgaaaccaccatggtgccaccaccactttgccttgccggggtgggtagggtgcagttctgttacagatttgagtcgtggcgaagctccctatacttatgtcgtcacgactcttgcttgggtccacaaaacttgacaactatgggcatcgttggaggaaacatggaggcggggaagggagcaaagagaggcagagaagaagatgaagagatgtggaggcagggagagaggctcgaggaagattatgtattgttatatataatctacaactacgctaacaaaaaaaatatatcgaagcacatgtaa

SEQ ID NO: 89567 - DNA, 207 bp, Glycine max
  Peptide Sequence Number=SeqID_206345
atgccaaaagatagggggacttatcttgatttcaggtattgtcatcatcaaaaagggggagattgtagacaaaggatcaagctgaaagttttgatgatgccaaaggattacatgaatcatatgcttctcaaagatttactcaagacaaagccattagagatattcaagatggataatcaagacagtcttagaaaggatattaaatag

SEQ ID NO: 89568 - DNA, 498 bp, Glycine max
  Peptide Sequence Number=SeqID_206346
atgaggtctgacacactgactagtagtagaggaaggagttcatttgtgttaattggttgtgaaaggaatggtcaatataggtgtaggaagaaagattttgttagaagagatacttggagtaggaaatatgggtgccccttcaagcttcatgggaaaccagtgattggagggcaaagttggatggtgaagttgatgtgtgggattcataatcacgaattggccaagtcattagttagacatccatacgctgggcgattgactaaggatgaaaagacaattattgctgatatggccaggtcaatggtgaaaccaagaaacattctgctaacgttgaaggagcacaatgccaatagttatacaacaatcaaacaaatatacaatgcaagaagtgcatatcgttcttccattagaggaagtgatactgaaatgaaacatcaaatgaagcttcttgaaggagatcaatatattcattggcatagattaaaggatgaagatgtg

SEQ ID NO: 89569 - DNA, 219 bp, Glycine max
  Peptide Sequence Number=SeqID_206347
atggtagcaataccccctgccagggttcctcaacctccatttttccaaggatacgacttgaatgcaacatgtgcatatcatgaaggagttccagcacattccattaagcactgtataaccttgaagtccattggtttgtttgcccaagcgacctgcgctcctgagtttggacttccaagaccgttcaatcagaaattactcgtgctacacatttggtga

SEQ ID NO: 89570 - DNA, 111 bp, Glycine max
  Peptide Sequence Number=SeqID_206348
atggcgctaagtgcgacgtcgaggggctttagcattgaaagatgtattgtctccttagaacttgatagagcaggattaggttaccgtatgtctggacacggagtgcagtaa

SEQ ID NO: 89571 - DNA, 291 bp, Glycine max
  Peptide Sequence Number=SeqID_206349
atgacatatattcaagttgttggcttgagtctacatggtaagggtaatttttctttgaatggcttgggatgcgacacacagaacatcactttggtcgacctggttctcggatatctatttcggtgtgaatacgagatgagacagatgttgcaagctgggttttcagatgttgcaaagctcaaacaagctaaaatcgatgattctttagttactactttggttgaaaggtggagacctgagtcacacatgtgttgtttccccaaagaatgcactggtggcgtcaacacttaa

SEQ ID NO: 89572 - DNA, 699 bp, Glycine max
  Peptide Sequence Number=SeqID_206350
gcgacaccatttcttgctggccttgctgtagctgctgcagcacttgctagcaagtatggcatccaagcttggcaagcattcaagacacaacccccaaaacccagattgcgcaagttctgcgatggtggtttccaacctacaatgacaaggagagaagcagctctaatattaggcgtcaggaattttggatcttccttcttggggataagacaacttgagtgtctctacatccagagagacatacttaacaaggtccaagtgaagaaggatgaaggcccagaggcagaggcactacttagacatggcaacggggaggagcagggaggggtattgtctccccagtccccgaccccgacttcccaacatatactcgtacctgtctccgatacccgacggaacttccctctgggttcctcgctgaaccaatctcgggcttatcaagataatccttatggtgtctaccctgacttatcttccctctctggaagtggcgttatccaaaactttgtaacttgtatcaagcgatccgctcctagtaaggatcacatcaagagggaaaatgcaactgctgacaaggtgaaggaagcacatagaagggttatggttgcaaaccatctgggtggaagtcttgcttccaaaataaacaaagccaaaaaggttatggttgggaagggaaagggaagtggatctgcattttaa

SEQ ID NO: 89573 - DNA, 2325 bp, Glycine max
  Peptide Sequence Number=SeqID_206351
atgatgcttcaatcatggccttttatgagccttgtttttgttttacttttgcacagtttgtcaataacaccatattgtcattgccaaaccagcaattctcctcctcaaaacattgaaactttctatccaaatggaacttcagcaacacaacaacctttgccgccaccaccacagccacaacaaccaccgccacttccaaccgctaacgtagcacctagccacggttcattgaaccataacatagcgaccgcggtggctgcaactgcggccagcaccatagttgtttgtggtttaattttctttttggttcaaaggtgcttgaggaagagaaggagaaggagagaggagacaagaagtaacactgcaactgctgatggagatacccgagttgtgcctcagggaaatgtgtttgagagaattgatgggaatgtgagggggttgatcgttgatgaggatggtttggatgtgatttattggagaaagcttgaagggaagaactctaacaaggatcttctacataaggaggttgtgagtagtcctagaaacaaagaaaaagcagaacatggtcatgatgaaaatcaagtgaagaaatccaagtccatccaagtggttcctctgcttagaggaaaatcttcaacttctcacttgaatgtatctccagaagaggatgagccatatagattttcgccgcttccatctcctactccttcaagtcttcctgcatcagctgggattgttatcaaggatgttcagaaaccagattctccaactcaaccatcaactccaccccctccaatttcaccctcaactccatcatcctctgcttcttttgcagcaattccgaaaaggaatactcctgcaccgtcgcctccccctctcccaatctcagttagaaggagtccagcaccacctcctcctcctccagcatcatcaaaaccaccacctgctccaattgaaatgacagctattaagcaaagaaactcttcagggaaaggcatgccagaaaccagcaatgatcaagtgaagctgaagcctttgcattgggataaggtgaatagtaataatgctgatcactccatagtttgggacaaagtcgatcgtggctctttcagggttgatcaagatcttatggaagctctctttggttatgtcgcaaccaaccgaagatctcccaaaggaaagagtcactcagccattcccagcaaggatggctcagcttcttcagcaaaaacatttcttcttgaccctagaaaatcacagaacattgctattgttttgaaatctcttgcagtctcacaaggcgaaattcttgatacactcattgatggtaagggcctcaatgcagatacccttgaaaagcttgctagagtttccccaacagaagaagagcaatctcttatccttcaatacaaaggagacccagcaagacttccagcagctgaatcattcctctatagcatccttaaagctgttccctcggctttcaagcgcttgaatgccatgctattcaggttgaactatgactcagagattcaagaaatcaaggaatctctgcagaccattgaactggggtgtaacgagcttaaaagcaaaggactctttgtgaagcttcttgaagcagtgcttaaggcaggaaatcgaatgaatgcaggaactgcaagaggtaatgctcaagcttttttcaatttggcttctctaaggaagctctctgatgtcaagaccaccaatggaagaacgacattacttcactttggggttgaagaggtagtccgtttggagggaaaacgggtttctcttaaccgcaatggcagcctgagcagtagcagcagtaggagcaacagcaacagcaatggaaactatgagaacaacattgcttcaaatgaactgatagaaagggaatatgtaacattaggattgccaattgtaggagggatcaattctgagttatccaatgttaagaaagcagcacaaatagattataacaatttagttggttcaatctcggccctctcaacctggttagttgaaattcgagaacttgcttccttgtgtggaaatggaggaaattttgtgaaagaaatggatcattttctgggaaatgcagaggatgagttgaaattagtgagggacaagcaaacaagtgtgtttcagctcatcaagaaaacaacacaatactatcaaggaggagcctcaaaagagactgcagaagacaatcttcaattgtttgtcatagtgaaggatttcctgggaatggttgatcaaacttgcactgagattgcacgtgagcatcagaagaggaaacctcccaaggcaatttttgggtag

SEQ ID NO: 89574 - DNA, 246 bp, Glycine max
  Peptide Sequence Number=SeqID_206352
atgtacaacacaacaggaggcatatgggtcagcctattttggaataaaaagatacttccggacgcgacttcaatcccaagccaggatcaaatcccaaccttggttaaaggatcaagtgtcaaaccactcgtacaagcaactttttattttacattaaattttcatggttacattggagacacctcatggaggtgtggtatagcgaatgatcaaacttccgacatcaacatatcacttaaatcgtaa

SEQ ID NO: 89575 - DNA, 186 bp, Glycine max
  Peptide Sequence Number=SeqID_206353
atggcaatggcatgtcgaggagctcctctggtgttggaaggggaaggctcgtgcccacttgcaactgcaagtagctcattgttatgccaacaacacacacaaccaaacatgatgggagacgattttggggatgtcctcattggtgaatgtcatttggatgacattaatgtggaacataagaggtag

SEQ ID NO: 89576 - DNA, 978 bp, Glycine max
  Peptide Sequence Number=SeqID_206354
atggcttctcatattgttggatacccccgcatgggccccaagagagagctgaagtttgcattggagtcattctgggatggaaagagcagtgccgatgatttgaagaaggtggcttctgatctcagggcgtccatttggaagcagatgattgatgctgggatcaagtacatccccagcaacactttctcatactacgatcaggtgcttgatactaccgccatgcttggcgccgttccacccagatatggatggaacggcgaagagataggatttgatacctttttctccatggccagaggtaatgcatctgtgcctgccatggagatgaccaagtggtttgacaccaactaccactttattgtccccgagttgggacctgatgtgaatttcagttatgcttcccacaaggcagtgaatgagtacaaggaagccaaggcgcttggagtagatacagttccagtcctcattggccctgtatcatacttggtgctctccaaacctgccaagggtgttgataagtcgttttgtcttctttctctcctcccaaaagtccttgctatctataaggaagttgtggctgatcttaagcaagctggtgcttcgtggattcaatttgacgaacctatccttgtcttggaccttggctctcaaacgttgcaagcacttactgcagcatacgcagaacttgaatctactctatcgggtttaaatgttcttattgagacctactttgctgacattcctgcggaggcataccagaccctcacagctcttaatggagttgcagcatttggatttgatttagtccgtggaactaagactcttgatctaatcaagggtggatttcccagtggaaaatacttgtttgctggcgtggtggatggaaggaacatctgggctaataatctcactgcttctcttgatacattaaatagtcttgagggaattgtgggaaaaggtacttgttgcaattcatga

SEQ ID NO: 89577 - DNA, 663 bp, Glycine max
  Peptide Sequence Number=SeqID_206355
atggagacctgtgctgaggcattggacaattatgtggaacttttgaagaaaaccaacaatcaccagaaatcatgggtccagctgtgttcattgtatttctgtgtatttgagataggcatcaatcttgaagaaaatgcagaaatacaacagttagctcttgtcttctctattaaacaagcaagatggagacgaaactggcagcagagaagtaaagttatacctagccttcatcagtatgtatactactgtctattggttttgcttcttgaggaagacattagatttgtcttgggagtggtggattggaagaagaattttttgtgccttttaagtaccaccgagcgcataaatcaactggcatggggtagttctagcttaacgagaggtctcaaattcgagttttgggtagatggcatggatgctcttgctgtgaaacaagcttgtaaatttgcaaaggagtttgctttaaagaatggtcccattattctcgagatggacacatacagataccatggccactccatgtctgatcctggcagcacataccgtacacgtgatgagatttctggtgtaagacaggagcgtgatccaattgagagagtaagaaagctactattgactcacgagattgctactgaaaaggagctaaaggtgattgaatga

SEQ ID NO: 89578 - DNA, 414 bp, Glycine max
  Peptide Sequence Number=SeqID_206356
atgcccttggccaaggaatcggagttccacaaatgcagaccaagacaaataatttttactaccactcagctttttgaggttatgacaggaggagcagtgcaaaccaagacatcaaactcgcacaaacagaaccttcacaaaaggttccaacttgagaacccaacactactgatgagagataatgaagatccaggaccaaatctaggtctagggagagggcggtgcgtggacttcatgtgccaaacaaagggctctggacaagcggtgcgtggagggctttttgactacgcgacttccagggttaggtcatgctcactgaggtgcaccaaacccctgggtttgttggatattttgccagggggtggtggcggtgtatggtggcagcggacggtggcgtcagtgataatcaagtag

SEQ ID NO: 89579 - DNA, 1914 bp, Glycine max
  Peptide Sequence Number=SeqID_206357
atgctgttaacttggcttcagtcaactctgtcaaaatctgttctttctcatgttcttggttcgactcattcgtataaagtgtggaacaatgttcatgagtattttcagctgcagacgaagaacattgccaacgaacttgctggtgttggtaatccagtgcagcatgaagagtatgttgatgcaattctggctagtctacctcaagattatgcgcaggtgattgctgtgattgaagtggttcaaatgctggttatgctcgcggcagtggcagtcgcggtggttacgccgatcctggtggcgtcagcggtggtcgtcgtggaggcggatccgacaaagatcgtggagtatggtcacactgctaacatttgctattacagatctgacaattatcaacctcatgagtcactggttctgtatgatcctaccacacagcaaccagtgcaattcaattcgcctcaatctaacaacagaaccactaacacctgggttaatcctaacttaaagtcctctaagcaaagtgctaatgctagttcagctattcctggtgctatgctagctaatacttcttttcaacgtgctgctaattccacatggattctagattctggtgcatcttatcatggcactggtgaacctcagaatattgatcaactaagtcattttgatggtcaggatcagattacattggtaacggccaaggggaccaatgagattcttcttcaaggtgttgttggtgctgatggtctctattcattcccaaatttaaagcttcaagatccttcagtgttggtgtcttcctcagctgaatcaacttcagattctgctgttcattcctctagttcaagtcccatgttcaattctaattctactagttcagcatctaaacccattcctgatgatcctactttgtataggtctgtagttggagctttacaatatgctacattaactagacctgaaataagttttgttgtgaacaaggtttgccagttcgtggctaagcctttggactctcactgggtgactgtaaaaaggatcctaaggtaccttaaaggcactctatttcattgtcttcatatgagacctgctactgctggacaatctttgacactaacagctatgtgtgatgctgattgggcttctgatatcaatgatagaaggtccacatcaggctcttggtggtcaaggaaacatgctgtagccattgctcgcaatccagtcttccatagtcgcaccaaacacatggagattgatgtcttttttgtgcaggagaaacttctgtctaagcagcttctgatataccacattccagatctggatcaatgggcggaggtgctgaccaagcctctctctcctgccagatttgagtttcttagaggcaaactcaatgtgaaaatcgtaagtgctgctatgtgggtgattttgctcctgcactctatcatgaacctctttgagctcatcactaatggaaacctcatcaataacctgacaacagcatttcgcacacagcttttggaactcatccaccacgtcacgtgtgactgttatgctcatggcttgggagagtgctttgaagaaaatgttcttgatagagagcaagagaagaaacgctcacatagaaacacttacaatctaatccttagccttctacaagcggacaaaatagtgaatgtgcttgagaaatccgaggtggaggttgaagaggtcaaattggaagttgtgaaccttagcagagcaacctttaagcatctggagacctacagaaaagaccttgtggaacaagcatgtattaacattgttgttggaagagactctaaagttcgaagggttggcatgtggaggatccgaaaagacgatgttcctagggatcttcgtatggtgaggctctttgaattggacaatggagccccctag

SEQ ID NO: 89580 - DNA, 366 bp, Glycine max
  Peptide Sequence Number=SeqID_206358
atgtttttaggtggattgaaagctgaaagcaagcttatgcttgatgcttcaactggtaggaagacctctctcaagcctccaagggaggctatagagatcactgagaacatggatgtcaatgctaatgagtttcaaagtgatagagccatggttccatcaaagagacttcttaaattcaacacccaagaaggtctcttagcccaacaaaagttgcccgataggaaaattgaaaagcttctcgctaagccaatctaccggcttagggagtcatccgctgagcgcaccactcttgcggctgagcgcgaggaagaatctggaagaaggatgagctgtacatgtgcgctaagcaagggctcatcccgctaa

SEQ ID NO: 89581 - DNA, 1716 bp, Glycine max
  Peptide Sequence Number=SeqID_206359
atgacaatcgccgattcagtttttccgatggataatgtggccagttgcatacagcttccgccggaggaggaaaaccggatcgtgtcggagttgatcaaggagtcggagcttaatttgaaagaaggcaacttatattacgttatttctaacaggtggttttcaaggtggcagagttatgttgggccttgtgttggtatgctttcaatcgacaaacaatcttctgataaccatttgataacccacccaaagattgcagatagacctgggcctattgataattctgacattatttcaaagggaaataactgtgacagcaataatttagatattcatcgaatgttggaagagggtacagactatgttttagttcctgaaaaagtgtgggaaaggctgttggaatggtacaaaggtggaccagctttaccaaggaagttaatttctcagggtcttgaacttaagcagtacaatgttgaggtttacccacttagtctaaaggtgactgatgcgcgagataacagtcagtcaattgtaaaattaagcagaaaggcgaccattggtgaacttcatgagctggtgtgcaaaattaaaggagtagaacaaaacaaggcctgtatttgggattacttcaatttgaagaaacaatcattgctgacggtctcaggccagaagacattagaggatgcaaacttgattatggaccaagatgtgggtagccttgagttgtataggtctttaattgtaattgatttcaagctgattcttctagaagtatcacttgatagagatcactcttctcattctggcatggattcaatgggaaatgaattagctttggtaccattagaacctccaaggtcatctgtgtccattgctgggggacctaccatgtcaaatggtcactcgactgggtctagttttagttcatatcagggaagttctgtaagttcatcgttgaccaatatggatgataaatatgatgtctatagaggtgagaggggtggtttggcaggactgcagaacttggggaatacctgcttcatgaacagttctattcaatgtttagtccacactccaccactttctgaatatttcttacaagattacagtgatgaaatcaacatggacaatcctttaggaatgcgtggtgagttagcacttgcatttggtgacttgttgaggaaactgtggtcttcagggcgaactgctattgcgccccgtgcattcaagagcaaattggcccgatttgctccacaattcagtggctataaccagcatgattctcagctcggtaggcatcagcaaggaaacgtactcctgcatcgccaacaccactgtagagatcttcgatcctatcttcactgtgaacgtgcgaggggtgtttgtgtgcgccaggtaggccacggaccatgtgaagcatggcagcggagggcagatcgttccagtgttgatgttgttggtggtggcactgaggcccgggtaggtgcatacatggcatcgaaggcagtaattggggtgatgacaaagatcctggcgaaggagctgaaggggacaaaggctctgtggcttttcattttaatcatggacatgccaccgcgttttcgttattttctgtttccaaacttaactgaagaaaacgttgaaaacaactcctgcgtgtttttgaaaatgggcttcattcagaaaatgttttctcataaaacattttctaaatgttaa

SEQ ID NO: 89582 - DNA, 228 bp, Glycine max
  Peptide Sequence Number=SeqID_206360
atgacatgccggaaattaaaaggaagtgctagtgcgcaatccgtaaagttccgtaacattccggaaggcaaaaaaggggatgattacgtaatccgggtgcaaatagcaaccatgcccacttgggccttccagaatattcctccagaaggcggttgcttctggaggaagcaacctagctcgcctgggcgagctgggtggcaagcttctcccctattttcctatagatag

SEQ ID NO: 89583 - DNA, 807 bp, Glycine max
  Peptide Sequence Number=SeqID_206361
atgtatactaacctgtatagtctatggatgtttgatatgaaaacagcgcaaaaaaactgtctgctccgtggtgttgtcattggagtttcctacttgttgttcgcttgtgcacaaacggctaaacccactatgagtagtgggtttcaagcggaggactggcccagttatggcttaaatatggcgtcgcaacgtttttcggagttgacgcaaattaaccagaaaacagtatctcaattacaaccggcatggtctatcgaaacaggtataaaagccacttttcaggcgaccccgattgtggtgaatggcgtcatgtatgtcagcctgcccttcaaccacgtattggctttggatgcagcgaccggtaagcagttgtggaaatatacacatgcaagaaaagctgactggccgatgtgttgtggaccagcgaatagaggggttgctgtctcagcaggcaaggtattcataggcactgtggatgccagattgattgcactggatgccaaaacaggtcaaaaactttgggatattgatgtggccggtactcaagtcaatacagaacaccaagatgcgctgaacggtgatgatcccaataaaacgcgtaaagtcacgggtggcacgggcgtaggcattgcgatggccccagtggtgtacaagaataaagtgattataggcatcactggcgttggctacggactgcatatcgacaatccccgtagcgatgcgccactcggtgcggtgattggcgtgacgggtcgttatggtcgccctgggtttttggcagcgtttgatatcaacgatggtcaccag

SEQ ID NO: 89584 - DNA, 376 bp, Glycine max
  Peptide Sequence Number=SeqID_206362
atgggctacgtgggagtacgtgagctcagttggaggtgggcaacaggggatggtgggtttatgcgcgcattgtggatgtggaaaaacttgttgtgcaccatcgcccgaccgccacctagtaccacagtggtacctggagatatgtcgcaggggtcaggagaccttggggacgtcaggcgagctcctggcagtcaacagataaaaggaacaaagaccacaaagcaaggaggcttgtggtggctggccagctgtgaattttgtgtgatatgtggattatggcctctggtaatcgattaccaagggtgggaagctaaggaagcctctggtaatcgattaccagcctgtgtaatcgattacacagaggaatgggtcactg

SEQ ID NO: 89585 - DNA, 213 bp, Glycine max
  Peptide Sequence Number=SeqID_206363
atgagaggcaccgtgcatgatcctcaagcaaacctaggggtagataagaagttcttacccggtagactccttatgattccttttgaatccaatggtggcctttgctttgggatcagcccgtgtcatcaagtttcagcgggatcaacagacccatggcatcactctatagccttaaatcaagaaagtttcacttggtcatataacaaagtgtaa

SEQ ID NO: 89586 - DNA, 203 bp, Glycine max
  Peptide Sequence Number=SeqID_206364
ccaataggaagcacaccacgttgaggccgcgacacaaggctcagctgagggtggtgcaacaggggctcctttcatggaaactagctgagggtggtttgaaaacagtgaccgaggatacgtggtgtgaaaggggttcacgaacaaactggaaaggggttcgattgagcatagtgggtgctttcgatctccaacaaagtggataa

SEQ ID NO: 89587 - DNA, 261 bp, Glycine max
  Peptide Sequence Number=SeqID_206365
atgaagatcgtaaacttaggcgttggtgaggaaaagaaagaggtaaaggttggcacgggcatgaccacacctatccgagatgaattggtggctctgctatcagactaccaagacatctttgcttggatgaagcctaagatgtccttaaagataaaagaagaggtgaaaaagaagtttgatactagctttttggctgtggttcgataccctgaatgggttgccaacattgtttcagtccccaagaaggatgggaaagtgtga

SEQ ID NO: 89588 - DNA, 1026 bp, Glycine max
  Peptide Sequence Number=SeqID_206366
atgacgatgatgagagagattcctgacgctgttaacacattaatttttacaatagcccaacatttcattggagacccatccttgtggaaagataggtctgcagaattattatcaaatcttaagtgtagaaccttagcggattttaggtggtatagagatactttcctaactagggtttacacaagagaagatagtcaacaacctttttggaaagaaaaatttttagccggtcttcccagatcattaggagacaaggttagagataaaatctgtagtcaatctgccaatggagacattccatatgaaaacttaagctatggtcaattaatttcctatgtccaaaaggtagccttaaaaatctgccaggaagacaaaattcagaggcaattagccaaagaaaaagctcaaacaaagagggatttaggttccttctgtgaacaatttggcttaccagcctgtccaaaacaaaagaagaaacaaacctctaagaaagaagcccaagatcataagccagccaatagaaaaagattttcaaaacgaagatactctcaaaaaccctcaaccaaaacctcggaggaggaaacagaaacttcatcctccgtgctttccgatgaaaacctaaacctaatccaacaagatgaccaactatcattaacaaatgatgatgggcaagtcaatactctaacgagagaacaagatctcttgtttgaagcaatcaattccatacctgacccccaggaaaagaaggttttcctggaaaaactcaagaaaacattagaggtaaaacctagacaaaaggattttatcacgaacaacaaatttgatgtaagtaacatactcaagagattagaaaattcttcaaccaaaccaacgacaatccaagatctccaaacagagataaacaatctaaaaggagaggtaaaagaacttcatcaacaacaagaaattcatcagatcattctttctcagcttgaggacgatagcgattctgaaagtgccaacaacagtgaagaaaatcaaccataa

SEQ ID NO: 89589 - DNA, 465 bp, Glycine max
  Peptide Sequence Number=SeqID_206367
atgtttgatatccggtttctgattctggttactcactcattggcttttcttatcgcttcaccacaaatccaagaagtaagtgataaggaagacttgattgatttgaatgaagattatgatcttagcctttttgtaaaaaggttcaacaagttcttgaaaatcagaggaaatcaaaggagaccaaattttaaacctaaaagaagaacagaagattcatcctctactccaaaatgctttgaatgcaatcaacctggacatatgagggttgattgctcgatctttaagaaaagaatggagaaatctgaaaagaaaaattttggtgaaaagaagatgaagaaggcctacatcacatgggatgacaatgatatggaatcatttgaggattcagaaaatgaagagataaacctgtgtctaatggctaaaagttatgaaagcgatgaagaggtatctttgaagaagaaatga

SEQ ID NO: 89590 - DNA, 1198 bp, Glycine max
  Peptide Sequence Number=SeqID_206368
atgtccggagaacaggaagcctggctgagcaattttacagataatcccatcgaatggttttcggcattcaacgtaaaattctctaaaggatattataagcatattccccatatgatcagctacctgcagaaggaaatcgagaagaatcctaatcagaaagaaagattggagagacttatagctgaactgaaggaagatcaggtaaagtaccatcctgataactatgcaaaattatcccaaaaagaaaaaaaccttcatgaaaaagcatttaccaataattcaggagaccctgatttctggaatctggaaacaggaaatgatgaatatggagaaaaactagtagttcctaaaggagatgtattatttcagttccgcaaggatgttgaagagaaaaagcttcctttggtttcatggctggttgctccggaacacttttcggaccatccgggatcaccttggtatggggcatggtatatttctgaagttctaaatatcttgacgaaggatcctgaaacctggaaaaaaaccatttttataatcaattatgatgaaaatgacggttattttgatcatgttttaccgttttctccgccactaaatccaagtcagccggtagacatgaatggaaaagaaggggtagaatatgttaataaagatcaggaatatatgctgtcatctcaattgagagattatgaacgtattgaaggaacagttggacttggttacagggttccgatgatcattgcttccccatggacaaaaggaggttttgtaaattctgaggtttcagatcatacttctgtattacagtttcttgagaaattcatcaggaaaaaattcagtaaagatgttaccatagacaatatcagtgactggagacgagccatttgtggagatttgacttctgcttttaatgattcaaatgtgacggtcccaaaaatggattacctgaatcaaaaagaatataccaaaaccattaatgcagccaagaataagcctgttcctgatctgaaatggcattctgaacatgagctatctcatgcattactggaaattcaggagagagggataaagccatccaatgcactcccttacaattaccatgttaatctcacagataacagtattaaaatggagaacctaaaggagacaggagttccattattaatctacgacagaacaaagctagatgatcatg

SEQ ID NO: 89591 - DNA, 791 bp, Glycine max
  Peptide Sequence Number=SeqID_206369
gtttgccgtgctggatggcgctgacgcggcgcgcgctgaaactgttgccgtcgcgcagggtttccacgtcgtaaacgataggcttgctgctgtcgcctgggcgcaggaagtaactgtggaacgaatgcacgctgcgttcgtccggcaccgtctgtttggctgcgtacagcgcctggccgaccacttgtccgccgaacacctggcgcagccccagatcttcactctggccgcggaacagcccttcttcgattttctccagatccagcagatcgaggagtgtgcggaatatcacggcgcggcgtcaacattttgcgttaaagggccgatgagaatgctcttaatcgtggacgccttgggagaccgatccatgaaactctggcaaatcgtaggcggtgccgcggcactgacgatcacgctggcgggatgcgcgcaaaagagtgctgatgtgcctacccaggcggccggtaacccggcggctgcgcaaacgcagattcagggcccggcggtgacaggttcggttaatatacgtcagcgcattgcgctgccgccggacgccgtactgacggtcaccctctctgatgcctcgctggcagatgcgccgtccaaagtgattgcacagcgcgcggtacgtactgaagggcagcaggcgccattcagctttacgctgccgtacaacccgtccgacatccaaccgaatgcgcgtatcattctgagcgcggcggtgacggtcaacgggcgactgatgtttattaccgacaccatccaggaagtggttaaccgcaacggcaccc

SEQ ID NO: 89592 - DNA, 1003 bp, Glycine max
  Peptide Sequence Number=SeqID_206370
atgagcggccatgccatcgatgcggctggcccggccggtgaagccacgcgcctgccgtgggcgggactgctggcgctggccggtggcggcttcatcactctgctgaccgagaccctgccggccggcgtcctgcggccgatgggcgaaagcctcggtgtgagcgacgcggcggttggccagctgcagctacccgctgatcctggccgcgcgcttcctggccggcgtgtgtggtggcctgctgtggtcgctggtggccggctacgccgcgcgcatggtggtgccctcgctgcagggccgggcgattgcggtggcgatggtcggatcgccgttggcgctgtcgctgggcgtaccggccggcacgttgctgggccagcagatcggctggcgctgggcattcgcgctgatgagcgtgctggcagtcgtgctgctggcctacgcgcgctgggcattgcccgcgttgccggcggcggcggccggtcagcgtacgtcgttggctacggtgtggcgcatgccgggcgtgcgcagtgcgttggcggtgatggtgctgtacgtgctggcgcacaacgtgctctacacctacatcgaaccactggcggtggaggccggtgccggcccgtggctggaccgcctgctgctggccttcggcctggccgccatcgccggcattggcattgccggctggggtgtggaccgtcatctgcgcacgctggtgtgggccgcggtgatcggtttcatcgtgccggtgctgaccctgctgttgtggccgggcgacgcgatcgcgctgctgctggcgacgatcctgtggggcgttgccttcggcgcggtacctacgttgttccagaccgcattggcgcggcgtgccggtgccgccgcggatctggcgcagtcgatgctggtgaccggttggaacctggccatcgccgccggaggtgttgcagggggtgtgctgctgcaggcgggcggcccgaaccagttgggatggctgccgctgctgctgctgtcg

SEQ ID NO: 89593 - DNA, 1167 bp, Glycine max
  Peptide Sequence Number=SeqID_206371
atgtgggcgatctgctggcactggcctcgcgcgtggtcggcgaacgtcatgcgcggcgttcgttcttcgagcaggcgcagtcgctgggccgtgaactggcaatcctccgcgcctgcagaccggccgtgggtgcagttcaccgaacgcctgctggccgcgtcgatcggcgcggcatccgcacgcctgctgctgaccagcctgctgcgtggctcgggcatggacctgggcgaagtggtggcagtgctggacgaagccgggcaggagctgcgcttcaaccgcgagatcctgtcgaccacgctggagaacatcagcgccggggtcagcgtggtcgatccggacatgcgcctgaccgcatggaaccgccggtaccaggacatgttcggctaccccgacgggatgctctacgtgggccgcccggtggccgacctgatccgttacaacgccgagcgcggcgaactgggcgagggcgatatcgaagtgcagatcaaccgccgcatcggctacatgcgcgccggttcaccgcacgtgttcgagcgcacccgcagcgacggcaaggtgatcgagatgcgtgggcaggcgctgcccggcggcggctacgtgaccagctacaacgacatcaccgactacaagcacgcggaaaaagcactgctggaagccaacgagacgctggaacagcgcgtggccgagcgctcgcacgaggccgaggtcgcgcagcagtcgaagacgcgtttcctggcagcgatcagccatgacgtgctgcagccactgaacgccgcgcgcctgttcgcttcggcgttgcgtgacagcgaccacgtgagcgatgagcagaagcacctggccgaacgcgtggatgcgtcgctgcgcgcggccgaagagctgctggatggcctgctggacgtgtcgcggctggatgccggtggcctgcacccggtgatcggcgagttcgacgtgagtgcgttgatgcgcgaactggcggcgcagtacacgccagtcgccgccggtcgtggcctgcgcctggacctgttcgcgcgcccggcgtgggtacgcagtgatcgccgcctgctgcgccgcgtgctgcagaatttcctggccaacgcgttgcgctacacccgccaggggcgcatcgtgctggcggtgcgccatcgtggcgacgaagtggagctgcag

SEQ ID NO: 89594 - DNA, 468 bp, Glycine max
  Peptide Sequence Number=SeqID_206372
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccctgatgaaacaaaagtccaaacttggagcagccaacactacaggaacgaacctgtggttgttgttgcggctccacggttgcaaaagtattctagttttgatgaccagagtggggataagcctctgcttttgcccatttga

SEQ ID NO: 89595 - DNA, 378 bp, Glycine max
  Peptide Sequence Number=SeqID_206373
atggaagacccgagcaaattcaaacggccacaacttttgcctcggatgtcaattcaggcgcataatatatcgagaagctctcaagatattcaaatggtgcataatatatcgagaagctcgaaattgaacatggaagcacaaggcaaattcaaatggccacaacttttgactcatatgtccgattcaggccaattatatatcgagtcgatcgaaattgaacaatggaagctcttgagaaagtcaaatggtcataaattttcaatcggatgtccgattcaggtgcataatatatcgagatgctcaaaattaaacatggaagcacaaggcaaattcaaacggcaaaaaattttggctcgaacgcccgattcaggccagtaa

SEQ ID NO: 89596 - DNA, 643 bp, Glycine max
  Peptide Sequence Number=SeqID_206374
ggtggacccttgggtacacgccctcgccttcagaggacgacacgtcctcaccttcagaggactgcatgtccttactttcagaggactgcacatcctcaccttcagaggactacacgtcctcaccttcagagggctgctcgccctcgccttcagaggactagacatcctcgccgtcagaggactagatgtcctcgccttcagaggactatacgtcctcgccttctgagggctatgcactttcgccttcagtgggctccacatccgcaccttaagagaatttatggtcctccaaccttaatgcttaaccaagacttgcgctcccgggcgaccaactatgcgagcacaaccagaggaagagactatcgcgtagctactgtgcataccgggggaagatttcacccgtgccactgcaaagagacgagtgcggatcatgcgcaccaacatgaacactcttacatagatgacgttgctactttgcaacattctgcccagcaaccgcaatgccgatctccccctgcgaaagtatcggttggtctgtgccatcccgacatagggccctggggtttccagctcgggttacgggcctctatcagtcctatagggtgctcgtaccccccagcaaggtcataccatcatgacatag

SEQ ID NO: 89597 - DNA, 201 bp, Glycine max
  Peptide Sequence Number=SeqID_206375
atgtccccacgtatatgtaaaaggaaaagggaagggaaagaaaacagaaaaatagaagaaggcaaaggggaaaaagaatataagatcgaagatgcaaatgatagaagcgtggaagatctttgttcaatttcgaatggcaacatcgatcactccaaagaggcatatggtatggggataatgagaaatgaccccaacacgtag

SEQ ID NO: 89598 - DNA, 985 bp, Glycine max
  Peptide Sequence Number=SeqID_206376
cggccacggcttttcgtggccagtgaacgcgcgggcgcgagcccgctgcaggggttgacctcagccatcagaccctggccgcaggcccggaacgcggtccctcgcggtccggcggagcttgccggctctgccggagggaaatggcagaagcacagcagcaggagcaaagagagcaggacagctcgacgtctgtctcacatgagtaagcgcacgcgacggaagaaaaccggtgcgtcagcacagggtttttaccggcatagccgcggggtttatccctgcgcgcgcgtcctgaagcggtacagcgaaaccgccacgatggccgcacccattatcatggccaaaagcggcagcagcatcccgtgggatgcagagtacagcatgtcaccgcctgccggccagcaggcgcgccagcacgaagcacatcgcgtagccgcaccagtatgtcaggcttatatcgcccggcaccacgaaccggaaggccagcgcataacccaggctcagcagggtgttttgccgcttaaagatggccgggggcctactcccctgccttttttcgttctagtctgtgactttccggttatagaccaccttccagtcatggtacgccgcgcagtcgcgcagcgattcaatgcgcaccacgttctccgccacgccgttcatcatcagcacgcgctcgatgcccgtaaaccagtcctccgccgggttgagcgggaaccacaggttgctgttgatgccgctcagcagcggatcgttgcagatgtggataccccgcccgtatcgggtttcgctgccggtcacaatcagttcgccgcgcagctcgcgcgtgacggcgcagcgcgccagttctgtgaccacgtcatcccagcaccattctttgtcctccggcaccggcagctcgacgcagcgcagatgcttgttgcccgcccgggcggtgcgctgtgcgagccccagcaccgacggttcgttactctcgccatccgcaccg

SEQ ID NO: 89599 - DNA, 1203 bp, Glycine max
  Peptide Sequence Number=SeqID_206377
atggcgggccaggacacctcaggaaaggcctcaaggcggataagcccgtctgtcaatgcggacgctgccgttggtggtgctggcgtgcagcgtgccgccgacggtgacgtcaccggtcgcggggtcggtggcctcgtcctcgatgctgtacacgctggcgatgccgtttttcttcacgtaggcggcctcggtggccagcaccttcttcatttccgagcgcgcggcgggagacgtccagctcagcagcagcgcgtgctgccggtcgaccgtctcgggcgtcacgttgaggcgcaggttaaccagcgagcgaaccagcatcccgttcagccgggcgtcaccgccgttcacgtcggagacaaacggctggtcgaaggccatcggcacggtgagggtcttctgcgtgtgtgcaaagtgccacgccatcgtgccggtcacgccggtcccgatggcgaggatgaaaacgagcgcaaccagccccgtgagggtgtaaaccaccacgcgatggcgcgtctcttttatctgaagcttcatggctcctcccgtaagtggagaaaaatgccgccttgcggggcggccgggaaactactgcatccagtggcggttaccggaatccggcacgcgccggagctgcgtgcggaaaagcgtggtgggcaggtaccagtagagcaggttaagaagccaccaggacccctgccccttcttgaggtggcggatgagaagccagagcgcccccccggcgaggagcataatgacgaacatggtttcagggaaccggtaccgctgcgactgcctgtcctccatggctcacccaatcatgccgtagaacgcgcgggtcaccagcagaacgatgatgaggccgacgaagaccagcgggttgcgggttttaatgaagcccaccaccgagatgatgatttccgcaaagtatatccagcgcatcaccgagctctgcagcccgaaggtgtcgctggcgtcctgctgctgcgttttcagcaggtcggtggcgtgggccaggtgcgggaaggcggtgacgaccagcatcagcgcccacagcagcagggtgaagcgaaaagcagggccaggcttctgcgcgacgttaagcacgcggagggcagacataaagcgggcggtaaaatggccgataacagagccgcgcggattattcctgaaagggcgtggcgtacgcttgctgcctgtccagggtga

SEQ ID NO: 89600 - DNA, 571 bp, Glycine max
  Peptide Sequence Number=SeqID_206378
atgaaaacaccccttctttcccttatcgtggcgctgaccgccggtgccggtctggccctgccggccgccgccgcggtgcccggtcccgccggcaccgcgtttgagaacaatgcgcacctgaaggcgcagatgagtaatacgagcccgaataaaatcatcatcgacggcgagctcatcaccgccgttaccggtccggaaaatgcctacacgaaggccaccaccgccgacggcgcgctgctcatcacgccgctgatggggcaggacttcaccctgtttctggaaaccgccgggggcatcggcgtctcgattgacgtctcaccgaaacccggcaacggccgcacgctgcacctcattccggcagacgtgcccctgaagcccaacccggacgcgaaggcgtgggaggagagccagcccttccagaaaacgctggtgagcgtcgcccgcagcgtcgtgaacggtgacgtaccggagaattacaccgaggtgaaagcctcgcgcggtccggcttacaacccgcccgcgggcgtgcagctgacgccggagcgccagctggccggcttcgcacttgcgc

SEQ ID NO: 89601 - DNA, 1833 bp, Glycine max
  Peptide Sequence Number=SeqID_206379
gatggcctcgctgattttatccagcgcctctgccggactggccagcacggcgagcagccccttgatgcgctccgcggagcgcttgatgctggtgacgttggcaaacgggttaaagcgcagcgtggcaccgtccagatagacgccgcccgcctgccggcagaagttttcatagcttcgccccatgtcgataacccagccgaagccgccggagttgagtgcctgtcgcagcgtctcctgaatcaggaagcttttgcccgccccggtggtaccggtcaccgcaatgttggcgtttgtggtgccgttctttttgctgaacatatcaaaaaaagccagttgcccccggtaggtgggcagcgggctgccgaagggcgacatctgccgctctgccaccaccggcatcaggttcaccgcgttaaagcttttgcagcgcagggtggcccccatgtgccgcatgtcgtcccacagcccctcctgcatcaggaacggcagcgtggtgagccagttgcgcagctgctgatagcggggcgccgacatttccagttcgttcttacggaacacgttgatggccgcgtcctcgcatttctgctgcgcactcgcgctgtcgggcgtaaacagggtcagattcagcgacatgtcgcacatggcaatttcgttgttcgccagctcctggcgcagcccccgccactcctggtaagcgcgctccgtgcccgggaacagcttcgcgtaagaggtgccggccttcttgcccagatcctgctctttgctgaacgcggcgttctggcttttcacctggtcctccacgcacaccgtccagctcaggataaacggacagggaatgccgagatcggggaagcgcatgttctgcaggttgtcggacgcctgccagagcgcgaactggagcggcgttttggtcatctgcaggctcacaatgcgcgtgctggtgacgtcagactccccttcctcacccagcgtccggtcttcgcgctgacgcgccgtggtgagccgcaggtagcccggatggacctcgagctccgtgctgggatccacgcactggcgatgcagttcctgatcgccattccagtgacggctgctggagaccacctgcccctggcgatagttcagctgttcacgcaccaccgaaagaaaggcttccggtccgacgcgcagggagtccatctttgcggccagcagcgacacgcgtacggtttcacgcagctgcaccgcctcgtccattgcgcgtatcccgccccgccccgcctgcccgtaaaccagaaacacgcggtaattgcgcagatagagggggtactcgtttttattggtcagccccatcagcgccgcccgctcccagtaggctttggtgatggcgttcaggcggggcgccatgctgccctgccacatgtcgcggctgagtcccttgtccagcatctcgcccacgcacttgctggccaccatcagcacggtcaccggggttttgcgcggcagcttcttgcggagcaggtcgtccagcgcctgcaccacctgctgattggcgccggtcaggggcgccacctccagaataaagcccacggaccggctgttcacgtagagctcccgggtctcgtcataggcgcgccagggcagcaggccactcagggacggatagctgaagctctgtcgcagcagggcggcagcgtctttcgtgccgccctcgtcccggctgctgctgaagatgccggcaaggtgttcgagaacgttactgagcatgctgacctcctgcgaatggtgcgcgcagcgcggtgttcatcacgtcctgtaacagcaggcttttgcctgcgccggtgtcggcgcagatga

SEQ ID NO: 89602 - DNA, 741 bp, Glycine max
  Peptide Sequence Number=SeqID_206380
atgagtgtgcgggttaatcggatggtgcgggttgccctggtgaaggcacaaaaattcgcgattcagtctgtatgcttctttttcataaaggttggcaccatctgcaggtccttaggcgcatcctcgctcatagcgcgatggctgctggcagcgggtacgttttttaccggtgcttttatgcgcgcccagacatctgcgcgcggtgtgcccggtgaaacctggcggatgacgtcagcaatgtacgccgccagccgctcaatcgtgatgtccgcgagtgcgggtacgtgcccggaattcattaccagcgggcgaattgccgcatccggaaccggtagggtattaagcctttcaagccggaacaccatattaccggcgggatgcgtcacgcggatgagcagcgcttccggcggagtgactgttttatcgggaaccataagcacctcagataacggcttcggacaaacactcacacacatacatacaggaaatataatgagcgaacttaatgcagtttccggcaagccggttatcacattctcctgcgacgataagcagatttgtgaagaaatcattgcacttaaaacctttgtcttcagcctgctcaggatgatgcctgaagacatctccctggacgttgtcaaaaacctcagcggaaacggtgataatccccctctcaacaggctttgcaccgaaatggttgacgcaatgattgccacatccacacacgttcaggagcactga

SEQ ID NO: 89603 - DNA, 759 bp, Glycine max
  Peptide Sequence Number=SeqID_206381
atggttcccgataaaacagtcactccgccggaagcgctgctcatccgcgtgacgcatcccgccggtaatatggtgttccggcttgaaaggcttaataccctaccggttccggatgcggcaattcgcccgctggtaatgaattccgggcacgtacccgcactcgcggacatcacgattgagcggctggcggcgtacattgctgacgtcatccgccaggtttcaccgggcacaccgcgcgcagatgtctgggcgcgcataaaagcaccggtaaaaaacgtacccgctgccagcagccatcgcgctatgagcgaggatgcgcctaaggacctgcagatggatattcccatgcaaaaaatctttgcgtgcgcactgctgtgcgctgcgctgaccggctgcgccggcatgaactctgactttgactgtaacaaaaccgccaccgaccagtgcctgtcgatgtctgaggccagcaaactggcatcaaaaggcaaaagcctggacgacctgaccgcgcagaaggaggccggcccaaagcctgcggctgaggcgctggcgacgcccggcaacgtgaagcccgccgttaatccttaccgccccgtgagcgtggcgacgctgactctccgtcctgtctccgggcaggcgctgagcgcagacggtctccgcgcgtccacggtgccggttcgcgcagcaacaccggtggtgccgggggactacagcggaccgggacagcttccatcagcccgccgtggtggaattcgttaa

SEQ ID NO: 89604 - DNA, 432 bp, Glycine max
  Peptide Sequence Number=SeqID_206382
atggctacgttgttcagcggatttatcattattagcacacttgcctttgaagggagtgctgtcagtgggtattaccctggttctctggttgcagcatggcgtgcgcgggctgaccaccaggaggatttcacataccagcgaccatacgatcatcatgaacgtacctctcttaccaataagcgcctcaagttcattaaagtaaatcgtgaccagggaaaacatccagaccatcacaagcggaggccgtatgcagctgagttttcagcgactggcgctgttcagcctgctggcctgcttcaccgccggtataacgcttatcctgcaccagctctgctgagtatcccaaaaaaagaatcaccgtgccttcaccagggtaaccagcgctatccggcgcgtcggatctcaataacagtcatcaggagtaacgcatga

SEQ ID NO: 89605 - DNA, 1032 bp, Glycine max
  Peptide Sequence Number=SeqID_206383
atgaagcgctttctcctcatactgtgcctgctgacagcgggcattatggcaaagccggtgatggcggcaaccagcaacgccggcgacggccgctgggtgaatccgatcagtgacgtctgctggaagtgcctgtttcccatgacgctcggcagcattcagctggcctccggcgcgcacccggacacaccgaacccggcctcgcccatccagctttgcccgtacggcattttttaccggctgggactggccatcggcttctgggaaccgctggccatgacggacgtcacgcgtgagcccggcgtaatggtgaacatggggggctttaagatcgacctcggccgcaccggtaccgggcgcggggggcagagcgatgcgcccacgcccggcagtttctatcacgtgcactggtacaagtatccgctgattttctggctcaacatcatcaccagtacgggctgcatgcagaccggcgacatggacattgcctacctgtctgaagtggacccgctctggaacgacagcacgctggccatgatcctgaatccggaagtggcgctcttcagcaacctgctggcgcagggcgcctgcgcggctgactcaatcgcttctaccgcggggctcgatgtacccgttcacgggctataccagcaacgagttttcgccgctggaggcttcgctgctggtcagcgagcgcatggccttcaagctgcaccgggagggactggtgatggagacggtcggggcggacgtggcggtgtgctacgaatatccgtccccgatcatcccaaaatcccgctggcgctaccagatggtgaacatgtaccccgaaccctcggactgccacccgttcggcacgaccacgcagctgtggggctcggtacacaactcacccacgtcgaagaagaacttcggctacctcatgtggcgcaagcgcaactgcgtttacctgtaaggaatcagcatgaatactccactgactacggcgctggccctcggcgctgcgctgctctgcgcgaccacgcaggcggctga

SEQ ID NO: 89606 - DNA, 288 bp, Glycine max
  Peptide Sequence Number=SeqID_206384
atgcaggatacacactggcatcgggaactgagctttacgctgacggacggcatgctgctgggcgtgctggggctcgtggtggtgacgctgtggtggcgggcgatcgctgattaccgtggtctgcgccgcaaagagcgccgtaacgcggccatgcaaaatggtaacgccgcgttacggcacgcctggtggcgcagagaccgcgttaacgtcgtgctggaatttaccatggccgcgatggtgacgctcgcgtcaggctgcctgctgattgttctgctcccgtattactga

SEQ ID NO: 89607 - DNA, 330 bp, Glycine max
  Peptide Sequence Number=SeqID_206385
atggatgctgccggtaaaccagcccgggccaggggggccggaaggctgccactggctgcagttaccggttttccggaaaacatccatcatccattcaggcacgtcgttttccatccaggtggtcgccgactgcagattgtgttcatcaagccaggcttcaaattcaccaggctgcggatactcattgccgcctgccggcaggaaaaaagcaggatgcgtccagccgccccagcgatcgcgcacgaccggctgagccgatatttcagcggggtgtgtcataagaggaaattccgtggttgcggcagccgggctgccggggtcagacgttaa

SEQ ID NO: 89608 - DNA, 1285 bp, Glycine max
  Peptide Sequence Number=SeqID_206386
gcgggatatgccggcgcgaacaaaggtcagggaacatcagcagcaaaaggcacagacccggcgtccgttattccgggctacacatcaagcccgtcgcagagcggctactacggtggggtccagggcggtgacgggggcatcagcgacaaggggcagaccgagctcagccacaacgaggcggggctggccatctccgactcgtccacgaagaacccggcggtgaccatcgacccgaacgccgactttatccagaacggcaaaaacgccgaggcgaacagcggctccatcgtggacggcacaaaccagcagtgcaccaccaaagtggtgtcaaagtcggtgtttgagaactacagctgcgaccgggacgtggcacaggtgcagacgtgtgcacggaccggaagcattcagatcacaggatcaaaggagtattacaacactgaactggtacttgattcccacaattcaacagcagtaatcctggatgattactgggtacgttttgactttaccgtgccggatgacggggtagtcagcactggtacatgggatttccgctatcccagaagtccaaattatcacggttcggatggcaatcgtctttggtacacgatgaaagccttcgacctcacggttgatcatatccagctaaataatggcgggcaggccgcgatcacaccgcagcgcgtaacaaaaggccagacagtctcattatacattcactaccacacggacggtcactacagtgaagggcgtgacggaatcattaagaacgcccgggatggcacgtttgtcatgaaaatgacctttcccttaactgccgaacgtgacacgaccagctcacaggttgtctggagtgagtcctgcggcttcgataaatcaaaggctaccggcacggcaggtacggtgtgtaccgacccgggcgggagccggacggtaaatcagaacggcaaagactatacgcagagcgcctcctgctggcagtactcggacgcctatatcgtgccggtcagctcaaccggcaactgcagcacgctgatggccaacaaaaactgcacggtctcagcccgcagctgtactcagacagaaggcggcacctgcctgcacgagcaggacacttaccagtgtcagaccacctacagctcagaagggctgctgtgcggcggtcagtacttctgccggaccggtgactgcagcggaaccgacggcgcgggcgacagcggtttgataccgcggtggccaagcttgccggcctggcctcggccggcgacgacgtcaagccgatcag

SEQ ID NO: 89609 - DNA, 1293 bp, Glycine max
  Peptide Sequence Number=SeqID_206387
ggcgacctcaacggctactttggcagcctcggctttgacggcaacgtttcgaaagcacaggcgtggcaggggcaggccgcgggctacttcaccggcggttcggtttatctgcgtaaccccgtcaaacaggtgcaactcatctcgatgcaggtgccctcgctgaacgcgggctgcggcggcatcgatgcctacctcggggcgttttcctttatcaacggcgccgagctgcagcggttcgtgaagcagattatgagcaacgccgccggctacgcctttgacctcgcgctgcagacgatggtgccggagctcaagcaggccaaagacttcctgcagaagctggcctcggacgtgaactccatgaacatgagttcctgtcaggcggcgcagggcatcatcggcggcctctggccggtgtcgcaggtgtccaatcagaaaatctgccaggacattgccggtgagagcaacatcttctctgactgggcgtcatcgcgtcagggctgcacggtgggcgggcagggtgacagcgtcaccagcagggcgtctgacaaagacaaagaccaggtgctgaaaaacaaaaacctcatctgggacgcgctggggcgtaaccacctgtttgacggcaaccggcagctgaaggagctggtgatgagcgtggtgggctccatcatcttcaacaaggacgggcaggtcaccatcctgaccccgctggtcgacaaccgcgacatcatcaacgtgctgatgcgcggcgggaccgccaaaatctacggctgcgacgagcaggatctgtgcctcgggcccatgcccgccagcgtgacggtcagcagcgacgtggcgctggtgacccaggtccgcaacctgatgatttccatcgacagcaagctcagcgccgacaccggcctgtcggataaggaaaagggctttatcaacaccacctcggtgccggtgctcaagtacctgaccaactctcgcagcatgggcatgagtccgacctacctgattcaggtcgcggacttcatcgcgcaggacatgatgatccagtacctgcaggagctggtgaagcaggcgagccagtcgctggcgggcaaaaacttcccggagcaggccgccggcgaactgcgcaacaacgtgcaggccgcgacctcgctgctggcgcagatgaagctgcagtcgaccgccgaccagaacgcgctggacggcattgaccgcaacatgcagtacctgcagcagcaggtgtcgaccattatctcaacgtcctatcagggcaactatcagtgggggaccggcaatgactga

SEQ ID NO: 89610 - DNA, 171 bp, Glycine max
  Peptide Sequence Number=SeqID_206388
atgactcctaacgtcgtcggaaaagaagaagctgatgacatttatgctaatccccatgactactccacatggctcgcctcctcctcctcttccttctgcagtagcataatagtcgccatctaccttgaagcggacacgaaaagccacacggctatgatccttggcgactag

SEQ ID NO: 89611 - DNA, 318 bp, Glycine max
  Peptide Sequence Number=SeqID_206389
atgattatgaggggccaagacatttatagtagccaagatgaggctactacttcaccttcctctagtgaaagtgaagaagcaaaagaggaagaatctaaggttcccatgagccttaagagaataaaggtcattcctgagtgggccactccaccaagtgttgagggaagaagctcagagttccaagaacctctggatttgtggtcaaatcattttcaagggggagggaatgatgcaatcctacccccccaagggcattggatagaagaatccaagaagattggaccagatatgcaagaaaaggccctaaggttctcatga

SEQ ID NO: 89612 - DNA, 232 bp, Glycine max
  Peptide Sequence Number=SeqID_206390
atgcaaaaattgaacaattcgctgcaaaattacgcatggggcagcaaaaccgcgctgaccgaactctacggcatcgaaaacccgcagggattgccgatggcggaattatggatgggcgcgcacccgaaaagcccctctaccgttgaagtgaatggcgtcacccgttcgctgcgtgacgtgatcaatgacgatccgctcgcgacgctgggcgccgcggtagcgcagcgtttcg

SEQ ID NO: 89613 - DNA, 378 bp, Glycine max
  Peptide Sequence Number=SeqID_206391
atggtttccaactcccagcaatttagtgccagaagtaatgctattgttattagaagagtgcatgaagtagccacaaattcatcctcatcaggcgagactaagaagcttgaagcaattgaacagcctgaagcttatgctggaaacatctacaacagacctcctcaacctcagcagcaaaatcagccacagcaaaataattatgacctctccaacaggtacaatctcggatggaggaatcatcccaaccttagatggtcgaatccttcacaacagcagcagcaacaacaacagccttattttcaaaatgctactggcccaagcagaccatacgttcctccaccaatccagcagcaacaacagcaacagccccagaaatag

SEQ ID NO: 89614 - DNA, 1600 bp, Glycine max
  Peptide Sequence Number=SeqID_206392
atgtcgatgaacgatagtccccagaaaagaacgatctggacgcgtatccatatcgacccgctgtttatgctgatcatcatcagcctgctggcctacagcgccattgttatctggagcgccagcggccaggatccgggcatgatggagcgcaagctcgggcagattgccatgggcaccatcatcatgctggtgatggcgcaggtgccgccgcgcgtgtatgaaagctgggcgccctacctctatattgtctgcgtgattttgctggtggcggtcgatgccttcggccacatcagtaaaggggcacagcgctggctggatctcggttttgtgcgcttccagccgtcggaaatcgctaaaatcgccgtgccgctgatggtggctcgcttcatcaaccgcgatgtctgcccgccaacgctgaaaaacaccggcatcgcgctggtgctgattttcatgccgacgctgctggtagcggcgcagccggacctcggtacctccattctgatcgccgcctccggcctgttcgtgctgttcctctcgggcatgagctggaagctgattggcgtggctgtgctgctggtggcggcgttcatcccgattctgtggttcttcctgatgcacgattatcagcgcgaccgcgtgatgatgctgctcgatccggagagcgatccgctcggtgccggctaccacattattcagtccaagattgctatcggctccggcggcctgcgcggcaaaggctggctgcatggcacccagtcgcagctggagtttctgcccgaacgtcacaccgactttatcttcgcggtgctggcggaagagctcggcctggtgggcgtcctgctgctgctggtgctttatctgctgctgatcatgcgcgggctggtgattgccgcacgcgcgcaaaccacctttggtcgcgtgatgtccggcggcctgatgctgattctgtttgtgtatgttttcgttaacattggcatggttagtggtatcttaccggtggttggcgtgccgctgccgctggtgagctacggcggatcggcgctgattgtgttaatggccggatttggcatcgtgatgctgcacatgcgtaaggactggcttggggttgctctggcatcactggtactggctgcctgttccacaccggaacagcagacgaacacggccccgccgcagccggcctacaatggcccggtggtggagattcccggcgtggagccgcgctatgagccgatcaatccttctaccagccaggactacagcgtcaacggcaaaacctaccgggtgattaaagatccgtctaactacagtgaagttggtctggcaacctggtacggcgaagaggcgcagggcaaccgcaccgcgctgggtgaaacctacgatccggacgcgttaagcgccgcacaccctaccctgccgctgccaagctacgtgcgcgtcaccaacctggctaacggccggcagattgtggtgcgcgtcaacgatcgcggcccttacacgccgggccggattatcgacctgtcgcgcgccgcgggcgatcgcctgaatatttccaataacacccgcgtacgggtggattacatcaaagtagcaccggacg

SEQ ID NO: 89615 - DNA, 2298 bp, Glycine max
  Peptide Sequence Number=SeqID_206393
atgcgtaaggactggcttggggttgctctggcatcactggtactggctgcctgttccacaccggaacagcagacgaacacggccccgccgcagccggcctataatggcccggtggtggagattcccggcgtggagccgcgctatgagccgatcaatccctctaccagccaggactacagcgtcaacggcaaaacctaccgggtgattaaagatccgtccaactacagcgaagttggtctggcaacctggtacggtgaagaagcgcagggcaaccgcaccgcgctgggtgaaacctacgatccggacgcgttaagcgccgcacaccctaccctgccgctgccaagctacgtgcgcgtcaccaacctggccaatggccggcagattgtggtgcgcgtcaacgatcgcggcccttacacgccgggccggattatcgacctgtcgcgcgccgcgggcgatcgcctgaatatttccaataacacccgcgtacgggtggattacatcaaagtagcgccggacggttcggtgtccggcccaggcaccatcggcaccaccgtggccaaacagagctatgcgctgccggcgaggcctgacctgagcggcggcatggtgatgaccggcgccagcagcgcgcccgcccctgccgcacaggacgtccgcgcggtggataacagttcactgcagagcaacggcaacatcggtgcaccggtgcagagcagaggctttctcggcgcgccgcagccgttagccagcggcgtgctggaaggtagcgcgccggctacaccggttgcccccagccctgccgcaccggctgcggctgcggcagcgagcccggctccggccagccacaacgccagcgcccatgccggcagcggttttgtggtacaggttggcgccctgaatgatgccgctcgcgcccggcagatggcggacagccttggccagcgctttggtgtacccggcgcggtggaagccaatggcaacgtctatcgcgtgcagcttggcggtttcagcagccgggctcaggccgcggcgctgcagcagcgcacttttttcactcttaaccccacggatgctgtagtcctgaacatgaatacgctgaaaccttctcgttttctgaaacgcctgacagtgggatcactggtcgctctctccctcagccacgttgcctttgcagatgatgttaatctgaaaaccatgattccgggcgtgccggacatcgatgccgaagcttacgtgctgatcgactataactccggcaaagtgctggcggaaaagaacgcggacgcgcgccgcgacccggccagtctgaccaaaatgatgaccagctacgtcatcggccaggcggtcaaagcgggcaaaatccatcaggatgacattgttaccgtcggtaaagatgcctgggcaaccggcaatccggtgttcaaaggctcctcgctgatgttcctcaagccgggcgatcgcgtaccggtctctcagctgacgcgcggcatcgtgctgcagtccggtaacgacgcctgcgtggcaatggccgattacgttgccggcagccaggacgcgttcgttaacctgatgaacaactacgtgggcgcgctgggcctgaaaaatacccatttccagaccgtgcacggtcttgatgctgacggtcagtacagtacggcgcgtgacatggcgctgattggccaggcgctgattcgcgatgtgccggatgagtacgcggtctacagagagaaagagttcacctttaataacatccgccagatgaaccgtaacggcctgctgtgggataccagcctgaacgtcgacggcatcaaaaccggccacaccgaagccgccggctataacctggtggcgtcagcgaccgaaggccagatgcgtctgatctcggcggtgatgggcggtcacaccttcaaaggccgtgaaaccgaaagtaaaaagctgctgacctggggcttccgcttcttcgaaaccgtggcaccgctgaaggcgggcaaagagtttgcgtctgagccggtatggtttggcaacagcgatcgcgtgcagctcggcgtggaaaaagatgcctacctgaccattccgcgcggccgcatgaaagacctcaaggccagttacgtgctgaacaacaccgaactgcacgcgccgctgcagaaaaaccaggtcgtgggcagcatcaacttccagctggatggtaaaaccatcgaacagcgtccgctggtggtgctgaacgaagtgcaggaaggcggtttcttcagccgcatcatcgattacatcaaactgatgttccatcactggttcggctaa

SEQ ID NO: 89616 - DNA, 1428 bp, Glycine max
  Peptide Sequence Number=SeqID_206394
atggtgctgggcaccgtgctggggctgctgctggcggtctggcggctgtcagagaataaactgctgagcggcgtgtcggcgctctacatctggttctttcgcggtacgccgctgctggtacagctgatattctggtacaacctgtcgacactgtttcccacgctttcgatcaccgtgccgtggacagacatcacctttgccagctggaatactaacgatctgatcacgccgctgactgccgccatcgccggtctggcgctcaacgaggccgcctatatggcggagattatccgtgccggcctgctgtcggtcgatcacggtcaggttgaaaccactcaggcgtttggcatgagccgcagccgcgcgctgcggcgtatcatcattccgcaggcgatgcgcgccattattcccccgaccggcaaccagctgattagcatgatcaaagctacgtcgctggtgagcgtcatcgcgatgggcgatctgctctattcggtgcaggccgtttacaaccgtacctttgaaatcattccgatgctgatggtggcggtgatctggtatctgctgattacctcgatcctcaacgtcggccagtcagccattgagcgctactacgcgcgcggcagcaaacgtaccgtggtggtgaacaaacgacgcgccagcagtgacacggcgctggctgcggccccgcgtttaaaggaggacagcttcggtgataacgcggtgctgaaaggcatcgaccttgatgtgtttccgggcgaagtggtggtgattctcgggccttcgggctcaggcaagtcgacctttctgcgctgcattaatcatctggaagagatgaatgccggctcgattatggtgggcgacgagcagattggttatgcgctaaagcgcggcctgctgcatcgcctgtcggcgcggaaaattgcccatcagcggcagaaaatcggcatggtgtttcagcagttcaatctctatccccatatgacggtgctgcaaaacatcatggaagcgccgattggcgtgcacaagttcccacgcgatgaggtgctgcaacacgcgcgtgagctgctggcaacggtcggattgagcgataaagccgacgcctggccgcggcatctgtcggggggacaacagcagcgcgtggcgattgcccgtgcgctggcgatcaaaccgctgctgatgctgttcgatgaaccgacgtcggcactggatccggaactggtgggggaagtgctggctacaatgcgtacgttagccgatcgcggcctgaccatgattgtggtgacgcatgaaatcggctttgcgcgtgaagccgccgaccgcgtggtgtttatggatggcggcgtggtggtcgaacagggcccgccggagcaggtgattggcaatccgcagcatccgcgcactcaggcgtttctcagccgctttatctga

SEQ ID NO: 89617 - DNA, 1821 bp, Glycine max
  Peptide Sequence Number=SeqID_206395
atggcgctgattccggtaaaaaccgtggtcaccgaacgccaggaaatcctgcgtaagccggagtggatgaagatcaagctgcctgcggattccagccgcattcagggcatcaaagcggcgatgcgtaaaaacggcctgcactcggtgtgtgaagaggcttcctgccctaacctcgccgaatgctttaaccacggcaccgccacctttatgatcctcggtgccatctgtacccgccgctgtccattctgcgatgtggcacacggtcggccaaacgcgccggacgccaacgagccgctgaagctggcacaaaccatcgccgatatggcgctgcgctatgtggtgatcacctcggtggaccgcgacgatctgcgtgacggcggtgcacagcactttgctgactgcatcagcgccatccgcgaaaaaagcccgagcattaaaattgaaacgctggtgccggacttccgcgggcgtatggatcgcgcgctggagatcctcacggctacgccgccggatgtgttcaaccataacctggaaaacgtaccgcgcgtctatcgtcaggtgcgtccgggcgctaactatgagtggtcgctgaagctgctggagcgttttaaagaggcgcatccggacgtgccaaccaaatccggtctgatggtcggtctcggggaaaccaatgtggaaatcatcgaggtgatgcgcgatctgcgtcgccacggtgtcaccatgctgaccctcggccagtacctgcagccaagccgtcaccacctgccggtacagcgttacgtcagcccggctgaatttgatgagatgaaagaggaagcgctggcgatgggctttacccacgccgcctgcggtcctttcgtccgctcgtcttatcacgctgatatgcaggccaaaggcctggaaattatgcaatcatcctttcatatcgatgagctcgattttatgcgggcggcggatgtgtcaggtccatcctctggtagaccgcgaagcggcgcgtcgggcgaaagcctggatgcgctaaaagcgcgtaccacgcccatggatatcactaatccgttcgtgacgccccatgcgtcgtgcgaactggcgtttcttgcaaccgccatcagcatcgaccaccgctacgacgaaattcatctgcacctgccgcaaagcgcgcagcctgcgtctgcgcccgcattgccgttcaccgaattgcgcagcgtaacgccggatgaaacgccgttgctgccagcgctgccgccgcttgagtcagcgcagcaggccgccggcgagagcgtctggcccagcctgcctgagattccggcgctcagcctggtgctgtcgttggtcagcgcgctgcctgcggcatggtatgcagcagaacatcagacgccccccccgtcgcctgtgaccacgctcacagcccggcagccgttgagcctgcctgaggtggctgtgctgcgcgacatgcagcaacacgactatgcggtggtaaccggcgacgcacagggtcactggcagttcgctcagcccgccgatttaagcgcggcacagcatgtattcagtgcagagttcgtcgatgaacaggggcatgtcagcagccccgccgctattatcacgccaattgatgacagcgatctcagcgcgattgattgtgcactgatggaactggcgatgcagcaggatgatattgcgcccgctcttctgccgctgaccttcagcgaagcatggctggatgagtggcacagcgctgacagcacgctaaccgccagcggcgatcacggtggcaacctgccaggctgggatgaaccgctggaacatcacattgtctggcactaa

SEQ ID NO: 89618 - DNA, 960 bp, Glycine max
  Peptide Sequence Number=SeqID_206396
atgatcactatcagactggcggtgcgcgactgggattacttcacgccgctggcgctgggcgatattcagccacagggcttcaggctgatcattgaccgcgtaggcacgctggtagataacctggccagcagtgaacactacgaaggcggtgaggtgtcgttcagccgctatgcgcaggcacgggcgcgcggcgacaattcactgctcggcctgccgcactttctgatgcgtggctttcgccagcgctgcatcatcaccaccaccgccagcccgctcaccacgccagcccagctgaaaggcaaaagaatcggcgttaccggctggcaggactccggtaatacctggacgcgcaccgagctgcgagaagcgggcgtcgatatcaacgacgccttctggtttgccggacgcctgaccgctgatcatccgattgttgaccggctggcgggatttggtcgcccgggccgtatcgaaccggcgcctgacgagcgtccgctgattgaactgttgaaagccggcgagctggatgcagtgttcacgccgtttatgcctgagggttttttcctgaaagattccggtctgcgccagctgcaggcggatttcgtcagtgccgagcgcgactacttcaaccgcgtcggctatgtgcccggtattcatctgctggcgctgaagccggcgctggcggcggcgcatccgtggctgccgcaggcgctgagcgaggtgatcgattgcgcgtatcagctgtggatgcgcaaacgcgagaagtacgcggataccacgccgtggctgctggatgatttgcgacgcaccgcgcaggaattgcctgccgactggaatcaaaacggatttaccgctaacaaaaggatgattgccgacttcgcccgtgagctgtttcagcagggcttaaccacaacgttgctctcgccggaggagattttcccggcggcggccagaggggagtga

SEQ ID NO: 89619 - DNA, 363 bp, Glycine max
  Peptide Sequence Number=SeqID_206397
atgttttcacttgtcgcactaagaactcttgtcattgtgcctccaaatgcagttaaaattagtcgcctaaagcaaaaccacccttatggagatggtgatgatgatgtggaatgcgcccgtgaccatggtggaatatctagcaggcacaagtttctttttgaaaacacttatgcattcccaaccttaatggtagaagttttcctgtttgttttagaaggttctcaaacactcggtcatccccctctgagtgtgaccagagacatctcatcactttgtgatgacaacaaaaatgatgacgtcaaatgcattcacgaccatggggaactctcttacatggacattatggagcttaagctctgttag

SEQ ID NO: 89620 - DNA, 864 bp, Glycine max
  Peptide Sequence Number=SeqID_206398
atggatgaaaacaacccgaattcggtggtgttccagatcaagggactggtgaagtacctcgaagaaatggacgcgcaggataatgcaggcggcattgctaccgagttgaacggctgctggcaggccttgctgcaacttgatccggatcaatgctttattgcaggtaatgccgcattggctgattggcttaatcaaacgtacaacatgcgctatcaggtcgaacatcaaacgatatatagctatgatctgccagtgattcagtcacagcagttactgcatatgatgccgcgccagacgccgttccaaacctgcgtgtcctacacgctggcttgcgaaccaataccggcagagcagtcacaacggctggacttttttggcaatcacaatcattacctgacgatgctcgcgacgcatcaggtgttgcaggtgacatcgcgtttccaagttgagctccaaccgcgtccgcctatcactgcattaatgcaaagtccggcgtgggagcaagtgcaagccatgctgcaagtgcaaggggcgcagcatcttgaggcggtgccttttatttatgccacgaacagggtcaagtccagcgaagccttggccgcatttgcgaaaaactgctttacgccacagcggtccttgctggacgctgccatggcgctgacccaaaagattcatgccgaatttgagtttgatgcacaggcgacagatgtatctacaccactggatgaggtgctcaaaggccgacgtggcgtttgccaggactttgcgcacctgatgataggtgcactgcgttcgcttggcctggcgtgccgatatgtgagtggttatatcctgacacacccgcctccgggccagccccgtttg

SEQ ID NO: 89621 - DNA, 267 bp, Glycine max
  Peptide Sequence Number=SeqID_206399
atgtcaaatcataaaagcactgagtcagcattgaagaaccttgaggtccaggtgggacaactggtcaagcagataactgacaagtcatccaacagttttgtggcaaatacagaacataatcccaaggaggaatgcaaagctgtgatgacaaggagtaaaaggtttgtggaggttgaggatgaggatagtgttgtacataagaagaaaactgttgacaaaaaaggtattgatggtgatgcaatcctatcccgcaagggcattgggtag

SEQ ID NO: 89622 - DNA, 1083 bp, Glycine max
  Peptide Sequence Number=SeqID_206400
atggctgcgcccgatccggcactgctgccggacctgcgcccggcgatgctggccgggctggcgtcaccgcagctgaatagctatcagcgtgaggcgatttcgccacagctgcaggcggccattgcgccgcgctggccctgtccggcggaggcgtggctggcgaccgatggcggcttcgatgccatgaacctgatagtgcagacgctgctgtcacccggcgatcgggtagtgattgaagatccgaccgcgacgcgtctgctggatatgctcgacaacatcggtgccgagatcctgccgctgcccggtgatgagcagggaccgctgcccgcggtgctggcgacacacttacagaaagcgccagcgatgttcatttatcagccacgcacccactcggcgaccggctacagcgtcagccagcagcgcagcgaagcgctggcgcaggtgctggcgcagagtgccaccctgattgtcgaggatgatggcatcggcgatttgtcgcgctggccggtatggagtctcggccgccactatccgcagcgcacgctgcacgtgcactccttttccaaagcctacggcccggatctgcggctggcggtggtatccggcacggcagaactggtgaaacggctgcaatcgtggcgtaacttcggggtcagctggaccagccgtattttgcaggatgcggtggcctggatgctgagcgatgcgcccacccagcagcgcatacagcaggctaaagccacgtatgccgcgcgccgtcagcagttgctggccgcactggcgcggcgcgggctggcgaacgctgcagcatcaacagcggacagttcattcgcgtcagcattgcgcggctgccggccgatcagctcgacagcatcgccgatgccgtggcgattcaacgtagccttctcgcgcataaaactggttggctttcagtcgcgaggcgtgacaatgcacttccatgcggtcgcagccgcgggcgcgcgccagttgctcggcgtggttcagcagttgctggccgctgcctttactgcgctcgccctcggcgatacagaaatagctgatgcacgcgaaatcgcccgctaa

SEQ ID NO: 89623 - DNA, 1027 bp, Glycine max
  Peptide Sequence Number=SeqID_206401
atgcgacatcctgttaccggtatcatgttaagggtaacattgacgggaaagcacctggtgcagcgggtgaatttctgttttgcgaaggtgatcaactttttgtcggagggttatcagaatgtttgccccggcagcggcgtggcttttggttacactagctgttttatgccaaccgataaggatctgcaggtgagtgagaatctgattgagctgtacagtaatcaacaaaccctgtttggccgtggcagcatcgaccgcctggtcccgctgctggcggcgaatccgcagcccacgctgctgttctgcggccgctcatttctcaacagtccggcgtgggcacgtctgggcgcgacgctgaacgatcacattctgggctatgaaattgtcagccatgaagcctcgccagacgagatcgatggctgggtgacgcgctggcgtggccacgtcgatcgcgttgttgccatcggcggcggcagcgtgctggatgcggccaaagcctttggcgccatgatgcagcatccgctgaatatcgcgcgctacctcgagaaagtgggcgatacgccggtacaggcggtcacgctgccgctgatcgccattcctaccaccgccggcaccggcagcgaagtcacgcagaatgcggtggtaaccgatcagcagcacattaaggtgaaggcctcgctgcgccatccggtgtttgtgccgcaggtggcgattctcgatcccgatctgctcaaaggggcgccggatcgcgtgctggccacctgcgccattgatgcctttacccacctgttcgaggcttatctgtcacgcaagggcaacctgttcagtcagcaaaacgcgctcaacgggctgcaactgttcatgcaggcgtggccgtacctcaatcaggacgacagccgcggcgatgcggcacgtgaagcgatgatgatggcatcatggctcggcggcatcagcctgagcagcgcgggtttgggggtggtccacggtattgccggcgagctgggggcgattaaaccgttccatcacg

SEQ ID NO: 89624 - DNA, 459 bp, Glycine max
  Peptide Sequence Number=SeqID_206402
atgatttccgtcgataaaggcccagtgctcgccgcacggcggatcatacagaccgcgtgcccgccagtcatcgacgcgatagtctggaccgcgaaactccggcggtgccggataaccacggcgaaaatcatgaccgcgccaggcaaagcgatcgccgccgcgatgtccctccggcatacgatgatcggcatagtgatcgtgacgatccgggcccggtccacgatcgtggccaaagtcacgacggtcatgatgatcgggacccgggccgcgatcctgatggcggtcgccgccgtgcgaatcccagcgaggatcaccgggaccgtcggcccaggagacgctggaaaacaggataacggcagtctgcgcgccgttgaggcttactattacctaaacaaagctaaaacagcatttccaaaactcttaaaaatcggtgacttacaatacattacgccaggttag

SEQ ID NO: 89625 - DNA, 1314 bp, Glycine max
  Peptide Sequence Number=SeqID_206403
atgtcaggctatatgcgatacatcatagaaaaaggagaatcgacctttctctatgataagtatcagaatcaactcatcatctctcagtttctgcgtaagctggatactcccccaaaccaaacagaggtagaacaggtctgcaatagcgtacaacacaacggggatgtcagtggtttgaatatcgccggatatacctatcaccagttgcatggcacgctaagcgccgcgcatgccgactgcggcaagtggcgtggcgatattcctgcactccaggcattcgatcgcgcggttgccaaaaatgatagctggcagccagaggttcccgcgacgctcaaatcagaaaaacgctttcgctattacatagacctggacagtaaactgggtattagccaggccagccttgatggtttagaacagggtcgttcgctcatctcgaccgtgtatgttgatgcgatgacgggaaagaatattttatcgtttttaacgccagtgtatttcaaggataagctgaaaggcgtagtgatggtcgatgtgaccgcgcaagagattgaggccttgttatacaccagcgaccgacctttggtgtggcgctatctggatattaccttgaaggattccgataccggcgcgctcattgaggtacatcatagtaaaacgcacctgttgaattacgcccattacacccatcaggtagcagaaaacttacggataacgctgtctctggatgttatgtattttctgcttagttcatggaaactcttcctgttttatttactctctaccgccgcattactgcatctggtgcgggttcatttccgcctttataactcggtatcgaaagacaatatcagcgataccatgaccggcctttataatcgtaaaatccttaccccgatgctggagtcgcgcctgcaacgacttaccgcgcaaggggttaacgtggtaacgatggcccttgactgcgatggactgaaaaagatcaacgatacctgggggcataacgccggcgacgaagcgattattctactggcgcaggctatttccgcatccattcgtagcagcgattatggcgtgcgcttaggaggcgatgagttctttctaattctgatcgattatccggaagctgaagcggaaaatatcccggcgaggatccggcaatatctggcgattcatgaccatcaacagcgcgtcgatttctcctggggcgcagcaagtcttgcgccagaacagtcgctcagcgaagcaatgaaagctgccgatgcgcgcctgtatatgaacaaaaagcagaaaaaaagccccggcattcgcagataa

SEQ ID NO: 89626 - DNA, 158 bp, Glycine max
  Peptide Sequence Number=SeqID_206404
atggaggaaccatcgaagaagtggaaaggcacttcaagtcgaagtcagcggcattccgggtcacaggaaaccccaattccttccttcattccctctggaccattgttctcatcagaggaatgttggacaactggcctcagatatcttaagaagggggg

SEQ ID NO: 89627 - DNA, 429 bp, Glycine max
  Peptide Sequence Number=SeqID_206405
atggagagcctgcaggttgtggctccaccaggaatcatcttgacagttgagccattcatggagaaggtagcctggccaggaactcagccttcccttgtgagggaaggtgaaggtcccaatgctcaggcaggagggacacaggtaaggcaaaaggctgctacgccaaagaggtcaccacagatttcaccagatccaccttcaccagtggtggatcaatcttctcctcagcagctagcagaccctcctacgccagtgcatgagatgccagcagacccttctactccattactggagattctagaggaccctgccacaccagtcctaggactgactaccactccttcaaccactcatgtgctacattttacagataaggagggcactcaggatcaggatacccagcaggatgaccagtcacatgagttttaa

SEQ ID NO: 89628 - DNA, 1304 bp, Glycine max
  Peptide Sequence Number=SeqID_206406
aggactacacatcctcaccttcagagggctacacgtcctcgcctttagagggctacacaccctcgaattcagaggactacacgtcctcgcctttagtggggtacacgtcctcccccttccaaggactacacatcctcgccttcagagggttacacgccctcacctccagaggattacacgtcctcgccatcagaggactacatgtcctcccctttagagtattgcacgtcctcctctttagagggctacacgccctcgccttcagaggactacacgtcctccctttcagaggactacacgtcctcaccttcagaggactacacgtcctcgccttcagagggctacatgcccacaaaggattacacgtccttgccttcaaaggattacacctcctcgccatcagaggactacacatcctcacctttagagggcgacatgtcctagcctgcagagggctacatgccctcaacttcagaggactacacgtcctcaccttcagaggaggattacacgtcctcgccattagaggactacacgtcctctccttcagagggcttcatgccctcaccttcagaggacttcacgtcctcgccattataggactagacgtccttgccttcagaggactacatgtcctcgccttcagcgggctacacgtcctcatcagcagaggactacatgtcctcgccttcatagggctacatgccctaacctttagaggaattcatgacctcgccttcagaggactacatgtcctcgcctttagagggctacacgccctcagcttcagagaactaaacatcctcgccttcagaggactacacgtcctcaccttcggaggactacgcgttgtcgcattcaaagggctacccgtcctcctcttaagaggactacacgtcctcaccttcagagggctacacgcccttacctttagaggactacacgtcctcgccatcagaggactacacgtccttgcctttagagggctccaggccctcacctttagaggactacacgtccaccccatcaaaggactacatgtcctccaaatcagaggactacagatcctcactttcagaaaactacacgtcctccccttcagaggactacacgtcctcaccttcagaggacttcatgtcctcgccttcataggattacacgtcctcgccatcagaggactgcacatcctctccttcagacggttacacgtcttcaccatcagaggaccacacgtcctcacctttagaggactacacgtcctcgccttcagaggactacacctcctagcctttagagggctacgt

SEQ ID NO: 89629 - DNA, 393 bp, Glycine max
  Peptide Sequence Number=SeqID_206407
atgggtattctgtatcccaacttggcatcctcagtgagacgttttctccgaggataccgcgtctcgctctcttccgtaatcctcttgcagcacgccggcgaggaaatcattactgccggccagccagacacaatcgctgccggaccattcggccaatgcctgccatacctggcctttcagctgtttccagcgcccgacgatgatgtcgctgttcatggccggccctccccgactttgcaggaaaataccggccggctaagggcgccggcggccggtgaacaggctgaccaggaacaggataatgccgacgacaaacacgattttagccgcccaggcggcggtgcccgccagcgaaccgaaccccagtgccgcagcgataagcgcgatgactaa

SEQ ID NO: 89630 - DNA, 321 bp, Glycine max
  Peptide Sequence Number=SeqID_206408
atgtggatcttatcattgaagaagctgaatctaatggtgaagttgcttctacttccatggttgtccaaaaccagagaagcccttactcaagccttattggatcatgctcatgttgaaaaagaggctcacaggcggtccatgattggggattacttttataaggagaccactagttggaaacctcctcatactccaatgcctccttgtagtcctattcatctctcatctgattctgctaactttggtgatgagtttcttaggaagcctgatgaggaagttgccaaaaaaggaaaagaaatagtaaaagttaaagtaagctga

SEQ ID NO: 89631 - DNA, 309 bp, Glycine max
  Peptide Sequence Number=SeqID_206409
atggtgataggaggtgaagctcttattatccccagttattcccaggattccagaccaatagtgtataatggtcttactggaccacagcttttaaaatcgatcaatgcgaaattgaaggaagaaccaaacgagctggagggttataggaaagaggatttcaagattttgtggatccccatagaattcaatttccaaacaggtattgatctgataaaagaggtattcaattacaaaggtaaccccattatcatgctcataagccctgagggtaaagttgaaaactctgatgcaaagcagattatttcctaa

SEQ ID NO: 89632 - DNA, 216 bp, Glycine max
  Peptide Sequence Number=SeqID_206410
atggaaatgggttatgtatattctctccaagatctgatcgtcactgacttcaaatgggttcagcaggagcttctcctgtggcatagtgctactggaaacttgcttagacatgttggtgattcaccctaccaatcttccaaaagccaagaaaagtacactagtttaaaatgcaaagccaaaataacgagcttcagtatggatcaagaaagagagtga

SEQ ID NO: 89633 - DNA, 645 bp, Glycine max
  Peptide Sequence Number=SeqID_206411
atggcatcttcaaattcaccatgtgcagcatgcaagttcttgcgtcgcaaatgccaacctgagtgtgcatttgcaccatattttccccctgaccagcctcaaaagtttgcaaatgttcatagaatttttggggcaagcaatgtcacaaagcttctcaacgacttgcaccctcaccaacgtgaagatgctgtcaattcccttgcttatgaagctgagatgaggctccgtgaccctgtctatggttgtgtaggagtcatatcactcttacaacaccaacttcgccagcttcaaatggacctctattgtgcgaaatccgagctctcgaggtaccaaaacttgagcatcaccaccaatttgagctctctagcttccgagtccgcgaccacggcctatcatcaccatcaccagaacatgtctggtgctggtgctggtgccggccgtgaccatcattatcactatcatcgccatcatcagttctttccaagggaccaacaccaacaacaacaagtggtgagaagctttgatgccggcaacaactatgatgcaagtcttttggccatgaacatatccgccaacttagggcaactcaaccagcttcagcatcatagtgcagctggcgggggcgacgaccgcaactgctcctag

SEQ ID NO: 89634 - DNA, 588 bp, Glycine max
  Peptide Sequence Number=SeqID_206412
atggcaaagcagaagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgccccccccccctttgccattcagacacagtcgtgttcgatggcaagcagagaccaagtttggtcattctgcacacatgatacgcggagataccttacggttatccgcccccctttgccattcagacacagtcgtgttcgatggcaagcagagaccaaacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgcccccctttgccattcaggcacggtcgtgttcgatggcaagcagagaccaagtttggtcattctgcacacatga

SEQ ID NO: 89635 - DNA, 234 bp, Glycine max
  Peptide Sequence Number=SeqID_206413
atgacttcctatggtgtggtgtctccattcatctttctccttctccattctgctgcaattagacctcaagaagcaaaggaatctattgatgaagaagatccaaggcctacaagctccacatggagctacatcacacacttactccgaagggttaattcgagtctcccaaatggtcaaggtgtgactatcttaaagaatgtacttgagttaatcactcaaggtgaaatcttttag

SEQ ID NO: 89636 - DNA, 471 bp, Glycine max
  Peptide Sequence Number=SeqID_206414
atgcaacacccggggccccattccattggtaagccccacccacccttcctccttcaaaatctacttcattgtggccgaaaccccatcgtacataacaaccgcaaccttgctcaccccctcgcctcgtacccgcatcatcaacctacgtcatccaatggtgtttctcacgacgtcgatatcgccctagcaagggtgccatacaaaacactctgcaccggttccaacaaacacttgccactagcggcccttcatgctggcctgcatttgttgcatgatgagctccttcaggcccatgatcgcggacaacatgatgttccccatggcattgactgtgggagggataagcagggtgtggatctagtcttagaggcgttgatggagaggtgcccttggtccctcttgcgatggcttgggaaccatagagggggagtcagagagtgggagagagtagagggagacatcaaatattaa

SEQ ID NO: 89637 - DNA, 1137 bp, Glycine max
  Peptide Sequence Number=SeqID_206415
atggcccgcacgaagaaaacaggggaaatgacgactgaggccgcaaaggaaatcgctgagaagattgattcttttgaggagcaggccacacagggatccttcgtccctcatcgacgtcaggatgttctcgccgctgctattggacgtccagagcaccctggatgtgtccatgctgctggatccggtgtcaccatcaatcaatactttggatcggctccacggacgtcccacagcgcttcctccctgcctcctgacgaattgcaacagctgaccaagcaaatcagggaccagctagaggagtccatcatacagaatgtgacgaggcaggtcatggcatccttcagccacttgcagtcccagcttcagtcgcagatgcaatctcagggacttgcagtgcctcctgagcctctggttggtccctccggtcctcgagtgagcacaaaggggagttgcgttgatccctcaggaaacgatcctgagacgggtgactctgacaggtgcggcttgtacatagaagcagatccagcccgcctggttgccatggggagattttatgagggatccactgttgttcataatgctcctttgttgcttggccaagtcaaggtgagtgtggaggaggttacagatgcagatgcttcagttcctgtacccactgatgaggtttccttagaggggcaggcactttacaccttccttgcttggccgacacatctggtcatgtctttatcacagcaggtagctgtgtctccgccaaaaccacctccgaagcccgatccggaggtcgatgatccgctttatctgatgacattgaccatcccagagcttttcttgaggccttatcaggttagatgggatgccaccgtattcggggtcgtcaatccagatttccccctgtacataaagcacgaagacctctccgaaatcgcacacggtggtcaatgtctcagcatatcagtgttacagttgtggattctgcatctcactgaaacatgtatgcgagcggggaattctgatatctatggattcctcgagccacagtccattcagaggtctgggcaatcgcagtttgaatctgaaagttccactgcagcggacactggcagatggtggtcatcctgcccaaggaacacttag

SEQ ID NO: 89638 - DNA, 330 bp, Glycine max
  Peptide Sequence Number=SeqID_206416
atggaggaattccttgttgtatgttatgatggtgatatgataccaacttatgaagttattattttcaatgtcctcatggatgattgcgttgaatacgaatgcataaagcttaaacatgacaagcatgtggcaaagatgtttttcatctttgttgaatttgttagtcttatatcgattaagttatgcaatatgttaagcagatcttccgaagagatcataactcttatgtgtaaatcaagatttgccgaagagatcgtatgttttatgcgtgaaacaatggcgacaactaatactaatgatgaaaggagtgttagttggagtaaaccatga

SEQ ID NO: 89639 - DNA, 324 bp, Glycine max
  Peptide Sequence Number=SeqID_206417
atggaggattgccttgagggtcctctcttaggcaatcatggaacacagctccaactcgaaaatggaggtcacatgaatgacaacgcaattcattcatggggctccgaaaaaagctcaaactcaaaagtggaggacacattaatgacaacgcaattcattcatgtggctctggaaaaggatgagaatggaggattgcctttagggtcctgtcttaggcaatcatggaacacagctgccaactcgaaagtggaggacccacgaatagccctaagcaataacattcatgtgactccggaaaaggatgagaatggaggatttccttga

SEQ ID NO: 89640 - DNA, 345 bp, Glycine max
  Peptide Sequence Number=SeqID_206418
atggaccaaaaagttccaaccaagctagtagacaacaaagaagtggagaaaagtgaagatgaatatgatgaagacgacatgaagagtttggaattagaagcaaaagcaaaaaatattttacattgtgccttaaatccagatatttttgaaatattttcagatgacccaaaatcagccaagcaaatgtgggacgagcttgacagatttttttttgacagggaaatgacaggtgccaactctccaactccacaaggacaactctccaaggatccaaacacaccagatgctactcaatttaattctcctgacctttacttttttcaggatacaagtacggttaaataa

SEQ ID NO: 89641 - DNA, 1122 bp, Glycine max
  Peptide Sequence Number=SeqID_206419
atggccttagaaatggcaagagagtgggaagagctagcttatgcacgggatgaaaataaggacacagctttgcatctcttggctctaaatcaaaaccctttggattcttgttgtcattgttcagagattaaagatcccatccagatcaaccctgaagttggtaattttggattcttgtcagagcttattagtgcttaccctagcatgatcatatgggaagtggacaacaaaaaccaaagtataattcacacagcagtttcatatcgccatgctagcatcttcaatctcgtacatgaaatagggtccattaaggatattataatatcatattttgtcaaagaaaacaacccgttgtgttttcaaccaaaaaataagaacaacactttattgcatttggctgcaaagttagccccaccagatcgacttgaattagtttctggagcagcattccaaatgtgcctcgagatcatatggtttaaggaggtgaagaaaataatgccaccatcattcataaagttgaaaaattctgatggcctaactgctgaagaattatttacaaaggagcatgaaggattgcgaaaagaaggagaggaatggatgaaacgcactgctgagttttgtatgcttatatcaacagttattgccacagcagtgttcgctgctgctattaacataccaggtggtatcgatgatggcacaaataaaccaaattacttgaacaaagcatcattccaagtatttgcaatatcagatgcagctgcattcgtcttctctgcaactgcaatattgatattcttgtctattctcatctcacgatatgcggagtatgactttcacaagtcactacccttgaagttaatatgtggactgataactctattcatctccatagcatgcatgatggtagcatttggcagtgccttcttcataacgtactactatggtttgaaggcggttcctgatataattgcagtacttgcatgtctaccattgcttctatatataggtttgcaattttcattatggtcagatatcatctactcaaccttctattgtaggaatctatttaagccaagtaaacgtatgatttatgtagctactaaagaattagggacattgtaa

SEQ ID NO: 89642 - DNA, 1492 bp, Glycine max
  Peptide Sequence Number=SeqID_206420
gcttctccacctgtccaaaccaggcatttcaaccggtgttgttcctactgctgctgcagctgctgcatctctaatgtctgatggtggggaggaagccaggcacaggtacctcacccaatgtgttccacttcacaaagcagcactaaaaggagactggaaagaggccaagaaaatactagaccaagaccccacgctactcaagtctgccataacaaaggggtgggcaacagtgctccacattgcagtcggagcaaaccatgaatgctttgtagaggagttggtgaaactactttcacgcgaagacttagaactgctagatgacaagggaaacactgcattctgctttgctgcagctgttgggaacgtgcacattgctgaaatcatgcgcataaagaatgaatcgttgccaactataaggggtggagaaggagtcactcctcttcacttggctgtgttacaaggacggagtgaaatgactcggtatctgtttgataaaactagagaaatactctatgatgatgattggattacactgttcctcatttgtgtaaactctgggctctatggcaagaacatgaaggaccctccggtccttaaacttacaagacgcatctgggatatatttcttacccttgatgactctgagatgatggatgcaataagagaaccatcccaagtaacatttattgccgcagaagaaggcaatttcgagtttctatctgtgattatgagcacttatccggatttgatttgggaattgaatacgatgggtcgtagtataattcacgttgctgccttacaccgacatgctagcatattcaatttgatacacgaaattggcccaagcaaagatttcgtgttaacatttttggatgatgaaggcagcacgttactccattctgttgcagtaatagcaccaacagatcgacttaatgtagtttctggagctgcttttcaaatgatgcttgagttgacatggtttgaggaggtaaaaaagatcatgctaccatcatttgtagagatgccaaattatgaaggcattattcctcgagaactattcaccaatcagcatgaagatttgttgaaaaagggagaatcttggatgaagcgaacagcaagttcttgcatggttgtctcaactctaattgcaacaggagtgttttctgcagctttcagcgtcccaggtggtatcgatgacaagttaggatctcccaattatttgaagaaacctttattcacggtatttgctttatcagatgccttggcattgaccctttctacgacctcaaccctaatttttttgtccatactcatctcacgttatgctgaggaagactttctcagcataacctttgatgaactttcggtagaagcccgtgagtccaaggaagcctcgcaggtccctttggttgttggggactggccactcgagcatcacgataatcttggagtggtctggttctatcctattagtggaaataacatgtcctaa

SEQ ID NO: 89643 - DNA, 580 bp, Glycine max
  Peptide Sequence Number=SeqID_206421
gcttgaaaacgaggtcaggaagctaggggagcttctagtaatcgattaccaagcttcaaaagggaactggaagactgtggaggcctctggtaatcgattaccagtctgtgtaatcaattacacaggggaatgggtcactggtaatcgattaccagtctgtgtaatcgattacacaggggaatgggtcattggtaatcgattaccagtgcctagagggagcttgggagaccctcgaaggaaacgcgaggtgccgatttcggggaatgaattggtgcatccagatgaacctgcacgtacgcttcagcgcacgatggagtggatactacccacgcctacaccatatcgtctaggggagccagtacaagtgatcgaagtaacgtcgtccgaggaagaccctgaggaggatcttgaggagctacctctcgagcctgctgtggatgctcttgactttttggagggtgatgaggacccacttcctgaggtggattctcccgaggaagtcatgtcggcatctgaggcagactctacggaggatagtggccctggagagatggcgatcagcggaggctcttcatcctag

SEQ ID NO: 89644 - DNA, 243 bp, Glycine max
  Peptide Sequence Number=SeqID_206422
atgagggaggggatttttgggtggaaagaaactccccctccctcgtttttatgtttccaggtgcaggggtgctcgcccaggcgagctcagctcgcccaggcgagctcagctcgcccaagcgagctaaccctgatactaggctgcctcccagctactctttccgcttgtccagagatgggcatgggacgaagatctatcgatcgtgatcctagcctctactcacgtccgtccccaagtacctga

SEQ ID NO: 89645 - DNA, 400 bp, Glycine max
  Peptide Sequence Number=SeqID_206423
gcgaatgggccctgttcatagacattctcgcactgttgatctatggaggagtcctctttccaaatgtggatgggttggtggacttagcagtgatcgacgcttttctcgcctatcatgaccacaaggaaagcccgattgtcgctatgctagccgacctatatgacacctttgaccaaagatgtgagaagagaagtacgaggattgtttgttatactccggtgtcataccctaatttcgtccggggacctttgcttgatgacatgcgacctttctttggtccttgtgagtcgaagtgcttccgtaacgcttccgtaagcgattctgtggaaattcttcatcgttcttcgtcgttcttcaccgttcttcatccgttcttcgttcgttcttcgttcttcaacgg

SEQ ID NO: 89646 - DNA, 618 bp, Glycine max
  Peptide Sequence Number=SeqID_206424
atgtatctcggcattgatattggcacctctgaactcaaagcgctgatcgttaacccgcagggcgagattgtggcgtcgaatcacgccacgctcagcgtgcagcgtccgcatccgcactgggcggagcaggatcccgagcgctggtggcaggcgtgtggtcaggcgatcgccgggctgcgccagcaggcgccggacgcgtgggccgcgattcgcgccatcggtctctccggtcagatgcacggcgccgtgctgctggatgccgccggtgaggtgctgcggccgtgcatattgtggaacgacacgcgcagcgcggcgcagtgtgatgcgctgcgccagcatcatccgcagatgatggaaatcgccgccaatctgattatgcccggctttaccgcgccgaaactgcactgggtggcggaacatgagcccgaaatcttccgccgcatcgacaaggtgttgctgcccaaggattacctgcgctggcgtctgaccgggcgctttgtcagcgagccgtcggacgccgccggtacgctgtggctcgacgtggcgcagcgcgactggtctgacgcactgctagcgattagcgggctgacgcgcgcacagatgcccgaactgggttga

SEQ ID NO: 89647 - DNA, 180 bp, Glycine max
  Peptide Sequence Number=SeqID_206425
atgtcgcttggggactggatcaaggtgggcatatggatcttcatttggtaccccatggaagagattgccttgaataaattaaatgagagaatgtggataagtgatattcgctgcatgaacttcgggtcgggctatgctggtaaagtattgaggtgtaaaggaactaaagtagtcctctag

SEQ ID NO: 89648 - DNA, 369 bp, Glycine max
  Peptide Sequence Number=SeqID_206426
atgtcggagcgtggccatggaatgtattacacgccacaaacatttgctgagtatccgacacagatgtatcagtatccttttcagggtcatcacactgatacttctgcaagccagcaatcgttcggtggtgttgcggaaacacaagctcatttttcatggcccacaatgaccccttcacagcaatatcatggcccaattccaacacctaatgccccgttaggaacacaatggaatgtaccgggacaaatacctaatacgggtgacttattcggtgttgatttgcgtcacgcattttctgcggaggctgacgaagaagaagcggggaggcatcggggcagaagaaatcctgatcgccaagcacgaagatag

SEQ ID NO: 89649 - DNA, 666 bp, Glycine max
  Peptide Sequence Number=SeqID_206427
actatctgctggcggcggaagcagcgcagcagcgcggcgacgaaatccgtgctaaccagcatctggagcgcgcctctgagctctccgagaacgataccattccggttgagatcacccgcgtgcgcctgcagctggcgcgtaacgaagatcacgccgcacgtcacggtatcgatcgcctgctggaagtggcgccgcgccatccggaagtgctgcgtctggccgagcaggcttatatccgcaccggcgcctggggcgcactgctggatatcctgccctccatgcagaaggcgcagattaacgatgagaaccagcgtaacgcgctgcagcagcaggcatggctgggtctgatgaatcaggccatggccgatcagggcagcgaaggcctgaaaaaatggtggcagaaccagagtcgcaaaacccgtcaggagaccgcgctgcaggtggcgatggctgagcatttgatcgagtgcgacgatccggacaccgcgcaaagcatcgtgctggaagggctgaagcgtcagtatgacgatcggctggtgctgctgatgccgcgtatcaaaagcggtgacccgcaggcgctggagaaagcgctgcgtcagcagatcaagcagcacggcgccacgccgctgttgcacagcacgctcggccagctgctgatgcgtcacg

SEQ ID NO: 89650 - DNA, 804 bp, Glycine max
  Peptide Sequence Number=SeqID_206428
gcctttagaggactacacgtcctcgcctttagagggctacacgccctcgccatcagaggactacgcgtcctcgccttcagagggcaacgcgccctcgccttcgtagggatacacgtcctcaccatcagaggactacatgtcctcgccttcagagggcaacacgtcctcgccttgggtactagtacccccaccttcaatgggctgcatgccctcgcctacaaaagactgcacgtcgtcaccttcagaggactacacattctcgcctttagagggcaacacgcccttgccttcagaggactacacatcctcgcctttagaggactacacgtcctcgcctttagagggctacacgccctcgccatcagaggactacgcgtcctcgccttcagagggcaatgcgccctcgccttcgtagggatacacgtcctcaccttcagaggactacacgtcctcgcctttagagggcaacacgtcctcgccttgggaactagtacccccaccttcaatggggtgcaagccctcgcctacaaaagactgcacgtcctcaccttcagaggactacacgttctcgcctttagagggggacacgcccttgtctttagaggactacacatcctcgtctttaaaggactacacgtactcgcctttataggagtacacgacatcgccatcagaggactacgcgtcctcgccttcagaggactacgagccctcgccttcgtaggggtacacgccctcaccttcagaggagtacgcgtccccgcctttagaggagtacacaccctcgacatcagaggactacac

SEQ ID NO: 89651 - DNA, 1733 bp, Glycine max
  Peptide Sequence Number=SeqID_206429
agcatctggctcagcaaatagaccagcagaatttgcccgatgccgatggccggcggcagcagccagcacgggatcgccagcgccagcagcaggtgcgccgccttgcccgccagaaactcgcaccagccgcgcacgccctgctgtgccatgcgcgccgccacccgggtgcgtcccgcccgatccagccagtcgaacagccagatgtagtacgggaacgtcagcgccgccaccagcggccaatagtaacgctgggcgcgcataaagggccgccagcgctggaacggcgtttgccgcagcacgccgttggcgtcgatgtcggggtcgtaatgttcgatattgttatgggcatggtggaacagcacgtgccgcacgcgccaacagtcgggatccagccccaacgggacgctcaccagggcgttcagccagcggttggcccagggccgacggaaaaacgcgttatgcgaggcatcgtgcaccacgttcaccgctcagcccgtaacacaggccgcacagcgccagcagcagcgccacctttgccagcatgccgccgtcggcgaagcggtgatcgccgttggccgccagataatgctgggcggcctgcatcagcgcgcgatgcaggccgccgtcgtcgcgccgataggctaacggacgcagcgctttcatggctgccccataaggcgcaagaagcgctgttgctgcgccagcagttcgcgatagccgatgcagcgatatgccatgccgtgccgctgcgccacttccgccagcgcggcggccagcgccggatagtggcggtgattccagccgggaaacaggtggtgggtcaggtgatagttcagcccgccggtcaggtgctccagccagcgcggctcgggctgccagtcgcaggcggtggcgaaattgtgccggtaccaaccgtgcggcatgctgtcgcccgccggcgccggatagaactcggcctgcgcccagtgggtgcccagcagcaggaacaccaccagcagcgaggcaaacatctggctgagcgcgtaagccaacagcacccagccccaaccgatgccgtgcaggtggcacaggatcagcggcaccaccagcaccagcgccacatgaagcaatttgcacagcacgaacagcgtccaaccgccgcgccccgccagcacgcgtttttcccgcagcggcgttttatcgagccgatcggaccaatcgaaaatccacgcgatgtagggcagcgagagcgcggcgatcagcggccagtacagatgctgatagcgcatatgcggccaccagcgctggaacggcgtctggcggaaaaagccgttctcttcggtgtccagatcgtagtgttcgacgttggcgtaaacgtggtggtaatccacgtgccgcgtgcgccagtagtccggatcgacgcccagcggcagcgtcaccagccgccccaccaggcgattggcccagggcgcgcgcaagaaggcgttatgcgaagcatcgtggttgacgttgacgttgagcagcatgcccatggccacgaacaggaaatagcagaggaaaaatgcccagggctgatgctgcatcaggctcagggcataaaacccgacgcacagcgccagcaacagtgcggccttggccaatcgcgcggcatcggcatagcgatgatcgcccgccaggcaggcgtgcgccgcgcgcttgagatcgcggtgaaacgcctgctcgccatcggcgggaaaacgcagcggcggcaataa

SEQ ID NO: 89652 - DNA, 378 bp, Glycine max
  Peptide Sequence Number=SeqID_206430
atggcatccaagaaaagaaaatctccttctacacctacccaagccagatttgataggtccagattcacatccctagaggcttgggagagatacactgacattgtggtgcctcgaaagctactaccagagaggaatgtggtagtttattacacagagtttgacgagatcaaggaggaactcaagagaagacattgggatgagaagctgactgatttttctaacagtagcatagacatcgctattatgaaggagttttacaccaacctttatgaccctgaggataaatcacctaagcaggtgagggtgagagacccttgtagtgttggaggagggggagaatttgtgtacatattccagatttgcactcctgaggcctga

SEQ ID NO: 89653 - DNA, 899 bp, Glycine max
  Peptide Sequence Number=SeqID_206431
cgtgcgcgtaggccaccaggcgcgccagcggcttgatgccgcgcttggccgccaccgacgcgttcatcagcaccagcgcgccggcgccgtcgttcaggcccgaggcgttgccggccgtgacggtgccgttttctttctggaacaccggcttgagcgcggccaggctctcggccgtgacgtcgcggcgcacgtgctcgtcggtatcgaacaccacttcacccttgcgcgtcttctgcacgatcggcacgatctggtcgcggaaatggccggcctcgatggcgttggcggcgcggcggtgcgactcggccgccagcgcgtcctggtcctggcggctgatgccgaactgggcggcgacgttctcggcggtcacgcccatgtgcatgcggccgaacggatcggacagggcgccggtcatcatgtcctgcatgatgctgtcgcccatgcgcgcgccccagcgctgcgccggcgcgatgtagggagcgcggctcatgctctcggcgcccgcgccgatggcgatgtcggcatcgcccagcagaatggtctgcgccgccgacacgatggcctgcaggccggagccgcacaggcggttgacgttgaaggccggggtttccttggcgatgccggcgttgatggcggccacgcgcgacaggtacatgtcgcgcggctcggtgttgatgacgtggccgacggcgacgtggccgacttcgtcgcccttgacgccggcgcgttccagcgcggccttgatgacggccgtgcccaggtcgcagggcggcacgtccttgagcgcgccgccgaaatcgccgatagcggtacggacggcggatgcgacgatgacttccttcttgatgggtttcctcctggtgatcccttcatcatactcgcgccgccgcgctgtcccg

SEQ ID NO: 89654 - DNA, 353 bp, Glycine max
  Peptide Sequence Number=SeqID_206432
gggtagcacccacaagacacccagtggacccggaggagcccaacagggccctggggtttccagctctggttacgggcctctgtcagtcctacagggcgcccgtccccccagcaagttcatgccatcgtgacatagggatcacgcctgcaagacactcagtggacccggagaaatccaacagggtcctggggtttccagctttgattatgggcctctgtcagttctacggagtgtctgtcacccccagcaaggtcatcaagccccctactcaccgagctttcatcaagaagtactgcgtgatggaagcttgcttgtggagcttctatggaggctggatctttgagcttcaatga

SEQ ID NO: 89655 - DNA, 273 bp, Glycine max
  Peptide Sequence Number=SeqID_206433
atgcctaaccaaatgttgaaggtaaaaggcgtgtcaaaactaaggcatgaagtctacatcattgaaacaggccgacaacaaggtgatcccaccaatggaaggcccccaagagcacgctacatgaagcacactaggccaacccaacacaatcccacaccgcccaaggctgatgaaaaaattaaacaagtaaataacacaagagaattgttaacccagttcggtgcaacctcacctacatctgggggctaccaagccagggaggaaatccactaa

SEQ ID NO: 89656 - DNA, 225 bp, Glycine max
  Peptide Sequence Number=SeqID_206434
atgcctatagtaatcattttcataaaatttggtgaaagcttctctctgggttccttgttgaaccaatctcagacttatcaaggtaatccttgtggcgtctaccctgacttatcttccttcatcggaagtggcgtctaccctgacttatcttcgttcaatggaagtggccccgtaagtttttctaaaagtcataactcttctaatggttctcttgaccagacatga

SEQ ID NO: 89657 - DNA, 1549 bp, Glycine max
  Peptide Sequence Number=SeqID_206435
atgtacaccgtgacgctgaacaaatcgtttcgtgatttgggtgttaccgcttacctcagttacacccatcagagttactggaaccgtccggcgagcgataacttcagcctgtcgatgtcgcgctactttgacattggccgcctgaaaaacgtcagcgtttcgctggcggcctatcgcaacaaatttaataaagtcaccgatgatggcgcttatatttcgctgtcgttcccgttcggcaacagcagcaatatcagctacagcgctgatgtgaagcgcgatgacaccagtcacgacgtcagttattacgatcgcgtcaacgaaaacagcagttatcagctgcgcgcaggccacagccggcgcggtaacagcatgggcggttacgtgtcgcatcacggcgatatcgctgataccaccgccagcatcaactatcaggaagggcagtacagcagcctgagtgtgtctgcccagggcggcgcggtgctgacccctgaaggcggcgcgctgcaccgcaacatgatgctgggcggaacccgactgttagtggataccagcggcgtgcctgacgtgccggtgcgcggctttggtgcaccggtatacaccaaccgctttggtaaagcggtgatcagcgatgtcaacagctattaccgcagcagcgcccgcattgactttggcaaactggatgacaacgccgaagccacccgttcggtggtgcaaaccaccctgactgaaggcgccataggctaccgtcgctttaacgtaattgccggtgctaaagcgatggcgatcattcgcctggcagacggctcggtgccgccgttcggtgccagcgtgatgaacagtaaaaagcaggaaaccggcatcatttacgatcagggcaacatctatttgagcggtgtccatccggcggaacggatggacgtgagctggaatggccaggtgcagtgttccgtcacgctgcctgccacgctgcctgatgacctttctggcgacgctgctcacgctggcgaccgcacagcaggcgctggccgcggtggcgctggatcgtacccggatgagcagggcaataagctgaatggcccgctggtgctgctgccgccggtgcagcgcatcgagccgggtgaaaagagccagatgaaggtgcaggcgctgccggcggcggcacagctgccgcaggatcgtgagaccgtttactactttaatctgcgcgaaatcccaccgcgcagtgaaaagcccaacgtgctgcagattgcgctgcaaacccgtgtgaagctgttctaccggccggcggcgatcgtaccggatcgcaaagcgatggagaatccgtggcaggagcagctgacgttgacccgtcagggagatagctacatggcacacaacccgacgccgtattacatcaccctggttgatgccacgacgcacaaggaaggcaaaacggtggcgggctttgcgccgctgatggtgccgccgaagggcagcattaagctgggcggcagcgccagcgcgctgggcaacgcgccggtgttaacctacatcaacgactacggtggcc

SEQ ID NO: 89658 - DNA, 316 bp, Glycine max
  Peptide Sequence Number=SeqID_206436
atggataaccatgagcatgcaaatcatcgtgatacagcacaagccaggataaagaataaagtttcttcacctgagaaccaaaattatatgtccttagctaatgagcccgcaattaatagagaaggatattctgatcttggtgatcagctcatgcagtgtagtcactgtaatgcaaatatgtggtatgatgaaagagtcttaaaagataaaagaactacaaatccaagattcagtttatgttgtggaaatggcaaggttgaacttccattgttacagaatccacctaaatatctctaccaacttttgtatgatcatg

SEQ ID NO: 89659 - DNA, 423 bp, Glycine max
  Peptide Sequence Number=SeqID_206437
atgccgagtaggaatagtgccaaaactccaaagaaggatggaaacaactcaaattccagtctttcttctctagaaaataatttctatgaaggagaacgtctcaccaatttgctccaatcaatccgtagggggatccaatctgcaagacatttggatggaagttccttgccagagaagatatggttaaagcaacaattttctattggggtcaatgatgtaactcgtgtccttgagcgcatgaaaccttgcacggagttagaaagctctactgaactcatctctttgagaagcaaccatacagcatcttcagttaagcttcaggttgatttcctctgtttgtctaatgtagaatatgtgtgggtaaagactaaagaagacattattgacgttttacattattcaggctgtgcttgtagcttctga

SEQ ID NO: 89660 - DNA, 216 bp, Glycine max
  Peptide Sequence Number=SeqID_206438
atggctgcggagttagggcaacagacggtggagctatccattctcatcacacatgccgctcacaataagtcattcgatacgttggtgaaatcaaaaggaataacaaaggagcttggatgcagttggatcgagatgaacggtatagtgcatacattcatttatgaagatagaggacatccaagggaagctgagatttattccaagattgatgaaatc

SEQ ID NO: 89661 - DNA, 1434 bp, Glycine max
  Peptide Sequence Number=SeqID_206439
atgatattttccactatgagaagacgtctaaccgatggtggcacttttctcttgcagttggtggatgggtttttggttcttgcattgttcagttgtagcacatggacagtgtggagcagctcatgctgcaatcagataaactcgtacgaagtccggcctcacagtgtcagtattactgaatttggagctgttggcgatgggatcactctcaacacaatagcatttcagaatgccatcttctacctaaattcatttgcggacaaaggtggagccaagcttttcgtcccggctggccggtggttaacaggaagctttgatctcatcagtcatctaactttgtggttggacaacgatgcagtaattcttggatcaatgaactctgacgactggccagttgtggatcctctaccatcatatggtcatggaagggagttgccgggtggaaggcatagaagcctcatttatggacgcaatttaactgatgttgtcataacaggtaacaatggaactatagatggtcaagggagtatctggtggaacaatttttggaacaaaacactgaattatacgcgtcctcatttggttgagttgatgaattcaactggggttctcatttcaaatgtaactttcatgaattcaccattttggactattcaccctgtatactgcagccatgtaacaattcagaacgtcacaatcattgctcctcttagttcaccaaatacagatggcattaatccagattcttcagacaatgtatgcattgaagactgttatataagcaccggtgatgatttaatttccatcaaaagtggatgggatggatatggcatttcatttggtcgacccagtacaaatattaacatccgcaggctcattgggaagacaacgagcgcagggattgctatcggaagtgagatgtctggaggagtatcagaagttcatgcagaagatatttacatttttgattcacatagcgcaattagaataaaaacttctcctggcaggggtggttatgttagaaatgtctatatctctaacatgatcttggttaatgtagatattgctattaggttcactggtttatatggagaacatccagatgacacttatgacccagatgctctaccggtaatagaaaggattactatcaaggatgtgataggggaaaaagtcaaacgtgccggccttatacagggtattaaaggtgacaactttgtcaatatctgcctatcaaacatcacccttaatgtgagcaaaaaattgccatggaactgctcttacgtaaaaggatactctgacttggtttcaccagaagcgtgcgagcctctcagagaaagaatattccctgagcattgttcagactgttactatttgccaaaccacttgaagagtttgagtaatcaaaactggggtgcttggttactgtcttag

SEQ ID NO: 89662 - DNA, 960 bp, Glycine max
  Peptide Sequence Number=SeqID_206440
atggagacaaatttaaatgggatgatgtttggtcaacatttattggacccacgaggaccattcaccaaattagacgctcaagttgcaccatttccagatgataaatctggtcaacggggtcatcctgaaactgatcctgtagaagatgttcttgaacaatcaacctcacagagttggggctcatccaagagtcccaagtttgaagagtccaactctagtgagcttcctttaaaaaaaaccagggtttccgtgcgtgcaagatcagaagctcctctgattagcgatggatgtcaatggaggaaatatggacaaaaaatagccaagggtaatccttgtccccgtgcctattatcgttgcactatggccgtaggatgcccggttcgtaagcaggtgcaaagatgcatggatgacaagacggtgttgataacaacctacgaaggcaatcataaccatcctcttccaccctcagccatagtcatggcaaattctacctcagcagctgcatctatgttcttatcttcttcatgttcaacatctaataataacgaagcactaagtaacactgtaggagtattctcttccatgccctacatcccaatggcaacgctctcaacctctgcaccatttcccactatcacccttgacatgaccaccaacccctctgccctaacatcccctcttccattgcatgcaactacttttcctcagctactaggacaccctgtcatcttcccccacaagatgccacatccattattaggccaacaacaacctttgtttacgacagagacgatgagtgcagctattgcttccaatccgaatttcactatagcattggcagcagcgatctcatcaattattggagctcctagaggaaatgatggaattaacaacaatagtagcaatggtggaagtgatcttcctcttaatgggacatctatgttgcctggatccacttag

SEQ ID NO: 89663 - DNA, 336 bp, Glycine max
  Peptide Sequence Number=SeqID_206441
atgctccaaccatatgggatcagcataggcttaaaggagcactcaaacccggtgacccccaaggcctacactccgaagagtccgtcagggtctctccctcctgattcagaccattttgggtttctacgggaaaggaagagactacaatgcgaaaggtatttctctcagctcaaacatgatatcaaaattcccaacggtgaaaatgctcggaactgggttgcaaaagtagtgctcaaatttcacgatgatccaacggtgaacgagtccaagatcgtcatttttctgagacaggttaggtggcctgtgggaaaaagagaggattttgagagaagatag

SEQ ID NO: 89664 - DNA, 1527 bp, Glycine max
  Peptide Sequence Number=SeqID_206442
atgagacgccatggctggcaacgccctcttcaccctttacagtttgtgggcgccgcggtgtacggttttctggtggtgtgcttcttcaccttcctcggactcttcctcggaaaccgaaccgccgagataacactcaccctcacgttttcctccgtcgcggttgctgttatgtttctgtttgtgaggtgtacggcgattgatcccacggacaggacctgcttccggaacaagaagaagcagagagccaaatcggacgcgattccgaagctgaattacgggttcattcttggccagattgtgatgaggttcttccggagggtggagaggaagttgctcaggaccttcattaagaggaagtacttggatccattcaagacaagtccccaaatggagcctctcttaccattccctctcgtcatgaaggatgatgatgatgccattgcccccaatctcaatgaggatgacatctcattttgtgccctctgtgattttgaggtgaaaaaacacagtaagcactgcaggacttgcaatcgctgtgttgaagggtttgatcaccattgcaggtggctgaataactgtgttgggaaaaggaactacacaaccttctttcttctcatgattttcgtcttgttaatgcttttgattgaaggagggactgcaattgctatatttatcaggtgctttgttgataggaggggaatagaaaaagagcttcagaggaagctttatgtagattttccaagaggagttcttgccaccatatgtgtatttcttctcttattgacagcgtatagttcagcagcattgggacagctgttcttctttcatgtggttctcatacgaaagggaatgaggacctatgactatattctagccatgagagaagagaacgaagcaatggatttggaatcattggatgattctgatttctcttcagatgagagcattgattttgactcacctgaaaagccaccactaatgtcaaggtttctatgcaaaggaaaccagagctcgcctaggttgtctatcaggattgaaggagaaactgaaccttcacccttgatcaagacaaagaagttccatgtaagcattaacccatggaaactcataaagttgaccagagaaaaagcccaactagcagctgagaaggccagggaaaagattatgagagaaaagccaatgggggagcataattcattaaaacctcttccattggaaacaaaatgcggaccattgatgagtccagataaaaatatggacactaaggattttggctcaacatcttttatagcaaaaggcagacttaccgaatcaccaggaggaaggttttcaagcccaagaaggagattttctgctggttcaccaacggtgttctctagcagcatgatggcatctccgcatcacaaatacagaagcagcttcgacttgaaattaactggtgtgtccagggagctcgaaacacatatttcaaggcaggttttatgttcagtgatcagcaaagatgatagcgaaccatccccaagataa

SEQ ID NO: 89665 - DNA, 1131 bp, Glycine max
  Peptide Sequence Number=SeqID_206443
atggtgaatttagaggtcacaaagtacagcaaagccacagggattggcaaaggtggcagtggtgggaagaagaggaaagctaaaagtatccggaagcattactttgcaatgcaaagaagacttcgccagtgtcggcactttgatgcaaagaatgcgactgagggctccctaagtgtggatgagcgttgtttggtgtcgagcgtggtagccttgaaaaatgtgagagttgcgagtcgatgtggcttgttaagcccccgagcttggacatgtgttgtccgagctgcttttgccaagttgtccatgatggacatgtgtcagcccattagagatcgggaggccatctcgataggcggtccctcgtttgaggatacttgccgaggtgtctccgatagcaagtcgtcctcgtcggaaaagtcaatcctagttactatgattatctccctttctgcttttgtgggtgtgaggagagttggtggcagtagagatgtgagggacgatgtgctgaagtataggtcatccttgacctcagtggtgagcatcgttgtgcttcaaagccaggtaaagatggtgaatgctgaggactcctataagctggtcgttcaggcttgtaagagtgatgacttcccatttctgagggcggacccttttttcaaggttctggctattgatgtcgaggttgatggaatgccattgatgttcaatagggacggggagctccgtttcctgctttactggcagtatgatcataccaggttcaagttgtatgacgaggatctactgacccttatgaagagggtcgataaagaaatcttgaagcagctgtcggcctcactggatgcgcggtccattttgtctcttccgttggcaagtgatcctcttgttgccttggatggaataatgggtgactttgcttggaggccactcatgaagcaggtcgaacttgcaggtgggatcgtgccaccgtcttttgttgctctgtctactggagaagggagaagagagacgattttgctaggtcgtcttgctcaagatgtgcctccgactgcgcctaccgttgaggttcatgctgttgctattgaagctactcctgttatccctgcccattcacctcctactgttgatgttgtgtag

SEQ ID NO: 89666 - DNA, 655 bp, Glycine max
  Peptide Sequence Number=SeqID_206444
caaagagctttttgactccattttcatccacaaagataacaatgcatgccctgccagaaacttctacacctacgactccttcatcaatgcatccaaacgcttccctagatttggcaccactggtagtccaaccacgcgcaagcgtgagattgcagcctttcttgctcagatttcacatgaaaccacaggtgggtgggccacagcacctgatggaccctatgcttggggattgtgcttcaaggaagaaattagccctcaatgtcactattgtgattccaccaacactcaatggccttgttatcctggacaaagttacaaaggcagagggccaattcaactttcatggaactacaactatggaccagcagggaaggctttgggatttgatggattgagaaacccagatgtgcaaaagccaaaaccttcttgccacaatgtgatggttggaaaatatgtgccaacacaagctgacatagcagctaatcgaactgcagggtatggctttgtgactaacataatcaatggtggacttgaatgtggaattcctgatgattcaagggtgaatgataggattggatactttcaaagatatgcaaccatgtttaacgtagatacaggacctaacttggactgtgcaaatcagaagtctttctaa

SEQ ID NO: 89667 - DNA, 1791 bp, Glycine max
  Peptide Sequence Number=SeqID_206445
atggtttccgtcttcaacgagatcctattcccgccgaaccaaacccttcttcgcccctccctccattccccaacctctttcttcacctctcccactcgaaaattccctcgctctcgccctaaccctattctacgctgctccattgcggaggaatccaccgcgtctccgcccaaaaccagagactccgcccccgtggactgcgtcgtcgtcggcggaggcgtcagcggcctctgcatcgcccaggccctcgccaccaaacacgccaatgccaacgtcgtcgtcacggaggcccgagaccgcgtcggcggcaacatcaccacgatggagagggacggatacctctgggaagaaggccccaacagcttccagccttctgatccaatgctcaccatggtggtggacagtggtttaaaggatgagcttgttttgggggatcctgatgcacctcggtttgtgttgtggaacaggaagttgaggccggtgcccgggaagctgactgatttgcctttctttgacttgatgagcattggtggcaaaatcagggctggctttggtgcgcttggaattcggcctcctcctccaggtcatgaggaatcggttgaagagtttgttcgtcggaaccttggtgatgaggtttttgaacggttgatagagcctttttgttcaggcgatccttcaaaattaagtatgaaagcagcattcgggaaagtttggaagctggaaaaaaatggtggtagcattattggtggaactttcaaagcaatacaagagagaaatggagcttcaaaaccacctcgagatccgcgtctgccaaaaccaaaaggtcagactgttggatctttccggaagggacttaccatgttgcctgatgcaatttctgccaggtactacatgttgcctaataccaatgtcctagttaagtttctcctattctccagattgatgatcctagccaattgtgatcctgttaacagactaggcaacaaagtaaagttatcttggaagctttcaagtattagtaaactggatagtggagagtacagtttgacatatgaaacaccagaaggagtggtttctttgcagtgcaaaactgttgtcctgaccattccttcctatgttgctagtacattgctgcgtcctctgtctgggtttaaggacatgtcatcccctgtggcaggcttttctttgagtcatattacaaaaatgcatgctgctgctgcagatgcactttcaaagttttattaccctccagttgctgcagtttccatatcctatccaaaagaagctattagatcagaatgcttgatagatggtgagttgaaggggtttggtcaattgcatccacgtagccaaggagtggaaacattaggaactatatacagctcatcactattccccaaccgagcaccacctggaagggttctactcttgaattacattggaggagcaactaatactggaattttatcgaagacggacagtgaacttgtggaaacagttgatcgagatttgaggaaaatccttataaacccaaatgcccaggatccatttgtagtgggggtgagactgtggcctcaagctattccacagttcttagttggccatcttgatcttctagatgttgctaaagcttctatcagaaatactgggtttgaagggctcttccttgggggtaattatgtgtctggtgttgccttgggacgatgcgttgagggagcctatgaggtagcagctgaagtagctatcagtctgcctctccattattcccctctattcttggagagttggtag

SEQ ID NO: 89668 - DNA, 702 bp, Glycine max
  Peptide Sequence Number=SeqID_206446
atgggtgacatgtactggagtcatcatcgtgatacggtcttgcatgtgtgtcactcgccgtgggtgacatgtactggagtcaccatcgtgatatgctcttgcattcgtgtccctcgccgtgcgtggcacacgctggagtcgtcaactgaagtagaacttcaggtgggtggtattccatggaccttcccaattggggctaagctttcccacttggggattttttctggcttcacctttgactctttatacgaggtcgccaggttgaaaggctcgtggttgaacctttgtatttctccttgtcaacgattccttgacttctacgaggatcatggcgtttgtgtcatatgtgagtcggcccttagacttattgagcctagtttgcaaggccctgaggatgactattcaattgcgactagtaagtatgtgacagctcctagggcttttggcagcggtcctaatatgtccattccccacatggaaaagggccaaggagagctcaggcttaagcctgctcgcaccattttggtggctagggagcgtcctctacttgccatcaaggatgacttagcagttggtctttcgtctaaggcgttgggcttcgtcctcattcattgtcataatttccttagcatctgtggtgacagtttggagcgtctcttggatgatggtcttaaggtgcccaaccttcttgttgctggctag

SEQ ID NO: 89669 - DNA, 480 bp, Glycine max
  Peptide Sequence Number=SeqID_206447
atgggcaaagcctctagttcttcctcctcctctatctccagctgcagaaacccttccaattcaactgcatcctctctcacacaccaacatagtcaagaccaccttcgcacagatcttaggcttggactaagcctttccgctactcaacatgttggctcttctagttcagggggacactggcaaccgatgcagccacatctaataagtagtttttcacaagctactgaagtgaatgattgcagcgatcataccagcttctttgtgaaggtgtacatggaaggcattccgattggtagaaaactcaacttgttagctcatgatggggggactgaaatggatggagtgcaaccagagagatgtcatgttctaacttatgaagatggagaaggagatttgattatggttggggatgtcccttgggagatgttcttatcagctgtaaagaggttgaagatcacaagggtggaggcattcgggtga

SEQ ID NO: 89670 - DNA, 891 bp, Glycine max
  Peptide Sequence Number=SeqID_206448
atggctctccttgctgttatcttggtggctatggtgtcgccttcttcgtccttgtgccctcacatctccctggatcatttgtacacctctatgttgattcactatgggaatgccactgatttttccaaggtttttctccaaaggagcttgatgattttggaggagaatgaattgcggcaccaagaggcggtgcaaaagattgcgtctctggaagtggaggatgaaccgtcaactgtctttcaagctggacttgggtgcaaagtggagagcatggcgactgagaaggatgagcttgccaagaggattactgagttagaggtccgacttactgattcagagtccaagctggtagagtctgagttacgggtggccaaagagagggaggccgacaaggagcttgaagaggagttgctcttgtacaagaaggaagttgtggagcagcatgagaaaggctttgaaaaggctgttaggcagggtagtttgtttgcaaaggacctcgacttgggtcaggatgtgaaggatgacatcctgcttgatgaggaagtgattgctactaaggaggaggaggaggctgctgatgaagggcagggtgttacggagcaaggcgatgatcccattgaccgtggtggtcttgtaaagagtgttgcagagtcatctcaggtattgcctaaccagtgtgggggtaggtcgttggacttgctgagtgtatcttctgatgtcttaccaaatagtggggcgacagttcgcttggtggaccttagaccattgacggtgatcgtcctagctgctccatggtggaccttgagttttggtaccaagggaagaccttgggttttagataagcttgcattcatgcacggtggtccttgggtttgccgagccttggactag

SEQ ID NO: 89671 - DNA, 261 bp, Glycine max
  Peptide Sequence Number=SeqID_206449
atggcattttctgatcaacagaaacagttgaggttaatatacaatagattcaaggaagaggttaatcagcatctacaggattgcaggagcactgttgaagatcttgaagcagatcggatagagatcaagagaaccatggaaaagcaaagagtagcacataagaagcttctgtcgcaagttgaagcagcagtgcagatccaacttgatgacgctcaaaggaaaatcacattcacacaagaggaaagtattcgttacatgtag

SEQ ID NO: 89672 - DNA, 1063 bp, Glycine max
  misc_feature (4)..(4): n is a, c, g, or t
  Peptide Sequence Number=SeqID_206450
cgcnctactattcggaaagatgagagaacaaggtctgatgcctgattcggtgattgtaacatctgtcttaccagtgtgtggacgattggaggctgtgaaattggggatggcattgcaagggtgtgctgtgaggagtggctttgagagtgatttgtatttctccttcgcaatgatagacatgtattgtaaatgtggtgatccatttgatgcccatcgggtgtttagtcgcatggtttataaagatgtagtttcttggagtacctcgattgttggctactcacagaaccgcctataccaagagagttatgagttgtatactggaatggtaaatgtgggtttagcaacaaatgcaatcgttgttgcaagtgttcttcctacttttggaaaactcaagttgttgaaacaaaggaaggatatgcacaactttgttcttatagaaggactcatgcctaatgttgttgtaggaagtgcattgattgatatgtatgctaattgtgggtcaatcaaggaagtagagtcaatatttgagtgcatgtcaaataaggatatcatggtgtggaattcagtgataataaggtataatttagttggtgactctgagtcaacattctttacctttagaagaatttggggagctaaacataggccaaattccattactttagtaagcatccttcctatatgcacccaaatggaagcttttagacagggaaaggaaatccatgtgaagatctttaaacaaatgatggtaaggaatgtcataacatatagcactatgatctctgccagtggagctcatggcctaggtgaaaagggtttggcattttatgagcaaatggaggaggaaggaattagaccaaacaaagtcacttttatttcactgttatctgcatgtagtcatgcatgtctctttgacagagaaggagatctcgatggtgcatacaagttcatcacaaggatgcatatgacaccagatgctaatgtcttggggagcttactaggccattatgttcttttgtcaaatttatatgcttatgggaaaagatgggaaggcatgtcaaag

SEQ ID NO: 89673 - DNA, 228 bp, Glycine max
  Peptide Sequence Number=SeqID_206451
atggaagttttagggttgtccaaattggtcaccattttcaaggatagaattcaaaaagctaaaaaaaaggataaaaagaaggccaacgatgatgatgaagactacatacctgaatatagagggggacttggatcaaagtcttcaagtgaaaattacgtggatgacagacctgatgagtttgctgctacaaataatcttgagtcacagaaaagaaatgtgatgaaataa

SEQ ID NO: 89674 - DNA, 414 bp, Glycine max
  Peptide Sequence Number=SeqID_206452
atgaatgacaatataactttaatattgcaccatggaggaagattcactccacgtgccagtgatggaaaggttgaatatataggcggagaatttgacgtttgggaggatatgtctgcagattgcctgaatgcatttatcttatatgatctggtgaaagcttgtaagaagtatagcaatataggagaatgtttttggttgattgataaggacttagattttaatcatgggttacggagttgtacaactgatggagatatattacacttagtcagggatgcttttgaaaatgagaatgagataaatgtttattttcatcatgaagtagatccaattttagaaggagtcccacagatgttgtacttggaatgtgatccaattccagaagttgttgagaatgaggatgatttagatgat

SEQ ID NO: 89675 - DNA, 156 bp, Glycine max
  Peptide Sequence Number=SeqID_206453
atggagaggcataattgtgaatccttgtttcaagattcactaaagaccaagccttgccttaaaacagagtgctttcaagacatgcaaggctctggtaatcgattaccaggaagtgtaatcgattaccagaagacagggttgagaaatagcggttga

SEQ ID NO: 89676 - DNA, 357 bp, Glycine max
  Peptide Sequence Number=SeqID_206454
atggaaggaagaacgcatcgcgttgtagcaaagatgaggattgagctaggaatggaagacgaagcaggtccatctaacacccaacaacaacgctctactccaccaccatcacggttaagcaccctcaacaaggaactggaaatggttcttgccaccctgcctgtgacagacactttctttggtaaccgcctaatactgactgtcgataacgaaaatgttatgaacagtgacgcccaaacatgtgtagaaacaagcttcatgatgatgaatcaagttgattcaagtagttttgatgatgacaaaaagcccaagagaatgatttcaagattgagtcaacaagtccaagatcaagtttaa

SEQ ID NO: 89677 - DNA, 1203 bp, Glycine max
  Peptide Sequence Number=SeqID_206455
atgaataacatgtgtagccttcataataatttgtacaatgactttgaagatgcatcttcaacttctactagagtagcaaatagtgaaatgcatgataattccttggtacgtgaacatgcaaatgatccacttcagcaaacagatgaaggttatttagatgacaacactgaaattggaggaaatgttgatagtttgctacatgatgacaatcacctgggtgatgatggtgatgaatgtgctcatgacattagcacaggatatattgatctaggagacccttctaaaacatgtccatattgccacactgctatgtggtatgaagaaagaacaagaaaagataaaaatcaggctaatgccaaatatagtctttattgcgacatggggagggtacaacttccttttctcaagaatccatcattgcttctgcaacaactattatgtgatcaagaatcacgtgaaagcaaaaattaccaacataatatcagagcttataatatgatgtttgctttcagctctcttggagccaagatagatacaagtgtgttgaatggaaaaggtccatcaatttataaaattcatggacaatcatgtcatttgattgtgagcctattaccaatgcctgagaaacctccaaaatttgcccagctgtatatatatgatacagagaatgaaatccaaaatagaattgatgcaacacacatcaacatagagtggtgtaatcagtcaacgtccatcaaatatctattcaagtacattaataaaggttatgatcggataaccgcaactttggtacctgtgcagaatgatgatggaaccactaaacaggttgtcgatgagattaagcactatcttgatggcaggttatactttcattttcctggtcaaaactcaataatatttgtggatgatgatgacattgatgttttgttgtccaagccaactattaaagagtctatgtttacgtcttggctccaagctaacagcatttatcatgaagcaaaagatctaacatacttgcatttcgtttcaaagtttacatacattgccaagtctagatgttggaggccacgtaaaggtggcaatacaattggtagacttaactgggtgcctccaagcactagcgaaatatattaccttaggatgatgttggttgtggttaaaggactgacaacttatgaaaaaatttgcacagttaatggttaa

SEQ ID NO: 89678 - DNA, 993 bp, Glycine max
  Peptide Sequence Number=SeqID_206456
atgagtgttgtcaataaacaagttggaggaatgtttttcctgtatggatatagaggtactggcaaaacctttatgtggaagacattatctgatacactacgttcaaaaggtgatattgttctgacagttgcttcaagtggtatagcctcattgttattacccaatggtagaactgcacattctaaatttgttattcttgtgcctacattagagaactccacatgtaatatccaccaaggaatagaacaagctcgactactaaaggctaccaagttgatcatatgggatgaggctcctatggctcataagtattgttttgaagcattagataaaacattgaacgactttatgctcatgtctaattccgacagtgttccatttggtggaaaagttgtagtctttggaggtgatttcaaacaaatttttcccatcatcacaagaggaagtaggtccgatatagtgaatgctactatcaatgcttcgtatctgtgggactactgcacagttttaaagctaactaaaaaaatgcatttgcagtcaaacctaacaatcacaaatgcacaagaaattaagaggttctcgcagtggctgatagatgttggtgaaggaaagctagagatttcaaatgaattgttgattaaaaatttcaacgatcatattgaattaattgtcggtcatacttatccatacatccagcacaattataaagatgaggaatttctgaagtctagagctattctagcttcaacaaatgagattgtggaccaaataaatgactacatattaaacattatctcaggtgatgaaaaagaatatttgagttgtgattcaattgacataacggatgttgcatcaagtgaatctcatgaagctgttacaccagaatttctacattcatttaagacatcaggcatgcctaatcataagataaggatcaaaataggcacacctattatgttgattcagaatttagatcaagtagaaggcctttga

SEQ ID NO: 89679 - DNA, 432 bp, Glycine max
  Peptide Sequence Number=SeqID_206457
atggataatgtgccaaaaatcaagacagagcctggcttcgaagatgaaaatggtccatcgcaccacgacagagccatgctccaccaacatcactacagacagctatcaaccggacaactaacacgtgtccaagccctgcgcctggtgccgaattcagtgactttcaacatgcttcttaatgaatacaaggccacgtgcaacagcttggatgttccaagtagtatgtacaacttcatgaaagagaaacggttcactcaattgaacatagcatactgtgccgaaatgccgctttgtttacaattagtggcgaaagacgacaaaaattggatctggatggagagatttttccaaatcccaaagcttcaaagctggaatttgtttgaatttcctgatcccaatgtcaactatgctttcatttggccttgtttataa

SEQ ID NO: 89680 - DNA, 1374 bp, Glycine max
  Peptide Sequence Number=SeqID_206458
atgacaacacttcccgaaacccccaccgtttcccccatggaaaacgaaaacaccatcctccgaaacggcaccgccaagaaacccaagctcacgcacgccatttccgaggctgagatccgcgaagaattctcccaccaccagcgcggcgtcgcaagaatcaacaacggtagcttcggcagctgcccgcgctccgtcctcaacgcacagtccatctggcagctccgcttcctccagcatcccgacgacttctacttcaactcgctccgccccggcatcctcgcctcacgcgccgccatcaaagatatcatcaatgccgaacacgtggacgacgtctcgctcgtcgacaacgccaccaccgccgccgccgtcgtcctccagcagatcggccgccacttcgtccgcggccactttcaccgcaacgacgccgttgtgatgttccactgcgcctaccaggccgtcaagaaatccatcgaggcttacgtcactcccatcggcggcaccgtcgtcgaggtccagctccccttcccggtccgctccgaggaagaaatcgtaacggaattcaagaaaggcctcgagaatggtaaactcaacggcggaaaagttaggttagcggtaatcgatcatataacttccatgccttcggtcgttctccccgttcgcgaattaattagggtttgcagagagcatggagtggaacaggttttcgtcgacggcgctcacgccattggaagcttgcacgttgacgttaaagaaattggagctgatttttacgtgagtaatttgtacaagtggtttttctcgccgccttcggtggcgtttttgtattgtaaggaaaaatcaaacgacgtgcaccaccctgtcgtttcccaggagtacgggaaggggttaccggttgaaagtgcgtgggttgggatgcgtgactatagcccgcagctcgttgtgccgtcgattttggagtttgtgaatcggtttgagggtgggattgaggggataatgaagaggaaccatgacggggttgtgaaaatggggacaatgttggcggagtcttggggaacggttctaggttcgcctcctgagatgtgtgctagcatgattatggtggggttgccttctaggttgtgtgtgatgagtgatgatgatgcattgaggttaagatcctaccttagggtttatcatgaagttgaagttcctgtgtattaccaggctttgaggaatggtgatagggatcctagggacaaggatgggtttataactggttatgtaaggatctctcaccaggtttataatactgttgatgactatgagaggcttaagactgcgattaatcagcttgtagaggacgggaaagtttgcagcgggattcctacggagtga

SEQ ID NO: 89681 - DNA, 785 bp, Glycine max
  Peptide Sequence Number=SeqID_206459
gctatcaccacaaaaccccaagcccgccgtattccaccgttcttcgcggcgacgttcagctccatccgccgtcggtttctagaacacggcggagcaggcggcgccaatcgggtgcggtggcgtccctcggagggttgcttggcggcatcttcaaaggcgccgatacgggagaagccacgaggcagcaatacgctgcgaccgttaacataatcaatggattggagccggagatttctgcattgtcggattcggaactgagggacaggacttttgcgctgcgagaacgcgcgcaacagggacagtctttggattcgctcttgccggaggcgtttgctgtggtgagagaaggttcgaagagggttctgggccttcgtccctttgatgtccagcttataggaggcatggttcttcataagggagaaatagctgaaatgaggactggagaaggaaagacactggttgctgttttgccagcttatttgaatgcattgagtgggaagggagttcatgttgttactgtcaatgattatctggctcggagggattgtgagtgggttggtcaggttcctcgctttcttggattgaagagtgtcgaagatcttgtcataaggggtttcaattactgtatcattgatgaggttgattcaatccttattgatgaagctagaacgccgcttattatatcaggacctgcagagaaacccagtgatcgatattataaggctgcaaagattgcagaagcctttgaacgagacatacattacactgtttgcaacaagggttag

SEQ ID NO: 89682 - DNA, 1383 bp, Glycine max
  Peptide Sequence Number=SeqID_206460
atggtaatagtggtgatgtcaatagcaatgacgatagagatatcaatggtggtggcggtggaggtggcattgttggtggtggttgcggtgttggtggtggcagccaatggtggtgatgttgttgttgttgttggtggtggtggtatcaatgtcggtggtggtggtaacggtgttggtggtggtggcaattacggaggtggtattgtgggtggtggtggtggtaacaatgatagtggcgatgacagtgatggtgatggtggtagcaatgccgatggtgatgtcggtggggacgatggtggcaccaaatggtggcagtgtggtggtggtggtagccatactagtgatgatggtgatggtggtggtggtctggtggtgaccgtagtagacgaaaaacaaaaatcagttctactttctgagcaaggttatgaagattctgaagaaattttagctgtcaaagatttatatgatcctcgagaacagtgggcttcatatatcctaaatgcaataaaagcaaaagaactatttcttcgagatgtaaactacataattcgtggaaaagaggtccttattgttgatgagtttactggtcgagtcatgcaggggagaaggtggagtgatggtcttcaccaagcagttgaggcaaaggaagggttgccaattcaaaatgaaactgtaacgctggcttctatcagttaccagaatttctttctgcagttccccaaactttgtggtatgactggcactgcagcaacagaaagcacagaatttgagagcatttacaaacttaaagttacaattgtgccaacaaacaaacctatgataagaaaggatgaatctgatgtagtttttagggcaacttcagggaaatggcgtgcagttgtagtagaaatctctaggatgcataaaaccggtcgcccagtgcttgttggcaccactagtgttgagcagagtgattcattatcagagcaattgaaagaagctggaattccgcacgagtttatttatttaaatatagataatactagtgtccttgaagaatccatccatttggaggtgttggctcaagtgtttgagctgacaaaatactcttttaattggaaaccaaatgaggagcgttcagcatgtgtgatacagcaggttcttaatgcaaaaccagaaaatgttgagagggaagcagaaattgtagcacagagtggtcgtcttggggcagtgacaattgctaccaatatggctggtcgtgggacagatataatccttggtggtaatgctgaatttatggcacgcttgaagcttcgtgagatattgatgccaaggtattatggagctttaattgacagttttattatggagaatttgttcttccatgtacttgttgccttttga

SEQ ID NO: 89683 - DNA, 1542 bp, Glycine max
  Peptide Sequence Number=SeqID_206461
atggttaaaaatgaaagtggtaagaacatgggttggcattataaaattaagttgtgcaagatgaatgtttgtatgatggtggatagggagttctggtggaaaatgaaaaaagtgaatgagaagttatttccatgccaactatcaaataaaaatgttgacttggctgagaaggctgtgcaattagctgttgaaacatggggcaagagatccttaactgagcttgaagcagaggagcgcctatcctatacctgtgaaaagggtcctgctcaagatgaagtcattgccaagctgagaaatgcatttctggaaatcggaaaagaatataaagtcttcactgaggaagagaggaagaaggttgtggaagctggcggactacatgtagtaggcacagagcgtcatgaatcacgtcgaattgataatcaggttttctcttctttccttttccttgtaaggttgaaaggagggaaactgggatgtactggcttgtggccttggacatctgcatatctcctaccctcttctattattattgcagctataataactactgctgcttctaccactcctaccctgttaaataagtatttaaaattggaacatttttttttatcatccataaagctgcgtggtcgaagtggcagacaaggagatccaggaagctcccgctttttcttaagtcttgaagataacatatttcgtatttttggtggagatcgaattcagggcctaatgcaagcgttcagagttgaagacctacctattgaatccaagatgttgaccaaagctttagatgaagcccaaaggaaagtggagaactatttctttgacattcggaagcaattgtttgagtatgatgaagtacttaacagccaaagagatcgagtttatacagagagaagacgagcccttgaatctgacaatcttcagtctcttcttattgaatatgctgaattgacaatggatgacattttagaagcaaacattggttctgatgctccaaaagacagctgggatcttgaaaaactaactgcaaaaattcagcaatattgctacttgttgaatgatctatcccctgatttgctggggaacacatgttcagattacgaggaattgcggaattatctccgtcttcgtggtcgtgaagcctacctgcagaaaagggatattgtggagcaacaagcagcaggcttgatgaaagaagcagagcggttcctaatcttaagcaatatcgatcgcctgtggaaagaacatctgcaggcactaaaatttgttcagcaagccgtggggttacggggatatgcgcagcgggatcctcttattgagtataagcttgaaggctataaccttttcttggatatgatggcacaaataagaagaaatgtcatatattctgtgtatcagtttcaacctgtgctggtagagcaagatcaggacaaaacagagaatcggaaatcaggaaaacgtaatgcacgaactcaggttaatccaaaccctgatccagttggcactgtcgagccttcaacgacaagtactacttcctaa

SEQ ID NO: 89684 - DNA, 132 bp, Glycine max
  Peptide Sequence Number=SeqID_206462
aagttgaagaagtcagagaccttaataagggtggactttgtggagtgtcctaaggttgaagtagtctatggttcaagttggaaaagtggggaccttaaaatggaggaccttgacatagacttgatggagtag

SEQ ID NO: 89685 - DNA, 165 bp, Glycine max
  Peptide Sequence Number=SeqID_206463
atggagagctgggtaatggaatcattgggtgatgagtggcggaaaccatcgtggggaatgtctctgcagagcacgtggtgtagggtactggccaatgatggatggaattgtatggacacgtgtcaggtggacggagagtgccgcttgttctgcgacatagcttag

SEQ ID NO: 89686 - DNA, 969 bp, Glycine max
  Peptide Sequence Number=SeqID_206464
atggatacagcatgttggaacacagggcatcaaaataccttgagaatgttttctgttaggcttggaggacctctatatctagtaatttctgttggaagagttgttgcagttgggttcttatccttgtctgtgacttacactgtgcaagagatccaacagtggcgtgaagcacggaaaaagaatcatcctttcaataacaacattcagaagatgttattgtctaataatcaattcctgaatcactacctacagaagcacagtgaacacccaaaagacaggaaggccattaatagggaggtcttacaaagagagctcaaggaggtgttagcgaagcaagctgaattgggagttgaagttgctgaaataccatcatactacttgaagaattctgacaatcaagctcttcagagtgaagggaaaaacaaatttactgacaaaagaaaattccaaaacaagttcaacaagaaatcagacagaaaaggtaggttcgccaagaggcagaagtttgatgacaaagatttttcagaaagcccctctttgaagaagaggaagcctacattattgcagaaactcctgagttcagatgtaaagagggataagagccacctgattcaggttttcaggttcatggtaatgaattctttcttcaaacattgtcttgataagccgctgagatatccgttggtcgtggttaaagaaaaggggtctgaagttgatggtgaagaaaaatacttgcacaccggaaaagatgttcttaaaggagggaatgaggaaacagttcaaaaaattgtgaccttcaataatgataatagccatgattgtgaagatgaagatagtgatgatgacgagaatgattctattgttgataataatcttcataaagatccttcttccttggttaaaagacagtgtgatagtggcgaaggaattgggaaatttgatgaagaggagggagaaattatagaatga

SEQ ID NO: 89687 - DNA, 516 bp, Glycine max
  Peptide Sequence Number=SeqID_206465
atgaaagtgggattggctaagggaattgacgtgtcaaatgacgactctgactacctcgacaatttgaaggccaacggtgctgccaaagacagggtcgaagagcacatcatagaggtggcgatagcttaccaaggcaaatacgacggtgtcaaaatacctctgacaaaattgctcgcgtcgcaacttgtttcgtcactagaggaggcatctttgacgagaactccaacgtcgataggcatttttgacaagaactctggcgccaatactggtcgcaatggcattggagcgagtggtgtcgacaactgcttctctagagacattgacagtatggtttctgtgcggggttgtgccaccaatgttgttatcgttgcagagtccatagatttgtatattaatggtgactttgtagaagggaaatatgaggaaggttggttggtcaccaggatatgcaatttcaggagaatgacatcgagtttggagaccatggaggctaggatcacagtggagtggagttga

SEQ ID NO: 89688 - DNA, 234 bp, Glycine max
  Peptide Sequence Number=SeqID_206466
atggacgaagcacctgtagatacacccgctcatgtagagcagcctcgacatgcagtgaaggcttgccaagaaatagctaaaaggttggaacgattgttcaacctaaggataatgacagaaggtatagaagtatacattgtcatggaaaactgcctaaggatcgctagaggtgtaactgcggaatgcaatgtatatgtgcgattgcaacgaaggtggcgtatggaagacgaatga

SEQ ID NO: 89689 - DNA, 300 bp, Glycine max
  Peptide Sequence Number=SeqID_206467
atgaacgaaaatcaatcgatgcatgacaatataatgtctaaagaagttgatatgaatgaacaaaatgaagacgaaattagtgtgaaatcaaaacacgttgattgttttgatgccttcaatacttctcaggtgtttgctactcatgatgatgttttgaattgggttcgagctcttgcttatgaaattggttttgtgccagtcattatgaggtcaaacacaaatattgtcagggttgagtttgctcattggaccttaaacagactactacagaatagccttggagacctatgtagtgtttaa

SEQ ID NO: 89690 - DNA, 3849 bp, Glycine max
  Peptide Sequence Number=SeqID_206468
atggctactcaaacttctgttacgaaagatttgacagaaccccatcatactgtttgtcatgctgtggttgttgtgattactgttcagtctccacttacagagttgatattgggtggaggagaccattacctttctcggctaccagcttatggtgtcctcagaggttgtcaggagcttaattcttctgtcaatgagagaactgattatagtagtagtagtagatggagaataaagggaagatatattcgtgctgcctcccagaaagggagagaattttcccattcatttggttctgatggtgctgaagcagttctcagcttgttgagtgaggaggcagataaggatgctatttgtagcaaatgtaagaatgcgtcttcatcaaaaagagtggaagttgataaaagaaaaaatgtgagcagagagaaacatttgagttcgagtgagaaagtagaaacagagaaaaaaggaattttgaaacggcgtgaatcatcctccgtagacttgagaagagaatatggaaaagccaaccaagaaagggaagcctttgtaaaaagtgaaagccataggaaacgaagagatgcatctagttgttcatcttattactctctctcatcaggagattttgggagtgagctggaagttcaagatgagattggtttggaagagttgtcactggaatatgagaaggatgaagcaaattgtctggaggaagtgaaggaagaattcaacaggcaaggggatgactcaaagaagctgcaggctgtttcaaataagggaagaattgcatttggtgtggatattgattggaacctaaggaacaaatctgaaaagaagctgattgagggaactctgcaaaacactgaatccataagagaacaacaggatatgcattcaagagaatttagaacacatgattctggtcataaaaaatcatctatttcacaaaagcgagtcaatagtgaggaagataaatcttcttttattgacaatttggataagaaagcaaacaaggcatatattcaaacagtaaacagaagaaagcatcaatctatagatgtacaagagtctggttgtgatgaagttgagacaactttgttatcacaaaagaaattcagtggcagggaagggaagcttgagatatcagaaacaatgttgaaggaaacaactgatgaatataaaaagtttgttggttcaacttctaccacaggaaaggaaactttgacatcgaagaaggcattcagtggcagggaagggaacctggcaatatcagaaacactttcacaagaaacaaatgataaacataaaaaaattgttggttctacttctacctctggaagggatgtgatagatagaagttcccagaaatattctggaaatttaaaaattgaagacactgaaaggacctcaaatactaggatgaaggacatgggagtgaaaaaagtttcagttttgagttctgttcagggagtggataagcagaaacaccaaaaaggagagaagatcattacacagatgaaggataaagaggggagaaaaaaatctgagcaattttctgaagtatcagaagctcacaagtctaatgttgaagatacatctagcataaagtctagaactagattaaagaacatggaagaaaaatcaaacataagctcagatgcaagggttacgttgctccaaacagataaaaggacaactcagagtttccaacacaggaaaggatctgaacttgtcagcactttatcagaaggctatgtcagtgatgaaaagcaagtttcaagttctcaaaaagcttatgagaaggtgagattaattccaaaaagtaaatcaacatcacttgttagaactagagaaagttctagccaaactgatgaaaggattgcaaaatttgaattggccagagacgaccaaagatcttgcaacctttcaatttctgatgaaactaactcaagagaggaatccagctcccagggatcattgagtttgatttctggggctggaaaacatagtatattagcatcaggtgaaaaaagaaggtctgcaacaatgttgatcccttcctcttctgaaatgggtggagactcagtacaatttgaactcactgcaggaattgcaagccctgagatcttccttggaacttcagaaagtggttcttctgctttgtatgacaattcaggaagaagttctgctttgcatccagatgctatcgatttagctaatcgtttagagaagtcatctagacagtttgttgatgagtttgctgagagggtcatgcatgaagtaacgacttcagaagcacaagagatggaagttacaggaacaaagttgacacttgaagttggtggtgatcagatctacagctcaaggcaacaaggcactcaaaatgacgctcagtcaaagaagcatgattctagtcgttcttctgggtttcctgggacaaaaggaccttctgatgagatgtgggatgtcatggaaccatctgttgagcaaggtcaagtagccaaagaaacggatatcagcaaggaaacagggaaagcagttgttactagaactgggaggtccttatggggtatgattggtgatattgttcaattacgttggggttcacgtgctggttcctccacttcagctggaagatcagctgagagaaactcaccaaacaagtctgacagtgacacatggttttctgggcaggagcatgaggaaaccactaaaactaatgtcttaaaaaaaacaagtgtaccaccacaagtcatgacttctgataagttaaaaccaggtaaacattatacccaaagtgagggagaggtgtctgacaatacaaaactgaaagacagaggaaaacatctcgaagttggattgtcatccccaaatacattggaaagtggatcaatgtcagtaggcgcttctcatacttctggagaggaaaatgttagtgggactgaggataaaaaagatttgaaagccactacttctggcacacaaaacatggaattaccaatttcagtacctgccagagggccttctattgatggagaaattgtaagcatcggtggatctgacatgtctggagctgagtcagtggttccaatcaaggaatctattgctcctgtgcggtctgaattgtccggctcagagagaaaggatggagagttgaagcaaagaaagtttcaacggaacaggcaagtcttgagagataggtttgatgactgggaagaagcctatcaatgtgaacttgagcagcgacgcatagatgaaatgttcatgaaggaagcacttttggaagccaagaaggctgctgatacatgggaggtacctgttggtgctgttcttgtgcagcatgggaaaattattgctcgaggctgcaacttagttgaagagttacgggactccactgcccatgcagagatgatttgtatacgagaagcttcaaagcttcttcgatcatggagactatcagacactacactttatgtaacgcttgagccatgtccaatgtgtgctggtgctatccttcaggcaagagtagacactgttgtgtggggtgctcccaataagcttcttggagctgatggtagctggattagaattttccctgatggaggagaaaatgtatcagaacaaagagatatgccacctgccccagttcatccattccatccaaacatgaaaataagaagaggggtcttagccactgagtgtgcagatgcaatgcagcaattctttcagcttagaaggaaaaagaagaaagaggaaccaccgaatggcccttctagccttcctgttactcaccacccatccaagttactcaacaagatacatgacgtcttccacatcatgttctgtttgtaa

SEQ ID NO: 89691 - DNA, 807 bp, Glycine max
  Peptide Sequence Number=SeqID_206469
atgtatgtgacaagacccctttctatgtacaaaaggaaccctagtgctgtttcagaccctccactagggccaaattcaggttaccttgtaatccttgataaagaagcccaggcttactctttctttggtttgttcaaggacagagctataagggatcttccttttcctcagaacaaaaacttatcaatcaactatggaagcgatggtgaagaagacttgtttgttccagtattgaatcaacccttgtcttcgaaccgctactatgtgataaaaaggaaggggaagcataaaggtcaagctagcacaagttcaaaagaagaggacatggagacgtttttatgttgtagctttgtccaagatgttaaaccaagacctttggatccctctgacgattatcagcaggttgaaatcatcaagagggtgaataatgatttcaaagcaaaatccgttgccccagatggaattcttcctggtctgttgagaagaaaagggtggcgtgtttatgctcatactcccacagattatcatttaggtgaagctttaggctctgatgattccttgcgtgccaagcttcctgatttcaacgtattcccactgtccaatgataggtctgaatcagtggatgttggaaagtggtactgcccttttatgtttgttaaggaaagattaatgaaattgaaggagcagatgaaaaagacagtgttctatgagttgacacttaagcaaagatgggagaagatattttcaaaggaaaataatgatggagaaaatctggctgtgtttgtggatgttgttgttcaaacagaa

SEQ ID NO: 89692 - DNA, 207 bp, Glycine max
  Peptide Sequence Number=SeqID_206470
atgttgttgaagggctcgctcagcgagtcaaattggctaagcgaggcttatccgcttagtaaggaagtcagctcgctaagtgaacacaaaaccctagaggatgttaagctagagagtagcacgcttagtgcgcagccagttttgaatgttggaaaatgcttagaatccttagaacttggtagagcagctagaggtctgtatatctag

SEQ ID NO: 89693 - DNA, 279 bp, Glycine max
  Peptide Sequence Number=SeqID_206471
atgcatttagtagccgttgctcagggaacatctacaacttattttaacacgactaataagccagaacaagatcaaacttttgtcaatactgaggatcaaagctatatgatgttgtcagtcccctcatcaaacagcaagttatatggttgcgcaaagaacaggggtgcagatacaaccaaattcaaagaggggcaccacaaagccctcttacctcagagactatgtataagaaagaaagggagaaaggaagatgacctggaagcttacccacgacagtga

SEQ ID NO: 89694 - DNA, 882 bp, Glycine max
  Peptide Sequence Number=SeqID_206472
atggataaaattgaagagttggttcaaaaaggatgtttaaatgattttgtcagaggaaacaactataactgtggcagttatagagaaagaggcagaggtggtcgcaaaggcggtttcagaggtgaatatttcaaagtttggggcaacaatgaccaacaacctataagagaaggtgaacaaaggcaacacgaaaatcccccagtaagaacaaaagagtttccaccccaatctctaccaacaatcacattcccagatgcagacttcatcagaaatgatccaacacaagatgacccaatggtggtaaggaggttacgcccgtacttccaaagtcatcaaatcaaagtcaagaccgaccaccctatcagacaaattcttcaaaagccagagctcaccggaaggatggtcgcatggtctatagagctatctgagtttggattgaaattcaagccacaaggacctattaaaactcaatgcttggatgacttcatggtagagtttccccctaaattgagcagtagtgacagagggttaaaattaacaaaagaagttggagtgaaaaaagttaggtgcagaagcgactccaagcttgtcattggccaagtaaatggagattttcaagccaaagacacacaaatgcataagtactatcatctaacgatgtgtttgcttagttgctttgacgagtatgagcttaagcatatttttagagaaaacaatgacagagcaaatgtattagcaaaattggctagttccaaaaagtcgaggcaacatagaacattcatacaaaaggcactcattacaccaagcatagataagtatgatatctttgcaagcaaattggtagtaactcttggatcaacccaatatggaattatcttgtga

SEQ ID NO: 89695 - DNA, 354 bp, Glycine max
  Peptide Sequence Number=SeqID_206473
atggttacgaaggttgacccagagatgatggactttgttggggctgacaacagtttggattccacgaggttttcctccatgtgtctgctgctactatttgccattggagaactagccttcatgataagtcgtgaagatggttttaaaaaagctctttgccaaattgctttattcgcccctgaaatggattcaaaggaatttaatgttttgaaagatgtaaaggaagaggagttggtaagagaatctgaaatgaggagttatgaagatgttcttgatagggaaacaacctgcaaggcaggtgatgttgaggcgacttcaaagtctactccaacttcaaatcctccaacatcatag

SEQ ID NO: 89696 - DNA, 138 bp, Glycine max
  Peptide Sequence Number=SeqID_206474
atgaattgggctcctctaaagtgcacaaatcctaaccatttaattttcagacgaagctgtagtgctgctttggttagggaaactcctgagactcaaaagccagtatatacaggattggacaatcttctccaaggttaa

SEQ ID NO: 89697 - DNA, 156 bp, Glycine max
  Peptide Sequence Number=SeqID_206475
atggagaatttccagtcaagtgaaggtgcgcttagtgcccaaccaattactcgtgctcagcatgtagtcgcggaatctcaaacccatgaaagttcaactagttgtgttcttgagggattaagaaaaggattaggagaattagactctctcgtgtga

SEQ ID NO: 89698 - DNA, 153 bp, Glycine max
  Peptide Sequence Number=SeqID_206476
aaagtagattaccttaccttgccggacgaagagcagcaaacgcgtgcgtttagaaagggagtgccatattgtgagattgagaaagggacgccattagacgctgttccagcatcctccgtgacggtgacggcgacgacaatgatgcgagattga

SEQ ID NO: 89699 - DNA, 1119 bp, Glycine max
  Peptide Sequence Number=SeqID_206477
atgaagggtggagacaggaagctctttgggaccccgttggttacttgtttggtagaagatcctcaatttggagccaacattgaggcatctgtacataaaatgttggcacctttaagaaaaacatattcttcgagtaagtctcatgatgggaaggaaaatggtttcatctcaggtgacagtgatgagcaatcaaacatctccaatactgaatctgaatctctgagtctaacaactggcaacaaagaacaagagggaacatcctgtggggagtcatctttacaacttgttttaactaacgaaagctgtttgagttgtgaacccatcgagaaggcttctcttataaaacccaaccaagttgtaagagtctttcttgactggactgacaaagaacaggaattatatgattctagctacctgagggatctcccggaagttcacaaaactggattcactgtgaaaaaaacccggcaagaagctatttctttgttttcttgcttggaggcattcttgactgaagaacctcttggaccagatgacatgtggtactgccctagatgcaaggaacacagacaagctacaaagaagcttgacttgtggaaattgccggagattcttgtttttcacttaaaacgattctcatacagcagatacctgaaaaacaaacttgacacttttgtaaattttcccattcacaatctggatttaaccaaatatgtgaaaagcaaggatggagagtcttatgtttataacctttatgcaatcagcaaccattatggtggtctaggtggtgggcattacactgcgtattgtaagttgatcgatgacaataaatggtgccatttcgatgatagtcatgtctctcctgttactgaagccgaaattaaatcttcagctgcatatgtgttattttatcagagaaatagaagtaaaggccagatggaaggagagacatctcaggttaaaacacatcatgaattcaccataattgctgtgtttgacagttgtatgtatcagtatcgtgctaggagggcggcacttgtgtttctgaaaggaatcgtgccatccttctgttattttgttgttaggattctaggacccagtatcatgtggaaaagatga

SEQ ID NO: 89700 - DNA, 273 bp, Glycine max
  Peptide Sequence Number=SeqID_206478
atgggaatatatgagaagggttttgaaaggccttctcccatccaagaagaaagcattccgattgctcttactggtagtgacattcttgctagggctaagaacgaaactggcaaaacagctgcattttgcattcctgcattggaaaaaattgaccaggacaataatgttattcaaggtttgatgccctcctctagttctcttgccttaagcttttcacatgattctcatagcctagttgaaagaatagtatttaaagatgtctcagttccataa

SEQ ID NO: 89701 - DNA, 1002 bp, Glycine max
  Peptide Sequence Number=SeqID_206479
atggtgaagaacagccaaggaatctatgcccccaaaaacgacaaggtcgtcgtcctctgggacctcgacaacaagcccccccgcggcgctccctacgacgccgccgtctccctcaaaaccctcgccgcccgcttcggccacctcgttgacttctccgcctacgccaaccgccacgccttcgtccacctcccccagtgggtcctccaccagcgccgccaccgcagaaacctcgacatcctcgaacgcaagggcgtcatcaccccacccgagccctacacgtgcggcgtgtgcggccgcaagtgcaagacccacctagacctcaagaaacacttcaagcagctccaccagcgcgagcgccagaagaagctcaaccgtctcaaatccctaaaggggaaaaaacggcaccgttttaaggagcggtttttgcgcgggaatcacaagtatgacgatgctgcgagaacgctggtggtgccgaaggtcgggtacgggctggcggcggagctgcggcgggcgggggtgtttgtgaagacggtgcaggacaagcctcaggcggcggattgggccttgaagaggcaaatggttcactccatgagcagaggtattgattggctgtttttggtttcggatgattcggatttttcggagatgctgaggagggctagggaggctgatttgggaaccgtggtggtcggggattgggataaggcgcttgggcgccacgccgatttgtgggtgccgtggagtggagtggagaatggggaggtgggggatttgttgcccaagagaagaagggagaatagtagaagaagagaacagggggaagaacatggttttggtttggaagatgatgacggtggggtgtttttgaatgaggatgaggaattggggcaagagtttatgttgttgtatagtgaggacgaggatgaggacgtggatgtggaggactattatgatgacgatgatgatgatgaagaagaggaagatgggttttatattctttga

SEQ ID NO: 89702 - DNA, 1476 bp, Glycine max
  Peptide Sequence Number=SeqID_206480
atggcgagactggctcctcctttcagtatctttagacaatcccattactggcgcccacttctctcttctcacaacgccaaacgcaccctaacagctgctactaacttctccatcacctcattagctcgaacgcccaaatcacgagacgaaggaacaaccaccatcgttaagctttcgagcaaagccagaagaaaagccttctatgagtctccagaaggagtcttgttgcgcaagctaaacgagtgctcgaaggacggaaatgtcgctcaagcgctttgccactacgatgaggctcgaaaattgggggttctactcaacctcgatcactacaacaagttgctctacctgtgttccattgaaagtgctgctggttttcccaatttgggtctcaaaagggggtttgaggtttttcagcagatgttgaatgaccgagttcagcccaatgaagccacttttaccaatgctgctaggcttgctgctgccaatgaagatcctgacatggcttttgaattgctgaagcagatgaagaatgttgctattgctccgaagctgagatcgtatgagccggctttatttggattttgcaagaggggtgatgcagagaaggcttatctagttgatgctgacatggttgagtctgggattgtggcggaagagcccgagctttctgctcttttggaagtcagtgtcaatgccaagaaggaagacaaggtgtatgatattttgcatcgattgcgctctacgttgaggcaggtatctgaatcaactttggggatagttgaggactggtttaactcagagtatgctgcaaaaattgggaaggagaagtgggatgttaagaaggtgagggaaggcattgcgcagggaggtggaggatggcatggacaagggtggcttgggagtgggcggtggaaggtggcgaatactcaggtgaacgaggatggggtgtgtcccttgtgcggggagaagcttgtgagcattgatattgatccaaaagagactgaaaattttgctgcatcattgtctaaattagcttgccaaaaagaagctaaggcaaactttgttcattttcagacatggcttgagcagcatggtccatttgatgctgttgttgatggtgccaatgtaggccttgccaatgggcataatttcagcttttcacagcttaatactgttgttgaacaattacgtcaaataagcccttcgaagagattgccacttataattttgcatataagtcgggtacgtggtggtcccgctcagaatccaaaaaacatgagacttatagaaaattggaaaaaaaacggtgctctttatgctacacctcaaggttcaaatgatgactggtattggttatatgctgctgttagttgtaaatgcttactgttaacaaatgacgagatgagggaccacttgttccaactattgggttctaattttttcccgagatggaaggaaaaacatcaggtaatctaa

SEQ ID NO: 89703 - DNA, 1553 bp, Glycine max
  Peptide Sequence Number=SeqID_206481
tggttctgaaagtttccttgggaattttcgattgcgatattgacactgtgatggcctcagccgtcgtgaatttcttgaacgcgacgttggattggatgacgttcgcgtcggatggtccttctgcgcgagctgtagttttcggagtccatatcggtggacatttgtttatcgaagtgtttttgctggtggtcatacttttcttgctttcacagaaaagctacaagcctcctaaaaggcctttaacaaataaggaaattgatgagttatgtgacgaatgggttccagaaccccttattccttctgttaataaagagttgcagtatgaaccaccagtgctggagagggagagctctagtgctttagtaaggtttccaccttggcatgatggtgttggtgctgctgggccacataccataattaatggcaaagaagttgtcaattttgcttcagcaaactatcttgggtttataggtcatccaaagctacttgactcatgttcttctgctttagcgaaatacggtgttggctcttgtggtccccgtggattttatgggacaattgatgtccaccttgactgtgaagcaagaatagcaaaatttttaggaacccctgaatcaattctgtactcttatggactttccaccatgttcagtgcaattcctgctttctctaaaaaaggagatataattgtggcggatgagggagtccactggggaatacagaatggcctttatctttctagaagcacagtggtgtattttaagcacaatgacatggatgctttaagagaaactctagagaacattacttccaaatataagaagaccaagaatctgaggcgttatattgttgttgaagctgtctaccagaattctgggcaaatagctcccttggacgagatcattaaattgaaggaaaaatatcgctttcgtgttttgctagatgagagcaactcattgggtgtgcttggaagttctggaagaggtctcactgaacactgtggagttccagttgagaagatagacattataactgctgctatgggacatgcattggccacagaaggaggattctgcaccggaagtacaagagttatagatcaccaaagattgagcagctctggttatgtcttctctgcttctttgcccccatatcttgcaagcgctgctattacagctattgatgtcctggaggaaaatcccaatctgataaaaaagctgaagaaaaatattgcttttctaagaaaaggattgtcaaaaataccaggcatcacaattgcaagtaatccagagtcacctattgtttatttgagattagagaaatcaagaggttcagtgaaagatgacctgcatctgcttgaaaatatcgcagagcgggttttgaatgaagaatctgtatttgtggtggtttccaaaagatcaacattggacaaatgccgtttgcctgtgggaattagattgtttgtttctgctgggcattcagagtctgatctgctcaaggcatctgaatcattgaaaagggttgtggcatcagtcctgggtggtcataattga

SEQ ID NO: 89704 - DNA, 144 bp, Glycine max
  Peptide Sequence Number=SeqID_206482
atggtgggttgtggtggtgggggtgcaaatgatacgatagtggaaggagtcgtgtgcgtggagccttggaggttgaggttcaaatttagggcaaagatggtgtcgttggatggtggcacagtaagggggtcaggtgtgatgtga

SEQ ID NO: 89705 - DNA, 225 bp, Glycine max
  Peptide Sequence Number=SeqID_206483
atggatggactagaacatcagcaacaacagaacatctccacgcgcctctttcaacgaggatggggaccggagccgctagagctccgcctcgagttcaacggtgctgcggcgtgtggactggtggagcttctccttgatgttgtggtcgaggtcctcaacggcgtcgtcctcgttgtggaatttgaggatctagacgaggcagtggatgagagccaggaatgttga

SEQ ID NO: 89706 - DNA, 471 bp, Glycine max
  Peptide Sequence Number=SeqID_206484
atgacttcatcttgtaaaagaaaaggaattatcgaagccttggaatcaatgttaatagaggttgcaagggtaagacttcatggcttttcagagcgtgaaatatctgtagttcgtgccctgttgatgtctgagattgaatctgcttatttggagcgtgatcaaattcaatctaccagcttgagagatgaatatttaccacattttctccacaatgaacctgttgttgggattgagtatgaagctcaactccaaaagactcttctaccacaggtctgtaagtgttcagagaaattaaggacatcgtgtagctgtgtcataaagactattgagccccaaccatttgccatgcttgatgatctgaaaaatgttgttaagaaagtcaatcctcttgaggaagagggtagaatctctccttgggacgatgaacatgttccacaagaaattgtcactacaaagccaaatatggggtga

SEQ ID NO: 89707 - DNA, 722 bp, Glycine max
  Peptide Sequence Number=SeqID_206485
gtgatccctcttataaggactcaatcccctcacatgaaagggatgatgctggagagaggcatcgaaggctgactgtgttagcatgtggttggcgacattcgctaacaaagctagaggcatgcccatttgacaggatcattggacctccatttggaagaggtccagtcttaccattccccactgagccgacggtgagggctattatgttacggttagggttatcagacatagttacggtgcagtaccctgtcgcaaacaaggtcttcgtggatgcccttgtggagaagaaacaccaggaaacctcgtccttccacctgcctgtcagagagatgaccatcactctggatgatgtgtcatgtctcatgcatcttcctatgataagtaggccttttgatcatgtcccttccatctttagtaaagaggtcatgaagtttctgctcatgactcgccttggcattttgatagagaaaaaggcaatagaagtgagcattgcaggtcccaagcctaggatcgatgctctggatgaactggtagctagcagatggaagccaacacaacgccacaagggtgttaggcctttcccccagcaaacccttttctttgacttcattaggtgcgagacaaacgaaggcttcaacgttgggtgtaacttagagaggcagaggaagagggttgtcaaggatggtggcaagggtggcaggaaaggtggcaagggcagatga

SEQ ID NO: 89708 - DNA, 1086 bp, Glycine max
  Peptide Sequence Number=SeqID_206486
atgggtcgagtgatacatgttgcggtggtggcagcctcattgggatgtgtttcaacccttttgctggtttttatatggcgtttgtgtcaccacaagaaagagcacaaagactttgttgaggccaataggatcaccagaatggagagcctccaagcaggaattgcaagacttcatcaacaaccatcaatctatcaccaatttgatcacaaaaacaaaaacaaaggtaaattttatgtgtttcataatggtgtctcaagaagaggacacttgtttaactgggatgatcatccctaccttgttgttgatgctgtggaaaatggttggtctagatttgcttttagtaactacaagagcaacatgacatctcatttaaagagatcaacccttttaggagcatgtgcagctggtgaatatggaatgaaaactaatgctgagataagctgggaagtgtgcaatggatcagctgaatatatgcagaagattaggctcaatcctgggttaaaaaaggttcttcacacaaacaactcttccaatatgagtgttgcttctgtcattaggacggttttacctcttcctggccctcctttggggaactatgccttcccacaagaggcctattttgaaatcaccatcttgttttctcatatcgatgatcatgaattggttgttgcgaagagagaaggggagaagacaaaactcctcattgaagatggttccaatggagcaagtgaattggacactgttgaagaaatgaaacttggccagaaagagggtggtgaaaagagtggatctgtgatgttctcattggggttaacagctggagggggtgttcctttgacagttccaggtagctaccctcggagcattggattcaattccaatggttctgtctttcttgaaggaatgaaacttgtaatggagtctgagaaggcacaatggataggaactgatagggtaattggttgcgggtttgatccaaggcagaaaaagtgcattcaaatatgcacctgcaaatgcgcaaagaacaccaaatccatgcttcatagccccacttgtgaattcccctggtgctacccttggctatga

SEQ ID NO: 89709 - DNA, 387 bp, Glycine max
  Peptide Sequence Number=SeqID_206487
atggctccttctctctatcgcccaaaaccctccaaggccatgccggtgaacattgcatcactatccatccaccagagaaactccacttcaggcgtccagaagagccatgttgtagaaaatctcaatcctgtggaccttgcagtagtcaatcttgttcttgatcgatttgacaaggtagtggtctccaaccgggttttcacacggtttcgggaacgaaccggttacaaggaggacgcggggtttgttgggtctgatgaagttgttgttgaaattggaaatggattcggattattattcagtcctgctccggcgtgcgaacttgccgacgccgatggtgccgcggaggacaaccaacgtgaggaagaggcagaggaacgtcaccgtgct

SEQ ID NO: 89710 - DNA, 246 bp, Glycine max
  Peptide Sequence Number=SeqID_206488
atggcttctatggacacctctgctatggtcaactctaagatctttccatgcaatctaggaatgcgggggtccggggaatttgtccccttcttagatacgacgtctaggggtagcaaaatgccccaacgcacgtttttaagaaggcgacacggaccctccgttggtttgtttacagtagggatcaagacagaacccatatgcaatgcctatgcaaaaagacacaatgcgggaatgtacacagtatga

SEQ ID NO: 89711 - DNA, 807 bp, Glycine max
  Peptide Sequence Number=SeqID_206489
atgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaa

SEQ ID NO: 89712 - DNA, 324 bp, Glycine max
  Peptide Sequence Number=SeqID_206490
atggagaagtggggactggggacaaatgaatgcaaccagggtgcatcactacaacgactctccgaagagtgtgaaatgaggtacaaggacatgccaccagcgccttttatatccttcaagtgggttcagttatgccagctacgaggctgtggagggctattgttgaagcaagagttgctgtcagggaaagggtgcttagtgtatcggacttactccgctagaggcagagcggtgcgcacgcccaaaatagccatcgtcaagtgcagcaaggagattcaggagaaggaggaggttatggtttcttcgtgtgtcacatctgcttag

SEQ ID NO: 89713 - DNA, 225 bp, Glycine max
  Peptide Sequence Number=SeqID_206491
atgattacaagtggccctctactagatcttatgcatgattgggaaatatatcgttcagaaaagccaggtcagggaatttccaaaatactctttaacgtttccgcggaagaaccttcttccgccgttaatgttacaactgtggaagaacttcctctgcaggaagccacggaagaaggttattccacagtaacattaactgtggaggaaccttcttccgtgagttaa

SEQ ID NO: 89714 - DNA, 201 bp, Glycine max
  Peptide Sequence Number=SeqID_206492
atgggagagttgggagatgacaagcatttccttgcccatattcaaacatatcatcagctgctccatcaaactgtcaagtccctagctagtctgctgatttacaactgcaactgccccatttacaaagctaatgaaaaatacaggcccaagaattcgttgtcacagatccctcaaaaatacatccaaatgcatcatatatag

SEQ ID NO: 89715 - DNA, 339 bp, Glycine max
  Peptide Sequence Number=SeqID_206493
atggacaaacgctcaaacacatcggcactcagcatctctccaagagtgcacgtgctatgcagggctttgggtggaagagttggtaaatcgaacagagggtgggatattggctttagacaagtgcatttcatgaaagatctagctcgatcttatagctacctagaggaccatgaaatgatgacagaatcgctttccatcgttgaggtacaccaatatgtggtttttgaggttcctctgggtgcacaagtgattggatcgtcagacaaaactggagtggaaatgtttgcgattgcagaccacacattcttggaattcagggtcatcctgagtatagcatag

SEQ ID NO: 89716 - DNA, 462 bp, Glycine max
  Peptide Sequence Number=SeqID_206494
atgccatatcactcagctagattcattaatgaaatgcaacatactatactcagcgaatccgaatccgaatcgaaatacccttcgaatttcaaacctcaagacaacaccggtagtagtgagagttcaataatccactcggtaatcgctgtaatcgtcgcgcgcagcagcagcgacgtcgttctcgaccctctcggcgatcttgtcctcttcgtagttaaggccctcgtcgagagcaagcccgccgagagccccagcaacagcgccaatggcgaggccagcgccgaggcccattttgggaggcttgggcatggggtcataagtggaggagtaatcaagcggagcagaaggcccactgggcccagcgtaacggtcgaagaagggtctaggggggggagggggaggagcgccagaatagtaagcggggtagtaattagaataggagtcagtgtaagaggtgtatga

SEQ ID NO: 89717 - DNA, 240 bp, Glycine max
  Peptide Sequence Number=SeqID_206495
atgtttgtattgaatagtgctttgaaagaatttgatgatactctacaaagtaaacccaaggttgctgctaggtggattgttgttaaatgtaatagacaaaaaggaagcactgagtgtgagtgttacgtcatgcactggatgtcaactataatcttaggaagtttcaagaataattgggaaacatatttcaatgatactagattattggaactagagagattgaaggcgcttcgcatctag

SEQ ID NO: 89718 - DNA, 1158 bp, Glycine max
  Peptide Sequence Number=SeqID_206496
atggccaaaaaatcacagctgcgtacccagaaaaacaatgctactaatgacgatattaatcttaacgcaaccaacactgtaatcaccaaggtgaaacgaacaaggagaagtgtccctagagactccccacctcaacgcagctcaatataccgaggagtcactaggcaccgatggactggccgatacgaagctcatttgtgggacaagcattgctggaatgaatcacagaataaaaaaggacgacaagattatatattgattacaagagtggtcatatccaagtttatggttattaagcaagttttataccatccaggcgcttatgataatgaagaggcagcagcacatgcttatgatctagcagcactgaaatactggggtcaagataccattcttaattttccgttatcaaactacctgaatgaactgaaagaaatggagggtcaatcacgggaagagtatatcggatcgctgaggaggaaaagcagtggtttttctagggggatttctaaatacagaggtgttgcaaggcatcatcataacggaaggtgggaggctcggattggcaaagtttttggcaataaatatctttatctcggaacttacgctacccaagaagaagctgctactgcctatgacctggcagctatagaataccgtggactcaatgctgtcaccaatttcgatctcagccgttacattaagtggcttaagcccaacaacaccaacagcaacaatgaccagattagtattaatctcactaacataaataataattgcactaacaacttcatcccaaaccctgatcaagaacaagaagttagtttcttccacaaccaggattcactcaataatactattgtagaggaagccacgttggtgccacatcagcctcgtccagcaagtgccacgttagcattggagcttctacttcagtcatccaagttcaaggaaatggtggaaatgacatccgtggccaatctttcaacacagatggaatctgatcagttgccacagtgcacatttcctgatcacattcagacatactttgagtatgaagattccaataaatatgaggaaggggatgatctcctgttcaagttcagcgagttcagctccattgtgccgttttaccattgtgacgagttcgagagttga

SEQ ID NO: 89719 - DNA, 735 bp, Glycine max
  Peptide Sequence Number=SeqID_206497
atggcacagggtgtttactattatctctatcaaatattcaggaacaaagctgaagcagctgcactacaacaaaagaaaatgggcgtcggcgatggatcagttgggatgctctcctcacttgttgttgctgttttatctgggtctgttaccgtgctgttgacaaatcccatatgggtagttgctacgcgtatgcagaataaagaaattattaagactattactgagcatttttatttcctttcctataagctcaagtattttcaaaagtatttcaactttacacatagaaaagagttgaacagaactccagctgatcagggtttgttagtttccactgagcagccaattctttctgcagttgagcatcttccttatggaactagtcaggtgattcaagatatctacagtgaagctggaattttgggtttctggaaaggtgtattaccaacattaatcatggtaagcaatccttccatacagttcatgctgtatgaagccatgttggtgaagttaagaaaaagacgtgcttggagtaagaagggtagcaatggggtaactgctttagagatatttcttattggagctttagctaagcttggagctactgttgtaacctatccgatcctagttgtgaaggaccttgggggcaatatggtattctaccagttagaatcttttaagccaagagcaatgaatgctagtttgtcagctctgaagagtgcaggagtggaataa

SEQ ID NO: 89720 - DNA, 1026 bp, Glycine max
  Peptide Sequence Number=SeqID_206498
atgattagccttcgccggagcgtaaacaagatcccggcgaaatcgaagcgattcaaatgccgattggtgaagttcgaggagctgccggagtacttaaaggacagcgagttcatattggactattaccgctctgaatggcccgtgaaggaagccttgtggagcatcttcgcgtggcacaacgaaaccctaaacatttggacgcatataggaggatttctcatattcgccgtgttggcggcgatgagcaccacctcggaactctggaatttgctcagatcgtccacggcgctcgggttgtcgacgaccacggcggcggagatgaacgggtctaacagtgacgccttcccggatttgcattttagacatgttctggacccttccatccttggtgagatgaaaggatctggggtagaaacagttcctcgatggccatggttcgttttcttagctggaggaatgggatgcttagcttgcagttctctttcccatcttctggcgtgccactccaaaggctttaacctatttttctggcgtctagattatgctggcatttctcttatgattgtctcttccttctttgctccaatttattatgcttttttctgcaatcctaacgcaaggttattctatttagcatcaatatctgtgcttggagtccttgccattattaccctactcgcaccttcactttctacacctcgatttcgacccctcagggcgtcattattcctctcaatgggcttttcaggtataattcctgcagctcatgctgttgccctatattggggtcagccgcatatatttgttgcacttggatatgagcttgttatggccattctgtatgctactggagctggattttatgttgctagagtaccagagcgatggaagccaggagcatttgatatcgcagggcacagccatcaaatttttcatgtttttgttgttcttggcgcacttgcccatagtgttgccacactagtcatattggatttccgactgggatcacctacttgtgcaaattag

SEQ ID NO: 89721 - DNA, 1176 bp, Glycine max
  Peptide Sequence Number=SeqID_206499
atggagtggatgggttttgtgtggttgggatcggagaatatggtgatgggtttcaggaagctccgttcagaccttgaaacggtgccgttcaagttggagatcgaggaaccgctacaagaagagcatgctcctctcaacaagcgcttcaaatcttcatccacttcacaagagcaatggaatgcttcaaacagtgcatcttccagttctccttcccagtacaatatacttgatgagcctagccctctgggtttacgtctgaggaagagcccttcgcttttagatttaatagaaatgaagctttctcaagggaatgtgattattgcaaatacacaaaatgaaaactttttaagctctggattgaaaaaggagagtcggggtgctgctgcatcggattctgttgagaagcttaaggcttcaaatttcccagcttcacttttaagaattggttcatgggagtataaatcaaaacatgagggtgacttagtggcaaaatgttactttgctaaacataagcttgtttgggaagttcttgaaggtgaactaaagaacaaaatggaaatccaatggtcagatatcatggcacttaaggcaaattgtcctgatactggacctagctcattgactgtagtgctcgctagacaacctcttttcttcaaggagactaatcctcagcctagaaagcatacaatatggcaagcaacatcagattttactgaaggagaggcttgcaaacacaggcagcattttttggaatttccacaaggcttgttagccaagcattttgaaaagcttatccagtgtgacacacatcttaatttcttaagccaacaacctgagataatcttggattcacctcattttgatacacgaccagctgcttttgagaaccttgacaatccagaagatcttgatttgcatcttgttaattgtaaaggatctaccacatcttgtttgcaggacataggatcacctcattcatccctgtcaccatcatttaagattgaacacaatgatcttcttggcattgcctcggataatctaccttgtgaagcacctttccccagttcaggtactccttacccttgcatatgcaaagaggctgtttccggattcgaacccatgaccaacaagtcaccaaggcacaactttaccgctgcaccagggctcgccctctaa

SEQ ID NO: 89722 - DNA, 2335 bp, Glycine max
  Peptide Sequence Number=SeqID_206500
atgaattcctgtgtgactggaagtttagtccatcagggccagttgcttgttcatattgctgagaatggacactcctttgagttggattgcaatgagaacacactagttgagtcagttatgcggtctattgaatctgttactgggattaatttcagtgatcagcttgttctttgtttggatatgaagcttgagtcgcagcggcagttgtctgcatacaagcttccatctgatgacagggaagtgttcatattcaataaaacaaggcttcagaacaactcgcctgttccaccgccggagcaagttgatattcccagtcatttggagcctccactgccagcctcctcccatgatcctcacccccttgatgatgcttcggatcctgctttgaaggctttaccttcttacgagcggcaattcaggtaccattatcatcagggtcatgtgatttatactggtaccatgatgaaatatgagcattgtgagaggcttttgagggaacagatggtccaagaaagagcggtggaggttgcaaggggtaatttggatcagtactatcgaatgattaaccaaaactatgtggacttcatgaaacgttatatgcaacaacacaggatgcattctgatctattggtgaattttgggaaggatgttgagaaactaagatctatcaaacttcaccctgctttacaaactgctaatcgcaaatgcttactggatttggtcaaggaagaaaacttgaggaagtcagtggagaattgcacctgctcccacaggcagtttgagaataaagtgacacaatttaagcagacttttggggaagtgaagcggcgggctgaggaactgttgtccagcagggctttcttgcccatcaagaatttagaacaagtaattaaagaacaccagagatatataaatgaacaaaagagtatcatgcaatctctgagcaaggatgttaacactgtaaagaaactggtagatgattgtctatcctcccaattgtcctcctcactccgtcctcatgatgcagtttccgccttgggtcctatgtatgatgttcatgacaaaaatcacttgcctaaaatgcagacttgtgatcgtgctatttcaaagctagtcgagttttgcaaggaaaacaagaatgaaatgaatctttttgttcacaattacatgcaaaacataacttatgtttcttatctcatcaaagatcagaagctacagttccctgtttttaaagaggcaatggctcgtcaggatggcttatttgtggatctaaagttgttccatggtattggtcctgcatacagagcttgccttgcagaaatagtgagacgaaaggcttctatgaagctgtacatgggcatggctgggcaaatggctgaaaggcttgctataaaacgggaggctgagctcaggagacgggaggagtttttgagagttcatagttcatgcattcctaaagaagtattagcatctatgggattgtttgacactcctaatcaatgcgatgtcaatatagctccatttgatggtggtttgcttaatattgacatatcagatgtggatcattatgctcctgaatatctaacaggagtaacttccaagctggagaagcaaggaagcgttaaaagttcatctgctttgagtagtgatagctctcacttggctgaggctgtagatattactggtgactcaattgagagatatgattctgaggacttgcttgatggcagtgagttgattgaaattgctggaacctgcaagatggaagttgagaatgcaaaactgaaagctgaacttgctggtagaatagctttgatatgttctctctgtcctgagttggagtatgagtcactggatgatgaaagggtgaataatatattgaagaatgccacagagaaaactgaagaagccttgcatttgaaagatgaatatattaaacatgttcaatccatgcttaagatgaagcagatgcaatgtgtgtcatacgagaaacgtattcaagagttggagcagaaattgtctgatcagtatgtgcaggggcagaagatgtccagtgtaaatgatacggctgactttcctcttgtggctgggaagacagataattacaaatcagaatctatcagtggtgaagccaacatgccttgcatatctacttctgagcccatggatgaggtttcatgcatctcaagttccttggatgcaaaacttggtttgttcacagaacatactggtaaagcgttagatggggtggatgaaaacatgctggattcctctggagttcagaacccgcagttggattcatctatgatggagccgcatcgcgaagaagcacaga

SEQ ID NO: 89723 - DNA, 198 bp, Glycine max
  Peptide Sequence Number=SeqID_206501
atggctgtgactgtatctttgattattttcatcaggttagtttccatagaggaaattcatgccaaaaattacatgctggattcattggtactgaatgaaaattcccacctttccatctttaaggcccagataattcccacccatagagtgttgctaggtgcacccagcattattgctggtgcacccagcattctttga

SEQ ID NO: 89724 - DNA, 636 bp, Glycine max
  Peptide Sequence Number=SeqID_206502
atggcgagggagttgatatcaaaattggatgacttgtgggtcaaggggcttagggttaagtatagagtggaaattgtatcatccctaatgttgtccagtggacaaatgactcttaaacttggaagggagttaaagactaatgttagaaaggtcaattgtgggattgctcaggatcatactttccctctttgtctaacccatgtagaaacgaatttccatgtgttgagagatttttcggtggtgagacctatatgggaagctttcaacaacaattggaatgacaagttaagccttttcttctccttttatatgaaagaatggattttcatgtccatgttgtcgaggaggcagaaagggaggataacttttggccttgccttagcaactatttggtatgccgagaatgatttcattttcaatagccagaattggaatgtgcagagtattgcgtttacttctcttgatgttgatcagactatgaggcttaatattaattgtcttctggttcgtcatgagtctatggtgacttggaaatttcctccaggtggtttggttaagttcaatgtggatggtttggtcaggaactcaagaactttggcaggctatggtggtgttttgaggaatgatgagggttaa

SEQ ID NO: 89725 - DNA, 303 bp, Glycine max
  Peptide Sequence Number=SeqID_206503
atgatcaaagcttatctccccttaaaccagccaagtagtgttctgagcattctagtaacaggagacttccttccaggcctttccccgaatgcaagctgggtgaaggtaataatgcttccatataaagaagcatggagattccatataaagaagcctggagattcaagaaccttctgcaatgttcagttaaagaagtatggagactcaagaaccttctgcaagtcaaaatcacctcttctctctggcagtggagggaaagctaatcctgggtatgatgtctcaaagccttccagcaactgttaa

SEQ ID NO: 89726 - DNA, 2976 bp, Glycine max
  Peptide Sequence Number=SeqID_206504
atgcctaatggtgacactgtcactaccacaatagctggttcagttttgttatatgactcccttgttcttcataatgtttactactttccttcgtttcatgccaatattatctctgttactactctatttgattccaccttatatgatgtgaaactctaccctaattgttgtaaaattgtgcagctacttcatcccaagatgactggatttacaactaggaggattggcaaattgtatgtgcttgacaccacctcacctctggttttctctcccacaactggttttgtcaacacctccatctctcatgatcctgccaccatttggcattttagactaggacatttaagttctcatatacacaaatgtatttcatcttactttccctttgtcactttcaatgacaatcataaaccttgtaatacttgccatttggctaaacaaagaaatttaccttttgctcatagtactactaaatttgttgccatttttgatttaattcatgctgatatatggggacctctttccagcccttccatatttggccataagtattttctaacacttgtagatgattacagcaggtttacttggacaattttcatgagaaataaaagtgaaactagaactcacttagttaatttcatttccttcatagaaactcaattcaataagaaactcaaatgtattcgtagtgataatgggcctgagtttctcatgactagtttttacctttctaaaggtatcatccatcataggtcatgtgttgaaacacctcaacaaaatggcatcgtggaaagaaagcatcaacacattttgaatgtagcacgtgctctttcttttcactctcatctccctcataacctttggcacctctctacacaacaagctatccacattatcaacagacttcccacccctcttttgaacaacctcaccccttatcaaatgcttcattctactcctcccagccttcatcatttaagagtttttggatgtcttgcatactcctcgaccttacataaccatagaaccaaatttgcaccaagggcaagaaaatccatatttcttggatatagggaaggcaccaaaggctaccttctttatgatcctatcacccatgagttctatgtttcaaggaatgtaatcttccatgaaattgtctttccttttgcctcacctccacctgccaataatcctgtcagtgtcaaccttgatattactaccttagacacatctgacattctcctagatcttccactatccttacctccaccaaatgaacctacctcccctcctgcaccaaccagaaaatcacatagactaacaaaacctcctgcttatctctctgaataccactgcaatttgctatcctcaatgctgccagcatctaatccagaacccaaaacttataaacaagcttgtaagtttgattgttggaatcttgctatgaaatctgagttagatgctcttgcatccacaaacacttggtttgttgttgatctgcctgaaggtaagcaaccaattggttgcaaatgggtttacaagatcaagcatcatgctgatggatccattgaacgatacaaggcccgtttggtggcaaagggatacactcaactagagggtgtggattattttgacactttttcaccagttgctaagcttaccacaattcgcacccttctatctgtggctgctattaaggattggcacttagaacaacttgacgtcaacaatgctttccttcatggtgatctgcatgaggaagtatatatggatctgcctcctgggttcttgctgcctggttcttcttctaataaagtctgcaaattacataagtccttatatggactgaaacaggctagcagacaatggttctccaagttatccactgctcttatctcccttggatactcaccttcatctgctgaccattctttgttcacaaaactacataattctcatttcactgctcttctagtctatgttgacgatattgtcttgacatgtgatgatttgcaggaaatacaatctgtcaaacaattccttgactccacattcaaaatcaaggaccttggcaagcttaaatactttcttggattggaaattgcaagatctatgcaaggcatctttctcaataaaaggaagtatgcattggaattgcttgaggacagtggtttattggctactaagcctagtacaactccctttgattgctccttgaagcttcatgacagtgactcacccccttatgaagaagaaataacctataggagacttgttggcagacttttatatttaactacaaccaggcctgacattgctttcattgttcagcaaattagtcaattcatctctcagccattacaagttcatcactcagcagcaattagagtcctcaaatatctcaaaagtgctcctgccaagggattgttctattcttcctcctccacactcaaactctctggttttgcagactcagattgggcaagttgccctgttactcgcagatcagtgactggttactgtgtctttcttggcacatctatgctgtcttggaaatctaaaaagcattccacagtatccaggtcaagttcagaagcagaatatagagctttggctagcttaacttgtgaattacaatggctgcagtatttgttcaaggatcttcacatctctcttgatcaacctatctcagtctactgtgataataagagtgctatctatcttgctcacaaccccatcttccatgagaggacaaaacatattgaaattgactgtcatgtcattcgtgagaaaatacaaactggcctcattcatctcctgccggtttcttctgctgcacaattggcagatgtacttaccaagccattgcctgctccctccttcaattcattaatttccaagcttggcctattagacattcatagtccagcttgtggggggctattacatgatgtaaatagtaactctagttag

SEQ ID NO: 89727 - DNA, 351 bp, Glycine max
  Peptide Sequence Number=SeqID_206505
atgaattcttaccgttgggggaggaaagatactggcgggaagttctgtttcactgaaatttccttctatgttcttggttgttcttgctgtaatatagcatcaatagcgatgttaggattcataagttcctggaaaagactagaagtcaccagagttcagaagctactgaaagaggaagaatctggcccttggggtcgtgatatccaggctaagctgggaagtcgattaatagaattattaattgaaacagcatttgtacactctccagttaatcagtctgctgatactccacctgatattcgaccagcattcagtcatagatttaaagccatatcaaagaatccagagtga

SEQ ID NO: 89728 - DNA, 2796 bp, Glycine max
  Peptide Sequence Number=SeqID_206506
atgatgtgtttgtttagaatctttagatcaatagtgcttctatttttctttctgggcactgttcaatctagagtacttcatgggaaagaaaatgctggcatcgtcaatggaaaaaattcacttatttcattcatgtcaggcattgtttctgaccctcaaaacgctctaaagagttggaagtcaccgggtgttcatgtttgtgattggtcaggtgtaagatgcaacaatgcaagtgacatgataattgagcttgatctcagtggagggtcactaggaggcaccatttcccctgctcttgctaacatatcttccttgcaaattcttgacctttctggcaactattttgtgggtcacattccaaaggaactaggctatttggttcagcttggacaactcagtttgtctgggaattttcttcaagggcacattccatccgagtttggttcacttcacaacttgtactaccttaacttgggaagcaatcatcttgagggagagattcccccatcacttttctgtaatggaacttcactgagttatgtagacctctctaacaattccttagggggagaaatccccttgaacaaagagtgtatccttaaagacctcaggttcctattactttggtctaacaagcttgtaggccaagttcctttagctcttgcatactctaccaagcttaaatggcttgatttggagttgaatatgttgagtggagagcttccttttaagattgtaagtaattggccacaactacagttcctctacttgtcatacaacaattttaccagccatgatggtaataccaaccttgaacctttctttgcctccttggtgaatttatcacactttcaagaactcgaattggcaggaaacaatcttggtgggaagctgcctcataacattggtgatcttcccaccagcctgcaacaacttcacctagaaaaaaatctaatatatggctctatacctccacaaattggcaaccttgtcaacctgactttcttgaagttgtccagtaacctattaaatggatctatccctcccagcctcggtcacatgaataggctagagagaatttatttgtcaaataattcactatctggtgatattccatcaatccttggtgatataaagcatctgggacttctagacttgtcaagaaacaagctttctggtccaataccagatagttttgcaaatctctcccagttaagaaggcttttactttatgacaaccagctttctggaacaattccaccaagtctgggaaaatgtgttaatttggagattttagacttatctcacaacaagataacaggtttgattcctgcagaagtagctgccttggatagcttgaaattatacctaaatttgtcaaacaataacttacatgggtctttaccattggagctcagcaaaatggacatggtgctagctattgatgtatccatgaataacctctctggcagcgtccctccacaactagaaagttgcacagcactggagtatctcaacctctctggtaattcctttgaaggccctctcccttattcattaggaaaattgctctatattcgagcacttgacgtgtcttcaaatcaattgactgggaaaataccagagtccatgcagttgtcttcctctctcaaggaacttaacttctctttcaacaaattctcagggagagtctcacacaagggagcattttcaaatcttaccattgactctttcctaggaaatgatggtctctgtggccggtttaaaggcatgcaacattgtcacaagaaacgtggttatcatttggtgttcttgttgattcctgtgttactatttggcacccctctcctatgcatgctttttaggtactccatggtaacgatcaagtcaaaagtgagaaatcgaattgctgtcgttagaagaggtgatttggaggatgtagaagagggaacagaagaccacaagtacccaagaatttcatataaacaacttagagaggccactggaggcttcagtgcttcaagcttaattggttcaggccggtttggacaagtctacgaaggaatgctacaagataatacaagagtagctgtgaaggtgttggatacaacgcatggtgagatttcaaggagctttagaagggaatatcaaattctgaaaaagataaggcacagaaatttaataaggatcatcacaatttgctgtaggccagaatttaatgcccttgtttttcccttgatgccaaatggtagccttgagaagtacctatatccaagccaaaggttggatgtggttcaattggtaagaatctgcagtgatgtagccgagggaatgtcctatctgcaccattactctccagtgaaagtagtgcattgtgatcttaagccaagcaatatactccttgatgaagatatgacagctttggttactgattttggaatttcaaggcttgtacaaagtgatgagaatacatccatcaatgaatcagcatctttcagttcaacacatggtttgttatgtggctcagttggttatatagctcctgactcactatatattctgtattacactttcttggacacagaatacggaatgggaaaacatgcttcaactgagggtgatgtagacgccccacagatgtactcagccatgaaggctcaagcttgtgtgagtggattaaaaagcaatacacacaccaacaccaacttgaaaactttgttgaacaagcactgcaaaggttctctccttgtggcgtgccaaaccatcgtaacaaaatttggaaagatgttatactag

SEQ ID NO: 89729 - DNA, 423 bp, Glycine max
  Peptide Sequence Number=SeqID_206507
atgaagttgttgaagcttagatccagcgactccaaagtggagagagccgaggaagccgttgaaggccacctcgagttccttgaggatggtcatttgcgtgagaacgtccatcgacaatgcgccacagaagaggttgctggagacgtcgaaggactgaatataggtgcacgcgtcgaacgagggagagaggaatctggccgtggaagccgacgtcgtagcagtcggagaagggggcgagggagagacaaagcttggaagaagaaggccgccagtgccaatggcggtataatgggtaccgctagtagcaacagcgggacaagctggctgagtaggagtgagaaatgggtaccgccatttctcctggcgggacatgcctacgtgggcagtcccgcctttggagttggcgggataggggcaaagaag

SEQ ID NO: 89730 - DNA, 1461 bp, Glycine max
  Peptide Sequence Number=SeqID_206508
atggctgaaagtgatataagagccatgaaggagacactccgcgcccaacagcaacttctgcagaagctatatgcggagttggatgaggaaagggaagcctcagcaactgcagccagtgaagccatggacatgatagtgcggttgcaaggagagaaggccgcggtgaagatggaggcgagtcactacaagagaatggcagaggagaagataggtcatgctgaggccactcttgaagtttttgaagagcttatgtatcagaaggaaatggaaattacttctcttgagtatcaagtcctggcttataaaaacaaacttctcacgttggggtctgatttcaatgcaagtgattttgaattcgatgaggacctgttgttgagtagaaatgatcaacaacaaaatggagaaaatggtcaagcttgtagcacggtaagaaggctaagttcacttccccctattccgttaaagaacaacttgagatctgctaggaagagagatagatcacctagtcctgttccggttccagatatggttcataacataatggagagtgatactgatcaagaagttacttctccaagcttggatttaccgagaaaatcggtagactatggacatggaactcttgatgcatactggaaccagatccagacgttagatgaaaaagtgaaagtgatttcagattgtaaagaatcaggaggagaaaaacgcaccacattgaggagtagaagagggagatcatgttcagtgttttcacaagcaagcaccaagataacctgtgacctaactgatagagtaggccctacttgttcagataaagtaaatcacagtgaaggtacatacgatggagaagcagttgctattccctcatgctccggtaatgtccatgatgtgtttgaagtcccacaaacgagtgaaaagcataaagcaagtggaaatgggaaaagaagacttgagagatggagttcagatgcagataacagattgacaaaaccagactcggtgtctgaggaagtcattgaatcgcatgttaaacatgacatggacaagctaaagagcatgatgattagtggaaaccatgaaatcaaaatacctagtcccaaagatatgaagaccattgtttggcagagaaaagaagggatggatggggattgcaatgctcatgctgagtttcaaaagttgcatcagagaattgatcagcttgagagggagacaatcaatgcaaggaaagagattatgcatgaagtgaatgggaaagagcatgtgaggttgttgaaggacatatgcagccaactcaagttaatggagtcagagatgagaagttggaaaacccaaaaagcaccacctaagagtagtaagagggataattgtttggatcctcttcaagaggtaatgcatactctagtgcttttgccttcttttgagaagaattgtctgttgcatgcaaatatctcctttatttga

SEQ ID NO: 89731 - DNA, 510 bp, Glycine max
  Peptide Sequence Number=SeqID_206509
atgaaggcttggaaggttcgagaagcttcaagaggaagggttggtggagggagggggatgaagttcgggaagattgttgaattcggggtgtttgcgaggaagaagagaaatggaatgggaggttgtgctgcgataggcgtggaggtgtttatggcttgcagtggttccaacgtgagtgctgagcttgttgaggatgctggatgggttgaacttcaaggaatttgttgccttcttgtccgccttcagtcccctgccactctccaccacaaaattgagtctaagcaagtctatgattccgattgcaatggaaaagtaaccttccatgacatgctgagggctttaagggatttgagtggacccttcatgtctgatcaacagagagaggaagttctgacacaggtccttgaggaagctggctatgcaaaggattgttcattagtcttgtctgacttcatgaagattcttggcaattcgggtttgaagatggaagtagaggttccggtggattag

SEQ ID NO: 89732 - DNA, 786 bp, Glycine max
  Peptide Sequence Number=SeqID_206510
atgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgaaaagactggcggatgataagtgccgtgacgttaacttcaccgtcggccaatgggtctacgttaagctgcgaccctttcgtcaacgaacagtagcaggcctgatacaccccaaattgtccaagagatattttgggccgtttcaggcaatagaacgcgtgggtcaagtttcttatcgactcaaattacccgaggaagcaaggatccaccccgtgttccattgttcacttttgcgcgaacaccatggcccttccccgacaccactggatagcttgccgttacaattcattgctcagaaaccagtagcacgccctttgtgtatcctggattctaaaatcgaaacatcatcatccccaccaacaagactcgtgttagtccaatgggagggtcaacctccagaggacaccacctgggaaaagtggtcagaaattcgggaccttcatcaccttgaggacaaggtggtgttcgcgggcgagggtattgttagcaatcatctacaagatctcgaggatagggtaccgagctcgaattcgtaa

SEQ ID NO: 89733 - DNA, 405 bp, Glycine max
  Peptide Sequence Number=SeqID_206511
ggggccggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccttgtcaagaggggtgtgtggaatgtctatgaattcttggcatcatttgcacttctttgtgaagtcgagggtgtcttctctgagtgtaggctaataccactttggttgcaagggagcgccccttggcatttgagcaaggatgctgtcaaccctcttttgaatagcttgccatcgaggatgatgtag

SEQ ID NO: 89734 - DNA, 230 bp, Glycine max
  Peptide Sequence Number=SeqID_206512
atgggatgtccagttgaaggtggattcattgttgcatttgatccccttgatggcttcagcattgtggacacaaatttcacagtaggcaccatctttgctcctttgaggttcttgattgaaaaagctgaaggttacaacagtgatgttcatcagtctgtgctagataaagtcatcactaacattgatgagataactcaagttgcttatggatccaagaatgagatcatccg

SEQ ID NO: 89735 - DNA, 243 bp, Glycine max
  Peptide Sequence Number=SeqID_206513
atgaacagtgagacacttaaacgtgtcttgagtgagcgagacaagaacctgccaatgcatacatctgtcatggatctctgttctgaaccctttgtttctttcaggaaacaatgcctccgaatcatgtttggttttcacaatagttttatggggatggacaatgatcgtccctgcacgtggacctccttgtctttacccataacccaaacaacaataccaccatcgacttcaaacttcaattaa

SEQ ID NO: 89736 - DNA, 1407 bp, Glycine max
  Peptide Sequence Number=SeqID_206514
atggcttccaatattcatgatgaatctgtttcatcagctccaacacgtgcttatgaaactaaacccagttcaaaatcaataccccagcaaagtgtcatagacattgaagccaccacactagaaatggaagcttttagaggcccaagaaagatcaatggatcagctggtgagactcagaaagaagagattggtatctgcttgacatggaaggatgtatgggtgactgcttccaatagaaagagtggaagcaaatcaattcttcacgggctaactggttatgctaagccagggcaactcttggcaataatgggtccctctggctgtggcaaatctactctacttgattctttagcagggagattaggttcaaacacaaggcaaaccggggagattctgatcaatggtcacaaacaagcactgtgttatggaacctcagcatatgtcacacaagatgatacattactcaccaccttaacggttagagaagcagtgcactattcagctcagctccaattacctgacaccatgtccaaagaagagaagaaagagagagcagatttcacaatcagagaaatgggtcttcaagatgccattaacacaagaattggagggtggggttgtaaaggcataagtgggggtcagaagaggagagttagcatctgcatagagatcctaacacgcccaaaacttctctttcttgatgaaccaactagtggacttgatagtgcagcttcctattatgtcatgaaaagaatcgctgcccttgctcaaaatgaccacattcagagaactgttattgcgtcaatccaccagcctagtagtgaagtttttcaactcttccatagcctttgtcttctgtcttcgggtaaaacagtttattttggacctgcttctgctgcaaaggagttttttgcttcaaatggttttccttgtcctcctctcatgaatccatctgatcatttactgaaaactataaacaaggattttgatcaggatattgaagcgggtttagcaggaactgaaaacatactcacagaagaagtaatccacatccttgtgaactcatacaaatcatctgaaaggaatcaagaagttcaaaatgaagtagctttactatctaagaaggacaccagttcattggatatgaagaaagggaatgcaggcttccttaatcaatgcttagttctaaccaaaagatcgttcattaacatgtatcgtgatctaggctattattggttacgccttgtcatatatattgcattggccataactttagccactgttttctatgatttgggaacaagttatgactcaattaaggatcgaggttcacttgttgctttcataaatggattcattactttcatgaccattggtggatttccttcctttgtggaagtcatgaag

SEQ ID NO: 89737 - DNA, 384 bp, Glycine max
  Peptide Sequence Number=SeqID_206515
atgcagacacatgccgaggttgtcgtcgggggaagcgttgatggcgaatgcataggtgaagttgtcgggggagagggtggtgtttttgcggagatgggtgtagagggaaatggaggaggcgtcgggggagaaggagaagcctttgatgaggacgttgaagaggaagatgtcgggtttgggaacggagaagaagagggcacgtgcgtggcgcgtggcgccgacgtcgaagagcttctgggcgagcttagtgacggtggcgaggccgtgctggtaaccgttgcggatgagctgcgcgtgggtttcggcaaggtgagggaagagacttattgtttgttacctttggactttggtgttgaaaatgatatgatatgtcagggttggtaa

SEQ ID NO: 89738 - DNA, 1311 bp, Glycine max
  Peptide Sequence Number=SeqID_206516
atgatttctgggcttagttgtaatggtgagactgagtgcgcggtgaatttttttagagaattacttgtttctgggcagagagtgagttctagcacaatggttgggttgattccagtgtcttctccatttgggcatttgcatttggcttgctgtattcaggggttttgtgtgaagtctggtactgttttgcatccctctgtttcaactgcactcacgactatttacagcaggctcaatgaaattgatttggcaaggcagttatttgatgaatcgttggagaaacctgtagctgcttggaatgctctgatttcaggttacacgcagaatggtttaacggagatggctatctctctttttcaggaaatgatggcgactgaatttactctgaatccattgattaaaagcaaaaatcttgagcaaaacatttatgtcttgactgctctgattgacatgtatgccaagtgtgggaatatttcggaggcttggcagttatttgacttgacgagtgaaaagaatactgtcacttggaatactaggatttttggttatgggctccatggatatgggcatgaagcacttaagcttttcaatgagatgttgcatttggggtttcaaccatctagtgttacttttctttcagttttatatgcttgcagtcatgctggcttagtaagagaaagagatgaaattttccatgctatggttaataaatacaagattgagcccttagctgagcattatgcgtgcatggtggatattctgggacgagctgggcaattagaaaaggcattggaatttataaggagaatgcctgttgagccaggtcctgcagtgtggggtacattgcttggcgcttgcatgattcacaaagacacaaacttggcccgggtggcttcagaaaggctatttgaactggatccagggaatgtaggatactatgtcttactttctaatatatactctgtggagagaaacttccgaaaggctgcctcagtacgggaagtagttaagaaaataaatttgtcaaagactccggggtgcactgtaattgaggttaatgggaccccaaacatctttgtatgtggtgatcgttctcattctcaaacaacagctatctatgcaaagctggaggagttaacgggcaagatgagggagatggggtatcagtcagagacagtcactgccttgcatgatgtggaagaagaagaaaaggaactcatgtttaatgttcttagtgagaagttagctattgctcttggccttattacaactgaacctggtacagagatcaggatcatcaagaatctttga

SEQ ID NO: 89739 - DNA, 195 bp, Glycine max
  Peptide Sequence Number=SeqID_206517
atgtggcacaacaatagtggagtggtgaggttgagacttgagaccaagtttatgttttatgaaggaacactgaggcttgtaggttttgagccacctccgtcaacaaacacgcttctaaatggatcgaccacctctgcctcattggtgtttggctcctgcacggaacacatagctagcgacgatgtaattcaatga

SEQ ID NO: 89740 - DNA, 2304 bp, Glycine max
  Peptide Sequence Number=SeqID_206518
atgaaacaaggctcacttacagtgactgagtatttcactcgtctacgtgtaatttgggatgagattgagaactttagacccgatcccatctgttcctgtaatatcaggtgttcctgcaacgcattcaccattatcgcgcaacggaagctcgaggatagagccatgcagttcctacgaggcctgaaggaacaatatgctaatattcgttctcatgttctcctcgtggatcccatacccgctatctccaaaatattctcctatgtagctcaacaggaaaggcaactactgggtaacaccgaaccaggtattaacttcgaacccaaagatatctccattaacgctgctaagaccgtttgcgatttctgtggacgcattggtcatgtggaaagcgcgtgttataagaagcatggagtgccctctaatcatgatgcaagaaataagagtaatggaagaaaagcatgtactcactgcggcaagataggacatactgtagatgtatgttatcggaaacgtgggtacccgccgggatacaagccttacagtggaaggaccaccgtgaacaacgtagtggcagttgaaagcaaagccactgatgatcaacctcagcattacgagtctcatgagtttgttcgcttctcccctaaccagtacaaggcacttcttgccttaatccaggagccatccgcagggaacacgacactcactcaacccaaacaggtggcttcaatctcatcatgcaccatcaatactccaacaaacccaggtatgtctctttctttcagagcgtctctcacctcctggatattagattcaggggctacagatcacgtaacctgctccctgcacaatcttcattcccataaacaaatcaatccaatcacaatgaaacttccgaacggtcaatatgttcatgcaactcactcaggaactgtccagctctcgtccaacataaccttacacgatgttctttacataccctctttcacattcaatcttatttcgatatcaaagcttgtgtcttctattaattgtgaactaattttttcttccacatcatgtgtactgcaagaaatgaacaaccatatgaagattggtatagttgaagcaaagcatggtctctatcacctgatacctaaccagttgaccaccaaagctgtgaactctactatcactcatcctcgatgcaatgtaattcccatagatctttggcattttaggttaggtcacccatcagctgaaaggatacaatgtatgaaaacctactattctcttctaagaaataataagaactttgtctgcaacacatgtcattatgcgaagcacaagaaaatgcctttttctcttagtaattcacatgcatctcatgttttagatttgcttcatatggatatatggggtccgtgttctaaaccatcaatgcatgggcataaatatttcttgaccattgtcgacgattgttcacgcttcacatgggtacatctcatgaaatctaaagctgaaacacgacaagtcattatgaatttcattacattcattgaaacacaatacaatggcaaagttaaaatcatcagaagtgataatggaatcgagttcttcatgcatcattattatgcatcaaagggaatcatacaccaaactacatgtgttgaaaccctagagcaaaacggtatcgtagaacgaaagcatcagcatctactcaatatcacacgcgcactcttatttcaggcgagtctaccacctagcttctggtgttacgccttgccacatgccacacacctaattaattgcatccccacaccatacttgcataacatctcaccttacgaaaagctacataagcatccatgcgacatctctaaccttcgtgttttcgggtgtctgtgcaacattaatacgctcaaagcaaatcggcaaaagcttgatgctagggcacacccatgcatcttcattgctccctctccgggacccttttccggcaagagccttgacccacaaatagaaaatcgctcatcacaacccacgatatcaataccgtcatccaatgaaccttcaaatgagcaacctcttccacatcttaggaatttcgtcatgagcatttcctcaacagcagaacctacctcatatgccaaagcttctcgccatgactgctggattaaggcaatgaaggtcgagttacaggctctccagtcgaacaacacatggagactcacaccttttcctcctcacaagacagctattgggtgtaggtggatatacaaaatcaagtatcgggcagatggatccatagaaaggcacaaggcgtga

SEQ ID NO: 89741 - DNA, 2760 bp, Glycine max
  Peptide Sequence Number=SeqID_206519
atggcgacaaaagaaggcaaagccataggcatagacctcggcacgacctacagctgcgtgggcgtgtggcaaaacgaccgcgttgagatcatccccaacgaccaaggcaaccgaaccaccccctcctatgtcgccttcaccgacaccgagaggctcatcggagacgccgcgaagaaccaagtcgcgatgaacccgcagaacaccgtcttcgacgccaagcgtttaatcggtcgcagattctcagactctcctgttcaaaacgacatgaagctgtggccgtttaaggtcgtggcgggaccgggcgacaagcccatgatcgtggtcaattacaaaggcgaggagaagaaattctctgcggaggagatatcttcaatggtgttggtgaagatgagagaagtagcagaggcgtttctcggacacgcggtgaagaacgcggttatcactgtccctgcttacttcaacgactctcagaggcaggcgacgaaggacgcaggggcaatttcgggtttgaatgtgttgaggattatcaatgaacctaccgctgctgccatcgcgtatggattggataagaaggcttcgagaaaaggtgaacagaacgtgcttattttcgaccttggtggtggcacttttgatgtttcaatattgaccatcgaggaggggattttcgaagtgaaagccactgctggtgatactcatcttggaggtgaagattttgataacagaatggtgaatcactttgtttctgaattcagaaggaagaacaagaaggacatcagtgggaatgctagagcgttgagaaggttgaggacagcgtgtgagagagcaaagagaacactctcttctaccgcgcagacaactattgaaatcgattctttatacgaagggattgatttctatgctacaatcacgagggcgaggtttgaggaaatgaacatggatttgttcaggaagtgcatggagccggtggagaagtgtttgcgtgatgccaagatagacaagagtcatgttcatgaggttgtgcttgttggagggtccactaggatccccaaggttcagcaactcttgcaggatttcttcaatgggaaagagctttgcaagagcattaaccccgatgaagctgttgcatacggtgcttcagttcaagctgccatcttgagcggtgaaggagacgagaaggttcaggatttgttgctgctggatgttacacctctcagtctcgggctcgaaactgcgggtggtgttatgactgtactaattccgcggaacactacaattcccaccaagaaggagcagattttctcaacctattccgataaccaacccggggtgttgatccaagtgttcgaaggagaacgagctagaacaaaggacaacaatcttcttgggaagtttgagcttactgggatccctccagcaccaagaggagtgcctcagatcaatgtctgcttcgacatcgacgctaacgggattctgaatgtctccgcagaggacaagactgctggtgtgaagaacaagatcacgatcaccaacgacaagggtaggctgagcaaggaggagattgagaagatgttgaaggatgcagagaggtacaaggcggaggatgaagaggtgaagaagaaggtggaggcgaaaaactcgcttgagaactacgcgtataatatgagaaacacaataaaggatgagaagattggagagaagttgagcccggatgagaaggagaagattgagaaggctgtggaggatgcgatacagtggttggaggggaaccagttggcggaagtggatgagtttgaggacaagcagaaggagttggaagggatctgcaaccccatcattgcgaaaatgtaccagggtgctgctgctagacctggtggagatgttcctacgggtgatgatgacatgcctggtgctggtggtgctggttctggcgcgggacctaagattgaagaagtttcaggaatcgtgaataaggtcttttttgcttcatgtgatgagtgtaatatcagagatggagttgagattaatcgtgctcgacgtcgttgttggcaagagaggtcgtcatctccgaatcgcagagtcatcgtggacgcgaagggagcgctccacctccaccctcacgagatcccttttgaatcgcacaaccaaattgcacacaaaatcccccttgagaaaccagcactctatcgacattgtgatattacgagcgccgcggctgtggtcctctccggctcttcttcacctgcgtttaaagaattggatggtgcgaacaaaggattctctggtggtggcgaggggaagtccatcggagatgacggcatcgttgatggcagcgctggtgtgggagttgacgatgacgaagttgtatgcgacaacggtccgcgcgccatggctggcatcacaaccttccccttcaaactctctcactgtcctctcttctctacttccgattccaaactcttcggccttcccctctccaatccctattccatcaaattcgacccttcttctctctccagtacctctctcccctacgtcaccgcccgctactacggcggcggcggcggcgcctctccccgctcccccaacgacccccgctcccgcaagtcctccgattctgacgacgacgataaagctctcgacctctccactctcaggtcagataccgtgaggcttattgatcagagccagaatatggttggagtagtgtcaatcgatgacgccattcaaatggctgaagatgtcgaacttgacttggtatga

SEQ ID NO: 89742 - DNA, 1710 bp, Glycine max
  Peptide Sequence Number=SeqID_206520
atgggtccttctggctgtggcaaatccacactacttgatactttagcagggcgactaggttcaaacacaaggcaaaccggggagattctgatcaatggacataaacaatcgctggcttatggaacctctgcatatgtcacacaagatgataccttgttaacaaccttaacggtcagagaagcagtgcactattcagctcaactccaattaccagacaccatgtccaaagaagagaagaaagagagagcagatttcacaatcagagaaatgggtcttcaagatgccattaacacaagaattggagggtggggttgtaaaggaatcagtgggggtcagaagaggcgagttaacatctgcatagagatcctaacccgccctaaacttctctttcttgatgaaccaactagtggacttgatagtgcagcttcctattatgtcatgagaagaattgctaccttggctcagaatgacctcattcagaggactgttattgcttctatccaccagcctagtagtgaagtttttcaatttttcaataacctttgtcttttgtcatcaggtaaagcagtttactttggacctgcttctggtgtaagtgagtttttcgcttcaaatggttttccctgtcctgttctcatgaatccttctgatcattttctgaaaactataaacaaggatttcgatcaggacattgaggtggatatatcggggaatagaaaaatacccacagaagaagcaatccacattcttgatattagttcaatagactggaagagagggcatgcgggcttccttaatcaatgcctagttcttactaaaagatcgttcgtgaacatgcgtcgtgatctaggctattacttgttacgccttgccatatttgttgcattggcaatagctttggccactattttctatgatttgggtacaagttacgtctcaattcaggatcgaggttcacttgttgcatttattaatggattcctaactttcatgaccattggtggattcccttcctttgtggaagtcatgaaggtatttcaacgagaaaggcaaaatgggcattatggtgtcactgcattcgtcattgggaacaccttgtcgtcgattccatacttgttattgattacaattattcctggggctatagcttattaccttcctggtcttcataatggatgcgagcactttctgtatttcatttgtgttttattttctagtctcatgttagtggagagtcttatgatgatagttgcgagcgttgttcccaactttctaatgggtatcatgactggtgctggaattctaggaatcatgcttttacttggcgggttctttaaattgccacatgatattcctatcccggtttggagatacccattacactttgttgcttttcacacgtttgccaaccgtggaatgttcaagaacgagtacgaaggactaagatttgcttccaatgaagttggaggaggttacataagcggtgaagaggttttgagatatgcatggcaagttgacatgagttactcaaagtgggttgatcttgcaatcttgatagggatgatttttctttatcgagttttgtttttggttatcatcaaggttaaagagaaggtgaggcccgttgttgtatcattatcatgtatgtcagcgtcttccaagcgaacaatacaagtcatggaaaatcccaacgccactcctttacattga

SEQ ID NO: 89743 - DNA, 325 bp, Glycine max
  Peptide Sequence Number=SeqID_206521
atgagctctatacttcaacctaatgctagtgattgtgaatcaaacaatagctcaaaaattctgccaccccttttagaatttgatacctcatttgaggtagaattagaaaggatcaaatcagtagaaactggtaaagatggtgaggaagatcaagaggagggtgttttcttgacgtgggaggacttgtgggtgacagtttcaaatggaaaaaatggaaggaaaccaatacttcagggtctaaaaggctatgccaaaccagggaaactcttggccataatgggtccctctggctgtggcaagtcaacacttcttgatgctttagcag

SEQ ID NO: 89744 - DNA, 579 bp, Glycine max
  Peptide Sequence Number=SeqID_206522
atgcaagctcatgggcaatctcccactctcatcttaaagcttttaatgagccgcatcctgaacctggaacttgttgaaggaattatcaacagcctagttacacgtttgattaggcagatgtgctcgtccttgtcagaaactgggtctcaacacacgggaaccaatgctcaattttgtattcaacatttgatccgtaaacttggaagtgagccttatattggtcagcgggcaatactttcagtttgtcaaagaattttggtactagctgaacgtttgcttttctctgatccttttgatgatggctttcctaacatgcatgaaagtatgttcataatgatccagcttatcgagttcttggtgacggattacttatcagagtggtcaaaagctgaagattttgacaacttgctccttgaagattgggtgacatcaattgtccagttaagaaaagcattagaacttctggaaagcagaaatggactttatgctctctatatggaccgagtcacaggaaaaactgttactgagaaaaatgaaaaaacgaatgtggtgcctggtaatggaacttatgtaagctag

SEQ ID NO: 89745 - DNA, 393 bp, Glycine max
  Peptide Sequence Number=SeqID_206523
atggccacaccaatagagcagtcagcaaagaatccccccactgtctcttggaacttggaaggcagagcttacggaagcacatgcactgaagatactggagattttagaacctccaagccagaacaaaaggagcctaaaccaatgcacggtatgatcatgggatcaagcaaaccttgcagtcaaagaaaatttccagaattgcatgctgccagatatacaaggatttctcggttaggaaaagcagtttatagaggaccaagcaacttaaggccccgcaatgttcggaatgcatcaaactccaattcaatcaaacctccatccttattcatggcggcacttgggcatctggtttttggactgcttttagttccttgcttctatcgaattacttag

SEQ ID NO: 89746 - DNA, 486 bp, Glycine max
  Peptide Sequence Number=SeqID_206524
atgaaaactgaaacagagccaaatgaaaccgagtcagattggagcgagttgactcgcgagtgcctcatcaacatcctctctcgactcagcgtcgaggatcgatggcgcggcaccatgctcgtttgcaagtcatggttcagcgtcttcaaggaaccctctcttcacttcgtcttcaacctcgaccctcaattcgactcgcccaccgaatcaactcgctggtggacccccgagttcgaggccaagatcgataacatgcttcgatctgtcgtcgaatgggcccaatcctctctcacccatatacgcattcgccactgttctgatcgttctctcgccctcgtcgcccaaaggttccaactttctcccaaattccaatacccttttgtttttccttcgctaatcgatggtggccccaattgggtctcaaaactttggtcctttaagtgtgtgtttgggttatcatttgcaaaactgattttgcaaatttaa

SEQ ID NO: 89747 - DNA, 162 bp, Glycine max
  Peptide Sequence Number=SeqID_206525
atgccaatctccccctgcagatgtatcggttgggatcgcgcccacaagatgcctagtgggcccgaagaagtccaacagggccttggggtttccagctctggttgcgggcctctgttagtcctacagggtgcccgttcccccagcgaggtcatgacatcgtga

SEQ ID NO: 89748 - DNA, 1304 bp, Glycine max
  Peptide Sequence Number=SeqID_206526
gcgacaaactcgttcaccaccagtttctgacctatcaggctgcccgccagcgccgcatcgtgccacgccacgcccatcagccacgccagcggggccagcgcgaagccgagtattccctgcaggctgatgtcgccgtgaccaaaccagccgccgatgccgccgagtatgccgttgagcatcgcgataataccgacaaacgccatcaccaccgtcgccagaccagcggctattttcatcccggtaatcgctccgctggcggcggcttcaatcaggctgcgtgccggcgtgtcgctaaacgacaggtgggtaaaagtcacctgcgacgcttccgttgccggactgagcagccgggcgaacagaatgccgccgggaatagccatcagcgaggcggccagcagatattcaattggtacccccagcccggcatagccgagcattgtggaaccggctatcgaagccatgccgctgcagatggcggtgaacagttcgttgcgattgagacggttgacgaagggtttgacgatggccgggatctcattctggccgaggaaaatggtggtgaccgccacgaaggattcgatcttactgatattaagcgcgcgctgaaagatgccgcccagcaggcgaataatggcgcccatcacgccaatatagtagagcacgctaaccagcgcggtgataaagatgatggccggcagaacgtgaaaagcaaacacaaagccggcgccgttaaacaccttgtccatttgcggtccggccagcgcgccaaacagaaacgcgctgcccgcatcactgtaagccagcgcctgatgcacgccgctggcgactttttccgccagccatttgcccggcggcaaatagaggatcgcgccgccgagggcaatctgaatcacagaaacgcgatcgccagtaataccaccatacccagaacacttctcattatatccatcatgatatttcctgatgtcagcctggtgaggttgcatagcgaaccaggcggtatccagcgtgatgcccactttggtgtttgccggtttccccagcacgccgagcgcatcacacaccgtgcggccatagcagggaccgctgttgacatcgatttcgacaaacatcggctgaacgttgaaggcatccggattgatcagataggcgacacaggtggcgtcatgcaccgggccgcctgccagaccgtaattgtcgtgctgggttttcaacgtaaaattcatcatgtcactgaacagctttccggccgggccgccggccttttccatgcggctaatgatgtccggcgtgcacaccgtctg

SEQ ID NO: 89749 - DNA, 1929 bp, Glycine max
  Peptide Sequence Number=SeqID_206527
atgactaacattccttatccacaacctgaggttttgcaaactaatgataaagttttaaccacatttgaaggtgatgctattaagttaacagaaatcagtgaaagtgttcaaagagaggacataacagggacatgggagaatttgtgggtcactgtttcaagtgggaagaacaagaagccaattctgcaggatcttacgggttatgcacggccaggaaggattcttgccataatgggcccttcaggatgtggaaaatctacacttcttgatgctttagcaggaagattgagctcaaacatgaagcaaacagggaagattctaatcaatggccagaagcaagcactggcctatggcacatcaggctatgtaactcaagatgatgctatgctgtcaactttaaccactggagaaactttatactactcagctcagctccagtttccagattccatgtccatagcagagaagaaggaacgcacagatatgacattgagagaaatgggtctgcaagatgccatcaacacaagggttggagggtggggttctaaaggcctcagtgggggacaaaagaggagacttagcatttgcattgagattctaacacgcccgagacttctcttccttgatgaaccaactagtggacttgacagtgcagcttcatattatgtcatgagtagaattgcaactctaaatcaaagggacggaattcgaaggactattgttgcatccatccatcagcctagcagtgaaatttttgaacttttccatgatctttgtcttttgtcttctggtgaaacagtatattttggtccagcctctgatgcaaatcagttttttgcttcaaatggtttcccttgcccaactctccacaatccttctgatcactacttaaggatcataaacaaagattttgaacaggatgctgaaaaaggccttggaacgggagtaacttcagaaaaagcaattgatacccttgtaaagtcttacaagtcgtctcaaattagaaaacaagttaaaaaggaagtggataaaataggtgaaagtgattctgatgcaataaggaaccagaggattcatgctgcatttcccactcaatgccttgttcttataagaagagcttccttgcagttgtttcgtgacataagcaattactggttacgtttaattgtcttcattgtaatagctataagcatcggctctatcttctatgacataggcacaagtaatggatctattcaggggagaggttcgctgctcatattttttgtttcagttctgactttcatgacccttgttggtggattctctccacttttggaagaaatgaaggtatttgaacgagagagattgaatgggcactatggcgtcacggcatttctcataggcaacatattctctgctgttccttacatgctattgatctctcttattcctggtggaatagcatactacctttgtgggatgcacaaaggaccagaacggttcttctacttcacttctttgctatttgccatagtgatgtgggttgagagccttatgttggttgtagggagtatctgccccaattatgtaataggcatgttccttgctggtggagttgaaggactcatgatcttaacaggtggattctatagacttccaaatgatcttcccaaaccactatggaaataccctttatactatgtttccttcctcaagtatgcattccaaggatcattcaagaatgactttgaaggcttaacattttctgttgaccaagatggaggaggcatcatgagtggtagagaagtactaactgacacatggcatttggaaatgggttactctaagtgggttgatcttgctatcatgtttggaatgattgttctgtatcgagttttgttcttggtcatcactaagtgcaaggagaaaatgaagccttttcactag

SEQ ID NO: 89750 - DNA, 792 bp, Glycine max
  Peptide Sequence Number=SeqID_206528
atggcttgctctaatacatttggactggttaccggtgcatttctacttggatttggtttgagtgaaattccaaaaggcatttggttaagtgcagattggaacattgagcaaaaagttctttcacataaagttgcaaaaatggctgtcaaattagatgatgctcatcatgatttttcaaatgctattgttatcacccaggcaacatcgaagcaaatgtccaagcgggattctttgagaccctacatgaatataattgacaaaatgttgcttcagatgttgaaggaagacccctccttcaaaccacagggtggaagactaggagaaagtgacatggattatgatacagatgataaatctatggcagcactaagacgtcgtcttaagagagctcgtgaacagtactatcgatatagaagtgaatatacaaaatttgtcgtagaagcccttgagctggaggataccataaagaattatgaccgacgtgatgctacaggatggaaatatttttcatgcttgaggcctgaacgcataggcaaagtaggtgcacttttggatacaatagagtttctatggcgatgtatattatggaaacagcttgagaaatcattggctgttatattgggctgcatgtcatttgcaattctattagcagaggctaccatactcaccagtggagttgatttatcccttttctctatcctagtacatgctggagggcagcaagaggtgcttgtacaggatgattgcaagatatgcagcacccatttcatacaactttctcaatctcattaa

SEQ ID NO: 89751 - DNA, 1413 bp, Glycine max
  Peptide Sequence Number=SeqID_206529
atggcttcttctctcagtctctccactcctcctctctatcgccctagagtatgcaaacatttcaaattgttcaatgggttacataagttctcattcaatggatatgggttggatttggccgttgtcctacaaaactctaatgctgctggcagaattagagctacattaacatttggaggaggagacttaggatcttatctgaagagttctgatgttgtgaccaatcgtttcggaactgggacacagtttgatgcggtagcgtttggaacgctgggagcagacacagcagtgccagcaggcagtggtttttctgatgatgaatccgagcatgatttcgatagtcccacggaaggttttgcttccataccggaggccatcgaagacattaggaatggaaagatggtagtggttgtagatgacgaggacagggaaaatgaaggagacttgataatggcggcacagttggctacacctgaggctatggcttttattgtgaagcatggaactgggatagtttgtataagcatgaaggaggaagatttagagagattggagctgcctttgatggtgaacagtcagtataacgatgagaaacttcgcaccgcgttcactgtgacagtggatgctaaatatggtactaccacaggggtgtcagctcatgatagggcaacaacagtcttggcccttgcatccaaagattcacaaccaagtgatttcaaccgcccaggccatatcttcccactaaaatacaaggagggtggtgtgctgaagagagctggacatacagaagcttcagttgatcttgccattcttgctggtttaaatcctgtggcagttctgtgtgagattgtagatgatgatggttccatggctagattacctaagcttcgccagtttgcagagcgtgaaaatttaaaaattgtatctattgctgacttaataaggtatagaaggaagagagataaactaatagagcgtgctggtgctgcactaataccaacaatgtgggggccatttgtagctaactgctataggtcacttttagatgggattgagcatattgctatggttaagatgagggaaacaaaatatgagaatggaaagcatactgatatgggtgacattggggatggacatgatgttcttgtaagggtacactcagagtgtctcacgggagacatatttggctctgccagatgtgactgtggaaatcagcttgctcttgcaatgcaacagattgaagctgctggtagaggtgttttggtttatcttcgtggacatgaaggaaggggtattggcttgggccacaaactacgagcttataacctacaggatgatggacgggacaccgttgaagccaatgaggagttgggattgcctgtcgactcaagggaatatggaattggtgcacag

SEQ ID NO: 89752 - DNA, 345 bp, Glycine max
  Peptide Sequence Number=SeqID_206530
atggtactttctctcttgctacctttctggaaaccttactggaaaaaattacagatagtagaagtggaggcagagtttgtggttgaagaggctgaagcggtggcaaaaatggtagaaaaagtggcaatggtaacagaaaaggtatctgaagatgtagcagagatgcttcctgaggatggtaaattaaggaaagcagctttggtggtagaacgtgcatcaaaagaggcagcacatgatgctcagttaactgaagaattcttacacaaggttgaagaactcaagaatgacctggatgatttagaagcctttgttgaaccggtaattgacaagattgtgaagatgtaa

SEQ ID NO: 89753 - DNA, 546 bp, Glycine max
  Peptide Sequence Number=SeqID_206531
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgatgtttggatttttcaaaactccatggacatgcagaagagaaatgctattcccactcggaccaagacataactttacttgttcaaataacaattaaggtgaagcagagtcaggaacaacgtatccctttatga

SEQ ID NO: 89754 - DNA, 588 bp, Glycine max
  Peptide Sequence Number=SeqID_206532
atgttggaggtacgcttggtggatttgacgccgagctggggttctaaagggggcaaaatgagtccaatcgagggtggtgtggtgaggcttaatggaggggaacgtggatttggtctcggcggcatagagggcgaggagaacggattcgaagatcgcaagggacaatggctccgaggagtggatgcaagagaggtagaggccggtgaggagggggacgaaggagaggactaccaggcgaagtctttcaaactcgttagcggcgatgctggagctcagccaaccagtttttgtggaaataattggcacagtctcgtagccgataatgatgaggatggagacgacagtgttaaccatgacgtcgaagaggtttcaatatcgaaccccgatggtgaagtcattgcggaagttaaacggatgttcttaaaaaggcacgattccaagaggaatctcggggttgaggcaataaagattgtaagggtagaggttgatgaagaagaaggaggagagaaaggggaggtgagtgcggtgatgaatgagaatgaggtggagaccttcatgttgtggatgtcgaggtcgcagatgcagtag

SEQ ID NO: 89755 - DNA, 330 bp, Glycine max
  Peptide Sequence Number=SeqID_206533
atggagcttttagagaaggccaagtctcaggttaatttgttaaagaagcagaataagaaacttgctaaagttgttggaggatgccttgggcaatactataggtatcatggtgattggaaaagtgagacacagtctgtagtttcaatgcttaaatttatgcactggctcgaaacaagaagccttctcgagcacaaagaggctaaggaaaaacttgggtcttctgcatgcaagctgagttcttggcagcaggctttctatcaagcaattaagaacaatatatctcttgctgagttgtttgatagtaatcgtgggcagctcaatgagaagtga

SEQ ID NO: 89756 - DNA, 219 bp, Glycine max
  Peptide Sequence Number=SeqID_206534
atgtgtaaaaggctgaatgttaaagtacttccttacttccacttttatcgtggggctgaggggcagaatcattttcatgttcacatgccaagtttgaaggtgcagcaaatgagggtgctaggggaccaagacaaaagcaatgtagatgtgaccattgatgcttatcatcgttacaaggtgaaggagaagggtggtgagtgggcgagtggtgaccactaa

SEQ ID NO: 89757 - DNA, 186 bp, Glycine max
  Peptide Sequence Number=SeqID_206535
atggctgaggaagaacaaccaagtgagcctgcaaccccagttacaccgccagcatcaatagaaggcaagccacaaccagtctctgctccttcggcaaaatttttattgaggattcttcatggaaaagtaagagaggtgcaattaatctttggttcaaaagggacgtttgttcatggaaatgattag

SEQ ID NO: 89758 - DNA, 177 bp, Glycine max
  Peptide Sequence Number=SeqID_206536
atggccaaatccaaaggacaccctcaccattgcaaccccctcttccctccaacacctatgtcaccaatcgcccattacaagggtgagtttgcatcaggtggttttcctagcaatgttttggcgcctagagtttttctaatggtcatgtcggtcaatgttgacaaagagttccaatga

SEQ ID NO: 89759 - DNA, 654 bp, Glycine max
  Peptide Sequence Number=SeqID_206537
atgagaaggaaattgcaggctacgaagcagaaaaagtttatgctggaagatgaagttagatttttgaggcaacgttacaattacttgctaaaacaccctattctaaagcctcaaccaaagcaacaagttgtaaagccacaaaagctcaaaatccaagctcccatcatctcaaagggaaagaattacaacaagaaggagcctaacctgcgaccccaccaccctgcatctcatttgaactcaaatggaaggatttccaatgtggctgatgtcccactgaaaaaaactggccacttgtttgatctaaacctgaatgctaggagttctagtaaaaaagatgcttccattaacatttctggtccaccagtgcttaacttgaatcacaaagaaaggattaacagcagcaaggaagccacgaagaagagtgtaactccatttttcgacttgaaccagatttcgagagaagaggaggaattgcagggaaacagtgagcccatgggaatcgaagaaccaaagagaagttcacaaagagttgcgactgacgagcagcatggcgatatcaagctctcggctgcttgtagaagtgttggggatggatctaatagggcagggaagaggaagatttcatggcaagaccaggtggcattgagggtttga

SEQ ID NO: 89760 - DNA, 1128 bp, Glycine max
  Peptide Sequence Number=SeqID_206538
atggttagcacttggtctggtctcaggcgtgagacccccctcgcatactcccatcctcctctggcggctatgaccgacacaaacattctaaaggcttgtatcagacacccccgcgacgacgagcaatccgcccacaccttggctaaacggactcaagggaaatcacaccctcgacgcacaggcaccattgccgatgatctgagcctcttccacatgcttcgtcgagtgcaaactgtgcgtcaacatctatttatcaattgcattatggagggagacatacccttgggggtggaaaccactcaacctcaagtgggggtagcactgacctgctatggtggacttccacctaggcccatagacaacttcgacaccctcatcgaacgattcagtgcacagtatgccactatcaagtctcatcgcatgagctcgaccgccttggccaatctgcgacaagtagatgatgagtccctcagaaaattcatggacggatttgggctcacaactgtccaaattcgaaatctcaatcccgagatatcgttgcattccatgctcctcatcttacgccttgacaagttcgtagacaatttgttcaaaaaaccacttggtagaatggacgaactacgcgaacgagccaagagctacatacaaatagaagaaatgaccagatttaggaatgaagtctggcaagccggacagaagtgcgacaagcgcaaagcacacactaaaggccccaagtacgagcattacacacccttaatgaccaatcatactacgattctcaaggaagcattgaacctgaaggtacccatctggctactccagacgaaacctcccaggtcggggttagatgtaaccaaatactacagatatcaccgaggtattggtcataatatcgaatactgctgggccctaaaggacaagataaaagaaattatacaagctgggtacttaactcagtttgttaaaagaccagacaaccaccaagtaggaccaagactcggaggacatccaaaagagcagcataggaaccatgaagcagacaaaagaagagcagaagatcaaggcagacaaagacaccaacaacagcggcgtgggcgacaacctccaccagaacaggaaccagcctaa

SEQ ID NO: 89761 - DNA, 1125 bp, Glycine max
  Peptide Sequence Number=SeqID_206539
atgatttggccaggatgctcatcggtagcatacggggcatcagaggaaattgggccgtttcgtataaacaaaactggctcttctctatatctcaacaaatatgcatggaacagagaagcaaatgtcctctttcttgaatcgcctgctggtgttggcttctcatacacaaataccagctctgatctcaaaacttcaggggacaaaaggacagctcaggatgcactgatttttgtaattagatggatgtcaagatttccacaatataaatatagggagttttacattgctggagagagctatgcagggcactacgtcccccagttggctaagaaaattcatgattataataaaaagaatcctcaaattattaatctcaaagggttcattgtgggaaatgctgtgactgatagctacaatgatgggattggaactgtcacatattggtggagccattctatgatatctgatcagtcatacaaatctatcctcaaatactgcaatttcacagcagaagaaacatctaaaaaatgtgatgatgtttatagttatgcggttaactatgaatttggaaatatagaccagtacagcatttatactcctacgtgcacaacatcacaaaacaataccgtgaggcacatgcgattcaagaatcttcatctgatttctgggtatgatccgtgtactgaaaattatgcagagaaatactataaccttccagaagtgcagatagcaatgcatgcgaacgttaccaacattccttacaaatggactgcttgcagtgatgtgctcctgaaaaattggaaggattctgaaatttctgtgttgcccatatacaaagagttaattgccgctggattaagaatatgggttttcagcggggacacagattctgtggttccagttactgccacaaggttttctctcaaccaccttaacctcaggaccagaactcgttggtatccatggtactctggtggacaggttggtggatggacagaggtgtatgatggcctaacttttgcaacagtaagaggagctggccatgaagtacctttatttcagccaaagcgagcttacattctttttaagtcttttttggcaggaaatgaactcccgaaatattga

SEQ ID NO: 89762 - DNA, 294 bp, Glycine max
  Peptide Sequence Number=SeqID_206540
atggttacaatctcccctgttagtgtagggaatttcattgttagatggagcatggacactacggctccaagctcgttgagtgtcttccttccaattaagtcaaagtataatgtgtttaggtcaagcagtagatatgtgatggatatcaacggaacttccttggtcgatgaggactctggacactatgaagatcagaatgatgatggagacaaccacatggtcgtcttggttgacgaggttgatgcccttgaagtccctgtccgtaaaggtgataagagggagacttcactataa

SEQ ID NO: 89763 - DNA, 372 bp, Glycine max
  Peptide Sequence Number=SeqID_206541
atggctaacctttccattgtggttcaaggacaaggagaggctgaaagcttaagagaactctgttttgttgtagccaatgttaatgctaagcatagtggtggtattgggaaagagaatgagagttcccatgttggggcttttgatgtaagtaggcttcagaagcttaaaggaaaaaaggggaatgggaagaagaaagatgcccttgttgttgctgctgctgccatggaagagccgaagaaggttgataagcgatcacgtggaaaggccaatttggagaagtcagacttggaaccggctctgaaagctctgaaggacaggctcatgaccaagaatgtggccgaggaaatagctgagaaactatgtgagtcttga

SEQ ID NO: 89764 - DNA, 492 bp, Glycine max
  Peptide Sequence Number=SeqID_206542
tgctggatctatgagcatttccctagtgtgcagcagtgcgtgacagatgatacataccaggagacgtccccaagtgcttctcggtggttgacgtcgaaggcgcacatgaagggaatcacaggagcaccttacagggcatgttgtgatgctttggccatcacatatgtgtcctggtttccgtacactgagcatcggggggttagggcctttgaggtgatttcatcattccagggtcagctgagatggggtcctatggtggtcacagctcgaccggagagattggtatctgcggattacatggagtggttttttcgcatatctcacccattcatgataccgacccaggcaggtgaccagcctagagatgcaccagccgcagaccctgaggagtacatacagccgcccaacccccaggttccagtggcatttgacccacctcgacatgcagtggatgattacgacggatatgaggctaattgcaccagaggttga

SEQ ID NO: 89765 - DNA, 678 bp, Glycine max
  Peptide Sequence Number=SeqID_206543
atggaacgtgtattggctgatgtacttagagatcaaaggaatttgggcaacaagggtgatggaggttggaaaaggtcagcattgaatgctgcagccgcaatgttatctacaagcttcaatgttaatgtcacatcagataatgtcaaaaatcgtatcaaattatggagatcgtggtatggtattgtaagtgacatccttggccagagtggatttgattgggatggcactaagcacatgatcacagttgagaatgaaaatgcttggaatgaatattgcactattggatttgactttttctttgttttccaatcgcataaatcggctaaactgtttcgattcaaggtgcttcaaaattgggatgatatagtggatttgtgtgctaaagatagagccaccggtcatggagctgaaactgctatggatgctgatgaagcgatgagtagagaaacaaatgaagtggaattcatagggttaggtgctactgccatagatttagaagaaccaagctctaatacaaaaggaaaaagacaatgttcgacttcttctagcacacatcctcacaagaaaaagatgggagaaaaagaaggaatagcagcttctttggataaaatggcgaactctttcaaccgaatggtggaaaaaatggatggtaaagttgatgacgaagatattcaagaa

SEQ ID NO: 89766 - DNA, 326 bp, Glycine max
  Peptide Sequence Number=SeqID_206544
atggcgtatgggaaatcgtacttgcatataaggtatttccaggtgaatttttccacctcgctggtcataatttctcaaagtggatgttcgttcccacattgcgaagagccaaggggagctcagactgtgaaaattgttaatagggttgcatggcacccagctcataccgctttagtggctaaggagcgtccaccggggggtcatttagtttggttcctccttttctccggccataacttcctcaacatctatgttaagagtttggagcgtctcttgtataatggtcttaaggtgccctaccttcttggttctggccagcttggagg

SEQ ID NO: 89767 - DNA, 174 bp, Glycine max
  Peptide Sequence Number=SeqID_206545
atggggaaaagagtttatgcgagagaaaaggtttcaacctcttatgatgacgacctcgacgaagaaaggtcttgggtgtggcggcaaaaggaggccagtgagaagcaaagcaggggggaaaagtttttccgtaccctaacattctctattcctgaccttggcagaaagttatga

SEQ ID NO: 89768 - DNA, 273 bp, Glycine max
  Peptide Sequence Number=SeqID_206546
atggttggaggaggaagagtaaatatggaaaaagctgaagcaaaaatgaaagaggtttcttctgcacctcagcaacattcgacagatgtacttcaccaacgtaagaaaatgcctcagtgtcccatgaaaatggccattgggggctttgtagcaatctctgtgttaggttatttcgtcttgtactccaataagaagtccgaagcatcagccatggatgttgcaaaggttgccactggaacgtccaacccagaaaatacccgtccccgcaattaa

SEQ ID NO: 89769 - DNA, 1929 bp, Glycine max
  Peptide Sequence Number=SeqID_206547
atggcgagagagcctctggctcgtgacctatgcatttgtgtgtgcatttacattctactcattgcccaccaaagtacctgtttttacctccctggtgttgcacctgaggatttctggaagggagatccgttgaaggtgaaagtgaacaaactgacttccacaaaaacacagctgccttactcatactattcactgccttattgccggccaaaacacattttcgacagtgcagaaaacctgggggaagttctccggggagatcgcattgaaaactctccctatgtgtttaaaatgagagaaccacagctgtgcaatgttgcttgtcgtctgattcttgatgaaaaagcagccaaagagttcaaggaaatgatagatgatgagtatcgggtgaacatgattttagacaatcttcctttggttgttcctatacgaaggcttgatcaggaatcttccgtggtgtatctgcatggcttccttgtaggtcttaagggacaatattctggaatcaaagaggacaagtattttattcacaaccacttagcatttgtggttaagtatcatactgatccagagttagatttgtcaaggattgtaggatttgaggttacaccattcagtgtaaagcatgaatatgaaggtaaatggaatgagaatacccgcttaactacctgtgatccccatgcaaaaaagctagtcactagctctgaatctcctcaagaggttgaacacaagaaggaaatcattttttcctatgatgttgagtttgaggcaagtgatgtgaagtgggcatatcgctgggatacctatcttcttatggccaatgaccagattcactggttttcaattgtcaattctttgatgattgtactcttcctttcaggcatggtggctatgataatgttgcggacactttaccgtgatatctctaagtacaatcaactagagacacaagaagaagcacaagaagagacaggatggaaacttgtccatggggatgtattcaggcctccatcaaactcagatttactctgtgtatatgttggaacaggtgttcagtttttcggaatgattcttgtcaccatgatgtttgctgcccttggatttttgtctccctcaaatagaggagggttgatgacagccatgctcttgctctgggtatttatgggactgtttgctggatatgcttcggcacgtctctataagatgttcaagggaacagaatggaagaaaatctcatttggcactgcctttatatttcctgccactgcctttgctgtattctttgtgctaaatgctctaatttgggggcagaggtcttctggggctgtgccatttcaaacaatgtttgcgcttcttttgttatggtttggcatctcatttccacttgtgtttgttggtggttttgttgggtttaataagaagccagcaattgaggatcctgtgaagacaaacaagatagctaggcagattccaaagcaggcttggtacatgaatcatgtatgctctattctaataggaggcatactcccatttggtgcagtcttcattgagcttttcttcatcctcacatcaatctggttacatcagttttattatatatttggtttcctcttcatcgtgttcgtcatcctcattatcacctgtgctgagatcacaattgtgctctgctactttcagctgtgtagtgagaactacaattggtggtggaggtcgtatctgacttcaggttcctctgcactctaccttttcctatatgctgttttttacttcttcacaaaacttgaaatctcaaaaccaatatctggaatcttgtacttcgggtacatgctgctgctttcgtatactttctttgtgttgaccggtacaattggtttctatgcatgcttctggttcacaaggctgatctattcgtcggtcaaaatcgactga

SEQ ID NO: 89770 - DNA, 342 bp, Glycine max
  Peptide Sequence Number=SeqID_206548
atgaacaataacaataataatactgccaacttcaagctcagattccaattgttcatcacaagcctcggggtagaggtttctgattcaaatctggaaaaattatcatgttcaacattcaacaataaggctagccttcaacatctcactgtctctgcaaaatcatcttcaagaacaccacataatatcataaatcaagagaaaacctcggttaagaaccgagagcagacggtgaccggcgaccggaaattttgccgccgactaagcaaggaaggtggaaaaggagggaacgaacctcgtcggagagaaatgagcgatgctgaacggaacgagaagatggagtga

SEQ ID NO: 89771 - DNA, 312 bp, Glycine max
  Peptide Sequence Number=SeqID_206549
atggttatgattaccattgcaactaactttttgcaggttcctgtaaaaacaccaaaagctgatgttattagcaaagacctggtgagaagaggtttccgaggcgtgggccctacagtcatatactccttcatgcaggttgtggggttaacaaatgaccacctcatcagttgcttcagattccaagattgtatggctgttgcagaagggaaggaagagaatgccgtcaaggatgatgctcaacaaaaggagggtgatcatgtggagtctgatctgtccattgccatcgacaatttgagtttatcctcagagtga

SEQ ID NO: 89772 - DNA, 516 bp, Glycine max
  Peptide Sequence Number=SeqID_206550
atgtaccctctcttgttctcagttacaatagcccaagtaaatgtaccctctacttgtactacaaaggatgtaccctccaatgtgttaagacaaagttctcaggcggttagtccgttgaaactttgtgaaggggaaacaaaagatatctcaggcgaacaaggtttagaaaccagaaaactcataaagcttttggcaaaggaagaagaagaagaagaagttcaaaaagatgttcaaagagattcaaaggttgtaaaagaatatgtgaaaagttattttcaagaaactggtaatcgattaccagagagtaaaaactctggtgaggttgcattgaagaaatggatgacagagatacactggggtgtagtggacggagagagactaagctttttgagttgggagatgaggggtcggtgtacaatgtatccgtatgtagcgatcactcccaactatcatccacatgattttgtaagaccaccaagacctgggaggattggtggtagtgattgggccctatag

SEQ ID NO: 89773 - DNA, 315 bp, Glycine max
  Peptide Sequence Number=SeqID_206551
atgagtgtatcattgactgtgatgaccttcaatctccatgatgatgagccacaagacagtcctaattcgtgggagaagagaagggatatgtgcataagcgttattaccagttactcacccatcatcctctgtacccaacaaggagtgaaagcacaattggattttctccagcagggtttgccaggtgaagtaccttttgaattagttgttcttcagcttctgaaaagattcatttatggtcctcaaattcattacatgcataatgtggtcactagcatattttgtatcttatttgacataatgtatgtgccatag

SEQ ID NO: 89774 - DNA, 336 bp, Glycine max
  Peptide Sequence Number=SeqID_206552
atggctatcagtgcagctcggggattagctttcttacacagctccaacaaccatgtcatattcagagatttcaagcccttaaatatactacttgatgaggccaacgatggaaacgaatttgattccaatagctcttactctcttcaccatttcgatcatcctggaatggttcttgtttctaaatctctcgatggcaacaattattcgacttggcgtcgagccaccaccatctcatggaatgcaaaatctaaattttgttttgttgatggaaccctcaaagcaccatctgccaaaaccaaaccagaagactatacaacatggaaaaaaatgcaatga

SEQ ID NO: 89775 - DNA, 159 bp, Glycine max
  Peptide Sequence Number=SeqID_206553
atgtctcagaaaaatgatgatctcagactcattcaccgtttgatcgtcgtgaaattaaagcaccagtcgaaggaaaaactggaggaatctctagaaaccgctagagatgccactgtcgctgtcagaagacacgtgagtccgcttaaaggtaagggatga

SEQ ID NO: 89776 - DNA, 336 bp, Glycine max
  Peptide Sequence Number=SeqID_206554
atgagttgtcacataacggaagccttagcgaacctcccaacaaggcgtcttctccgccacctcaagagtaatttcttcttctctggatttagttttgatgaaccaagtaaaggtgcatatggtacacgtaggaatgaggccttgtggaatcagattgtcaaacctcctgatatttcttttgatgcagttacgaactaccactcccaatggcaagcagcacgcacaacaacaggctcgaaccaaacaccaccagcactagaccaagttataaaatggagtcctccacctcaaaactacatcaagtgcaatctcaatgcggcagggatcacggactga

SEQ ID NO: 89777 - DNA, 597 bp, Glycine max
  Peptide Sequence Number=SeqID_206555
atggattctccagtaaaacctggaaaaaagcccaagttcgttgtacatgcagcaggggatgtggggatatctggtgatggttaccgatggcgcaagtatgggcagaaaatggtgaaaggaaatccacatcccagggaggatgagatttcttatcttctaaagcaaagatgtgtaggtggtggtgtcgtccttttgcttccttgctatgctgagaagagctctactttgtctgggcaaaatggcaagaacagatgcacttctgctggatgtcctgtcagaaagcacattgagaccgcagtagataactcagatgccgtcatcataacatacaagggtgtacatgaccatgacatgccagtccccaagaaacgacatgggccaccaagtgctcctcttgtggctgctgcagcacctgcctccatgaacagtttgcaggtgaagaaacctgactccccacaaaacaagaaaatttctactcaatggtcagtggacaccgaaggagaactgaccggggaagcgctagagcttggaggtgagaaagcaatggagtcagctcgaacacttctgagcataggttttgaaattaagccttgctaa

SEQ ID NO: 89778 - DNA, 435 bp, Glycine max
  Peptide Sequence Number=SeqID_206556
atggaagaagaggaagatttggacgaggtcgattccaccaccgagatcgaaattgtgctagaaaatctcggggaagggggtcttgtaggcgtggtagccgtggttggtggcggcagaagcgaatcacccatggaagaggggacgcgaaggtggcacgccgtgtttggtggaggctcggatttgggtgttttgggtacgcatctggacaaagatgatgtttattgggcggatctggctggtttggtggtgtcggaggtgggtgttcgccgaggaggttccgatctggctgatggtggaggtgtgggaggtgcgggagaaagagaaagaaaaaagaaaaaaattaatatggaacttcacatgtccaattttctagtggacagacatgaaacatcggattcatccactccaatcctagctctaaacaaaaaattataa

SEQ ID NO: 89779 - DNA, 237 bp, Glycine max
  Peptide Sequence Number=SeqID_206557
atgggtccaccgtccaccatacctggtagtcatactaaaatgcaacttaattgtgaaaaaatgggtcatcacagacaaactcctggtcctgcaggctttaatagcacgtcaaggatcaattctcccaaaagctcaaagttagacataagcttgagaatctcggtttatgggaccaaaatcagatttcaacaaccatggagattacgacaccagaaaacagaacaaacaaaaggatga

SEQ ID NO: 89780 - DNA, 327 bp, Glycine max
  Peptide Sequence Number=SeqID_206558
atggaccagcgccatggaccccaacctctcccagagtcagacaccataggaaacgattctcacccaaaaacgcaactcaccaaggaaacagaacgagttgtggaatcgctgtccgacgccgagtcgcggcaccgcgagttacggagctccgacaaaccttgttcggactccaatttagaaaccctaggcgctggtgttacctcttcggttgaaacccttgctgtgcagcatcggagtgacgatttgcaagggagctctactgctccgaattcgggtggcaaagccgaaagtcttctagatgatgatggtcaggttagttttgaatga

SEQ ID NO: 89781 - DNA, 615 bp, Glycine max
  Peptide Sequence Number=SeqID_206559
atgcacccatctcgtgccgaagcagcagcatcacaaccctgctttaatggctgtttcccatctccacttcttgcctctgagaagtcccatagaactacttcttccaagcccaaagtcgtcaataataataatgtaacttcatcacacgatgacttcgtcgcagccacatcttccacccttcacccacacacaaatttcaccaaccacgagtccctcccatctttgcaagactcatacatcagcttcaccaaagcattccctcagttctccacaacaacttctgaagtcgatcaaattcgagccctagaataccatcacttgagcaaccactccaacgcctgcttcgactacaccggttatggccttttctcctactatcagcaacaaagaatatcttattcttaccccacaattgcttcttcttcttcatcctcatttccttacttcagatcagatgcatccttctttgatatatcatacaagtcagtgaacttgcagtcgcaggttctatacggtggacacgagtcagaactagaatccagaatcagaaagagaatcatgtctttcatgaatgtctccgaagctgagtacacccttgttttcattgctaatgag

SEQ ID NO: 89782 - DNA, 2763 bp, Glycine max
  Peptide Sequence Number=SeqID_206560
atggggttgggagtgtttggttctgttctggttttggctctcttattcaagcatttggcatctcagcaaccgaatactgatgaattctttgtgtctgagttcttgaagaagatgggtttagcatcttcccaaggctacaacttctctgcttctgtctgttcatggcaaggggtttcttgtgatgccaatggagaacatattgttgacttagtcttttctggtatggacctttctggcactatgcctgacaacaccattggcaagctaagcaaacttcaatctttggatcttagccacaacaaaatcactggcttgccttcagatttctggagtttaagctctctcaagagccttaacctgtcctccaatcagatttctggctcattgactaacaacattggcaactttggtttgctagaaagcattgacttgtccagcaacaatttctcagaggaaattcctgaagctgttagctcactgctgagtctgagggtcctcaaacttgaccacaacaggtttgcacacagcataccttctgggattctcaagtgccagtctctagtttcaattgatgtttcttcaaatcagctgaatggaacacttccagaaggttttggcgctgcttttcctaaacttagggtcttgaacctttctgggaataatatgtatggtcatgtttcagatatttctgggttaaagtccattgtgaatctcaacatatcagggaattcgtttcagggttctattgtggatgtgtttcagggaagattggaggttctggaccttagcagaaaccaatttcaaggtcacattccacagaaattcccacaaattgaaattctcctgaaattggaatatctgaacttgtccaaaactagccttgttggtgaaattcctgatgaaatcttacaaatgagtaatttgagtgcacttgatctttctatgaatcatcttagtgggaaaattcccttgctgaggaatgaacacctccaagtccttgacctttcaaacaacaatttgactggagcagtccctccatctgtcttggagaaactcccatggatggagaagtacaacttctcttataataacctaatcctctgtgcttctgaaatcaaacctgagatcctgacaacagcattctttggatcattgaacagttgtccaattgctgcaaatccacgactcttcaaaaggagagacactggaaacaagggaatgaagctagccctggcattaagcttctcaatgatctttgtgcttgctggccttctgtttttagcatttggtttcagaaggaaaacaaaaatgtgggaattcaagcaaacttcatacaaagaagagcaaaacatttcaggtcccttttcattccagactgattcaacaacttgggtagctgatattaagcaagcaacatcagtcccagtagtaatctttgagaagcctttgttgaatatcacatttgcagacctcttggctgcaacttcaaattttgataggggcacccttttggctgaaggaaaatttgggccggtctatagaggctttctgcttggtggcgttcatgtggcggttaaggttttggttgttggttctacattgaccgatgaagaggctgcaagagagctagaatttcttggtagaatcaagcaccccaaccttgttcctttaactggatattgtgtagctggggaccagagaattgccatatatgattacatggagaatggtaacttgcaaaacctgctttatgacttgccacttggggtacaaagcacagatgattggagcacagacgcatgggaagaagccgacaacaatggtattcaaaatgctggctctgaagggctactcacatcttggagatttcgccacaaaatcgcccttggcacggctcgagcattggcctttttgcatcatggttgctcacctccaataatccacagagctgttaaggctagcagtgtctatttagactatgacttggagccaaggttgtctgattctgggttggccaagatttttggaagtggcttggatgatgaaattgtgcgtggctcgcctggttatgttccaccagagtttactcgaccagaattggacactccaacaccaaaatctgatgtgtactgttttggggtggtgctctttgagctagtgactggaaagatgccagttggagatgattaccctgatgataaagaagcaactttggtaagttgggtgagaggacttgtaagaaagaaccaagcttcaagagctatcgatccgaaaattcacgacacaggaccagatgaacaaatggaagaggctcttaagattggttatctttgcactgctgaccttcccttcaagcgaccaagcatgcaacagatagttggacttctaaaggatattgaacctactgctagtagcggagtgagagtgacgatgctctatagtggtggtgtcagtggaatggtggtgggatggaatagtgatagcaatggtggtgacgatgatgatagtagtgatgaaatgtggtggaacggtgatggtggtagtgacaataatagtggtggtgacaacgacaatggtgagaggtggaatagtgataacgatgacaatgaaaatgacaacaatagtgatagtggtggtggtggtgaatgcaataaaggcgaggtgcgatggcgagagaatgatagaggcaatagtggttgtgacgatgatagtggtagtggagacaacaataatgataggatgccaagggtggtggtgttatga

SEQ ID NO: 89783 - DNA, 336 bp, Glycine max
  Peptide Sequence Number=SeqID_206561
atgggagatcgcttggaggatatgatttgtgaccttggacaagagtcttttcagcaagcacatgcccctatgtatgaaggattgcaaagtgattcaaagaagcctttgtatatggggtgtaagaattccttgacgatgttgtcagcagtgttaagtctggttagtgtcaaggacagatatgggtggagtgacaaaagctttatttccctacttcaactagtgcacgatctgcttccagaggaaaacacgttgcctaaaagttactatcaggcgaaaaagatactatgtccgatgggtatggagtatcagaagattcatgctttcccgaatgattga

SEQ ID NO: 89784 - DNA, 522 bp, Glycine max
  Peptide Sequence Number=SeqID_206562
atgaaaattgaactcactattcttcggaaggtaattccgaagctgagctccggatccaagccgtactcggagaattcggaagcgtcgtgtttcttagcgacggaaccggagggtcgaggctcggaggaggaagggtttagggtttcgatgtggaaatcgttggagaaacccttgaagggcttcttgacgggaagaaacacgatgtttctcgacaacaagggagtggcgatagtagtggacgaagaaggatctggcggattcggaggctccgtttggatcacgatggtttcagccattgctggagttcgagaagcttcgaaaagtgggaacgaggggaagaggggaagaggagaagaacaatcacacagaagcagagtggaaagagaatggtcgggcccgggcccggcccagaatgtagtgtatgtgtgcggccttgaaaatcttgggtcggtaatagaacaactgggccactcaagcctcaaccgcgtggatagatttttacttattcctaccctttattaa

SEQ ID NO: 89785 - DNA, 492 bp, Glycine max
  Peptide Sequence Number=SeqID_206563
atggaaatctgttctgatatctgtcacttcttatgcactgggtctcttcatgatttccaaagccccctggtatcttcttcctctggcttgggtatggacagggactgcaataactggggacatgattgtgctcacagatcattttcgtctaacaaattggtagaagacattgttggaactctggcctttatgcctctgatttatccatatgagccttggcgatttaagcatgacaggcatcatgcaaaaacaaacatgttacgtgaagatactgcttggcaccctgtttggaaggacgagtttgaatctactccacttttgaggaaagcaataatatacggatatggtccatttcgatgttggatgtctatagctcactgcaattggatggccattaattatttacaagactggaatcatgggatggataaaattctggttgatgccatggttgggctatcacttctgggtaatttcaactctatcttgtaa

SEQ ID NO: 89786 - DNA, 1341 bp, Glycine max
  Peptide Sequence Number=SeqID_206564
atgggggttcaaaaagacagggtgaaattcaacgtgggtggcagggtgatggaaacaacatccacaaccctcgccaatgctgggcgcaattcaatgttcggcgcaatgttcgacgacaattggaacctaataccaaacaacgacgacaacaacaacaacgaaagattcatcgatcgcaacccggattgcttcgcgattctcctcgatctgctccgaaccggcgagctctacgtcccacccgatatcccggagaagctcctctacagggaggccctctactacggcctattggaccacgtgcgcgccgccaagtggggcccattcgacggcaacaggttaaggttgtcgcggtctctgcagggccaggcaccgggcgacggaaccgccattcgggcgggcccggatggcggctgctgcgttgcgcatggcagcatggttcatgtctatgattggatgttggatgaacacccacctcttaaccttgattaccagagggtcaacgatgttggttgggttgactccgacaacatcgtcatcggagtcagcgagcgccttgggcggggcgacggcgggatggggctgttcagctcccacaccggagagcttaggtacaagtttcacgtttgtcatgacaatcaggtgaagagttacactgctggggctttgagttttagttcggattacaagatattttctagttgcaaagggaggagtaatgagtatggggttggagtttgggaccaggttactgggaagcagattgatttcttctacgagcctttggggtggtctcttggggatgctgataagcttcagtggatggaagggagcaattgtttgttggtggctaccatgtttcctaggaaggacaactgttacattagtcttttggatttcagggacaagaagatggtgtggtgttggtctgatgtgggggctccttttgccgtggatgagaaacgggtcagggatgctattgccatggaggataataactccatttgtgtggtcaatgagtttgaggatttggggttcatggatttgagaagttctgctgccaatagcattaggtggagctccaggagtaggttgatgaaggggaagatgcctgaggaaccttgttatcctaaactggcattgcatgggggacagcttttttcgtccatgaatgattgtatttcggtgttctgtggtcctgaatgggttttgacgtctaggctcagacgaagctatggtggttcaatttgtgatttttccattggaggggataggcttttcgcgcttcatagtgaggagaatgtggttgatatttgggagactccaacaccaccaattatatga

SEQ ID NO: 89787 - DNA, 2015 bp, Glycine max
  Peptide Sequence Number=SeqID_206565
atgagatcaggcatatcaagaaatttccgaaatgcaaggcaggaagatgcacacgagtatatggtgaacttacttgagtgtatgcataaatgttgcctgccttctggcataccaagtgaatcacctggtgcttatgagaaaagttttgttcataaaatttttggtggtcgtctcaggagtcaggtgaaatgccaccagtgttcttattgctccaacaaatttgatcctttcttagatttaagtcttgaaatattcaaggcagattcattgcaaaaagcactttcaaattttacggctgcagaatggttggatggaggggagaaggagtaccattgtcaacggtgcaaacagaaagttagggctctcaaacagctaacaattcataaggcaccttatgtgctaacgatccacttaaagcggtttcacgcccatgatcctggacaaaagattaaaaagaagattcaatttggctgtgcactggacttgaaaccttttgtcagtggctcgtatgatggagatgtaaagtactctctatatggcgttctggttcatgctggttccagcactcattctggacactattactgctatgttcgcacttcaaataacatgtggtataccttggatgacaaccgggtaagtcatgtcagtgagcgggaagttttaaaccagcaagcatacatgttgttttatgttcgtgatagaaaaaatattgttccaaggaagcctgttgacattgctaagaaggaaaatatgaagactaatgtgaatggaaatagagaatcttcaacttcaaaccatgtattgcaggaatatccaaatggtaccatcgaaaataaagccgagaaggatgctctagttctgcaaaagcataatgtcatattagcagaaagcttgatgcaaagtaaaagacatggatctgaactttcttccaaggcccaggcacagaatgactcaccagatggactgtctgatcactctggaaaagattatagtctccctcataatctgaaatctttggctgcaccagttggagaaaaaaataatttgcgctatgagaatgtaatttcaaaagagggcattaaagattctccttcaatagtgccctcatccactaatccccagaatggtgaactcactactgatggaaaatgtcagtctccgaagaaaaatcttgtcaagatagttgatgttgctgcacctcaagattcaagcacaaatatgaccaatggcatttgccctaagacatcactaattcatccgaaagttaaccatcagcttggaacttctgcaattggttcggtgtgtgagaaagcaagtagcatgacgtatgaagatctggttggttctcagggactggttcttaacgagtcagtaaatacatctttgaatacagcgagtcttaatcaaaagcctgtgaaaaaatcaaaaaagaagttccttaggtatcaggtatcttggatgcatcttcgcccaatcttccattacatggtatacttgggcccacggaagaagaatcacaaaagaagtaaacgccgcactttgggtatgaagaatccaaacaaagacaagatggataagcttgctttctcatcagaagatgccaaacctgttgtatttcctttgttattaagttgctctgaaagtaaagcaaccaaggctggttatagacctggtgctaattttaaatctagtgatgaatctctgatagaaaatagggctgaaggggaatttaggaagagaattgatcatagctgtgctgtgcttgcatcagcggcgcaaattgaaattatatccgggagtggttcaatagtaagtcaatttgaagctagacaggctgatagtgcacaagatagcagaagagatcaaatgcataatggtttaatgagtatgcttagtcgaggtctggaggagacagttgttgcacgttgggatgatatagaattaccttcatctcagcatttggagtcaaagaatgacaaacttgtcagcattggatatgtcggggatgaatg

SEQ ID NO: 89788 - DNA, 399 bp, Glycine max
  Peptide Sequence Number=SeqID_206566
atggcttgcacgctcgctgattcattactcctattcaagggttcttatcagaaaccagttctgaggagagacattgctgcccggtactccccgggtatatttagtctaaacagtaatgggcttatccagaaaaggttcaggcgtcaaaggaattttgttactaggaataaggttactgtcatacatgccgtggcaattccagtacaaccagctccggtggaaagtgcggagtatagaaaacagctagctgaagactacggtttcaggcaagttggagagccgcttccagatgatgttactttaaaggatgtcatcaattcccttcctaaggaggtgcttttttttaaaatctatgtcatgttttatagcatcatcactgaacaggacttttctgtttaa

SEQ ID NO: 89789 - DNA, 1174 bp, Glycine max
  Peptide Sequence Number=SeqID_206567
atggcttctactggtggcaaatctcattctctaataactacctcaaaacgctccgttttgctgaaggactacctcagggatgacctgagttcatgttcatcgaacggtttcaaatcgctcacacgccaacaatgctgcaccaccgtgggatttttcatggagaaagatctccaactccaacgcaaaagaaggaacacattcactccacggtccactacatcttcttcttcatcaaccatattggctctgcagagagcttctggagccataatcaacgcgataaagtcactgccgttgtcacaaaagagtggtgtcgctggtgttctttctagaagcttttcgaggaaggtgttgagtagaaggttcttctggagaaaagcggcggcgagggaagagggaagcgaaggtgtgccgcggaggaggaaatctttccgcgaactcattatgctggatcatgaggagcatcgtaaagcgacgtcgtcgttgaatgaggatactgatactaccgttttcgctgcacatgccccgagcgtcaccacctcttcgggtcgcggcagtgaaagctggggagacagtgaattcacttttgcgtctaacgctgcttcttcttcctctgagagctccaacgagaattacctcgtacttgaggatacaaaagaaggtgcgccacatcacaagctggaacaagtagtaaccaagccggtggttttggagaaaaagttcgcgcggttagagctggaggatgaaccacacaagcattctacgaaacaatgttccaccgtattagctccaacatttcgtcgtgacaacaataacaacatcgaggagaatgctcgcgatcttctcaacttagttaaaaggtcaattgcacccaacgttttgataacaaaggcagagaatttgctgtttgatttcttcaagaagagtatagaggaaaacaaagacattgattactcaaagaagcttcaactttgcaaggtagctgaggattggatacatgggcaaccccaagaaccgtatttgggttgggaagtgcagggaggaaagtgtgtctacattagagagatggataagtgtgaggagtggaaaaactcgtatcaagaaatacaacaattgggtcaggagctggcaaacgagctagtagccactaaagatgagatgttgcaacttgcaa

SEQ ID NO: 89790 - DNA, 2472 bp, Glycine max
  Peptide Sequence Number=SeqID_206568
atggctatgctccgcaaattgttcttccgcaagcctcctgatggactcctcgagatctgcgagagagtttacgtttttgattgctgcttcaccacggatgcttggaatgaagagaattacagagtgtacatggatgggatagttggccaactaagggagaacttgcctgatgcttcgattctgattttcaattttcgcgaggaagatacgaagagtcagatggcaaatatcatgtctgagcatgacattactatcatggactatccccggcattacgagggtgttccagtactcaaaatggagctcattcaccactttttgaggaggaatgtggccttagattggcctcccctggacagggcactcatgttggactgcatcattctcagattcttcccaaactttgatggggaaggtggttgtcatcccatttttagaatttatggacaggatccctttagtgctgataaaaatccaaaaatgttgtactcaacaccgaagagaagcaaaagcgtccgggcctataagcagggagagtgtgaacttatcaaaatcgatatcaattgccatattcaaggtgatgttgtcattgagagcattaacttgaatggtaacatggatcgtgaaaagatgatgttccgagtcatgttcaacacagcttttgttagatctaatattttgatgcttaaccgggatgaaattgacattttatgggatgctaaagatcactttccaaaagattttagagctgagatccttttctcagagatggatgctgctgcagcagttattgcggatggtacctcatgctttgaggagaaggaaggacttccaattgaagcatttgcgaaggttcaagagatctttagccatgtagactggatgaaccccaaggctgatgctgcactaaatgtgctccaacagatgagtgcttcagctatgaatgacaggttggatacagtttctgatcagtgtatggaaaatggcactttattgcatgaaacaagtcctagaattcctcaggggaatttgagtgaagcaagacaatctttatcctcaactaagagatcaccagataatgacatgagtagaaaagaggataaggccaacaaggtcgagggtattccacaacagcctagtacatctaacatcatctatcaagagacagccatatcttcagaaagaaccacggaatccaataaatgtccaacaggaccgacaaatgttgacataaaactgcaggcacctcatcctgccttatcttcttctgttgatacttctttttcccctagaacacctcctttgcggcctcaatccactagtgctaaagaagttcatgattctcctcgccaaacagaatcacccccttcttatcttttgcctttgcaatcaaaacaccaaacacaagacagaagttctatccctacacctgggacccaattgtcatctacttttcatagtaagtcaccagcagacaccatttcccatccttcagcttcagcaattacttcaactcagccatctcctttactttcttccaaaaatgtgaatgagattcctcctattagaacaagactagagtcttccccttcacgacctccaactccacctcctcctcctacccctccactgaaggatcatagactagttcgagctaaacctcctccacctccacatcctcctcctcctcctccaaagaaagaactacatgttaaagccgaaccccttccttctcctctatctcctatgaatgtggagccacaggttagaggtgggccctctccaccccctccccctccaccaaaagaggagcaacctgttacttttaatgctcctccacctccttgtctctcggggaaagttgcaggttctactatagcaccaccaccaccaccaccaccttcctcagatcacattaattcttcattgcaaaagtctccacctcctcctgcagcacctgctcctccacctcctcctggggcacctgctcctccacctccccctggtgcacctgctgctccacctcctcctgctaaaggaggtctaaaatcaggcagtccatttccattgtctctttctgtgagtggtgatgggaataatgtgtcaggaccaactagttcaaagggacgaattctatcacgtacgatcagctcaaagaataacaccaaaaagttgaagccattgcattggttgaaactatctagagcagtgcaaggaagtttgtgggctgagacacagaaatctggcgaagtttccaaggccccagagattgatatgtcagagcttgagagtctcttctcagcagcagtcccttcaggtcctgccaaaaagtcaaatgtccaaagctcagctggccctaaatctgataaagtgcaactgattgagcataggcgagcatataattgtgaaatcatgctttcaaaagtgaaagtgccgttgcatgatttaatgagtctacctagaacttattag

SEQ ID NO: 89791 - DNA, 1692 bp, Glycine max
  Peptide Sequence Number=SeqID_206569
atggatgtgagtaggagaagagttggagttagatgcagtgtggttgcagggtcagtgtgggagagcagaatgaagagtgatgaagttggtggtggagttaaggtcttcagtggagaacaaagtgctgaagaaggaggcaatgatggcaccagattgaagagaggccaaattgggagtgtggttgcttctggaaagagaaaaacttggaaatctgaagggttagaaaataacctaattcaaatagccagaggaaaagcagaaccccagaagaatggtagtaatagtagtagtagtcaacaatgtaaggatctcaacatttcttctgattcagtcaagaagagcccaattccggccaggaagaaaaggtctgaggtaggtgaaccttttgaaaagaatgttgggaagctcagaaagaacaaatcagattctgttaagaatgtcgatgatggaaatggggggaatgcaatacagcctaggaaggacaaaccagagttggatcatgttttgaatgaatcaaggaatgatggattggctggtgggtctggcagaaatgttattgacaatggtaagaatgacagtgatggaaattgcaaggattttggtgtgtgcctagagaaagtaatttccagcaattcagataatgttggcatgatcaagtgttcaccagtgcatgttgatggagactttgatgatgttgttgttgatgatgaagaagaagatgaggagattgatgttgagatggagaaggggagctttgatgttaaggaaatcagtgtgccagaatccaaggttgtgaatgaaccagaaaggaaggaggttgtgaatgtaccagcaaaacagaagattgtgaatgaaccggaacctaaaaaggttgtgactaccaacagacaatttcatcaaaaaaatgaaaggccagtgtcaatccctatagctgtgaagccatctcctccaattagaaagctttccacaattcaccaaaatttctccaaggctgattcaattgatttaatcatgtggagagaggtctcaagatcagcatttatcttcgggattggaacattcactatagtttcatcttcttatgcaaaagatatcaatctgaggggggtcatagatgtagacgacacaaactatgtactaggagaagaagaagcaatttgggtgctaagattgatccttccttatttgaatgagttcctgtcaaaacttagagccatgttttctggagatcctggtaccacaataaagttggcagttttgctctttgttcttgccagatgtggcagttccataaccatttggaagatggccaaatttggcttctttggagtttttaccgggccaaaaatttgctcctcatattctgcacagttaactgcattcgcaaacttttggattcgtcgattccgggatgcttgggtttcttgctctcacaaaaaggccgttgctcttggcatttttggccttgtttggaatttgtcttcagttgttgctcgcatttggtcagtgtttgttctatttgtggccttcagatactatcaacaacattatttggtgagagatggatgggtggaggatgtggcaggatgtgatgaaacatggcaagaacctgttggagttaaagttggaatgcagagacaacaatccacatacaaaatctttgaaactcagaaagtaaagaaagtattctga

SEQ ID NO: 89792 - DNA, 225 bp, Glycine max
  Peptide Sequence Number=SeqID_206570
atgggacacgagtgtttgatggataagaggctttcagctgaagaaatggcggttggtggggtgccacattgggatctccttgtaaagcaagctcatagagagagagaatcaagggattgtgtgtggagaggaggaacccttttatctatgcatagattccttaggtctcacatcacttctaccgaggaagctaaagtcattggtctcaccctcacatgcaaatga

SEQ ID NO: 89793 - DNA, 570 bp, Glycine max
  Peptide Sequence Number=SeqID_206571
atgcagatgagtgttgttaccgattctcctgtgcattcgtccagcagtgatgacttcattgcatttcttgacgctgaactagatgcaagttcaccggactcgtcgcctgataaagaagttgaaaaacaagatgatgatgagcttgagagtgtcagaattaaaagacgtaaatttgaaagcattgaggaaactgagggatctacttcagaaggaatcatcaaacagagtttagaggcatccatggaggtagacgtatgtacacatcccggctcgtttgggaatatgtgtatacgttgtgggcaaaagttggatggggaatctggtgttacatttgggtacatacataagggactgagacttcatgatgaggaaatttctagattgcgcaatactgacatgaagagtttgttatgtcgtaaaaagctctacttggttcttgacctagatcacacactgctaaattccactcaccttgctcatttgacttctgaagagtcgcatttacttaaccaaacagattctcttagagttaatgaagatactgtaattaagggtgctaagaaaaactag

SEQ ID NO: 89794 - DNA, 974 bp, Glycine max
  Peptide Sequence Number=SeqID_206572
atggttggatgtgcagaacccagtcggcgattagaaaaagacgagtccgtgatggaggctgaggatggtccatacacgtgtcgatctgatccaccgttgattaacgaaatccgctctataaaagaaggaaaccttgggccattaagcttgctggaaaagaaaggcaagtggcgagtggccctgccaaacgcagaagctccggcagaaattgccaccgcaaacacgtcgaagacgggtagtaatagcactcggtttcattctcccacattcccaattctgagcgttaagatgagtgagaaagagaaaggcaataatagtgagggacagtcgacgttgctgcacggcaagtacgagcttggtcgtgtgctggggcacggaacgttcgccaaggtgtaccacgcgcggaacctgaatacagggcagcacgtggccatgaaggtggtgggaaaagaaaaggtgataaaggtcggaatgatggagcaggtgaagagggagatctcggtgatgaagatggtgaagcaccaaaacatcgtcgaactccacgaagtcatggccagcaagtccaagatctatattgccatggaactcgtccgcggcggagagctcttcaacaaggtctctaaaggccgcttaaaggaggacgtggcaagactctacttccagcagttaatctccgccgtcgacttctgccacagccgcggcgtctaccaccgcgacctcaagccggaaaacctcctcctggacgaacacggcaacctcaaagtctccgacttcggactcaccgctttctccgaacacctcaaggaggacgggctgttacacaccacgtgcggcacgcctgcgtacgtgtcgcctgaagtgatagcgaaaaaaggctatgacggtgccaaggctgatatatggtcatgtggtgtaatcctctacgttctcctcgcaggctttttaccctttcaggatgataatttggttgccat

SEQ ID NO: 89795 - DNA, 2375 bp, Glycine max
  Peptide Sequence Number=SeqID_206573
agaattatggattcaaagtttcgggatttcatgctgatacaatgcacatggcacgattatgggattcttcaagacatttggatgggggttattctcttgaaggacttacaggtgacagaagggtcatgtctagggctcagctgaaccatgaaaaggacttgattggtaaggtgtcaatgaaaactatatttagtaagaaaaaattgaaaaaggatggatctgagggtaaaacaagtatcattgctcctgttgaagaactacagagagatgagcgtataccttggatatgttattctgccttagatgctagcagcactttgaagctgtatgagagcctaaagagccatctttcagacatgccctggaaatttgatggtgtgccagtttatgggaaaaccatgtatgatttctacaatgaatattggcgtccatttggtgagcttctagtcatgatggaatctgagggaatgctagttgaccgggcttatcttgaaagcatagaaaaggtggccaaagaagagcaagaggtagctgttaatagattccgtaaatgggccactaggtattgtcctgatgcccagtatatgaatgtgggaagtgattcgcagttgcgccagctgctttttggtggcattgtgaacagaaaggactccaatcaaacgcttccaactgaacgaatattcaaaattcccaatgttaataatgtgattgaagaaggcaagaaggctccaaaaagattttgtgatataaagttgacgagcttaggttataatctggagactgagatgtacacagcaactggttggccgtcagttagtggtcatgctttaaaggccctggctggaagtatttccgctgattatgacttttttgatgaggattgtaacttggatctcgatgatgaagatgaaaatccttctcaaagtcaagttgcaccggtaaaaattgataaatctgcatatgggacagcctatgcagcttttccaacagaggaagaagggagagaagcttgccatgcaattgctgctttatgtcaaggacataatatatcaggaaaagatctccgtgttcattgttccttaaatatcaacacagagacaggacgcttgtcagcaagaaggccaaatctgcagaatcaacctgctctagaaaaggatcgatacaaaatccgtcaagcattcattgctgcacccaagaattctcttatagttgctgattatggacagctggaacttaggattctggcacaccttgcagactgtaagagcatgttggaagcttttgaagctggtggagatttccattcaaggactgcaatgaatatgtacccacatattcgtgaagcacttgaaaaaaaggaagtgcttcttgagtggcatcctcagcctggtgaagataaacccccagttcctcttttgaagactcctgtggggctttccaaggattggaaggtttctgtgaaagaagctaagaaaacagttgacctttggtacaatgatagaaaagaggttttgcaatggcaagaggagcgtaaaaaggaagctcgcgtgttacattgtgtttacacattgctagggcgagctcgacggttccctttgatggcccaagctaacacctatcagaaaggtcacattgagcgagctgctattaatactccagtgcagcaacagcttgttgcaaatgatgagtatgttgcttttgggggcaagaaaataattgtggatgggttttggaaattggtagcaggagacacgtggatggtgttgatggttgttaggattttgaaaaaaattgatctaagggctggtgatgctaatgagagagtgggagccagctgtgatgtgggagtgcacatgggtgaaaggacacatggtgatctagatgtcttattttcttatatgatggacaggtgtgattggggaaggaggttaggggattgtgggtggtggattggggttgcaaaaattgaaaaggttgatgtggggaaaatagattttgttgcaacaccagcaagtggcaagggtacggagaggagaaactttgttgtggcggaaacggtggcgactgttgcggcagtggttgtgacagtggtgacagtggcggcgattgtggtggcagttgtgggtagtgcagctgatgttgccatgtgtgctatgttgcaaatttccaagaataaacggttgaaggagcttgggtggaagttacttctacaggttcatgatgaagtcatattggaaggaccaacggaatcggctgaggttgcgaagtccatagttattgagtgcatgtccaaaccctttaacggcaagaatattcttaaagttgacctctctgttgatgccaagtgtgctcaaaactggtactctgggaaatag

SEQ ID NO: 89796 - DNA, 315 bp, Glycine max
  Peptide Sequence Number=SeqID_206574
atgcctcaaagtctctgcagtttcccctctagaacaaacccacaaaccacccttaaatcaaaagattttgctttctccccaacaccaaccaacaagagcatgcataaatccactacccttgactcaaatgacacaaaagataaggctgaatttcccccagtagaaataggaaccagaggcacagttgcatcactcataatgcaagaaattgagtacttcagcagaattggttccaattcacaaaggaacaagtcccaaatcacagagacagtggtaggccaaatgggacctcagccttcagttacaggaacctga

SEQ ID NO: 89797 - DNA, 255 bp, Glycine max
  Peptide Sequence Number=SeqID_206575
atggcgaagaagatcattcacgacaccactaggaagatgtctcagctgtgccagaaaatcgttcaggtcgacgtccgcccatctcactaccggaaactacccctccgggacccctcttcttcgccgccggccaccgttgacgacgtcttctcctccgctgcaaccactactggcggctatgactccgattccgatttggtgaacctcaagatcagcttgttgggtgattgccatattggaaaaactacttttgtg

SEQ ID NO: 89798 - DNA, 177 bp, Glycine max
  Peptide Sequence Number=SeqID_206576
atggaggttttcgagttatatacgcgtttgtttgctaccgtgattgaagggaattcaagcaacaatcttccttatacagtgcttcgcaacttggattccatagcacagaagttggtagatgttaccaaggactgcacagtgaagaacttgaagcactataatcactcagatggatag

SEQ ID NO: 89799 - DNA, 950 bp, Glycine max
  Peptide Sequence Number=SeqID_206577
acttggctttggtgaaagagttctatgcaaacttatacagctcgaagggcccttcaccaaagcagtccaaagtcagaggccatttagtgaagattgatgctgatagtctcaacacattcctggagacacctgtggtattagcagaggggttcatcttgaacactgagggccatcctgggaagattctcaggaaggatttgactactctagctcaggtgtggagtgttctctcatactccaacctggcccccacatcacatacctctgatctgacagtggatagagctaggctgatctttggcctagtctctcacatggacatgaacataggagctcttatttctggccagatgacctctatagcccagtctaacacttctaaacttgggtttcctgctctaatcactgcattatgtagagccagagaggttgtctctgacagccttacctttgagcgcctgagcccggtcattaacttggcctacatcaggaagaactgttggaatcccgaggatctaatagtttctatccaaggggctaggagggcgagggcgaggctagctgagcttccttccacttctggacagatcattttattacagagtttacaggtggtggcgcctccaggatctattccttcagttgagcagtttagcgagatggatgaatcatttgaggccaccattctagagacatttgttataagagaagaggtagatgagacacaggtgagacaggtagctgctgccactcccgagagatcccttgaggccacttcagtgcctcctgcaccaatggtggacctaccctcacctcatcatacaatagacccttccactcctatcttagagataccagaggacccgaccacaccagtcctaactatagacacttctcctccagctactccaatacttcatctaacaaatgaggaggatgttcagacatag

SEQ ID NO: 89800 - DNA, 897 bp, Glycine max
  Peptide Sequence Number=SeqID_206578
atgagcatcaattcgttgccaattgaattgcttataactattgtttcacttcttcccttcaaggaagctgtgagaacttctgtcctctcgaagaaatggttagagttgaacgtttgcaagttcacaaaaaacatagagtttgatgaactcttttttgttaaacctgatcaacctaatgaaacaagagaaatccaaagaaggacttttcttgacttcattaatttgtggattgaaaattacaaaggaactttggtggagaagttctcttttaggttatcaaatcctagaaatggtggtgagatcattgatcaatgcgttgcttttgccacagaatgtgaggtgaaggagttggaacttgactttgctgatccaaactggaatgaaaataatatctattatggtaattatgaggaggcgctgtttaaattgccagcacgagtttaccagcatggtagccttgagtctttgaagctatattcatgtagttttgttgagactgaagtgcttaactttcatgcactcaaagaagtttctttgggttggatggaagtgagactcagtgctatcaaagctttgctttccaattgtaacatgctggagagtttgagttttaaaaggtgttggaactcagacaagtttgacctaggcgaagaagaacacacaggtcttagaaagcttgtcctggacaagtgccgctttgaatttgatgttttcaaagtgaatgcaccagatctaaaaattttccagtactgtgggttaatgaactttttcatcacggaaattcattcacccgcaatggaagaggcaaatattgatttctctccagaatatggattcgaaggactaggtcatcctctttataatctggtggaaatctatttattgttagagttttga

SEQ ID NO: 89801 - DNA, 456 bp, Glycine max
  Peptide Sequence Number=SeqID_206579
atgacggctacttgcgacagtggcagcatccttccaggaacaatggaggcacgaacacatttctgggaatgggttttagtctattctctaatctctcgcttcacaattcacatggctctggaagcttacgcagcagcaaaccctgacaaaatccacacagatgtcctcaccaaagctagggattcttgttacaaggctcgtgatgcgttctatgcctgcctggagaaggaatcggacaagaagcccacagagattgcatctgtgggtttgttatacccattagaatgcaaagagtgcaggaatgaatatgtcaaacagtgccgatcttcttgggtgaaacatttcgataggcaatactgccagaacaagagggttcagagacttttggatgacaaagggtcccggagaggtccgttgacgctcccacagccttacactttcaaacccattgcttga

SEQ ID NO: 89802 - DNA, 123 bp, Glycine max
  Peptide Sequence Number=SeqID_206580
atgtcactacttgttgatgggttaaccaaggtgacaacggataagtggatggatataacggacatgggacatgtcattgcattaaggtataacataatcattgtatccttgtctaaacaataa

SEQ ID NO: 89803 - DNA, 159 bp, Glycine max
  Peptide Sequence Number=SeqID_206581
atggtagaggtaaggttagcattgagacaaataatgagtaagataaaggtagagatacttgatagagatgagctctacctcttctcagatgtagcaagagccactagttttatcactgaatgcgtggttcatagcaaatctaactccattgctgggtaa

SEQ ID NO: 89804 - DNA, 3261 bp, Glycine max
  Peptide Sequence Number=SeqID_206582
atggaggtagaggaagaaagttctgctagggtttttggagtttattcgaaagaggaggatgatctcctttcacagagtaatagaaaagttaaaaggaaagctgaggagggagatgatgatggagtgatggaggcagaaaagggagaagaaatacagaaaaaggatttgtatatgaagaagctattgactaaagagggtgcaatgcctttctctgcatttgatggagggtggagtcacagaaggagaaagtctaagaagaatggaaaaagtgtaaacacaaaaagggctaacgcagataagacgaggagcatcgttggagtgtccaatcatgataacacagagggtttaaatatgattcacatgcttcaggaaataggagctgattttcttggtgacaagaatggctataacccaggggagaaagtcgtggctatgcctgatgcagaaactctcgaatttgtgcaaaatcaaaagaaaggtcctttgaaaggagggtcttcatctatttctccagattcgacgaagttggaagaaccagaggttcgttttgtggagaatataacaaacatggaaactgaaatccaagttgaggatcagaaaaccagcgcaataattgatgtgaataatgaagctttgggggaggatattagtagggaatatgaatcatctttgattttcctgattgaaactcatgcagatgcttctgctacagatcgtgtgattgaccgtttaggttttgataagagctttgttgtgaatgctagaggccactcaggcggtttatggtgtttgtggaaagctagttgctggaatgtggagattattagtagtggagtccagaaagctctttgggaagttttgagtaatattgcagaaacggtcattgaagcatgggctattatgggggattttaatacaatcctaaatgatatggactgggttggttgctcgaccaatccctcatggagaggagcaaatgatttccagcagtttatcagtgactgtaacttgatagatgttggattccagggtccggcttttacctgggggagaggaaatttgttggagaggcttgatcgtgtcctgaaaaagcaaaaactcatctgtaaccttcagtccatctcccaaaagctatctagaagtgggctgatagagttggaagagacacagctacatatttgggagcagtaccgggatgctttgaggcaagaagaactcctttggcataacacatatgaagcaattcaagatgtagatggtatttgggtggcaaatgatggtgatcttgaaaggttggtaactgagtatttctccaatctgttttatgacatcatgcattttgttccttactgcatacatggagcttttccccatctatccgaaaacaattttgatatgtttaaagatagagtaatgtcggagggagctagactaggaaagctttattttctatggaaaatttcaaagctccaggatctctgcaaccttattaaatctgttttcgagaatctcattaagattgaaactattaacaatatgtttattgccctcatccccaaggtggagccggaattggttaacccctgcctgagtagctttattccaaacagaagaatgggggataatgtaatcattgcgcaagaagtgattcattcaatgaagcataagaaaggcaatagtggatggatggctataaaagtagacttggaaaaagtttatgacagattgaagtggagatttgtgacagatactttgaaggacatcgttttccatgagaaatttatccatctaattcattatagtatctcatcatcacgggaacaaattttatggaacggggaagctcttgagaggttcaagccatacaaaggtgttagacaagcttggactccaattcagttggctagaggtgggccaaagctatctcatctggcattcacggatgacctgttgttattttcagaagcatctatttctcaagctaacacgattaaaaaagtgttggataccttttgtgctagctcaggccaaaaaggaactccggatctgggcaagtatttgggagtgcctcttcatcatcaaaaggcaaatgctcagagtttccgtttcatcattgataaattggaacaacgtttgagctgttggaaagataagagtttgtcattcgctggacgtttaactcttaataaagttgttatacaggccatgccaacatacataatgcaaactaattctattccagaatcagtgtgcaaggatattgttaagtatcgaaacttcatatggggagatagtcaaaattcgaggaagttgatacctaatgtgagatgggttattggtaatggtagatcaactcggttctggtctgataattgggtgtcaggagtagggaagttgtctgagatttgtaattcaggaaatcagcaaggtcatgatgagcgctctaatcctccagattatattgtttggaatactaattctgatggagtgttcacgatttgtgaagcttgtactcagcttgctaaggagcttagagactcagatatcagattgttcgattttgtgtggaggaaacaactctacattgtcttagagattgtagttgggtatgtcaagtcaggagtaatctctgagcagataactggagtgtgctattcggagtggctttggatcgaatttggtggagaaggaacagtttcgtttttaaacacacctagcaatctatgcagggtttgttcgataactccttgcaaactgatagtcatgggatttggaattattaaactaaactatgacgcaacgtccatccaaggtgatctgtttgttgcttgcggtgggttgattcgagatgatcatgacaatttcattcatgatttttctcaaagaataggccgatgttcgattgttgaggttgagctttggtcgattttatatggtatgaggttggtggctgatagacacatgaaaaaggttattgtggagtctgattctttggcagcaattaatctaattcatgaaggttgtccgactttgcatccgtgctttggaatagtggaagagatcaagaacctatataatgaatttgagcattgcagctgcaaaaatattctcagggaagctaatatacttgctaatacgttcgcgaaacatggtttatctataagtactgattgtcaattcttttgtaacgttccaacttttgctttggacccttttcagggtgatgttagttgtatctttggtcaattgactcttaactga

SEQ ID NO: 89805 - DNA, 1035 bp, Glycine max
  Peptide Sequence Number=SeqID_206583
atgcagcaagatataagggattttgtgagaaaatgtattatttgccaacaggccaaggtagaacaagcgttgtcagctggcttattacaaccactgccaattcctcaaagaatctgggaggacattgctatggactttattatgcatttgccatcttcatatggttattctattgtccttgttgttgttgataggctatctaaatttgctcattttataccattaaaagctgatttcaccagcaaatgtgtggcatatgcctttattgttaatataggcaccacattggctacgagttctacttatcaccttcaatcagatggccaaacggaggttttgaacaagacactagagatatacttgagatgctttgtgtttgatcatcctgaagcctggtttgagatgcttccttgggctcaatttttatacaacacttcctttcatcataacattggtatgtctcccttcaaggctatttttggtagggatccaccatttccttatagacagcactcagttgcattgagaaaaaatcagaaattgagaacgaagtattttggtccatttgaagtggtggatcgaattggcatagtggcatataagttgaaattgcttgaaacagctcgtatacatcttgtttttcacatttctatattgaaaaggttcattggtagctcaaagcagccttatttaccattaccattaacagtgggtgaaagtggtccgatggttcaacccatagcaatattggattcaagggtgttattgagagactcttcccaagtggaacaggtgctgattcagtgggaaattgctggtcctaaggaagctacatgggaggatgcgacttgggttaaggcaagttatcctcatttcaaccttgaggacaacgttgtttttaaaggggagggtaatgtaacatgtaggaagcaggagggaaatttggcgcgtgagtctgttacaaaggaaagacacatggctgatgatccgcatgtgggggtcagaagagcacactcgttaggagggagaatataa

SEQ ID NO: 89806 - DNA, 414 bp, Glycine max
  Peptide Sequence Number=SeqID_206584
atgtcgcagaggagcaatgcatcatcatctcgaacaagagtttcatcacaagttgttcttttttgtggttgtggtaaaagggctgttaggcgtgttgctggaacaaatattaacagaggaagggcgtttttcacttgttcaattaataaggatgaagttggatattgtgggtactttatttgggttgatcaattgattgaagtacttggagttgatgattcacttgggacattttccatggaacaaagaagacaatttggaagagaggaagataagacaatgtggaaggctcaagttaactcaaagcttgattgtatggggattgaaatgaagatgtttagaacaattgtctatggaatgttcttaatccaattgttgtcaatggtggtgtttgtatatattcacaagtactag

SEQ ID NO: 89807 - DNA, 1647 bp, Glycine max
  Peptide Sequence Number=SeqID_206585
atggaaaactcagatacaacactgacaagttcatccctgcctccaccacctccagtatctgcggaggagccagagcccaagaagttgaagatgtccaccacaacttctgatgatgaagaaacaggcaccaagaaaagatacaagcgccgtaaggttgctattttctttgcttactgtggtgttggctatcagggtatgcagaaaaaccctggtgcaaagaccattgaaggtgacctagaagaagccttgtatgtgtctggagctgttcctgaacaggatcgtggagttcctaaacgatatgactgggctcgctcagctagaactgataaaggtgttagtgctgttggtcaggttgtctcaggccggttctatattgatccacctggccttgttgaccgccttaattcaaacctcccctctcagataaggatctttggttacaaacgtgtgacagcttcttttaatgccaaaaagttttgcgaccggaggaggtatgtctatctcattcccgtgtttgctcttgatccaagctgtcatcgtgatagagagactgtcatggctagtttgggatctggaaatgagcttgttaagtgtttggagtgttctgagaggggccgaaaggtggtaggattagttggtaatcgtaagcagaatctggaactagaagctgtggatgttgaggctggtatttcatcaaacagagactctggagttacagaagatgtggaggtttctttgagcaaaggtgatgataatcatttaaatgaggaatctgggaatgataacaagggtggcatgaactgtaaaactggccttgagactgtgattcctgttcaggaagagggtactcctttgaatggtgaatctgtgaataattcagacattcttgaggaagaaaaagttaatggagaggataagccaaccaatggaagtaggttctgttatggtgagaaggagagagagagatttaataagattttgaagtgctttgtagggactcataatttccataacttcaccaccagaacaaaagctgaggaccctgctgctcgacgctacattatttcattcaatgcaaacaccactcttgtagttgagggcgtggaatttgtaaagtgtgaggttgtgggacagagcttcatgcttcatcagatacggaagatgattgggctggcagtggcaatcatgagaaattgtgcaccagagtcacttatcgatgaagctttgcagcaggatgttaacattaatgtgcctactgcccctgaggtgggattatatttggacgagtgcttcttcacttcatataaccagaagtggaaagatcatgaagagttgtcaatgaaagcatatgagaaagaagctgatgagttcaaaatgaagtacatatattctcatattgcttccacggagcagaaggaaggaactgtcgctctttggttgcattctttgaaccatagaaattatccagatctgcgtgttatcaacgaggaagccatccccaataacaagagtgctgatcccaaagaagccatcactgataacaagagtgctgatcctgaagatgccaccactaaaaacaagggtgccgatctcaaagaagccatcactgataacaagagtgctgatcctgaagttgtgactgagtga

SEQ ID NO: 89808 - DNA, 492 bp, Glycine max
  Peptide Sequence Number=SeqID_206586
atgacacgtatgcatttgccacctaataattcacaaccaacaaatgtggacgtatcctccacagaagacaattttttccatgattcgtgtagtctgaattgcaaaatgctagggaagaagatggtatcactgaagaaactagccaaaagggtgaagggtgttggaggagctgatcactcggaccctccctaccaagaatgtttgctaaaggggtatgaggaagataaagaatcaccctctagcccaaccccaacagggttttttgcactttatgttggtgaggagcgtcagagatatgtggtaccaaccagctacctctctcaccctctattcaagatgctgctggagaaggcctacaatgaatttggctttgcacagaggaatggcctagtggtgccatgcagtgtttccacatttcaggaggtggtgaatgctattgaatgcaacaatggcaactttgacttaggcaagatttttgaagattttgcttag

SEQ ID NO: 89809 - DNA, 870 bp, Glycine max
  Peptide Sequence Number=SeqID_206587
atggtggaaaatgggaattatatggaagctgaaggaatgattaacaagttaactatcaaagctcaaaatgctaggtttcaattgcctgtgtttttattaccagtatcaagtgctgatctcatcttagaagctagttggctgaaaactattggtcctcacatagctgattatgacaatgttgtgtttggaactcctacgtcattacctcttccacgagctcatgatcattccattcccttagtggatggttatcaacctgttaaggatcatttgtctcatttggaatttgtgttgagcattttgaagcagcatcagttgtttgctagattctctaaatgtgcttttggagttagagagattgattatttgggacacaccttatcaggaattggtgtagcaatggagacaacaaaattacaagctattttggattggccattaccaaattctcttaagcaattaaggggatttttgggcttgataggatattatagaagatttgtgaaaggttatgctacaatagcaacaaccttaattgatattttaaagaaggactcgtttaagtggtctgcaagtgccattactgcccttaataagttgaaggaagttatgacttcagctccagtcttagccattcctaacttcaaggaaccttttgtactagagactgatgcttcaggtactggaattggggttgtattaagtcagagtgaacatccaatagcttattttttcaaaaagctatcatctagaatgcaaaaacaatctgcttacattagagagtttcatgccattacggaagctttggctaagttcagacactacctattgggacataaattcattatccgtactgatcagaaaaactga

SEQ ID NO: 89810 - DNA, 1599 bp, Glycine max
  Peptide Sequence Number=SeqID_206588
atggccgacacttctagtcccgttcaacgaaggtgtagaagaccacccctttggatggaagagtatgaaactagcgaaggactttctgaaggcagtacagaagctaatctggttatgtctgcaagtgaaagtgatcctactcactttgatgctgctgttcaaattgcaaaatggaggaaagccatggatgaggagatggaagccataaacaaaaatggcacatggaaattgaaggaattacctgatggagcaaagaaaattggagtaaagtggatttataagacaaaattcaaagagaatggagaagtggacaagtacaaagccaggcttgtagtgaaggggtatgcacaagaatatgaggtagactatacagaagtatttgcaccagtagcccacatggagacaattcgtttggtggtagcacttgcagctcaaaagggatggaccatctatcagctggatgtaaagtcagcatttttacatggagagttggaggaaacagtgtatctggaccagccttgtggttatgtacaaaaaggggatgagcataaagtgtataagctgaagaaagccctttacggacttaagcaagcaccacgtgcttggtacagccgcatagaagcacattttttgaaggaaggatttgagaagtgtgactacgagcatactttgtttgtgaagagagaaaagaaagatataatattaattgttagtttgtatgttgatgaccttatttttactccaaatgatgagttgatgtttgcaaaatttaaaagctccatgaagcatgaatttgacatgacagatcttggtattgagatgctgcaaaggtttggaatggataaaagcaatttggtgcaaactccaattattcctggcattaaactcacaaaggacgacactggtgcaaaggtggataagacttactataaacaaattgtgggaagtctaatgtatctaacatctactcgacctgatatgatgtttgtggtgaacttaattagcaggtatatggagaatcctactgagctgcatttactagcagccaaaaggttgctaagatatttaaggggaacaactgagtttcgaattttctacatgaagggaggaaacaaagagcttcttgcttacactgacagtgattatgcaagagatttggatgatagaaaaagtacttcgggttatgttttcttattgtgttcagctgctgtttcttggtcatcaaagaaacaaccaattgtgagtctatcaactacagaggcagagttcataggtgcagcatcgtgtgcttgtcaagccatatggttgaaaagggtgttgggaaaattgtgtaaaatgcaaaaccaggctactgtaatttgttgtgatagtagctctgctattaagctttcgaagaatccagtaaagcatggtcgttataaacatattgatgtccgatttcatttccttcgagatcttacaaagactggagctatcaagatgatgcattgtgggacacaagaacaagtggttgatattatgaccaaaccactcaaactggatactttgttaaagcttcgcaggtcactaggagtgtgttcagagtttgatataaactaa

SEQ ID NO: 89811 - DNA, 513 bp, Glycine max
  Peptide Sequence Number=SeqID_206589
atggaaaagaactacctatttcaagcattagatcgttcagtcctggagacaattcttaacaaggatacagcaaaggatatatgggattctttgaaacagaagtaccaaggcacttcacaagtcaagcgtgcacagttgcaagctctaagaaaggagtttgaaattctccacatgaaggagggagaatctgtaaatgtttattttgctcggacacttaccatagccaacaagacgaaggctaatggtaaaaacaaaggcgatgttgcagtagttgagaaaattctgagatccatgactcccaagtttgattatgttgtgtgctccattgaggagtctaaggatacagacacgttgaccattgatgaattgcaaagtagtctcctcgtccatgaactacgcatgacttctgatatcaacatgcagaacagggatgaggtcgtggaggctttggacgatgcggaaggggatgaggtcgaggacgtggcagacaaggatttgacaaatccactgtag

SEQ ID NO: 89812 - DNA, 492 bp, Glycine max
  Peptide Sequence Number=SeqID_206590
atgtcgaagatctttatcagagaaggacgacaacagatgtctcctatgcacaagcgatcaatcgaaaggtataactctatatgtatcaagtatgtgggaggcaaccaagtttgtctgactggtcaggaatctgaggatactgaagccctaatctttggtggagggttctttgttaaacctaaacctttacaacagaaggcaatgttaggaagctttggatcaatgggtggggatgatgaggagtcgatttctgcatttataggaaatggtgatgaagacgactggtcactatgcgaggatgagtttgagatgacaaggaggtctaggcgatcgttgatggaagctccattggagcttgtaggcctaggatcttcttcatcaatggattcctttgcttcttggaagatgaatggcagcggaatggagaaggaagagagagaggagacgccacttcaaggagaagatgagtctagaagaagctcaccaccatag

SEQ ID NO: 89813 - DNA, 207 bp, Glycine max
  Peptide Sequence Number=SeqID_206591
atgtcattgcctagcgctgttcatgtgttctccattatccagtgcgaagcttctggtgactgggaagcacgttattctgttgttttccagatcggttccttcgccaaaagaaaaaaagcagaagtagagatgagagtcgtcatcgcgaaaaagggcaggacggacgaaatcagtgtcctatctttgctttcctcttatctccgatga

SEQ ID NO: 89814 - DNA, 312 bp, Glycine max
  Peptide Sequence Number=SeqID_206592
atgaaaaccataaccaagcaatttgaagagcttgatgtttgtggcaaagttactttgaagagtaaacttcgggaaattgcttaccctgatctaaactctacgtgtgctcctctagaaaagaatagtaattcttcagtcaaacatagtgcatcatcatctgagcaaccaattcaaagaaggagtatgtcaatgttggatcaatttcatccatgtattcatgattccattgtaaacattgttgatgtcaaagttgatggtcaccatgatcaagtggatgaatataaccaacatgggatatgtcattgtatcaag

SEQ ID NO: 89815 - DNA, 465 bp, Glycine max
  Peptide Sequence Number=SeqID_206593
atgttgggaagacacatattagctgaaaggaaagtggaaatctatcacacagagctggatgaattcaagggcgggctggagaggcgtaactttcacaagtgcctcaccaacttagctgatagtagcattgacctcgcgttggtgaaggagttctacaccaacctctacagtctcgaggggccttcacctaaacaagtcagaaaccggggccacttaataaggattgatgcagacagcctcaattcctttctagaaacacctgtggtgcttgctgagggtgaatctttgcccacctacttaagatattgcaggatccctactgacattagagaaattgagggtcacccagggaagatccttagaaaagatctaaccacccttgctcaggtctggagtgttctatcctactccaacctggctctgacctcccacacatcgaatctgactgtggatcgagctaggtaa

SEQ ID NO: 89816 - DNA, 623 bp, Glycine max
  Peptide Sequence Number=SeqID_206594
atgatgcgtatgtctaaaaagacgttaagtgataccattcaagctatcttgattcctatcgaagggatgacatgtgccagctgtgcaggacgtgttgaaaaagccttaacaaaggtccctggcgttaaaagtgtctcagtcaacctcgccaccgagcgagccactatccaagcgagcggagaagtagaccgaaatgccttgattgaagctattcataaaactggttatgaagttccaacatccagggtggagctcaatgtgatgggcatgacctgtgcctcatgtgtgggtcgtgtggagagagcactcaggtctgtccctggggttgttgaggcagccgttaacctggccaatgaacgagcatccattgcgggttcagccgacccggcagcattgatttccgcgatcaagcgtatcggttacgaagcgacagtcatcgattctttatcgcagttacagggcgtagctgagcgtcaaaaagagactgaattactcagcttaaagtgggaccttattgtggcagccgcgctgtcgttacctgtgtttgtgatggaaatgggcgcacacttgataccaggtgttcatgagttaatcatggataccattgggatgaaatctagttg

SEQ ID NO: 89817 - DNA, 592 bp, Glycine max
  Peptide Sequence Number=SeqID_206595
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcgtgtgccgcttcgtgatgtccaccccatcgaattcaagcttgcccgcgctggcctgccacaaacccatgatggtgcgcagcgtggtggtcttgcccgcgccgttacggccgagcagcatcgtcacgccgccgcgcggcacctcaagattcacgccgtgcaagatgtgatacggcccgatatgggtctgcacgtcagccaggtgcaagaccggttggcgctgggtatcagccatgggccacctccgtcatggcttccgttatcacttcggccgtacggtaccgagctcgaattcgtaatcatggtcatagctgtttcct

SEQ ID NO: 89818 - DNA, 1049 bp, Glycine max
  Peptide Sequence Number=SeqID_206596
atggtagccacggcttaccaaacctcccatgaatgttcggaagaaaccattatagatatcttagtggcaggattttccggacaactaaaaggatggtgggataattatctcactaatgaagagaaatcaaaaatttacagcgcagttaagacggatctcaatggaaaagtcattactaatgacgatgataaagagattcctgacgctgtgaacacgttaatttttacaatagcccaacatttcattggagacccatccttgtggaaagacaggtccgcagaattattatcaaatcttaagtgtagaaccttagcagattttaggtggtatagagatactttcctaactagggtttacacaagagaagatagtcaacaacctttttggaaagaaaaattcctagccggtcttcccagatccttaggagacaaagtcagagataaaatccgtagtcaatctgccaatggagacattccatatgaaaacttaagctatggtcaattaatttcctatgtccaaaaggtagccttaaaaatctgccaggacgacaagattcagaggcaattagccaaagaaaaagctcaaacaaagagggatttaggttccttctgtgaacaatttggcttgccagcctgtccaaaacaaaagaaaaaacaaacctccaggaaagaagcccaggatcataagccagccaatagaagaagattttcaaaacgaagatactctcaaaaaccctcaaccagtagagaaatggaaaatcctaaacaaaaaataaaattaaaaataacgtgctacaattgtggaaaacaaggccacattagcaaatattgtagactaaaaaagaagttaagaaaccttaacctagaaccctcaattgaagagcaaataaacaatttgctcatagaaacctcgaaggaggaaacagaaacagaaacttcatcctctgtgctttccgatgaaaacctaaatctaatccagcaagatgaccaactatcatcaacaaatgatgatgggcaaatcaatactctaacgagagaacaagatctctt

SEQ ID NO: 89819 - DNA, 735 bp, Glycine max
  Peptide Sequence Number=SeqID_206597
atgacggaaaaattacttcaatatctttggaactttaaagttttcaaaaattttgacttcaaggatattgaaggaaattccgttgagatcatacatttcgggaaatggaataccaatgccgggcctgattttcttctggcgtccattaaaatcaataacctcatcctgagtggaaacatagagcttcatgtaaagtcttcagactggatcttccataatcattccggggatcccaactatcaaaatattattcttcatgttgtttttcaaaatgatattgtgattgaagaatttaatgataaaaaaattcctactcttgaactgaagaattatattgatgaaaatattctgtggaagtatgagaaactcatcaaagaaaatcagtttattccctgcgaaagtatttttgatcagcataatgttcctcttcatttccacgaagaaaatgttttaagaaaactaaatgagaaatcagaggaactggaacatgctttacaacagtcaaaaaacaatttcgaagctatcctctttcatagtcttgcctattctttcggactaaaagtaaatgcctatatattcagacaaattgctgaaagtattgattacagtgtcatcaataaaatcaggcaaaacccaacacatcttgaagctttattctttggaatttcggggtggcttgagtatccggaagacgaacaaatggaaatctggaaacgggaatttcagttcataaat

SEQ ID NO: 89820 - DNA, 558 bp, Glycine max
  Peptide Sequence Number=SeqID_206598
atggcagagttgtgcataatgcctaacgtcgtcatccctccaaagttcaaggtgcaggacttcaataagtacacggggactacttgccccaagaatcacctgaagatgtactgtaggaaaatgggagcatatgcgaaagatgaaaaattattgatgcattccttccaggaaagtcttactggggcagtcgtcacctggtatactaatttagaaccttcccaatatcagtacaattttgatatggctccggatagaatgcagctacagaacatgtgcaagaaagagcatgaatctttcaaagaatacgcccaaaggtgtagggatctggcaactcaagtagcgcccccaatgacggagaagaagatgataacaatgatagtggacacgttaccagtgttctactatgagaagatggtgggttacacaccttcaagctttgctgatttagttttcgccggagaaaggatcgaagtgggtttgagaagaggcaaatttgtttttcctactttgatgaataggaagcctggggaaaatggagagaatgagaaggagggatga

SEQ ID NO: 89821 - DNA, 228 bp, Glycine max
  Peptide Sequence Number=SeqID_206599
atggatcgggcggcgttgacggtcggaccgggcatggacatgccgataatgcacgacagcgaccgttacgatctggtccgcgacatcgggtccggaaatttcggcgtggcgaggctgatgcaggataaacaaaccaaggaactcgtcgccgtcaagtacatcgaaagggaatttttttccttacggcattcgtttggtgtttcttactctgatgaagttgctgactga

SEQ ID NO: 89822 - DNA, 216 bp, Glycine max
  Peptide Sequence Number=SeqID_206600
atggttgcagacaccccaaaaacattaaagttgccaccaaaatcacggtcacagaaaatagtggctaaattcagccgaagcgacaacaaatgcagtcatggacactgcaaaaacgttggcaattgcggtcgtggacactccaaaaaccttgacgttgtgaccaaaaactcggccgcaaaccgttttttaaataaaaccctagaaaaatataactaa

SEQ ID NO: 89823 - DNA, 366 bp, Glycine max
  Peptide Sequence Number=SeqID_206601
atggaatatgcatctgggggagagctctttgagaaaatctgcaatgctggacgttttactgaggatgaggctcgattcttctttcagcaactcatatccggggtcagctattgccatgctatgtcttcttataatatgtctcttcacgaagcaagtatgtcatcgggacttgaagctggaaaacactttgctggatggaagctcggcacctcgtttaaagatatgcgattttgggtactccaagatttagactgtgatgatggaaatgagttgctccttaagttactaaaagattgtttcggtaatttgggatattggaagagacacatttctacacgactgttgatggtgaattttataatctaa

SEQ ID NO: 89824 - DNA, 1812 bp, Glycine max
  Peptide Sequence Number=SeqID_206602
atggggcgcaacagggaaaacgggcggtattatagagaaatggcacggacagaggcctgtgagccattacgagacaactatttgaaacgcctgaaattaaattatctgtttatcggtctgatcaccgtgctgcttgcgctggcgctgtggccgtccatcccctggtacgggggcggaaaagacgcgttatcacagatcaaatcgcggggagtgttgcgcatcagtactgtcaactcgccgctgacttactacaccatcaataatgcaccagccggtatggactacgagctggcgaagcgtttcgccgattatcttggcgtgaagctggaagtcacggtgcggcccaacctcggcgacctgtttgacgatctcgacgacggcaaagccgacctgctggccgccgggctgatctacaacagcgagcgcctcagccgttatcagagtggcccgagctactattcggtgtcgcagcagctggtgtatcgcatcgacaaaccgcggcccaaaaaccttggtgatctgaaaggccggctgattgtgcagtccggttcggcctatctgtcaacgttacgttccgccaaagcggacagctatcccgatctcgactgggccatttccaccgatatgggccagaaagcgctgctggaagcggtcgccgacggcaagctcgactataccgtgggggattcggtgaccatcggcctgctgcagcgtatccatccacagctggcagtggcgtttgatattaccgatgaagagccggtgacctggtatctgccacgtaacgatgacgatagcctgaacgccgccatgctcgacttctacagtcagatgggggaagaaggcaccatggcgcggctggaagagaagtatctcggccacgagtcgcactggaatccgcaggcgacctcgcccaccggcgtgcgcggcatgatgatgctgacgcgcaataccgctgacagcctcgacgtgaacgatcgtctcgatccggaacagagcattcgcggcggcagcgaatacctgcggcgcatgatggaaaaagtgccggagaccattccggaagatgaacgcatctggtttgcgctggcggcctataacatgggctacgcacatatgctggatgcacgccggctgacgcttaaacagggcggcaatccggacagctgggccgacgttaagctgcgcctgccgatgctgagccagaagcgctattacgcgcagaccacatacggctatgcgcgcggccacgaagcttataactacgttgagaacatccgtaagtatcagatcagcctggtaggctatctgcaggagcaggagaaacggctggcacagcagtcggcacttgaagcggaactcggtgccgtcgctcagcagcgtggcgcactcttcggccagcacgccatgcgcaatctcaatctgatgattcatgcccggatggccgatcacatccagcagcgaaccggcggcaccggttttctcatccttcgcgccatagaccagacgggtaatccggctgtgcaccatggcaccggcacacatcacgcacggctccagcgtcaccgccataatctcggcatgcgcggtgggatcgcactggctaatcggccggttccagccctcgccaatcactcggtcaccctgcaccagtaccgcaccgaccggcacttcgccctgctcccacgcacgccgcgccagttcaagcgcgtggcgcatccattcaccgcgcggcgtcacgcgccagcgatgctggcagaaaaacagcagcgggttatcctgcttgctgtcgctgtagccgctgtacagctgtag

SEQ ID NO: 89825 - DNA, 510 bp, Glycine max
  Peptide Sequence Number=SeqID_206603
atggctgaaaatttattaatcggagatcctccaattattttcaattggagaggatctggatccgagattctcctggaaagcgttcgcgtccgctcgtcacgttcccgctcactccctctcgcgttcgccctgttcgtccctctcatctattcatatctctctactctgagcatagtggatatggaatgtgtggttcagggaattatagagactcagcatgttgaggccttggagattcttcttcaaggactatgtggtgttcagagagaacgattgaggatccatgaaatatgcctcaagagtggtccacatctgggaagcagggaaacagacattgatacaacaaagccttcaattctgatatataagcaagcccctgagaatctgagagtgcatatgataataacagtattgagaatagagaaaaagagcaccatccttcaccctactccaccaaggcagaaaaagagtgcttctccccagagccttacccaattccccccctcctaa

SEQ ID NO: 89826 - DNA, 393 bp, Glycine max
  Peptide Sequence Number=SeqID_206604
tttttgaagttcttagatgattatgaaggtgatggcccaattacagttctattaagccattgtaggatcaaggaagcgcagggatcttatcccgcattgatcagcaattctttcaaggcttcaaagttaattattaaccagcccgtgatggagattcaagaattcaatgaacggcttgcagagttgggcattgaggcccggtcaggttttaaatcgcatggtgaagggagtacacagctttcaggttctatccaattatcatcaaaagaatcaatctttggcaaggctaaggcagagactattgctgacattaacaccatctatgaagaaattgtttgtgtcactgttggcacaattactaggattgttctggacaatcattcatggtgttaa

SEQ ID NO: 89827 - DNA, 2190 bp, Glycine max
  Peptide Sequence Number=SeqID_206605
atgctgaaacttatttcccgttatgcaggaattggcgttatcaacaccgcgattcactggacggtgtttgcgcttattctcaagctgttcgagtcaggtcaggctatggctaactttggagcattctgcgttgcggtgacgttttccttttttgctaatgcccgctggaccttctcttctgcagccacgcccttgcgttacctgctttatgtcagctttatgggaggcatggcggcgctggttggctggatggccgacgcctgcacgctttccccgggaagtaaaatgaaattgtctctcgtcgtgcccgtcttcaatgaagaggaaaccattccactcttttatcaggcggttcgtcatgaattagccggctatcaggtggaaattgtttttatcaatgacggcagtagcgatggcagcgaaaacatcatcaatgccctggccatctcggatccgctggtcattgcgctgtcattcacccgcaatttcggcaaagagcccgcgttgtttgccggactggagcatgccaccggtgacgcggttatcccgattgatgttgatctgcaggatcccatcgccgttatccatcaactggttgaacgctggcaagcgggtgccgatgtggttctggctaaacggaaagatcgcagcgccgatgggcatgtcaaacgtaaaacagccgagtggttttatcacttccacaaccaaatcagctcgccgaaaatagaggaaaacgttggcgattttcgtctgctgtcgcgcgagacggtagaacatataaaaagcctgccggaaaggaatctgttcatgaagggcattttatcctgggttggcggtaaaacagcgattgtggaatatgatcgggctgaacgcgtcacaggggtgtcgaaatttaatggctggaaattgtggaatctggcattagaaggattaaccagtttttccaccttccccttacgcatctggagttacatcggcggtagcgtcgcgttactctcctttctttatggattctggatgatcatcgataaactgctctggggcaatccggtggcgggttacccttcgttgctggtttccattctgtttttgggtggagtgcaacttatcggcatcgtttttgagcgtcatccctccgccatgtatctgatactggccgtcgctttactcatcggttatagcccggtttatttatcaacatacggattttccgacgactggttctatttatacgcatccactaccgatgcattcagtattttcaaatgggatatcttatcgggccgacctttttatggtgctatccgctacttcttcgctttcctgatcgatgacgtgcaggatttgacctggctccgtgcactctcattattaagcctgattttactgggcgggtacattatccgtttccttgagcgtcgcagcattttcgccagcgcggtccagcgtctgacgtttgccactctgctttccttatgtcctgtccgtactgctggcgggcatcagttattcaacgctggcggaaaacaaaggcctgggccggcgcagcgcggtgatcaagctgatgttgatgctgggatttggcatggtgatggcgctggtgctggcgaaagttctgccgctcgtgctgcacccgatttcaaaccgcgtaaagcttttctgttcctgtttttcctgctggcggcgggcattcctaatcttttggtgagtgaagactgggcagcctatcgcacggttatcgcgctgtcgttaatcaccacctcagccttcattgctggcttattcgtgatttttaataagctgaagataaccacgtctgccagtatcgtttgcctcgttattgcagtgctctcatgcatgctgaatattcagaagggcttttctacgcctcagcagcgcgagtatcagttgttaagcagcgcaatcacagagagcgtgcctgcagaatactctggccagctttattatcgtatcgatagcgacaacttacctgctgtcgcaaaatccaaaaaatacgatgagttcggttcgctttcgctgggtatgccatggacctttgccggtatggccgacgcgattaaaaaagagcacgcgatgaagttttccttgccaaaggcgcccgttatctacggcagcgatcaatgtccaggtgactgtctgacgctggatgccacccacgtgctggcaccg

SEQ ID NO: 89828 - DNA, 1635 bp, Glycine max
  Peptide Sequence Number=SeqID_206606
atggctatggcagttcgtaatacaacaaatccagaagaattacagatagtcatccataaagttgattcagttcaattcagaagtccttcatgtgatctagtacaaaatacaagggattacgtgaacaaatgtgctcccatttacaaccttgcaattaaaggggactggaaagaagctaaaaccatgttagccaaagatagaaggttggctactgctgctatttcacagggatgggccacactacttcatgtggctgcagaagctaatcacttgcactttgtagaagagctggtaaaacttttaagcgaaaaagacttagaaatacaagacctgaaaggcaacactgctttctgctttgctgctgcagttggaaatgttaaaattgctgaagcaatggcaagaaaaaataggagtttgccaactatcaggggtggggaaggactcaccccacttcacttggctgctttacagggaaaaggtgagatggcatggtatctctaccatgatactgttcacaacctcaaccacatgtttggtgatgcagattggagtttattgttcttcctttgtatcaacaccggcatttatgatttagctttaaagatgttacaagagaatccaagattagccgtggctcagaatgagaacaaggaaacgggattgcatgttttggcccgcaaaccttcggcctttagttgtcaaggtcgaaggtatccaaatcagctcatcaactcacgtaagaatccaactttggctctccaacttgtcaggtgtttctggaaaaatcttctttctcttgattgcacagagatacaaatgagaatagtcataagccagctgtctcaagtaatattcatagccgcagaagttggaaattttgagattatagccgagctggttagatcttaccctgatctaagttgggaagttgacgccaaaaatcgaagcatcattcacattgctgttttacaccgccatgcagccatatttaatctaatacatgaaataagaactattaagaattttgtagtagcatatgaagatgctgatcaaaacaatttactgcattgtgctgcaaaattagcaccaccgagccaacttaacttggtctccggagcagcttttcagatgatgcgagagttacggtggtttgaggtggtcaaaaaggtcatgccaccttgtttcatagagaagagaaactccaatgggaaaacacctcgtgaactgttcactgaagagcatacagagttactgactaaagccgagtgttggatgaagggcatggcaaaatcatgtatgattgtttcaacgctcattgctacagaagtgttcactgcagcattcagcattccacgcggtgatggcggtgatgacaacaacaatggcaacctcaactgcaattctatcttcataatatttgcaatatcagatgcaactgcactgatatcatcttcagtttctattctgattttcttgtctatgcttgtcatatcacgttatgcagaagatgacttcttcaagtcacttccaatgaagctaatatgtggattgacattgtctgctcagcctatttttgtaggtctgtatttcggccaagtaaacatgttctttactaggaaaactgaggccgtgtaa

SEQ ID NO: 89829 - DNA, 471 bp, Glycine max
  Peptide Sequence Number=SeqID_206607
atggaatatgtgcagttgctatcatggaagttgatgcggttttgtaccaaaggattcatttatccaccgtcttcttggatcaataaccctctggcatgtatgaatggtgaagtctgcttacatttgaagatctggtgctcatcatgtagatctggtggtggtgttggtgtttttggcgcggtggctgaaggagcgggtgtgtacggttcctttggcggtagcattgttgtcgtcgagcaacatggcagtgacgagggcgtagagcgccctcttggcgcggtggacctggtcgtcactgatatgggtttgtttaagggccgtgacggaaatctcgacgaggagttggagatccttaacagcgtcgtggccaagggtgtcgacattatagacctcgacgacacgattgagagagaagttcaaagatggagtgaggggagtccacaaagactagctagggtgcgagctgagtag

SEQ ID NO: 89830 - DNA, 738 bp, Glycine max
  Peptide Sequence Number=SeqID_206608
atggggtgcttgcttcggagaaaggcttccaaaattcaggtcactatcatcaaatctgttaaatggaagcattccatatgccttatcgttgttaactcaattgtcagacttggtgtcattgctcaaatcaaccatgcaattggagcggttggtgttgtgagcaaagaatgcaaggtagtggtagctcaatatggaaaaaccatattggataagctgataaatgaggttctctctgtgtctgccgttagggataatatcttggaggctgtcaaagttttaattgacggtgcttacgtaagcactgtccttgaaagcttgttgttttctaagacggtgtgtttttacccgtcgttgaaagttaacactttcaacgacgttagcttctacgacggtcgtcgaccgtctttgtatgtggcaatcgcttcattcacacctcatttgccacctatccttgaagagcccactatgacagctggtgttgatggattgacaagtgcaccaattcgtcccaacatagcaaaaacccttcaagctgaaaatgtttcgtattcagcttctttgatcactttgatcaaggccaaccaagttcatggtttgtctcacgaagatccttacactcaattggctaatgctgtggagatatgcaacacaatgaagatagctcaggcgaataacttgcgtacttgggaggaagttgtgttcaagttcttgaaaaaatattttcctcaaccaatttga

SEQ ID NO: 89831 - DNA, 204 bp, Glycine max
  Peptide Sequence Number=SeqID_206609
atgaagacattaaaggctagttccgctggtaaatttgatcaacctgcacctcactggattgaagtaaagagtcatactcaaatcagaggctataagtgtgactactatgccatgcattggatgtggaacatagtcagtggaggtttgaaaaatgaatggagcatggaaatttactttcacaagtttgaattgttaattgaatga

SEQ ID NO: 89832 - DNA, 315 bp, Glycine max
  Peptide Sequence Number=SeqID_206610
atgagaagagatagaagccctcatttgtactgtcttcgtgcgattcctttttctacctccacgaatattctatcgcaaatcccaatggtgaagaatttggttacgaatattttgtttaaatttcacgatgatccaacggtgaatgagtctaagatcgtcatttttctaagacagatttggtggcctgcaggaaaaatagagggttttgagagaagaagagagaaaaacgaaaatgaggaaaagatgaggcatcgtcagtctgaaactgacctaacatcgctatttatacttagggtacacacaacttattattaa

SEQ ID NO: 89833 - DNA, 2451 bp, Glycine max
  Peptide Sequence Number=SeqID_206611
acattacctcggatgagcgagcagttaacggatcaggttctcgttgagcgggttcagaaaggagatcaaaagtcatttaatttactggtgatccgataccagcataaagtggcgagcctggtttcacgttatgtcccgtcaggcgatgtgcctgatgtggttcaggaatctttcattaaagcgtatcgcgcactggagtcgttccggggtgatagcgccttttacacgtggctgtaccgcattgcggtcaacaccgcgaagaattatctggtggctcaggggcgccgaccgccgtccagcgatgtggacgcgattgacgcggaaaatttcgaaagtgcgggtgcgctaaaagaaatttcgaaccctgagaacttaatgttgtcagacgaactgaaacaaattgtttttcggacgattgaggcgttgcctgaagatctgcgtatggccatcaccctgcgggaactggatggtctgagttacgaagagatcgccgccatcatggattgtccggatgcagatctacaaaaaagctgggagagctaccatttgatccgcgacaccctgcggggcgatgtgggcgaagtgctgcattttgatatctccgcacgcgttgctgccgcgatcgaaaacgagccggtgcgcaaagtgacttcgttgatcccggaagcacagccggagccgtcgcgctggcagaaaatgccattctggcgtcgcggtggcggctgggttgctcaggtcacgcagatcggtgtggcggcctgtgtgtcgctggcggtgatcgtcggtgtgcagcactacaacagctcaccagcgggtagtgcgacagaaacgtcggatgcaccagcctttaataccttaccgatgatgggtaaagcgtcaccggtcagcctgggcgtgccgtctgatgcttttgacaccaacagctcaaatcagcaggtgcaggagcagcgtcgccgcgtgaatgccatgctgcaggattacgaactgcaacgccgtctgcatgccgatcaggtgcagtttgaaagcaatgcgccgcaacaggcgcaggctaacgttcccggaactcagtcgttaggaactcaacagcacctgctttggtcatctaccgccccggcgcagacatctgcgtccggggcgttgttacagcagatggagcaggccagccagaacctcaactacgaattcgcctatatcaatgtctcacgtctgggcattgaatccctgcgttaccgccatgcggtcatcgacaatcgtgtgttcgctcagctgttacagatggacggaccgcgccgtgaggtgatccagcgcggcaacgacatcagctatttcgaaccgggtctcgatccgttctcgctgccgggcaagcacattattgatgcgcttccggcgctgatgttcgctgacttctcgcgcctcggcgatgcctacgattttattccggtagggcgttcccgcatggccgatcagatgtgcgaagtagtgcgcatcgtgtcgcgtgacggcacgcgttacagctacgtggtgtggctggacgtcgataccaaattgccgctgcggattgatttgctggatcgcgacggtgagacgctggaacagttccgcgtcatcagttttgccgttgatgaaggcgtacgcaatctgatgcaggggctggaaaaagccaatctgccgccgtcgctgtcgttaccggcgggcgacaaagtgcaactcagctggcagccgggctggttgccggccggcatgaagctgatttcgcaaagccggcgtgatattccggcgatgaacaaaaccgtagaatcccgtctgtatagcgatggcctgttcagcttcgctattaacatcacgcctgccgataaaagcagttcgccccagtcattgcgcactgggcgtcgtacggtgcagaccgaagtgcgcgataatcgtgaaattaccgtggtgggcgaattgccgccgaccaccgccaaacgtatcgcggacagcatagattcagcgcgcaaaggctgcggcagccatgcgctcaaccagctgggaccgaaaaacgcccatgtgatgaccatcgccagtccggagccgctacagccgggccagcgcattgagctgggcattcgtgaaagcagcctgctcggttctgcgctgctggtgtatatgacgccactgtttggtctgttcctggtcgcgggcctgttccagatgctgttccacagcgacctggcggcggcctgcggtgcgctgctgggtggcgttggcggctttattgttgccaaaggggtttccagccggtttggcgatcgcgaagcgttccagccggtgattctcagcgttgcgctcccacctgatgcgctacggttccattctttaacgcgcggcgttaacagtgtaatatgcgtcgtcattaatgaggctgacagggttccgggtaaagctcacttgcctgaatgtgtctgtgctcac

SEQ ID NO: 89834 - DNA, 2124 bp, Glycine max
  Peptide Sequence Number=SeqID_206612
atggatacggtaaatgcaaacccagcagcaacatcgtcaccatcacaaacgcaggtggttgttcctatggcttctgcttatttttcaagcccttctgttgaattaacaacatcatcaccacaagcacatgtggttcagatggcttctcctcaacctcgacacccttcccgtcacatattggaagataaaaacagtggttgtactaatcacatgactagtaatgaagaactcattagagatttggacaagtcacaagtatccaaagttagaatgggcaatggtgattacattactatcaaagggaagggaattgttattatagagagtagcacaggtacaaaacaaatttctaatgttttgtatgcacctgacattgataagaatttactgagtgttaggcagctacttgagaagggattcaaaatcttctttgagaacaagcagtgcacaatcaaggatccgtatgacaatgaggtcataagaattaaaatgagaggcaagagtttctcacttgacccaatggcggaggagcaagcagcttatatggttgctatgaccaacacaaagacttggcataagaggccagcaaagcttcctttccaaaagggagcttggagagctaacatgaagctgcgactcattcatacagatgttgccggacctcataaaaatccttcactaaatgggagtgtgttctttaaattcaagaactggattgagaaccaaagtggttttaggattcaagttttgaggtcaaataacggcaaggaatacacctcaaatgaatttgataaattctgtgaggaggttggaattgagtatcaacttatagcactatacactccacagcaaaatggggtcaatgagtggaaaaatagaaccataatggagatggctagatgtctgcttcatgagaaggaacttcctagagaatattgggcggaggcatcaaatactgttgtatttttgttgaacagacttcccacaaaagcagttgatgggaagactccttttgagtcatggtatgactttaagccacaattaaaaaatctgaaagttttcgattgtttgtgttttacgaatgtaccacaggttaagcgagacaagttggacaaaagagcgaagcccgacatatttatcagcaacattgagcttattcaacaattcaaagaagacatgatgcgagtctttgagataactgatcttggagaaatgtcttatttcctcggaatagaaatcgaacagagacaaaatgaaatattcatttctcaacaaaagcatgcagaggagattctaaagaagtttcgcatgggtaactgtaagagtatgaggactcctatgtgtcaaaaagagaagttgtgcaaggatgatggagcaactaaagtggatgagttcgaatatagaactgcaaaaagagttctccgatatgtcaagggaactgtaagcttcggtgttaagtttttcttgacaccaagctttgagttacaagatgttcagaaagatggtacagttagattgaagtatcgcaaaattgaagatcaactggcagatatattcacaaagccttttgcaaaaagcagatttgaagatctaagagaaagacttgagatttgcacctaccgatccatgatgcaaggaggagtgtttgaatgggaatacttagagaaatgtatacccctttataagctagcactgagaggtgactggaatgcagccaggcgcatgatagatgcagacactagtctattaaacgctgctataacaaaggaatggggtacactacttcatgttgtggcaggaacagaccaagtacactttgtgaatcagctggtgaaattactgagcccagatgacttagaactgcaaaatttcaatggaaacaccgcgttttgctatgctgctgcatttggaagcttgcaaattgctgctatgatgatcaagaaaaatgcttgcctaccgaaaatccggggcggagaaggagccactcctctttacatggctgccttacaaggaaaaggtgacatggctaggcatctctatgatctgacttccgaaattttagaagaagacgagtggactacattgttcttcctttgcataaagaatggattgtatggtgagtga

SEQ ID NO: 89835 - DNA, 936 bp, Glycine max
  Peptide Sequence Number=SeqID_206613
atggcatcactgactagtccaattatcgtgacaggcatgaagacaacaccattcgtccaacttgttgagtgtctttggaacaagcttctccaacaagattacgatgaaacagagatgaggagtttcataaatctaccatcacaaataacatttgatgctacacaagttggaaattttcaatttgtagctacacttatgaggtctttccctgatttattatgggaaatggatgagaaaaaccgaagtataattcacattgctgttatacatcggcattcaagtatctatagtctaatacacgaactaggctccttcaaagatttcatatcgacttttgaagatgatgaaggaaacaatatattgcactatgctgctaagttgacacctcctgataaacttagcttaatttctggagcagctcttcaaatgacacatgaattacgatggttcgagacggaggtgaaagaattaatgttgctattagatgtagagaagaaaaatgtcaaaggcaaaactccccgtgaaatatttgctgaggagcacaaagaattattgataaaggcagagtcatggacaaagagcacatctattaattgcatgcttgtttctgcactcataaccgcaggagttttcactgctacatttatgatacctggtggcaacgataaaaaattaggaactcccaactttttgcacaaaccagcattcttggcattctcattatcagttgcatgtgcactggtatcagcctcagcctccatactaatgttcttgtctatctatattagctatgcagaggaagaatgtttcaagttgctccctaaaaagttactattaggaatggtggcacaaatcatttccatcataagcatgatggtggcttttagtgttgcattttacatgtcatattcccatggttcaaagtggacgtattaa

SEQ ID NO: 89836 - DNA, 182 bp, Glycine max
  Peptide Sequence Number=SeqID_206614
tttgggagataacggaagaaatccgcgatcaaagttggaaaatagcagaatcagggagcagaaaacgcatcggaagaaagataaaggaactctatatgcaactgatactttgtaaagggcttgtttcgtttgcatatccaagaggggaggtggagccaacagaattgagtgtagcagaagaa

SEQ ID NO: 89837 - DNA, 264 bp, Glycine max
  Peptide Sequence Number=SeqID_206615
atggctacaatttggtctctttggctccctaggaatgaagtaatcttcaaagggacaaccgtgacggatgatgtggttttagatcctggtcctggattcatgccaaggctactcattcacattattagttttttgaatgacatcgaatctgatgtcgtgccttcaagcctcatcgtgattggtttccagttgggaaataatttgctgggctatggtccttgggtgaggggttttgtactgaaaggctatttgcgtcatgtgtga

SEQ ID NO: 89838 - DNA, 210 bp, Glycine max
  Peptide Sequence Number=SeqID_206616
atggtgaggaactttaaactaccgcttctcaagctacaggaatttgggaacatagacctctgctttgccaatgagaatgacgcagctgaacttttaaggcaggacacgactaccccgaagagctggctgtcatgttgcaagaaaattgttgtcgtgccgagatgcataatgtgcattgcgactaccttgctctcatattattgtagttga

SEQ ID NO: 89839 - DNA, 204 bp, Glycine max
  Peptide Sequence Number=SeqID_206617
atgaaatttcgcggagctgttccatttctcattcctatgaagaggggtattataaattgtggcaatattaaggatgagggtgggggtcacaacccactctttgaggatttacctagtgagtgcggtagtggagccgccactgtcagatatgggctaatctccaatgatactcacgaagcaagatacaagtgcaaggccgtgtaa

SEQ ID NO: 89840 - DNA, 333 bp, Glycine max
  Peptide Sequence Number=SeqID_206618
atgtttgaagaaaatcctgacccaattgttggtggttctcatcatcttctgtgctatgggtgccgcaacctacccttcggcaggagggcgaattggggctcacgggtgcatcttccaatggaggaaggcgcacggagtcgccaccaacgtttattcaaggaaaacgtcagaaaaatcggatcatgtggtctacgaactttaagtgtgaaaggttcaggaattgtttttacgcacagggaagggatggtcgacaaaagcagggtttttgctcctacgtatcctcgatttgtgatgaggaactcagacctacgtagttcttacgaaaagcggtaa

SEQ ID NO: 89841 - DNA, 384 bp, Glycine max
  Peptide Sequence Number=SeqID_206619
atgagaggccgtgaaggaaaagagaggctacatagagataagactgagggtgcttacttgacttcgacctatcaaaacaaggaaaggaagaagactaaggatgttgtgcaagggtcttcgaaacaaaggaaacaaaagaaggttaagaaatttacctgctacttctacaagaagtcggggtacatgaagaaaaagtgtcccaagtatgccacttggcatgtaatgaaagttaatttggcttttgtaccaaaggatatttggtgggtggattgtggtgctactacttacataagtatgtctttacacatgattgccttgggagccgatcgccaagtgatgatgaaagattcatctttgtgggtgatgacaaaaaggttgcagtag

SEQ ID NO: 89842 - DNA, 618 bp, Glycine max
  Peptide Sequence Number=SeqID_206620
acagagcaagacccctcatcacgtgccccgcacgtgctcgattacgccaccactacatctgacgaggaggcggaacaggacgaggaggaggagctggtgccggaggaaaacggcttcgggaacggcgtacggtggtttccggcggcgagcggttgcggagggcgacggagcgggggaggtgcgttgggtagggttcttgacccgagggcgaagtgggtccaggaatggaacagggttttcctgctagtgtgcgccgcggggctgttcgtggaccctctcttcttctacgtgctctccgtcagcgactcgtgcatgtgcgtcttcgtggatgggtggctcgctgtcaccgtcacggtgctgcgctgcatgacggatgcgcttcacgtgtggaacatggttataaggagcaagatggcgaaacgcaccttcggattgggcgccgccaccgcttccggcagaggatcttcatcttccatcggactcagagacacccgaccgtgctccgtcgccatcggttatctcaagtcacggaccggattcttttttgacctgtttgttattcttcctctaccacagggactaacccaacattcaattcgtcgggggccgactatgtaa

SEQ ID NO: 89843 - DNA, 318 bp, Glycine max
  Peptide Sequence Number=SeqID_206621
atggccttaaccatcagggtattactggaaaatcgccttgcagcgcaggccgatccggcgttgacagccaaagccggacttagcctgctccttgaagatgaaaccagcaaagtgctgtttgataccggcccggacggcagttttcttaagaatgcgcagcggatggggattaaactggataacttgaccgcggcggtattatcacacggccattacgatcactgcggtggcgtcccctggctgccggaggggagccgaattatttgtcatccacagcttacccaaccgcgctatgccgctatcagccttggccggcac

SEQ ID NO: 89844 - DNA, 798 bp, Glycine max
  Peptide Sequence Number=SeqID_206622
atgaggttatctatggcagactggaatccctcgctgtatctgaaatttgctgatgagcgcacccgaccggcggctgagttaacggcgcgtattgcgcaacagccggtcaagctggctgtggatctgggctgcggtccaggcaacagcacggccttactgcgtgcagcgtggcctgaagcgcgaattattggcgttgataattccgccgccatgctggcacaggcggcgcaagcgcttcccgattgtgagtttatcaccgcaaatatagaagactggcagccatctgagcccgcagacgtgatctatgccaatgcctctttacaatggctcacagaccatcaaacgctgttcccgcgactggccggccagttaagcaatggcggcgttctggcggttcagatgccggataactggcaagagccctctcataccctgatgcgtcaggtcgctgaagagctgggatttccggaaagtggccgacagccgctcccccgcgtccagcagtattacgacatgctgagcaacagcggttgcgaggtggacatctggcgcaccacctattatcaccctctggaatcgcaccaggcgatcgttgactggctgcaggcgaccggtctgcgccctgtaacggaaaggtattgttattgttcccgcggctgtttattgtcgcgcgacgcctggttaacgcgtagtcgccagttcgacatcaacgttaagcgcattcagctgatttaccacactgccgctcagccggtcatcgctgatgatgacatcaagctcgctcagcggcaggatcag

SEQ ID NO: 89845 - DNA, 1620 bp, Glycine max
  Peptide Sequence Number=SeqID_206623
atgcaaacgaaggcgcatgcccaccaacttcgcactgaccttcgctccacctcccttgacggcaagacgatgcgtgagttcttatcgcagatcaagaacattgttgacaaactcacaggcgttgacaatccggtacctcatgaagaacacgtcgatgccattcttgaaggcctaccacatgattatgcaccagtgatctctgttattgaaagcaagttcgagactcctcctgttgttgaagttgaggctctccttcttgcacatgaatctcgagccaacagatttcataaacaatcattttctccctctatcaattacactaaagggtatgtgctccctaactcaaatgatactagcactcacaataattctagtggtggatatggccacaacggtggaggtcgtggcaacaatggtggtcgtcgtggcatcggtaatgggaagggtcgtggaactctacaacctatgcaaattaatccttctcaatccaacaacagaacttccaacacttgggtgaatcccaatttgaaaaactccaatcaggatattaatgtcaccttagctactcctagtgccatgcttgtcaatgtctcttctacaggtgctgcccattctgcatggatccctgactcagatgcatcatttcatgtcaccgatgagcctcagaacatccataagctaggtcactttgagggtccaaaccaaattttcattggaaactgtcaaggtttgcatattaatggttctggttcttcttcctttttgtctcctattaactcacatgtttgttttagactaaacaacttacttcatgtcccatctattaccaaaaatttgttaagtgtgagcaaatttgccaaggacaattatgttttctttgagtttcaccctcatcattgtcttgtcaaatctcaggggactcatgaaactttgcttctaggtgttgttggtgttgatgccctgtattcctttcccaacctaaagcttcaagagtcatctatgttgttgtcctctgcagctaaatcaccttcaagttctgctgatttgtcatctagatctagggttgtttttaattctagtgatcaacctagtttgtcctcaaataacagtctccataataatgaaaccagccctacatctgtgtcacagcctaaatttgattcctcatcccctagtgaatcccttgaacatggtgaacttgtttctagaactaccaatgctcatcctatgcaaaccaggtctaaatcagggatatatactcctcgaattcatcattcattatttttggctcatagtgaaccaaaaggtgttaaacaggctctcactgatccaaattggctttctgccatgcaacttgaatatgctgccttactaaagaatcacacctgggatttagttcccttgccctctaatagaagggcagtagggtgtgaatgggtttttcggatcaaagaaaatgcggatgggtccatcaacaagtacaaagctcggttagtggccaagggcattcaccaagtccatggttttgactttcatgagacgttttctcctgttgttaaacctatcactattaggcttatcattactcttacccttactaataattgggagttattttag

SEQ ID NO: 89846 - DNA, 3321 bp, Glycine max
  Peptide Sequence Number=SeqID_206624
atgtcagacaacaactctcctgaaacaaagtatgatgtttttgttagcttcaggggcaaggacatccgtgacgggtttcttagccatttgactgacacttttctaaggaagaaaataaatgtctttgtagatgagacaaatcttaaaaagggagatgaaatatggccatcacttgccgtagcaattgaagtatcatccatttcattgatcatattctcacaagactatgcttcttcgcgttggtgtttagaagaacttgtgaaaatactcgaatgcagagagaaatatggacgaattgtaatacctattttctaccacgtacaacccaaaaatgtacgacatcagttggggagttacgaaaatatatttgctcagcgtggaagaaaatacaagaccaaggtgcaaatctggaaagatgcgttgaacatatccgctgatttatctggagttgaatcatcaagatttcaaaatgatgctgagctgattcaagaaattgtcaatgttgtgctaaacaagttggcgaaaccatcagttaattcaaaaggaattgtgggaattgatgaagaaattgcaaatgtagaattattgataagcaaagagccaaaaaaaacccgtcttattggaatttggggtatgggcggtatcgggaagtcaaccctcgcagaaaaagtacttaataaattacggtctggattcgaaggctgttattttttagccaatgaaagagaacaatcaaacaggcatggattgatttctttgaaggaaaaaatattttctgaactattaggatatgatgtaaaaattgacactctgtattcgttgcctgaagatattgtcagaagaattagttgtatgaaggttcttcttattcttgatgatgtaaatgatttagatcaccttgaaaaattactaggaactcttgacaattttggctcagggagtagaataattgtcacaactagagatgagcaggtacttaaagccaacaaagttgatgagatttaccggcttagagaattcaatcatgataaagcactggaatttttcaacttgaatacctttaaccaaagtgatgatcaaagggagtatagtacactatcagaaaaggttgttgattatgcccgaggcattccattagttcttaaagttctagctcatcttctgcgagggagaaaaaaggaaatatgggaaagtgagctagacaagcttagaaggatgcctcctaccactgtttatgatgcaatgaagctgagttatgatgatctagatcgtaaagagcaacaactttttctagatctagcatgtttctttcttagatcacatataatagtaaacgtgagcaatgtaaaatctttattgaaagatggtgaaagtgataattcagtggttgttgggttggaaaggttgaaagataaagctcttataactatctccgaggataattgtatatctatgcatgattgtttacaagaaatggcctgggagattgttcgtcgcgaagaccctgaaagtcgtagttggttgtgggatccaaatgatgacatttatgaagcattggaaaatgacaagtgtactgaggccattagaagcatacgaattcacttgccaacatttaagaagcataagttatgccgtcacatatttgcaaagatgagaagactacagtttttggaaacttctggggaatatagatataatttcgattgcttcgatcaacatgatattcttgctgaaggacttcaatttttggcaactgaactaaaatttctttgttggtactattaccctctaaaattgttgccagagaatttttctcccgagaaacttgttatattgaatatgccagggggcagaattgaaaaactttggcatggagttaagaatttggtgaatttaaaacaacttgacctcggttggtcccagatgttaaaggagctgccagatttatcaaaagccagaaatcttgaagtactgcttctggggggttgttctatgttgagtagtgtgcatccgtctattttctctctgcccaaacttgagaaattagacctttggaattgccggtccctcaccagacttgcaagtgattgtcacttatgcagcctctgttatctcaaccttgattattgcaagaatcttacagaattctctctgatttcagagaatatgaaagaattgggattacgatttacaaaggtcaaagcacttccctcaacctttggatgtcaaagcaagcttaaatcgctacatctaaaaggaagtgccattgagagattacctgcatctatcaacaatcttacacaactgctacatctagaggtaagtcgttgcaggaagcttcaaacaatagcagagcttcccatgttccttgaaactctagatgtctatttttgcacttcacttcggactctacaagagcttccccctttccttaaaactctaaatgtcaaagattgcaaatcacttcagactctagcagagctacccctttcccttaaaactctaaatgtcaaagaatgcaaatcacttcagacactacccaagcttcccccgctccttgaaactctatatgtccgaaaatgcacatcacttcagactctgccagagcttccctgtttcgttaaaactttatatgccatatactgcacatcattgaagactgtattgttcccttcaactgctgttgaacaattaaaggaaaacaggacacgggttctgttcttgaattgcttgaagttggatgaacattctctagaggctattgggttgactgcgcaaattaatgtgatgaaatttgcaaaccagcacctatctacaccaaatcacgatcatgttgaaaattacaatgattacgattatggtgataatcatcattcttatcaagctgtatacctatatccaggaagcagtgttccagagtggatggagtacaagacaaccaaggattatataaatattgatctctcttctgcaccatattcccccctgctcagcttcattttctgcttcgtccttgataagtaccgggacacagcactgattgaaagattttatgttaacatcactgtaaatgatggtgagggtgaacgtaaaaaggacagtgtcagaatgcacataggttatttggattcaacaattgaatcaaatcatgtgtgtgtgatgtatgaccaaagatgttctcacttcctaaatagcagagccaaaaatcaaacaaggcttagaattgaggtttcaatgggggtacgaatcttctattatgaaacttataaaccactgcagcgggtgttgaaaggatttggggtcagtctaatcagcagctga

SEQ ID NO: 89847 - DNA, 371 bp, Glycine max
  misc_feature (9)..(9): n is a, c, g, or t
  Peptide Sequence Number=SeqID_206625
gggaaggantcgaggtagacaaacttcagcgatttgttgttaacccttcaattcctcaacgatatctcactgatgaagatcgcgttgcgaacaaagtgaatcccgcgtatgaggcttgggaagtccaagaccaaacgctcctcacatggcttcaatcaacattgtcgaaatcagttctctctcgagtcattggctcgattcactcgcatcaagtctgggataaaattcatgagtacttccatgtgcagaagaaggcgcgtgcccagtcatcatccaataagaacgtgacacgtgacagtcaacatcacttgttaacggtcaatgtcaaattgtggcttgggggactaacattgcacgattttagaaaatag

SEQ ID NO: 89848 - DNA, 594 bp, Glycine max
  Peptide Sequence Number=SeqID_206626
atggcagcaaccattcctttctctctgcttaggtgcgcaccctttttggctttcgtttcctctcaatcactcgcttctctcactttcgtgaactgcgcgccattgaaactagcaacacctttcgctcgcaaagcctccaactttaatcttcttctccctcttcaaccacgcaggttggtctctagtacctgtgctgtgaacaatgaagaggctgcagcaaaaacagcagctgttaattttgatagtgaagctccaacaatatttgataagatcataaataaggaaatcccttcgagcattgtatatgaggatgaaaaggttcttgcatttcgtgacattaatccacaggctccggttcatgtcctagtcattccaaaattaagagatggattaacacaacttgggaaggctgatagtaggcatggggaaatattgggtcaacttctgtatgctgccaaaattgtagctgagaaagaaggtattgatgatggattccgtgtcgtcatcaacaatggtcccagtgcctgtcaatctgtgtatcatctgcacttgcatgtattaggtggcagacagatgaattggccacctggttga

SEQ ID NO: 89849 - DNA, 276 bp, Glycine max
  Peptide Sequence Number=SeqID_206627
atgcgtcaagctagtgatgttaaagaagcacttactgggaggcaacccatcactggtgctaagcgtgccaacccccacccattggctgaaggggctaagcaagtcagttcgctaagtgcaacccagcatctcgctaagcgcttatcactctttgcctggaccctcatgtcaattgggctaagcgggtcatacccgctaagcccacatatctctctggaatggcattgtgctaagcgatcccatctcgctaagcgtaaccccactactgcatcttga

SEQ ID NO: 89850 - DNA, 234 bp, Glycine max
  Peptide Sequence Number=SeqID_206628
atggaggatttcatggcccaggtggcctggccaggagtccaaccttctcctttgggggaaggtgatgctcctacagcccaggagccgcagctagaggccgaggtagaggttgaggagacgtctgaagacacccctattgccacaccatctgaggcacttgaggagggagacggtgttgcagacgcagattatgcagtagatatggcagcagcacagagcacctggaatccctga

SEQ ID NO: 89851 - DNA, 399 bp, Glycine max
  Peptide Sequence Number=SeqID_206629
atgcaagtctcctcaatctgtttaccagctaaggttccagttcgcgtgaagtcactgcacacgaacccagcaaccgtaaacgaccccacttccacggccaaggtggctgctcctaagtgggcccagaagacaataactttgcctccccttaaacgtggttgtcatttaatcacttctaagaagatgattattgaagctacagggatagtgaaagaagttcggcaagaattgtctgaataccagtgtggcctggcccatctcttcttgcatcacacaagtgcttctcttaccatcaatgagaattatgactatgatgttcgggatgatacagaaaccttcctcaatgggatagttccagagggaccatctgcgccttggaagcatactctagagggttag

SEQ ID NO: 89852 - DNA, 574 bp, Glycine max
  Peptide Sequence Number=SeqID_206630
atggcttcaaatgcctataatggtactaaagataggaggattctaaagaagtcgactggtgtgcaccaagtggaagtcaattcatctagcatagatattggtcaaaagttagatgttctagccaagcatatgaagaccttgatgaaggaaaattcaaatgatgacacctactccccacccattagctcagggcacattgtcttctcaactgaagcaaatcctgaggaggatgtgaatgttgtgactacaagtagtatgagactcataactgagctgaagaagaaagagaaagtggacccgtcacttgagaaggaagctcttattgaagagagctcaagaaaagaaaaggggaagaaaaaagaggcaattgctcaaatgccaaagtacaacaaacatataaaaaagatcatttcaaacaaaggaaaattggcgaactttgtgacaattggccttaacaaagagtgctctgttgtgaatttaaaggagttggctcctaagcttatagatccagggagtttttcaatccctcgtgtcattggcaacttgtcctttgatagagcattgtgtgatttag

SEQ ID NO: 89853 - DNA, 369 bp, Glycine max
  Peptide Sequence Number=SeqID_206631
atggagagggcgaggttagtgtacgatttggtgaccaagatggacatggacgtgggctctttcatttcaggccagatttctcagatggcccagtccaactcctctcggcttggcttccctgccctcagcacaactttatgcatcgccagaggagttgtcccagactcgatgacctttgagtcccttagccttgccattaatttggcttatatccggaagaactgttggaacccagatgatcccttgatcacttttctggggacccgcaagactagggctaggggacctgacattctgctccatcctcctctactcctactgctccagctcttacactgcacctgcatcagcaccagttcctccgcttag

SEQ ID NO: 89854 - DNA, 147 bp, Glycine max
  Peptide Sequence Number=SeqID_206632
atgccggcacatattaaatcgtcgatgtttggttgtgcactcatgatacccatttcaaatggaaagcttaatatggggacatggcaggtaacagctaaatcaacgttttgcaatgatatcttggtcaagattaatactgataagtga

SEQ ID NO: 89855 - DNA, 354 bp, Glycine max
  Peptide Sequence Number=SeqID_206633
atgcatatattcatgggaggatccccagacctctatgcctccactagtaaatcttgcttcggcgatgattcaaggttagaggaagcgtgtgatgaggattcaacatcggtgatgaatgaagaggtgggggagttctacgtcatttacaatttgaaattcttttgtgcggtaggataccacactttctctggctccttcattctctcactattctctctcttgcaacagcttctcccgaaaacctctgctcttgttcagctgccaacggtggtttctggtgactgcatcggaaaggaagaagaaaaagaagctgatgatggcgctgccgatgctgcaggacacagtcgtggttga

SEQ ID NO: 89856 - DNA, 324 bp, Glycine max
  Peptide Sequence Number=SeqID_206634
atgtctattaccaaaaaaatcaagcaaaggaccttgggcaaagatgagtttgtcgttctactccaacggcacaatagaaggtttggtgccttgaagctccttctcaaagaagattcgagagcatattttatcttcaaaatggaagatgctaatagcattcctaactacttcgaaaccttagtccttcatatgaaaacatatgaagtaaagcaaatagccgtgagctactcatcatattccattaagagtgacaacaactgtacgcggtgtaggataatcccgatgctcacaaagccatataccctaagcaaaatggaaatttaa

SEQ ID NO: 89857 - DNA, 678 bp, Glycine max
  Peptide Sequence Number=SeqID_206635
atggcatccagggataatccaagtaccagagggtcgagtatgaacaaggctatcctctgctaccatgaaggcaagttgcgccaattggatcatatggactatgtggggccagtggagagtgcttggacaccatcgagatcttccttggtggacaagaagactaaggcgatggttgcacgagtgaaggccatgaaggttcaggtgagcaaaaccaaacaacttgttgtggaattggctaagagtaggggattagtgaggaaactggaagaggactctcgcttagcgtgttgggaaaccctagaagaggatcggtcaaatatgtgctcgcccagcgcaccgcaagctcgctcagcgagtcgtttgtctcttctcgcgctcagcgtgcccagctcgcaagtgaaagatattggcactagggttgaggggaatttggaaactacagaagacaaagttgcagatctgaagaagaggattgagaagctgaggagcaagttacaaaagaaagaggaagcgaagtgtgcagtgacggtcgagttggacgagactcaacgtcaggttaaggtgttgcttttgtctttcggccctggacaacttgatgtaaactttgatgtcgtggatggcgagatcatcagggagttacaactctgctccgagtctgagggggaggaggagaaggag

SEQ ID NO: 89858 - DNA, 513 bp, Glycine max
  Peptide Sequence Number=SeqID_206636
atgtacacaaagttggtctcgtcctttgacgccctcataaacacgtgctccttggtgctacaaggctccacgatcaacaactcgatgtcatccaaggccattatgttgatcttccttttcaactcctctatagactcgcgagtttggaatcgagtagggtacgagttgacttccacggaaacccacttgtaccaagggatggaagacataacacatgaagcaaagaacaaaggactaaagaaaaagggaacaagaccaaggagcatatctagcaagaagcgcaaggaaatcaagagcaagggatgcagaacgaagaacacttccattgtaggaaagcgagagcaaaggtacgtccctccgcttcaatgtagaagattggagattctgctaagaatgaggagaaccatacaactcgttaggagcttgtcggaactcagcaggagcatgagtatatctctacatgagattgagttgatgctccatatgattggttttatgtccacaagagattga

SEQ ID NO: 89859 - DNA, 1293 bp, Glycine max
  Peptide Sequence Number=SeqID_206637
atgaagtatattaggagcaacagcttgaagaggctcttttcgtttgggagacacgggtttggggaagaaaacgacgtggggttggtggtttttccttgtgaagagcaccctccaagaccctcttggaaatgcttctcttatgaagagttgtttgatgccaccaatggctttagctcagagaatgtgattggtaaaggagggtatgcggaggtttataagggaatattgaatggtggtgaggaagttgcggtgaagaggctcacaagaacttcaagggatgagagaaaggagaaggagtttctgttagagattggcacaattggtcacgtgcgtcattccaacgtgttgcctcttctggggtgttgcattgataatggactttacctcgtttttgagctatccaacgttggttctgttgcttctcttattcatgatgagcacttgcctcatttggattggaaaacaaggtataagatagctcttgggactgcacgtggccttcactacttgcacaaaggctgcaagaggaggatcattcatagggacatcaaggcctcaaacattttgttgacagcagattttgaaccgaagatatctgattttggactagcaaggtggcttccatctcagtggactcaccattcaatagctccaatagaagggacatttgggcatttagcacctgagtactacttgcatggagttgtggatgagaagactgatgtatttgcctttggcgtattcttgcttgaagtcatctctgggaggaaaccagtggatgggtctcaccaaagcttgcacagctgggctaaaccaatactaaacaaaggggagatagaaaagctggtagatccaaggcttggaggggcttatgatgtgacacagtttaatagagtagcctttgctgcctccctgtgcattcgggcatctgcaacttgcagacctaccatgagtgagttgtgccttggtgacttgttggtcatgggttcgaatccggaaacagcctctttgcatatgcaaggggcgagtcctggtgcagcggtaaagttgtgccttggtgatttgttggtcatgggttcgaatccggaaacagcctctttgcatatgcaaggcgaagagcctccgggcaatggggtattggaggtaatggaggagtgggagatggataaagggaagtgggaaatgccagaggaagaagagcaagaggaggaattatggggttttgaggatctagaatatgaatatgacagttccttttcaatgtcactacctgactctgtgggaagtacttag

SEQ ID NO: 89860 - DNA, 306 bp, Glycine max
  Peptide Sequence Number=SeqID_206638
atggcatgcaagaaaaagactttagactggctatctttagttgatgttcatagtgatgcatggttacttgttattgcattctattttggagccagatttgggtttgacaaagttgacaggaaatggattttcaacatgatcaatgaattgccaacaatatttaaagttgttactggttcaacaaataagcaagttaaggagaagtcttcagtttcaaaccacagtggtagcaagtctaaatccaactctaagcggtacaacattgatgttttcaaagagttttgtgaattggaaacctatgactga

SEQ ID NO: 89861 - DNA, 303 bp, Glycine max
  Peptide Sequence Number=SeqID_206639
atgagaaagggggtggaagaaagaaagggagtaaatgaaacccctaggagagggggttctatggtgttatcagaggttgaactcgaggtggagcccaagcggctctggtccctgcccttgctgaaagagacgctagagaaggagaaggaggtactggaggaggaggagttatcgtcatggatcgagcaggcggagatggttctggaggagaaggagaagcagatggaggcaaaggaagagaagatgaagcgaatctacgaggagaacaaggagctgaaatggcatgtggaggcgcaaacgtaa

SEQ ID NO: 89862 - DNA, 591 bp, Glycine max
  Peptide Sequence Number=SeqID_206640
atgacggatcgcggccgcagaacgtcacagattcgtgcgggagatctttctcctcggctcacagtgcactccaagaaagaaagtgcaatattgcactctatggacgacagtgcagaatcattgcgcgagcagcgcaagcgcgaaacctctcgcgccctcaccgaggccgcccgtcgactgaccgccgaacgggggttcgccggcttcaccatcgaggaactgtgcgcggacgcgggcgtctcccggcgcaccttcttcaactacttcgagagcaaggagaacgcggtcttcgggttcaccacgatcgactcccgccagcaggccctcgaggaggagttcgcctcgcagccgggagacctcctcgatgacttcgtccagctgacgatccgccgcttcgagctcttcaaccccgtcgaggacgcaccagccctgttcgccgtgatcgagcaggagccacggctgctcaaggccgcgttcgagcagatgagcaagaacgagcagcacgacaggggactgatcctgcgccgcatgcagggaaccgcggaggccgagctgcgcgccgaggtcatcgtccacaccgtcggcgcgctg

SEQ ID NO: 89863 - DNA, 444 bp, Glycine max
  Peptide Sequence Number=SeqID_206641
atggcgaatgtgaccggaggcgcccagcccaaggctcaggctcccgcagcaccgtcgggcacggctgcgggcaagaccacgatcgaggatgccgtggtggcgaagatcgccggcatcgccgctcgcgaggtcagcggggtctacgcgctcggcgggggcgccgcgcgcatggtgggggccattcgcgacgccctcaacaccaccgacctctcgcaggggatcaacgtcgaggtgggcgagaccgaggtcgccgtcgacgtcacgatcgtggccgagtacccggtcgcgctgcagcaggtggcggacgacgtgcgagccgcgatccaccgcgcgatggtggaactggtcgggatgcaggtcgccgaggtcaacgtgactgtcaacgacgtgcacatcccctcggaggacgacgcaagcgacgcccatgaggcgcgagtccagtga

SEQ ID NO: 89864 - DNA, 165 bp, Glycine max
  Peptide Sequence Number=SeqID_206642
atgaacaaagtaaggctatcatccttgttgttatggattccatctcttcaaccgggtttcccaactcgtttccgttcgaatttccagggacgtggccacccaacaatcccttggttacgactacgtcaatttcagcaactctcacgatgccgcgaaagcaattga

SEQ ID NO: 89865 - DNA, 1721 bp, Glycine max
  Peptide Sequence Number=SeqID_206643
tgtggcagcaacaggttcttgccacaattcgaggtttgaagctcagtaaatatcttcatgaagaacacgtttcaaagaaatttgagtccaaagaatatgaagaagctggtacgatcagtgaagcttttctcaattttgaacaacaggatcagttactcgttgcttggctccttgcatcaatgtcagcaccaatcctcacaaagatggtacaattgcgtatgattaagaaagataagtcaatttcggaatatttgcttacaatcaagaaaatcgtagattcactatctgtaattggttctgcgatttctgatgatgatcatatagaagcgattttagatggctttcctgaagattatgattcttttgttacttctattacatcgcgtttagatccagacactgttgactacattgaggcatttctattggctcaagaagagcattttgagaaacacaagaaagctgattcaaatttgattctggctaatactgtttctggacctagttatacttctggtagaggaagtggagataagtcaaattctaaaggagaatataacaatcgtggtggtcctcttcaagaaaatcatagtcagtatcagcgtgtctctcaatttgatcaagcattcatgtcaacactaacaactgttatggattcactctggtatccagatagaggagcaagccatcacatcagcaatgatgagagcaacttttctgttaagactgattacacagggaatgatcgagtaaaaattggtaatggttcagattcttcattcatagtcttggagctttggcattcaagacttgctcatgcctctcttaaagctgcacgtcagcttcctttctttacctctcaatctgtttacgctagtcctcttgatcttgttttcacagatatttggggtccagctccattaaattcttctaatggatcaagatattacataatatttgtttatgcattctctagatatacttggatgtatttgcttcaaaataaatctcaagcatttactgctttccttcaatttaaatctcttgttgaaaaacaacttggcacaactttaaaagctttacaatctgataatgcaaaagagtatttcacctttaccccttatcttactgaacaagggattcatcatagattgacttgtccgtatacacatgaacaaaatggtacacctgaaagaaagcatagacatttgatagaaactggtctcactctgttggcttcatcttctcttccttcaacttttggggagattctcagcacaagggttataaatgtctctcaccttctggcaaatgctacatttctagacatgccatctttcatgagtcagttttttccttataaacttcctggcagccctttagtttctgcctcttcccctccttcttccaattctacctcctctaatcctttactcgttttatttcctactgctcagaatttccaaaatgctaatgatacaactgatttattacctaacgcttctttacaatgtgatactactaattcttctgccgtagctgtttcatctcccattgtaggttctattcctcaaaatactcatcccatgacaactagagccaaagctggtgtttttaaaccaaaaacttatgcttcttacaaggaaggaagttatgattacacttttgagccacatactgtaaaggaatcaatggccaagcctgaatgctcaaagctatga

SEQ ID NO: 89866 - DNA, 225 bp, Glycine max
  Peptide Sequence Number=SeqID_206644
atgttagactctaaatctcagccaactcccatggtttctggtttaaagcttactgctgatggttcagaccctgatgatagaaagtctaccacgggttactgtgtatatcttggaccaaatcttgtatcatggtcttttaggaagcaaactgttgtttctcgaagtagcattgaggctgagtatagaggacttgctgttgtcgctgcagatattttatggctgtag

SEQ ID NO: 89867 - DNA, 381 bp, Glycine max
  Peptide Sequence Number=SeqID_206645
atggccaagggaggttgctcattatataccattctcttcctcttattcacattaggagctctgatggctatggtggttggtgacaggtgtaatgaagatttgggggtttgccatgccgaacatgcttgtaaggcaaagtgcactaaaattcatcgaggtggacaagggatttgtgagaacaatggttcggccaagaatcattgtttgtgttatcatgattgcgaaatatgtgaagtaggtttgaatggtttaggagactgcaatgagactcaatgcaattctgattgtgcaatcaagttcccaggcaaaggagcaactggatattgttttagcataccagagaccaactatattaattgttattgtaggtacaattgttag

SEQ ID NO: 89868 - DNA, 153 bp, Glycine max
  Peptide Sequence Number=SeqID_206646
ggaatagaagagaagactgccaagttgaaaggaagtgagaaggctctagttacacggcatgaacctagtcatgctgtagtaggtactgcagtagcaaaccttcttgctggacagccacatgttgaggctctggttatcagactcctggtttaa

SEQ ID NO: 89869 - DNA, 168 bp, Glycine max
  Peptide Sequence Number=SeqID_206647
atgaaaggctgcataataggcgcaaaaagcactggcaagttcaatagagaaaatctagacacgaaagatagcacacgcccgagaacgtgtactcgtccgattttgggagttaagcagccatctgggggcactccgtgtcgtgctcagtctacatcgagcacgaactaa

SEQ ID NO: 89870 - DNA, 201 bp, Glycine max
  Peptide Sequence Number=SeqID_206648
atgggatcaagtcaaatgccttcacttaaaaagaggttctatcaagttaaggtcaagagcctagggaccaccagtctaaaggagttagggcagttaatgggtcagctccaacggcaagcttttcgcgaagattacggtaaaatctgggacttagccatggtagaagtctctacatattgcctcccttgcccagtattatga

SEQ ID NO: 89871 - DNA, 372 bp, Glycine max
  Peptide Sequence Number=SeqID_206649
atggagaaagctttcccttctcaacctgacacttcacaccttcctttcttggctgacacatctggtcaagtctttatcacagcagttgtgtctcctgcaaaaccacctccaaagctcgatgatccgctttatctgatgacattgaccatcccagagcttttctcgaggccttatcaggttagatgggatgccactgtgttcggggtctttaatccagatttccccctctacataaagcacgaagacctctccgaaatcgcacacggtggtcaatgtctcagcatatcagtgttacagttgcatctcactgaaacatgtatgcgagcggggaattctgatatctatggattcctcgagccacagtccatttag

SEQ ID NO: 89872 - DNA, 486 bp, Glycine max
  Peptide Sequence Number=SeqID_206650
atggccctcaagcacaaagtgcaaagcttgattgacgcgggatggctaactttccaagaagatggcccgaatatgaacacgaacctactcgccaatcatggaggatcaaccgtgaatgcaatagaggcgggcgaattggaaaggcccaagcaaatgaaggacatagcaacctttaggaggtttatccttgaagccctcaaacctgtccttttcccttaccgaagcgacaaggcagtcccgtggaaatacgcccctcaaaagccaagcaaaaggaaggaggaggccaccagcattgacttactttctgctaaggttaccaacatcaccgacttaagtggtgtgacacgtagcggtcgcgtcttcgcagcacccaacccgtcggtgcgactcgcagatgtcaaaggaaaagtgaaggtggttgtggaggagaccagcgaagaaggcccctctttggagaaggatgttccggcaggcgttagtcgatga

SEQ ID NO: 89873 - DNA, 459 bp, Glycine max
  Peptide Sequence Number=SeqID_206651
atggatgccctacaatatattaaggaagtacaatgtgcatttcacgacagcagagaaaagtttgacaagtttatggatgccatgaaagattacaaatttcatagaattgatgttgggattgtcgtagaaaaaatggaggagattcttaaagacaatggggatttgattttgggattcaacaagtttttgccaaagggatatgaaatcttacttctagatgagggtaaggatgggtttggaaatgcttcgaaatatttgaagaagattcaggatcgatttgaaaacaaagatcatgtttataagtcatttctaaatatacttcttaagtacaaaaataatggagtcactctttatgatacataccatgaggctgctacactttttgagggtcattgtgatcttgttcgtgacttcactaaatttctaccatctgtacatctaagggggaaatctacttaa

SEQ ID NO: 89874 - DNA, 235 bp, Glycine max
  Peptide Sequence Number=SeqID_206652
gctttccaccttaagctcaagatcatcagtgacagagaatgagagtgatcatgctgatttctatgataattctctggcattagttcccgtgaccgtgacagctaaatcacaagccaccaataatcccaaaccaattatgagtgtccttgaagctctagatgcactgaggcatgccagagaaaggcttcaaagttcgatgagaacaaggcaaatgattcatgttggcccaatttaa

SEQ ID NO: 89875 - DNA, 726 bp, Glycine max
  Peptide Sequence Number=SeqID_206653
atgtcatgggtaaggtcagcggtgaacaaagcggtggaaggtgggcaaagcaatttcggacgtgccgttcgtacctacgccgactccgtcgtgctccatgcaagcaacgccgtcgccggcggtgccagaatcatccaagatcgcattgtggctcggaatatgcaaagttttaagcacactgtaaaacggttagaagaagtttctgtttcgtgtagagggatagagagagttcagttgctaagaagatggctagttgcacttagggaagttgagagacttactgttacctgcaatggaaccaaggctaaagatcaagacaacgagtttcttcatgatgaatccaaggattcacctacaccacaacccactttgatttactatgtagaccctgctgctccggatgaactgaaaaatttccgcgatgtctttctttccagtcaagctcttgagggcataacgatgtcaatgaggctgagctttatatttgctgatttatggaacttaaccgcaggttacctcttttgtgtgactcagattcttgatgcaccaaatgaggaagaagtttcactactttcagagatatatggactctgtattaaaggaggaaaggaagaacatactgccttgttatccagtgtacaggatttggcaaaagcattttctggatatgaagttgaagtgctgaatgtgtcaggggccaagaggagaggttcatgctccccctag

SEQ ID NO: 89876 - DNA, 690 bp, Glycine max
  Peptide Sequence Number=SeqID_206654
atggaaacattgcaaacagacccgaccacacttctagactatctactacgtgatggtttagttttcttcaaaggtcgcctcatgttaggttcttcctcagttttgatacccaccttgcttgctgaatttcacgaatcaattctaggaggacattctggcccattcttatcccctaaagtggtttgggaagatatttctatggatttcatcattgatttgccttgttctcacggacatttctgcgttgtttctcttctgaacaaccaacaaggtggtccttatggttatcatgggcagagttctgtagaatatgtggcctccgtgcttcttgaccgggatgaagctctccgacagttgaagtttcatttgcatagggcgcaacaatctatgaagaaagttgttgatgctcgtcatcaccaaagtggtgtggtgattgctaacttgccccctagcatggaggtgagagatttagacccccttactctagaggccattttggatactcgtgacaatcattgcaatggagctctttttcctgaatggctcatcctgtggaagtcccagccagtcgaagaagctacctgggagtccgctactgccattcagactaagtacccttctttctaccttaaggacaaggcaaattttagagagggtggtaatgatgggatccaacccaaggagaagtaa

SEQ ID NO: 89877 - DNA, 318 bp, Glycine max
  Peptide Sequence Number=SeqID_206655
atgatgactcatttggacaacgttgaatccaaactctccaacctcaaatcggttcttaaatcgcacaacttaatgttcaaggaacactccattcagctgaactccctcctcaccagcgtcaacgagctctcgaagaccgtttcctcactaagtaaggagatgagaaatggtttccaagacaacccgatacccccaaatcctatgtcatcttttgatgatgcttcacagccgttgtcgaaacaggtcgagcttccctctttcatcgacaaagatcctgtcgaatggctagtgaaggcgaaactctatttctctatttag

SEQ ID NO: 89878 - DNA, 108 bp, Glycine max
  Peptide Sequence Number=SeqID_206656
atggtcattctgcgtcttgtatcagccaagaggaacaagttcgacagtatcgggatgatgtgtcggaaggttcactggccgaaaggtgtttcgcttgaacgaaattag

SEQ ID NO: 89879 - DNA, 729 bp, Glycine max
  Peptide Sequence Number=SeqID_206657
atggtgaaagagggcataaaagtggatttgcttattttgggctacctcaacaatgtaaaggtactcaaaatcccccttatcgtgagcttattgagcgtagaactaagggactatgtttcaacgatgaaaagagtcttgcaagaggtagctattgataggggtgaacttactcatgtggatgggaatgagacctccaaggtaatggtgttagacaaatacctaatcccaaccattcatgagcttttggatgatctccatgactcccgattcttctcaaagattgacctcaaatcgggcttccaccaaatccagtcaacatggacccctctaaggtttaagttgttcttaaatggccacgaccccaaactacgaaggatgtcaggggattcttgggccttatgggctattaccattgattcatcagttggtgtctcgctaagcgaggcttgtgcgcttagcgagaatcacgcgctaagcgagacactcaacccgcttagcgagttgggagaatctagaggagaaattgagaagcatctacgcgctcagttcgtcatcagctcgctcagtgagacccttcgaggacagaaagccctttttaaggctgaagttggaaaaatcaagggggtgcctgaattgggacggagagagcagaacagaagcgcaaaacaaagcaaggacgccaaaaatctcagctttcaagaggatcttaggtttaggagtaatttctag

SEQ ID NO: 89880 - DNA, 189 bp, Glycine max
  Peptide Sequence Number=SeqID_206658
atggcaatggggcgggtcgggtatgggtattgtctccccaatcccttatcccgacttctcaacatatctccatgtccgtacccgatacgcgacgggtttgagtttattgtcccatccccgtacccgtcgggtacccgttggattttaagtggcggggcgggttcgggttcgaggtcgggacgggtctag

SEQ ID NO: 89881 - DNA, 234 bp, Glycine max
  Peptide Sequence Number=SeqID_206659
atgactaaagcacgtcaaaagaagggtacggaaaacagaagaacgacaaacaacgaacgaagaacgatgaagaacggtggaaaatcttcacgaaatcgcccacggaaacgtctcgaaagcgttagggaaaagagggaggtggttgccgcccagctcacccaagcgagctgggttgcttccaccagaaggcaccgccttctgttggaacatcctggaaggcccaagtgggcctga

SEQ ID NO: 89882 - DNA, 240 bp, Glycine max
  Peptide Sequence Number=SeqID_206660
atgaagcccgtagcgcaacatcgtttctggaatggttcaagggtgattctcaaagtgcactcgcttgaatttcatctttcccaaacttatcatgaaggatttctcaagttacaagcaaaagagtacgagaaggctcgcgagctcttagaatttgtccttaaagatcctcttatggctaatgctcaagttttggtggatagtagtgccaatgatggtcatctattgcaactcaaattttga

SEQ ID NO: 89883 - DNA, 275 bp, Glycine max
  Peptide Sequence Number=SeqID_206661
atgtcacgaaaccttacggattacggaatcgtcccctctttggcttccggaatgttacggaactttacggattgcgcattaacacttcctttcaactcccgaatgtcgcggaacttcacggattgcctaacgatgagtgtcaagtacctcgaagtgtcaagcgaaggtcgcatcccaccaaacagatggtccccggacgaaattagggttataggagtagttgtggctgatactcatgaaaatgcaaagattgcagcaagaagagttcatgttga

SEQ ID NO: 89884 - DNA, 504 bp, Glycine max
  Peptide Sequence Number=SeqID_206662
atgtggcaatggggtgtagatcgcatcacaaaaggtgcggataactataaggctcgcttgcctctagttgacaaaggtgcagatgatgacgttagtcactgcatgctaccggacccgttaattaggcaagctttggaaaatgttgtttttcaccttctcgctaagccaatatgttggcttaatgagcgtccgctaagcgcaacactgctaggctatgcgcgaggaagaatccaaaagacgatgagctatacaggttcgctgagcgcatcgctccaggtcatcaagcgcaccgcttcagctcatccgctaagcgagagaagtgcgctaagccaaaatccagtaatgtgcactaagcgaacgagcacgaacaaggccacctatttaagcctaaaattagattttgtgaatagagtttggactgggattcagagctttgcatgtctagggtttctagagagagaaaggtccaagttccagagagttttgagagattttgctgtgtga

SEQ ID NO: 89885 - DNA, 138 bp, Glycine max
  Peptide Sequence Number=SeqID_206663
gtagatgagcaatatgtgaataagttgatttataccagttcttcacaagtcaaagagggggcaatcacgtgcttcatagcagtagggtgcacaatggaggtctcctcgtttcagcaatggctaggggttcaccggtaa

SEQ ID NO: 89886 - DNA, 153 bp, Glycine max
  Peptide Sequence Number=SeqID_206664
atgtgggatcgacataggcttaaaggagcactcaaatcgggtgtatttacccccaaggtctacactctgaagagtccgtcagggactttccctcctgattcagacactactcatgaattatacaatacccacgacctcacactcgtgtcttaa

SEQ ID NO: 89887 - DNA, 1308 bp, Glycine max
  Peptide Sequence Number=SeqID_206665
atgggtaactcccatggacaccggcatcgcaaacacggtaactccgttcctcccaacacggttcctcctccccataaatacaatcctcacccaaccacctccaattccaccatgctttctcttccttacacccacgtcgacaccaccctccgctccctcgccgcccaagccgagggcttcggtcgcttcgctatcggcggcctccacggtccccttcaccccgtcacatctctcgcagatgatggaccggggtcactgcgtgacgcgtgtcgcagaaaagaacctttgtggattgtgttcgaagtttccggcaccattcaactctcctcgtacttgaacgtgtcgtctcacaagaccatcgatggtcgtggccagaggatcaaactcagcggaaaaggcttgcggctgaaggaatgcgagcacgtgataatttgcaatctggagttcgaaggaggcagagggcatgatgttgatgccattcagatcaaacctaattccaagcacatatggatcgatcgttgcacgctcagtgattttgatgatgggctcatagatatcacccgagaaagcacagacattactatttcaaggtgccacttctctcagcatgacaaagccatgctcattggggctgatcccacgcatgttggagataggtgcatgagggtgaccatacaccattgttttttcaatgggactcgacagaggcaacctcgtgttaggtttgcaaaagtgcatctgtacaataactatatcagaaactggggcatatatgctgtttgtgctagtgtggaatcccagatattctcgcaacataatatctatgaagcaggacagaagaaagtggcatttaagtaccttactgagaagatgttattactgttatctatgccacaatctcttcattacctgcttttagatatgcctgtgaaagtattgcatatagcaaagacaatcccatcattgagttcctacccttatcaaatttcggaattccttggccttgcacctgtacattttacactttcaactctggttcatctacatggggcattgttcaccagcattgtaacagttgcagcagacaaggaagtgggagcaactggtaccataaggtctgaaggagacatattcttaaatggtgctcaaaaagggttaatgactgaggatgttgggtgcaacatgtttcaccccagtgaacactatccctcttggacagtggaagcccctacagacgatctgaaacagattcttcatcactgcactggatggcaatctcttgctaagccagcagatcaaacactatga

SEQ ID NO: 89888 - DNA, 506 bp, Glycine max
  Peptide Sequence Number=SeqID_206666
atggcggatctcaaatccatcgctgactgcatgatttccaacggctacgcgaaggaatgtatcagcgtgtacacgacgatgagaaaatcgatcgttgacgaaggcatttatcgcctcaacgtggagcagttgagcgcttcgaaggttaacaagatgcactgggatgtgctcgagtttaaaatcaagagctggttggaggcggttaagatcgccgtgaggacgctcttcgcccgagagaggatcctctgcgatcacgtcttcggtgcgtcgcaatccatcagagaagcttgcttcgctgatgtttctagaagcggagcatctcttttgttcggattccccgaactcgtcgtgaagacgaagaaatcgccgccggagaagatcttccggatgattgacatgtacgcggcaatcgccacgctgtggctggagatcgaatcgatattctcgctcgattcaacaaccgctgttaaatctcaagcctacggtcttcttctccgactctcaga

SEQ ID NO: 89889 - DNA, 760 bp, Glycine max
  Peptide Sequence Number=SeqID_206667
atgtctgatgaatatccggttaaagcaatgcaagaagagctggaccagtttcagaagaacaatgtatggaaactggtagaactccccaaaggaaaatctgccattagagtaaagtgggtgtttagaaacaagttggacaaaataggtaatgttgtgaggaaccaggctaggcttgtagccaaagcacctccatctcctatccaccttgaccacttccaatatcaaggagcacctacctttgacccaaacctcaccacagatgatatttcaaggttgcactttccagggcctttcttttattcaatgaagactagacatggaattccaacctttggtggattggacatagcaccaatcgagattgaagttcttcccccaccaacattgaagcaacttcatcccaaggtgtccaagccttcatctactgtggtttcgataagggcatcattggatggaattcatatcagacccaccagtaccataaagttcatgccaaatcgcatcgctccaaggttgcctccattggaccttagaaagaagaaaggcaaggttcctcctcacagcaaacatatgcctcatccgggtctaaaggataatattgccttgcgtccaattccttacaattggagttggtacttcaccagggattctgctaagaaaaccattgctctgaagacaaatactaagtttgataaaaatgcgccatgctcttttattttaaagacatgtacgaaaactctcatcatgcttccacttcaaa

SEQ ID NO: 89890 - DNA, 604 bp, Glycine max
  Peptide Sequence Number=SeqID_206668
gtatggcgttttcagtggtcatcacacgggtaaatttcacggtgatctgctggatttgcaatacaaggatggtgatgttgatgcacatcacaaaactgtggaggagaaagggaaagaagttgatggttttgtggttgataatgaccatgttgtggatgattatgatgacttggaaggagttgcagagaaaaagttggttaaaatgaaaaaccatccttatacagaaaaaaacaaaaacaacgtggctggtgttgaatttcatggggacaatgatggagacgtgaatgaccaaggcaatactgatgataattactcaagtgaggagttgattagtgataatactgatagtggagaggaagacaaccctagaccaatatatgtgatgtatagaagtgaagacgtgaggaaggaattccaatttaaagctgatatggagttcaaatcattgaaagaatttaaggctgccattcaagaacactcagctctaaatggtaaggagcgagcaaggttggagagaaaatcacttacagagtcaagacttgttgaagtaagcacagatgtggcagagtatttcataacaaaaatgctaactctcattggatag

SEQ ID NO: 89891 - DNA, 258 bp, Glycine max
  Peptide Sequence Number=SeqID_206669
atgacaagtattattttagtggaaaaacacaggaacaacacaagggacagtagagaagctaaatttaggattcatctaatagttagaagtgcttgtgaaatggcacgtggcatttgtacactccgtcaactcgaaaaatggcagtggcatcaacatttgataaaacaaaacttcatcttctcctttatatccatgcaaccagatgcctttaacctctcaaaactatctcctttagctgttgtccagtgccacttgtga

SEQ ID NO: 89892 - DNA, 288 bp, Glycine max
  Peptide Sequence Number=SeqID_206670
atggaagaagatcagtggatgtatgaaggtataatgcttgaagaagttgatacggatgaaaatgaagaagaatgtggtgtgaatgaactacatgttgattgttcggatgcgttcaatacttctcaggtgtttgacaaccgagatgatgttttgcagtgggctcgattcattgcttatgaaaatagatttgtgacgatgatggaattgtgggtgtcccttcaagcttcatggcaagccaatggttggaggataaggctggatggtaaagttgatttgtgggattcataa

SEQ ID NO: 89893 - DNA, 522 bp, Glycine max
  Peptide Sequence Number=SeqID_206671
atgatgaggatcctcagcttgatgacattgtcaactctgatagtgaagaggatctcaagaaaactaatcaagctcatttagttgattttgttctggaaaccacttcagctggtgatctacaagacaactttgtttgtaaggaggtcaagacattattggacgaaaaggtatccagtggacgaaaaattcttcttaaggattatcgagacttggaagaaagggaactaccacccgagattgaaaaacaatacaaggagataggaaccttgagagataacctaggaaaatttgttggaggtgatgaagctcttcataaaattattaaggtgcaaagaaaccccaaggacaaatttagccatggtttcaaaggcaaaaaagggctccataatgtaggtagggtgtcgcaacctacccttcggcggaagggcgatgcgagactcatgggtgcgtcttccaagaaaggaaaatacgcggagtcgccaccaatatttattctaggaaaatgtcggaaaaaccgtaaag

SEQ ID NO: 89894 - DNA, 333 bp, Glycine max
  Peptide Sequence Number=SeqID_206672
atgatcgaggataaggtgtacgagttgaggaataagacgaaggcggagctactgaaccagctcaaggatctcaaggcggagctagccctgctccgcgtcgccaaggttaccggcggcgccccaaacaagctctccaaaattaaggtggtgaggctatcgatagcgcaggttttgacggttatttcccagaagcagaaagcggcgctgagagaggcttacaagaagaagaagtatttgccccttgacctccgtcccaagaagacccgcgccattcgcagacgccttaccaaacaccagatagataaacaactgacacgagttgttccaatttaa

SEQ ID NO: 89895 - DNA, 2205 bp, Glycine max
  Peptide Sequence Number=SeqID_206673
atggttctccactaccttttcaccaccaggctctctttgtttttcagaacccaattgcccaacaaaccaatgctgacaagaacacaacaattccattcaaaagcagcactccaaaacaatagaggattttgcttccatgactgtgtctccctctttcagcacctgagggacctcaaagacctcaactttggcaaaactcttcactctcttttcgttaaaactgccctcgacaaggatgtcattgtacaaaacaatatgattagattttatggagacattggacaagttcagaatgcacataaattgtttgatgaaattcctcaaccgagtttggtttcttggaccagcttagtctcttgttatgtccacgtggggaaacatgaaataggtttgagtttgtttcgtggcttgtgtcaatccgggatgtgccccaacgagtttggtttttttgtggcactcagggcttgcagggtcatgtgtgatcctgtgatggggaaggtcattcatgggttgatactcaaaagtggttttgatttgcatagtttttgcagtgcttcgattcttctcatgtatgctgaatgtggtgatattgagaattccaggaaggtttttgatggggtttgtcttggtgaaaggtctgttcatgaccagactgggattgaaaatgatgctgttgtgggtggggctattattgactgctatgttaaactgcaattattagaagatgctcgtaaagtgtttcaaattcttggcgagaaggataatgtggcaatgtgtgctttacttgctgggtttaatcagattggaaaatctaaggaaggacttgcattatatgttgattttctttgtgaaggtaataaactggatccatttacttctgcgagggttgtcagtttgtgctcaaatttggagactgagctttctggtactcaaattcactgtggtgtcatcaaacttggcttcaagatggattcatatcttggcagtgcctttatcaacatgtatggaaattttgggatgatatctgatgcttataaatgttttcttgacgtttgcaataagaatgaaatatgtggaaatgccatgatgaacactttaattttcaattcaaatgatttgaaagctttagagctgttttgtaggatgagggaagttggtattgcacaaagcagttcttcaatcagttatgctctgcgggcttgtgggaacctttttatgcttaaagaaggaagatcttttcattcttacgtgattaaaaatcctttggaagatgactgtagattgggtgtagaaaatgctcttcttgagatgtatgttagatgtagagctattgatgatgcaaaattgattttcaaaagaatgctgatacgaaatgagttttcctggactactatcatatctggatgtggtgaatcagggcactttgtagaagcactggggatcttctgcgatatgcttcaatattcaaaacccagtcaattcactttaattagtgttattcaggcttgtgcagaaataaaggcacttgatgtaggaaaacaagcccaaacttatatcatcaaagtaggatttgaatatcatccgtttgttggaagtgccctgattaacatgtatgcagtatttaaacatgaaactctgaatgctttacatgtcttcttgtccatgaaagagaaagatcttgtctcttggagtgtcatgttaacagcatgggtccaaaatggttatcataaagaagtacttaagcattttgcagaattccaaactgttcccatttttcaggttgatgagtctatcttatccagctgtatttcagctgcttctggcttagcagcattggacataggcaaatgtttccattcctgggttatcaaagttggccttgaggttgatcttcatgtggcttcttccattacagacatgtatagtaaatgtggaaacattagagatgcctgcaaagaagctattgacctgtttaacaaagctaaagaagctggattagaacctgatggtgtcaccttcacaggggttttagctgcatgtagccatgctggactggtggaagaaggttgcgaatattttcggtacatgagaaatgaatacaacagtgaagtaactataaaccattatgcctgcatggtcgatattctcggtcaagcagcaaagttggaagaagcagaggctttgataaaggaagctccattctag

SEQ ID NO: 89896 - DNA, 209 bp, Glycine max
  Peptide Sequence Number=SeqID_206674
atgggtaaccaattagtctcactacgcccctcagaagccacgggcaaaattattacgtgggatggttcggtgcacgaaattgagcaatctttgacagtggcagagctgatgctggagcacccagagcaagtggtggttgagttgcactcagcggtgaataataaaaggccaacgccattgccagcggataacaagttagagagaataag

SEQ ID NO: 89897 - DNA, 267 bp, Glycine max
  Peptide Sequence Number=SeqID_206675
atggagacccttttgatcatcagctcaaatccttcccaaaaactcctttacaaagagctagctaacatcattgaaaagctgtcgaggcacatgacaaaagcttcattggatcattttttcctttcaaaccgcaaaaatttagtctcgcacggaaggaatcgtagattgaagaatttcgttgagcctacacgagaaagaagttcttactgccacttcaagggctttgagtatatgattcataaacaaaagaatttgagtacaagttag

SEQ ID NO: 89898 - DNA, 246 bp, Glycine max
  Peptide Sequence Number=SeqID_206676
atgacacaaatgggactcccttctccatcatctgctggacgatttggaaagcaagcaagtcacaaatcttccagcaaaaatctcttcctgattggcttccaaggaacaacatccaggaaaggctcgtcaactgaacactgtgaacatgggaacactcatccaaatgcagctgttatcacaaagatccattctcttcacgtgaatctctcgcatactctccgcgaaggaaacaaatgtgtgtactag

SEQ ID NO: 89899 - DNA, 831 bp, Glycine max
  Peptide Sequence Number=SeqID_206677
atgaaacgcatagacatcttctgtgcttctcaagcctcaacagccatatgtctgagcatggatcaagcctcatgctcctcttccaacaccattctactcggaggccgaaccattgatcgccacaatcccattatcaatgactcaagaaggagcacttccaaatccctcactgccccatgttcctcttctcagtcccccatcaaccccaagccttaccatgagctccacaaggccaagaaaaactcttcttcaaaaaatgcaacaaagggtcatgataatcagaagaagagaagtacagcagaaaaactcactgaacatgtcaccaacacttctaaaccaattgatgacattgttcctaggagttggcttaagccacctgctgatttaatcactcctcctggttcaactagatctttgctcagtgacactgccttattggatggttcatcagattatgatccagttttggctttaactactatgattaacaacaaaacttctcaagctgttcatcaagatgaagccaatcctgtttccaaactttctagctcttctcatccaaaatctggttcctcagaccaggttgtagtattgagggtatctttgcattgcaaaggctgtgaagggaaggttaggaaacacctctccagaatgcaaggagttacttctttcaacatagattttgcgtcgaagaaggtgacagtggttggggatgtgactccattgagtgtcttggctagcatatcaaaggtgaaaaatgcacagttatggccagcatctgcctcagcagtggaatctggtacggttgaaacagagaagaaatatatctaa

SEQ ID NO: 89900 - DNA, 387 bp, Glycine max
  Peptide Sequence Number=SeqID_206678
atgactggagagcttttttcatacttcctatgcagatgtttggtctttgttgaacggtctgtgtcaagtttaaagacagacaagaacaaaggcagaagtaatcttgaatccctgttttgttatgataaggctattccagaagaaataattgagaaacctgttgggttatctttggaagagaaagctattggtaacaattcccgatgcactgattgccaggccaaaggtgctgtgctttgtgccacttgtgctggttctggtctatatgttgactccataatggaaagccagggcataattgttaaagttcgttgcttaggttgcgggggaacaggaaatataatgtgtgcagaatgtggcggacgaggtcatctgggaccaaaatga

SEQ ID NO: 89901 - DNA, 348 bp, Glycine max
  Peptide Sequence Number=SeqID_206679
atggcatggattttgaactggccgtcgccgcggggcaaagaacaaattttgacgtcgctatttgcacagaaactgaatccatcggtgcccaataatgaacatgcacacctcaatttgttcacgcaacagaacagcaccactacctcgtacaaatcgcttgttcattcacaccaacaacaactggggtctcgttctcgtagttcacgacgtgggtccacgggtcctggatcaaccgaattctacatccgaactggaattcgggttcagtatatggactttattaggcccatttattcgataaataatattgggcttgggagcccaatcaccaagaaaagcatgaaatga

SEQ ID NO: 89902 - DNA, 1332 bp, Glycine max
  Peptide Sequence Number=SeqID_206680
atggccatgttgaacaactctgataccaccacaccacctcagatcatccaaatcccaccacaagctccacagcaaaggcttccattcacagtgcccatcaaggcacaagtttcaagctttcctaacacaacaactgtggcgggtcaaacagcaagaagggtcttcaagattctcttctacttgcatttgttcctagttgcagccttggtgactcttcttaccatatatggtcttgtttctgattctcacacccaccatttccaccccaagaaatggtaccctcaacttcttgcatcagcagcatgtgctggaattgttggtttcacatggcaatggatcactgcacgccattccacaagggtggttaggttggtattttggttgagtccccttctaatatgtgcaatgggaatcatgtttgtgtgcattggcactgcagtgagtctggcagtcggtgtgattgctttggtttgtgcattagttcaatccctctatttttgttgggtcaatcctagatttgaatatgccaccagaatcttgtcagtttcaatagcttttcctccaaacagaacccaggggctaaccctttattcaattctcattggaaccctttattgttgttttctggtggctggaattggagggggaagagctattgaaaacagaaccaaactagcagcctttttcatcttcttgatcctgttgagcctaggatggactatgcagtttctgaagaatgcaatgtatgtcactatttcaagggtcaagtatatgaattttgcaggaggagttgacatggacactagagttgcattttgtgacacaatcaagcacttaactggaagtgtttccatgggctccatcctcgttcctgtcatcgtgctcttccgaggttttgcgcgaaccacgagcctggttggaggagacacagatgagttcatgttttcctgtgttagttgctatatgggggttgcatcttttcttgtggtccgtgggaaccggtggggttttgtgcatgttggagtttataacaaagggtttgtgcaggcatctactgatacttgggaaatgttcattagagttggattggagcaactcattgacttggatctcacaggggcattctgtttccttagtggtgttggaacaggtgcaatatgtagtctatgtcggttggctattgcatgggtacaagcatgtgtttcagcttactatgttgcctacgcagaaaatccacagagcactcaatttgactccactattccagtacgcttggagcagcttaatagatctcaagctttgcaaatattcagaggtaacaatttgagctga

SEQ ID NO: 89903 - DNA, 435 bp, Glycine max
  Peptide Sequence Number=SeqID_206681
atggggaagaggaagctggagctaggttttgaagatcagaaaattgattttgatttgtttgttgaagacaagcctgctccagaacacaatgtttgcttacaggtaatggaaggaggctggcctgaagctcaacttcctttggtgagacccaacgaggctgctcctcctgagcccgcacctgtgcaggtcaatccagagccaactaacccacaatctccagtggtgaatccacattcttctcttgagcttgaagcggttccctcgtctcctccttttattgtcatctctgatgtatcatcagatgaagcggttgcccctcctgattcaccagctgcagaagcagctgacccccctgcttccccaattggaggaattgctgatctttctgattcatcatctggagaagttgttgctctcattgattccccagtttaa

SEQ ID NO: 89904 - DNA, 372 bp, Glycine max
  Peptide Sequence Number=SeqID_206682
atgacatctacaattgttcatcttctttggaaacaacatcttcatatatctggagaagtaatgccctctccagttcccatagttaaacctttgttggttcaagttgagttttcagatgttgcaaagctcaggaaagttaaaatcgatgatgttttagtgactattttggttgaaaggtggagacctgagtcatatgcatttcatctttttgttggtgaatgcacaatcaccttggaagatgttactcttcaactaggtttacatgttgatggtagaccagttactggcccaacatattatgattgggaacaaatgtgtgcaaaatatataggtgttgttcctctagagaacactagtggaatcaacacttaa

SEQ ID NO: 89905 - DNA, 549 bp, Glycine max
  Peptide Sequence Number=SeqID_206683
atggatttttggaggaagaataaccttcgtgctcatttgatggaggttgatgaggagaggagatctttgtttgttgttaggctgaatatcatatggttagctccaaaaaagcttgtgtttaggaatgaagatttcgatgtggacaatattgcctacaccatcaaggcccagggatcatctagtagtgtccttttgtcagagctttggggcattctctttgtagctcaggtagcttggaatgctaatattagtcatctctggattgaacgtgactctaaattggcagtccaatttgtttcagaaggagtcaatagagagcatccttttaaggctatggtggaccttattcgtggttggttgggaaaggagtggcatgtgaaggtgtctcaagtctaccaggaacaaaatgttgttgcggactatatggaaaatgtttttcatggtgttgcttatggtttacatttgttatctcaccctcttgcgggtactgatgtttttcttatttgtgatgctataggtctttccatgactcgtagcattcgtgtgtag

SEQ ID NO: 89906 - DNA, 673 bp, Glycine max
  Peptide Sequence Number=SeqID_206684
ggatattcccatcaccatacctaaagctgaatggacagatggcgacctagccattatgaagactgaggaaagtcgcgactctgacagacactacaaaagcttcatgatgaaggatgaagagtttgtggacaacgtgttggacaactttcccatggtgtgggaacccaagaccataaccatccaagaagcaaaagatttgaaaaatcttgcatgggatgagttgttagtgcagatgaaggaatctgatggattagacaactatgatggatccacggatgatgaagtggctctcatgcccaaaaagttcaagcaaattaagaaaaagaaggaaaattttcaacattcctccagacgtgaagattttagattcaagaagaagaacaaagaggaaaacaatgagatcatctgctttaagtgcagaaagcctggacacatgaaggatgacttggacaacgagaagagtaacagttcagacaacaaacaagccaaaatttgtcttatggcaaacacagatgataaggtttatgtaaaaacctcctctaagtctgatacttcttcttctgcttcatcaaatgatgaagaggatatgccctatgatgatcatgcgcttctcaagtttaattcaagacaagaagccaagaaattcaagatatatgatcaagataatctctag

SEQ ID NO: 89907 - DNA, 1038 bp, Glycine max
  Peptide Sequence Number=SeqID_206685
atggtgctgttggactcaacagcatccttggaggccacacatctcatctatggaggggacagaatgaatgaaaggcaataccaatactcaacattctctgatgaggaatcactagaggctagcatacctttgttaggctatgttgatgaagagaaacaaagtttggcagagatagtggtggtggttgatgacaaggaccaaaaccaaaagcaagatagtgctatttttttgggtaacaattcattgtttgattgtatttacatgggaaaaatcctgcaagtgctagaactacctcttggcttaccaagaaggctaacaatcccagtggtgagtgaggagaaatggtcaaagccatatgcagtaatttcagtcacattggcaccggttttgttggcaattcttttcaacacacaaagtgaaaacgtgggttcaaggagtggtcttgttacatacatagtagctgcattgattgggatagttttgggcaacatggcatgcgtgacaactgagaggtgcaccccaccaagaaagtccttgttcccttggcttgctggtggctttgccatgagtgtaacatggacttacataattgctgaggagcttgtttctctcttggtctcaattgggagcatcattggggttagcccttcaattctaggactaactgtcctagcttggggcaactcgcttggtgacttgattgccaatggtgccatggccatgaatggtgggcctgatggggtccaaatggccatttctggctgctatgctggcccaatgtttaacaccttgatgggattgggcttaccccttgttctctcagcttggtctgagcatccagacccttatgtcactcctaaggacacttcactctatgagacccttttgttcttgatgggaggggtgctttgggcacttgtgattttgcctaagaagaatatgaggcttgataaatccttgggggcaggcctattgagtgtgtacctttgctttttggtcataaggatagccatggctgttggaattgtgaaattttag

SEQ ID NO: 89908 - DNA, 273 bp, Glycine max
  Peptide Sequence Number=SeqID_206686
atggaatcagaccagtgttttgaaacacttgatagcaatcaaatgcttccccatcaaagaattctaggtcaagatatttgggatcaagaatttgacgagattgaaagagagaggagtactagatacgctgttcatcagatgaaaatagtgtatacgatgacaaggagggtggaattggtgtcggggatgctccggtggctccgggatgagattttgatcggctggaatgaaagagaatcgaaaatgatgaaaaatgggctttgtgggaggtga

SEQ ID NO: 89909 - DNA, 1107 bp, Glycine max
  Peptide Sequence Number=SeqID_206687
atggtgccaaaggatgctcacagacgtgagaggagaagatctggtcacaagaagtctaggtctttgcattcatcaattcagaataagatgaaaatcagtctcaaagattcacccaagcttgaggttctagctagtgaatcttcatctgagattgtaagacatgcagttgctgatgttgataacgatgtgacaaatggaagtaaagtttggtctgaaccttctactaaggtgcttcctgaatcatcttctcaccttttgataaaagacaacagtagtgcagacctagacaattcaaaacagcaggatctatcagcttgttcatcttgtggaagttcagtcctccctgaacctcccgttcctgttcctggacttgaagcttcttgctgtaaagatgctgatcagcccagtcctgtctcagtcctggagccttcgtttacagatgatgcgtcatcttgttctgataattttgaaagtctgaataatgacctacaagggctgcgaatgcaactccagttgctgaagttggaatctgatgaatatgtggaggggcccatgatagtaagtgatgaagatggtggggaaggatctactggaatgttagaggacaaaggattgcgtaggactgaagatagctgggagtgttcctacattattgatgtcttgtctgaatctggcattgatggagctcagccagatacaatttcggaactttggcattccctagaatgccctgtgagtctatctgtttttgatgagcttgaaaagaggtatggtgattggactacttgctcaaggtctcaaaggagattgctttttgaccgtattaatttgggaattgtcaagatcaatgagcaatgcactcatgcactaccatgggtgggtccagtgaccaaaaatgttattggttctaatttgatcgagaatgggttccgagatggccttctgaggatgttagtgagcgacggaaaagtgaaggatgatgctctggggaaggtgctagttatggaatcagagtggttggacttgagagatgacattgatgtcataggcagggaagttgagagattgttgttagatgatttagtggcagagataatcggtgcttag

SEQ ID NO: 89910 - DNA, 1519 bp, Glycine max
  Peptide Sequence Number=SeqID_206688
atggacaaatcccgccacagcaagtccaacgcagcaccctcctccacccaccaacctcaaccacctcttcctcaagggaacaaagaggttcatagacagcgacaacctctgaatctatctcctgatcctggttcatccagtggtggggttgcatacaaggattcattctcatctaaatttgggtggagatcttccaaacagctgtttggaactccgattaagaagttattagctgaagagatgtcaccgaaagctgaatccaaaagaagatcacctggtgttattgccagattgatggggcttgatgggctgccgttccagcagcctattaataagcagcataaggctttgtcagaaaaccaacagaagacagcacaattagagagaacacgcggcaaaggagtgccatatgatggtcaatcgtctaggagaagctcaaaggatcaccaagaatttaaggatgtatttgaggtctcagagattccaaaggtagagagccataggtatccatcacaggggtgtgcagacttgatgaccactgatgccgaaatctcattcattgaacagaagttcatggatgccaaacgacttgcaactcatcaagacttacagtcttcaaaggatttctgtgacacacttgaggttttggactctaacaaggatcttctgctaaaatactttaagcgtccagattctttgtttaaaaagcatctaaatgatcttcaagctgctcctgtccaatcacattatggttatgtaaaacctatggatattgagaagtatgaacatgacttcaatttgaggtcagattgggagaaaacacggtcaaactacaatagatcatctcatgagaagcatcatgatggttatccttgtcattttgacaaaagacatgtgatgcatagttcaccaaaatcatcaaagcttcaatttaaggctaaatatgaacaaaaggcagtcacctcacagattgtccttctgaaacctaatcttggaaaagtgcagaatggtaccagaattgtgtcatcaccttgttcttcacataattttctggcagggtgtgaaaatgacactgaactgtgccaagcgacaaatttgcctgaaagtgccaggtcttggaggcaagattcttttgaatctagagaaattgcaaaggaagtcactaggcaaatgaaaattagtcttaacaatggaagcatgaagctttccacctctagaattagaggttatgctggggatgatagttcgtgtagtgtttctgggaatgaatctcctgaggagtctgaggaaacaactgcaactttggggaattcgattgacttaaacaaccgcagcaggcgatcatcccgttctagtgaatcttctgtcagtagagaggcaaagaagagactatcagagaggtggaaaatgacacacaagtctcaagagctgcaaggcatcagcaggagcagtacgctggctgaaatgcttgccatccctgacatgaaattgaaggcttctaattcggacagcatggcta

SEQ ID NO: 89911 - DNA, 204 bp, Glycine max
  Peptide Sequence Number=SeqID_206689
atggagatccctgaagtgaaagagattcagtatttagcagctagagatggagatggaatagaaagtgagcgttgcggttgtggggatggttacacacactctgcgcgggcaagtgggggtggcgtgatgcgtgtgagagttcagttgagtccaccttcctcgcacgtgtcacggacattggataccaccttcgtctccttataa

SEQ ID NO: 89912 - DNA, 459 bp, Glycine max
  Peptide Sequence Number=SeqID_206690
atggtgcaaagcaggatacaattcttacattcctcttcctgtttcttcttttgtttacttgttttcatttgtggtgaatctctgccctttttatttttgcaatctattctgggattatcagtgaatgtgaatgggtttaaaaacaaaatatattgtaaggttaagaagatgcttttcagtagagggaaacctgacccagttgatattgagagagcaaaaaggactcttacggaacaagaaatagctataactgaagcacttggtaaagtggctaatgtgttagagaggggtgatgcacctaatcagatgcaacgttatgaactctctaagaatactcctggaggacaagaaatgatgatacatgctaatttccgtgaactaattggtaatgttagggtgatgatttcatggcatagatatggagcttttaactctgatgaggctatacaacttatatag

SEQ ID NO: 89913 - DNA, 132 bp, Glycine max
  Peptide Sequence Number=SeqID_206691
atgaagatggatctgcgacggcaagaccagagcggtgaaaggtggagcagcgagaagttgacaatgacggagctcggaacaaaacaattgagaacttccaacaagttgggtacaatgttgagtatctattga

SEQ ID NO: 89914 - DNA, 531 bp, Glycine max
  Peptide Sequence Number=SeqID_206692
atgcattatgtgactggtgttttacttacattggctacagaacctcatgggataaggggtgtaatggacttggagcatcaaattcactacctggaaactgaggcttatagttctattttgaaggctttcattgctcaatctgatcttcttacttggggcaaagaggggcttatgactgagctgcgaaaggaactaaatgttacagatattgaacatggagaaatcctactgaaaataaattcagaccagttaattaagcagataagggagcagaggaaattggcatctcaagctaaggattatattaaacctagtgctcctgattgtgtttgtgcttcgatgggaaattcagtgataagaatgaaaactccttcctctgctgcattttatactcagaagaaaatgtcacactgccaagcttctctaatttccactcccattccttctccaatgcctgtgagaaaatcaagcctaatacaaatattaaattcgtattgctttcttgctgcatttagagtctacttgatttag

SEQ ID NO: 89915 - DNA, 543 bp, Glycine max
  Peptide Sequence Number=SeqID_206693
atgtatttaaaagaatgtgttagaaaaatatgtatgtttttggcatttcttaagttaaaaccacttaggttgtgtgtgacttggtctcctagcaaaggtgttgctagattggaaatcttggaagggtttcaaacacctaggagtgaggttttcctaggtggtaggaatatccttgatgtgcttgtggcaaatgaggtgatggatgaggctaggaggaagaaaaagaagtgtttattattcaaaattgactatgaaaaagtctataattcgatgtcttctggaactttttgctatacatgctcacaaggcttggttttagtgataaatgggttggatggattagacaatgaatttgggtcacaaagaggccttagacaaagagactcactacctttcatcttcacaattgtgacgaaaggtttaagtgggatgatgagagaagcaatggataagaagctgctttttatgggatattccataagtagggaggaggtaaagatggaattgctacaatatgtcaatgattcaacgaagaagcaatga

SEQ ID NO: 89916 - DNA, 597 bp, Glycine max
  Peptide Sequence Number=SeqID_206694
atgaagtttgttgatgtagacatgactcgttgtgggtgcattataagatctatccatggtttgccttgcgcctgtgaactagctaggtatgatttaagtagcataccacttcaagcactttatttgtacttgactaggctaagtttcaatgacttggggtttacttataaaaacaaagaattctttgtgcaacaagaatttgatgctataattcaacgtctaaaagaggttgacatagttggaaatattattatcaaaaatattgttgacgtaagatcagatggtcattatggttatatgacagttagagctttactttgtatggttgaagatttttggtctctagtttgtaacaatttgcataaagagttgggacaatggcatgatgagtatgcaaatatctttggaggatatgatcacttctatcagataaaacaatctttacttattaatcatgtctcaatgggcaaatggaaggagggcgcaggggttggcatggtggacgatgaggttgttgtcgtcacaggtgaaagaggtgttgttgcgacgctgagggaaatgttaggattggggaagagaggagaaggctacaaataa

SEQ ID NO: 89917 - DNA, 159 bp, Glycine max
  Peptide Sequence Number=SeqID_206695
atgcccgaaaaggcaaataaagttgcgaatacaaccatgctaaaggcgaaagaagatacgccattgagcccgagattgcacaagccatctatctatttatgggctaaatgtgtattggacttcttcggcaactctatttccctcagtccataccattaa

SEQ ID NO: 89918 - DNA, 418 bp, Glycine max
  Peptide Sequence Number=SeqID_206696
atggagttgataattgacagactaccaactgttgataatctctctaagagaaatatccaattgaatgatgaggaaaagaagggtgttttctgtttggagttggaggaatctgctggacattgccgtgctcactttcaacaacttccatgggtgatgaaatctgctgcggaaaaatcgcggtggcaagttgtttggggttatttggagtgtctggatctgggtattcttttacccaatggagtatttgtcctggtgcctgcttgtgctctcagtttggtgaaggcgatgcataaatgcaggattatgtactgctttgcgggttctgcggtgcttcctggcttcatcatatatgaacgtgtttgcgtgagagggtggttagtatgcagcattaaattcatgatgattgcctttacactgg

SEQ ID NO: 89919 - DNA, 360 bp, Glycine max
  Peptide Sequence Number=SeqID_206697
atgtctatcaccgacgggaatcttcacggaatacggttgcaggccaccaccgtcgccaacaccaacagactccggcacctccggcgagtccgcggaagctctgacggcggaacggcgacgggtttttcaattgtggagcgagttgaagctgttgcttcccagtttcagggagtggagagtgtgagggagaagagagagtgggacgcagaggacaagggagagaaggagaaagcgctgcctttatccgcttctgctattttgttcagacgcgcgctcaggttttgggccgttgggctttttctcattcagctttgggctgttgcttcccaggggtttgaatcctacactcccgtaccttaa

SEQ ID NO: 89920 - DNA, 1131 bp, Glycine max
  Peptide Sequence Number=SeqID_206698
atgccaaacacctcgcaggttatttcatgcaaagctgcaatatgctggggggctggaaagcctgtaacggtggaagagatacaagtagacccaccaaaagcaacagaagttcgagttaagatgctatgtgccagtttatgccacacagacatctcaagcattcaaggattcccatatatcaattttcctctagcacttggacacgaaggagttggtgttgtagagagtgttggtgatcaagtgagaaatttgaaagaaggggatgtagtaattccaacatacataggcgagtgccaagaatgtgagaactgtgtttcaggaaaaaccaatttgtgtctgacataccctataagattgactggtctactaccagataacacttcaaggatgtccatccgaggccagaggctacaccatgtcttaagttgtgcaacatggtcagagtacatggttagtgatgccaactatactctcaaagttgatccaaccattgatccagcccatgccagtttcatctcatgtgggttttcaactggttatggagctgcttggaaggaggccaaggttgaaagtggatccagtgtagctgtttttggtcttggagctgttggattaggggctataagtggcgccaaaatgctgggagcaactaagataattggaattgacaaaaatgagatgaagagagaaaaaggagaggcttttggaatgactgactttataaaggctggtgattcagctaaatctgtttcagaattggttaaggaaatgagtggtgggatgggtgtggattattcctttgagtgcagtggagttgcccctttacttactgaatctgtggaagccacaaaagtgggaacaggtaaaacaatagcaattggtacaggaacagaacctattatcccgtttggtcttacttccattatgtatggtagaactttgaaaggttctgtttttggggggctaaaagccatatctgacctgtccatcgtagctaacaaatgccagaaagaggaattccctcttcaagaactattcacccatgaggtcccattgacagatataaacaaagcatttgaactattgaaaaagcccaattgtgtgaaagttgtcatcaagatgtcacattga

SEQ ID NO: 89921 - DNA, 126 bp, Glycine max
  Peptide Sequence Number=SeqID_206699
atggcaaagaggttgtttcccggtatgaacccatgggcgcaatttaccactgaaccagggttcattcagatcacagagggaaaagtaccagaggacgtagaggcctatcaatcaatctacaaataa

SEQ ID NO: 89922 - DNA, 203 bp, Glycine max
  Peptide Sequence Number=SeqID_206700
atggcatgcaacctttgtttgacagcttcgaggtacatggcaccctttgttgcacaatacgtgaagttccgagacatgccagaaatcaaaaggaagcattgttacgaaatccgtgaaattccgcccacttgggccctccagaatgttcctccagaaggcggttgcttctggaggaagcaacctggctcgcctgggcgagctgg

SEQ ID NO: 89923 - DNA, 291 bp, Glycine max
  Peptide Sequence Number=SeqID_206701
atggaagattcttcctcagccgcttatatccacctggtgcaccgtctgatagaggagtgtatcctattccacatgagtcaagaggaatgcatggaagctctttccaaacatgcaaatatcaaaccggttattaccagcactgtatggaaggggctagagaaggaaaacaaggagttcttcaaggcctattcgaagagtaaagcagagagagcttcgaagacagaagttaggcaaaagatacacaagatggtttcagaatcacattcttccagttccaacgaacgagtttag

SEQ ID NO: 89924 - DNA, 940 bp, Glycine max
  Peptide Sequence Number=SeqID_206702
atgaagagacagagagagaacgaagtaacaacgttggaaagctgggacatgcaaatttgttcaacttcaatcacacccgacacaagtgtttccagttccaccatatctccggaagatgtatttgagtgcaaaacgtgcaaccgcaagttcaactcttttcaagcgctgggtggccatagggcttgtcacaacaagagggtgaagatggaaggtgaagaacaacaactcaaaacaagggcaaaatatctgggtttgggaaaacacagtgagcccaaaatgcataattgctccatttgtggtcaaggtttctctctgggccaggccttgggaggacacatgagaagacacagagcttcgaccaacgatgttttctcttccataaaccaggctctgggaaatgattctacccaaaatgcatcatccagctcagttaatggtgatctttggagaaagctatggaaaattcctactgctcccaaatatgtggccaagaatctgaaactgagttacatgctttattattatgtgaagaatcgaacatggcatggtgtttacagattggagatttggaatttgtggctcgtatctgtgaatttctgtggaccatctggtttagaagtagaaaccaatggctgtttcaacaaaggaaagtccccatgtgacttagttgtgcctgcaattgaagtggtatcaaatgataatgtccaaattcataaatggaagaagccaactgtttgtcttatgaaagccaatttggatgcctctgtgaagaagaatatggggacttggaaacctcatgtagcagaagttgtggcactcaaatggccaatagagatgacaaaggatcagatatttgattcagttcaatatgagacagattgcaagagacttgttcatgcttggaatggtaaccattttcatgacagcagctatttctcag

SEQ ID NO: 89925 - DNA, 1575 bp, Glycine max
  Peptide Sequence Number=SeqID_206703
ggggggaaaagaagcgatgggcgtacacctgacggaatacgtccaatctactcgagatgtggtctattacctagagcacatggaagtactcttttcacaagaggcgagacacaggcactagcagttgttacacttggagataaacaaatggcacaaagaattgacagtcttgatggtgttgatgaattcaagaggttctatctgcaggtctctttagaaattgactactttaatgttctcttatatttatgtggatgttacctattctcagaaatctgggcgatgtttgaaaaaccgaactggactgatgccaaaagccaagataaacccactgaactgccatttagctggtccaaccagttctcagttgatgacttggcactgactgcatcaaatgctccatggaggcggaccagaacaaaacaagattgcttggatcaaatgggaggaagtggcagctcctacaacaaggggaattatgggccagttttgccttgggtggggagactgaagaatctggcgatgtttgacagagttgaagacgacctactatgggacatcggagcagacgtaacaccgaagtatatgggggatgatttaattctattacttggtctcacggatgcgaaagcagaacaaatgatccaggaagaaatagaaggaggagagtctttgttttactcgttggagaagtggaacccaaggatacatatggtggaggtggacgatgatgttgaagaaattcggagggtggacagggcacaggtgctcatcaagatatcgtggaggcctacaatccaacacaccgtaaacctccacatacaaggggaggtatacggagtgcatgtggtggaggaatgcgggtgcagcttcgacgcataccacggtcgacataggagggatatggggtcgttggaggagattgaatctgacgatagcgacgtcggaacttgggtgccggaggagacacacggattggagaaagaaggcgacctgcaacttatggagaagcgcaaaactgtgaaccgccgacagaaaccaaacccattgggtaaagtcagtaccacctgggtacaggtagctaagcagaagaggggtatgtcagagcacgaagtaggtacacaggaagagcagatggcgcgccaatccatggctgttgaccgagatgaccaaacatgcaaagaggggggcgagcagattgtgggaaacaacgatgacgcagagagggatagcttttttcacgaaaacggaaaaaatgaatcctacaaacaagtaaaggcgaaaacactacagcatggcaaatttattcacgtcgaagagggtaccaaaagcaaagggatctgggctggtgatattaaagcacatgtggaaactacatcagcacaagatgaagcagatgatgcaaacccagccaatattcagctacaagaggcaatggagttatggaaagttgcaaagaaactgggggtaacaggtggcccagcccaggggaaaattatagacaacataagggcaatggaggaaagagataagaaagaggcagagagattgggaaataggagcagtaccccatga

SEQ ID NO: 89926 - DNA, 1128 bp, Glycine max
  Peptide Sequence Number=SeqID_206704
atgggggaaagtaacctaagggagttcaacgaatggattgatgagatggaggtagatgaagtgccatgggtggggagaaaattcacttggtttagaccggatggaactgctaggagcaagctggacagattcttggtgtctcctaaatggattgctaaatggccgagaagtacccagttcgtcttggataggaatttttccgaccattgcccaattttgctcagatacaaacataactcgctgcagggaatcatggttgctggatcttggattgaggaatcgggagaagtaaaagaggtagtacgacagttcttcatgcaaagatttcaagaatctgaccaagacagaccccgcttggatggaatccactttcaaaccattggtcatccacagaatgagatgttggtggggcgcttccaagaggatgaagtcaaacaggctgtatgggattgtggaagcgagaaaagtcctggcccagatggactaaacttcaagtttatcaaggaattttggcatttaatcaaacctgatgtcctccggtttctggatgaattctatgtaaatggaatttttccaaggggctgtaatgcatcttttttagccttaattcctaaggtgtccgatccacaaatgctgaatgactatagacctatttcactaataggtagtatgtacaaaattgtgtccaagctgctggctcaaagactgaagaaggtgatgccaatcattatagatgaaagacaatccgcattcatagggggcagacatttgctgcacagtgtgatcatagcaaatgaagtggtggaggaagctcagaggagtcaaaaaccatgcctggttttcaaagtagactatgagaaggcatacgattcagtatcgcgggagttcttgatatacatgctgagaaggatgggtttctgctccaaatggattcaatggattgagggttgtttaagatctgcgtccatatcactattggtaaatggaagtccctcggttgagttcatcccacaaagagggcttagacaaggagatccattagcaccccttctgtataatattgtggctgaagctttgaatggtttgatgagagtagccattgagaaaaatctgttcagaggattctag

SEQ ID NO: 89927 - DNA, 684 bp, Glycine max
  Peptide Sequence Number=SeqID_206705
atggtggcaatttctgtgttgatcctaagatatatccctccagacgaagtcccattgcctccatctctccaggattcaattgcttcagtgttaaagcggtacagattgagcaatgcagagacaaatgtggaatatgcagatgcaaatgttgtttcttctgagtacagaaaacctttaattattaaggaggatgtttcaattgattttcctaaacatcttgctgtaggaaaccatctaaatgaaggtgataagcgaagagttgttgggtggatcatagcattcatatgcttaggggagtttgtccttatatatgcaacttcagattttactcttcttagttctgttcgcttcgcattatgtggaattggcggtgctactcttctgtgtggttttgttttactgacctgtatagatcaagatgatgcaagacatgactttgggcactctggaggtttcatttgcccatttgtgccactgcttcccatagcttgcattctcatcaattcctacttactagttaatcttggagatggcacatggttccgtgtttctatatggctggcaacaggactactagtttatgtgttctatggccgaacccatagctctctaaaggatgcaatttatgtgccagcaaagcaagtggatgaaatttaccagaattacagaagctgtcttgcttaa

SEQ ID NO: 89928 - DNA, 309 bp, Glycine max
  Peptide Sequence Number=SeqID_206706
atgggtaagaaggaggcgaaagaaaagagaaaggtgaaggtgatgactgagagtggcagcgctggtggtgtgtgtttcgtcgtcaatcccgtcgttccgcctcactatctcacggaggatgatcacatttctgatcgtgtgaatcctaagtatgaagcttgggaagttcaggaccaaagacttcttgtttgcctccaatccactttctcgaagccagttctgtcgcgcgtccttgactctaatcactcctatcaggtttgggagaagattcacgagtatttcaatctctatacgaaatctcgtgcttga

SEQ ID NO: 89929 - DNA, 855 bp, Glycine max
  Peptide Sequence Number=SeqID_206707
atggcagaagatgattcaaagcctctgaactacatctccgaagtcatactcaagaagaggaaaagcaccgaagcatgggcgttaaggaaaaaagaacagttccagcaaaagaaattccaatccatcagaaagcccgaggatttcatccacgagtatcgcaacaaggaagtggaccttataagaatgaagcggagggtgaagaggaaagtgcctgaagctaactccaacactatgataatcattcggatacaggggaaaaaagacatgcatcctaggactaggaaggtgttgtacagcttggggttgaggagaaggttcagtgctgtgtttgtgaagccaagtgagggaataatggccaagctgcagagggtggaaccatatgtcacctatggatatcctaatcttaaaagcataaaggagctaatttacaaaaaaggacatgcaaggatggaacagcgaaaagttcccttgacggataataacattattgagcaggaattaggaaagttcggtattgtatgcatagaagacatggttcatcagatttataatgctggtccacactttaaggaagttgccagatttatgtggccctttgagctgaacaagccagctgaaggattgaaaggatcaaaaaccatattcaaggaaggtggagacacagggaaccgcattggaatggggtggggtggagaagaaagggacgggcatggtgtgctgtggggcttgaatctgaattctcaatatatttttaatgtcatgaacgatgattcaagtccgaatgtgattttcattaaggtggacagaaatggaatatctgaatatatgaagaacattattgttgaaggatcttag

SEQ ID NO: 89930 - DNA, 510 bp, Glycine max
  Peptide Sequence Number=SeqID_206708
atggaggaggctgcaggccacttattcttccactgcaataaaatcattcctatttggtgggaatctctgtcttgggtgaatatcctagtggctttcccagaaaatcctaggctgcatttccttcaacatgtacttggcctggctgatggaataggagctactagatggaagtgttggtggttggctttgacttggaccattttgcagcagaggaccaccatacttttttcaagtggcacctttaatgccaacaaattgttggatgatgcagtatttctgttgtggacatggctcagaaatttggagccagctttttattcatttcctccttcatgtgttggggaagttggccggattggtgccccaagtagaagagaaattggtcatgggatgcttgctgagagatcccttgaaccaattttgccttctgaagatgatttcccttacactatacgtgttgagagtactatcacagaaagcaatggctcttcaagattttctaaagcttaa

SEQ ID NO: 89931 - DNA, 750 bp, Glycine max
  Peptide Sequence Number=SeqID_206709
atgatgaattcctcacctcctccagcaaaaagactttcgaagtatgctcctctgattcatgttatgaaggtacgaccagatagaataaatcttataattggttctggtgggaaaaaagtgaagagcattattgaggaatctggagtagacactattgatacagaagatgatggcactgtgaaaatatttgcaaaagacttgcctagtttagagaagtctaaagctattattaatagtttgacgatggttccaactattggtgatatatataggagctgtgaaatcaaatcaatagcctcatatggagtttttgtagagatagcacctggacgagagggactgtgtcatatcagtgaactgagttcaggttggctacccaaggcagaagatgttttcaaagtgggagatcgcattgatgtaaagcttatagagataaatgaaaagggacagctgcgccttagtcaccgagcactgcttcctgatacagaagcttcaccgaaggatggtttagtggaagaaaagactgaacagtctaaggataagtctagcactcccaatgtcacagcctcttctaaaaggagttcagaggatgattctgtgcttccttctaaaaagtttgtcaggagattggtcagctcttccctggataagcctttcactaacaaagacaagacaaagaagagtagcaacaaagcagttggtagtgtgtctggcaaagatgaaagcagtttggttagtggagaggcgtaa

SEQ ID NO: 89932 - DNA, 342 bp, Glycine max
  Peptide Sequence Number=SeqID_206710
atgggacagtgcaagagtgagaacaatacgaatggtgacaggcttgatcacaggagaaaaggtctcatgaaagtcaaagccatgaatttgatgaaatcccttggctaccaaccttgctttgaacttgttgatggaaccatcaacattttcctttactctgaaaactcaatcctgactgttagaagcaaagcatcatattcttttgcatggcagcaagccaatctgcattttccaggacctgcttcacaattttgggttcagaatgggaacaggggaaaaaccagggggaaagaggggcagaaggagaatgataaggagatagctgagaagattgaggcatag

SEQ ID NO: 89933 - DNA, 780 bp, Glycine max
  Peptide Sequence Number=SeqID_206711
gctgcactttttggtggtgcggacaatttacccatatttttggcccgacagcatattcgtggaatagatattgttgtggacccatgtgcagcaatcctggtattacttgttactggactcttatgcgtggggatcaaggagagtacagtggtacaaggcatagtgacagcagtgaatgtatgtgcattgctttttgttatagcagctggtggttacttgggattcaagtctggatgggttggatatgaacttccaataggatttttcccctttgggattaatgggatgctggctggttctgctacagtattctttgcatatattggttttgatgcagttgccagtactgctgaagaggttaaaaatcctcaacgagatttaccgcttggtattggtggtgcattgtttatttgttgtgggatatatatgatggtgtccattgttgtagttggtttagtaccttattatgcaattgatccagataccccaatatcatctgcatttgctaatcaagggatggaatgggcagcttacattataaatgctggtgctttcacagctctctgctcagcattgttgggagggatacttccccagccacgaattctgatgtctatggcaagggatgggcttctgccaccttttttttgtgatataaataagcagactcaggttcccgttaagggcacaatagctactggcgttgtggcttcattcttggctttttctatggaagtctctcaactagcaggaatggtaagcctgggacttgtttgctag

SEQ ID NO: 89934 - DNA, 1447 bp, Glycine max
  Peptide Sequence Number=SeqID_206712
gtgcgacgaggtttggcttgcgcggcacgtgttcgacggaatgtccgagagagatatcgtaacgtggaacgcgatgattggtgggtattctcagaggaggttatatgatgagtgtaagaggttgtacttggagatgttgaatgtttccgcggttgcacccaatgtggttacggcggtgagcgtgatgcaggcgtgtggacagtccatggaccttgcgtttggaatggagcttcaccgtttcgtgaaggagagtggaattgagattgatgtttcgctctccaatgctgtggttgctatgtatgccaagtgtggtaggttggattatgcgcgggagatgtttgagggaatgcgtgagaaggacgaggttacttatggggcaattatttcggggtacatggattatgggcttgttgatgatgccatgggtgtttttcgaggggtggagaaccctggattgaatatgtggaatgctgtgatttctggtatggttcagaataagcagtttgaaggggtttttgatttggtacggcaaatgcagggttctggtttgagtcccaatgctgtcacacttgctagcattcttccttcgttttcgtacttctcaaacctgcgaggagggaaagaggtgcatggttatgctatcaggagaggttatgagcaaaatgtatatgtgtcaacttctattattgatgcttatggaaagttggggtgtatttgtggggcacggtgggtttttgatctatcacagagtaggagcttgataatttggacatcaattatatctgcttatgctgctcatggtgatgctggtttggcacttggtctctatgctcagatgctagataagggaattcgacctgacccggtgacattaacttctgtattgacagcttgtgctcactctggattggttgatgaagcttggaatatcttcaattcgatgccctcaaaatatggcattcaacctttggtggagcactatgcttgcatggtgggtgttcttagtcgagctggtaagctctcagaagcagtgcaattcatttctgaaatgccaattgaaccaagtgctaaagtttggggtcctctactacacggggcttctgtttttggtgatgttgaaatcggcaagtttgcttgtgatcatttgtttgagattgagcctgaaaatactgggaattacatcattatggccaatttatatgcacatgcagggaaatgggaacaagctggtgaggttagggaaagaatgaaagtaattgggttacaaaagatccgtggaagtagctggattgaaacgagtggagggctactgagtttcattgccaaggatgtgtcaaatggaagatctgatgagatttatgcattgctggaagggttgcttggtttgatgagggaagaaggatgtgtattacaggaagagttagattatgagaatgtttttagttaa

SEQ ID NO: 89935 - DNA, 435 bp, Glycine max
  Peptide Sequence Number=SeqID_206713
atgggtgtttcggttgattcaccgtcacaaaagggttcatgggatttcttgaagtttttaactaggaggaagcaggttgattctccacgtaggaactctcagcctctgcttgccaaggagttaactgtgcttcatctcattgcagttggtgttggttcaacaattggtgctggagtgtatgtgctggtgggagcggttgcacgggagcatgcaggaccggctttggccatttcttttctgattgctggattagcagctggtctctctgcattttgctatgcagagttggctagtcgctgcccttctgctggaagtgcataccactatacatacatttgtcttggggaaggtgttgcttggttgattggctggtctttgttattggaatatacaattggtagtgctgcagttgctcgtggcgtgacccccaatttg

SEQ ID NO: 89936 - DNA, 408 bp, Glycine max
  Peptide Sequence Number=SeqID_206714
atgaagctagtcaaacacagtgaccaagtcataccactccccactaagccaactgtgagggttatcagccctagctacgacgcggtggccatcactctggatgatgtcatgtctcttgcacagcctgtgacaagcagacccattgatcatgtcccctccaccttcactaaagagaccgtgaaggttttgcttataacttgccttggcatttcgatagaggaagaggctatagtgatgaccaccgcaagtgccaattcaggattatacatgtgggctgccacaacttatcttttgaacttggtcgacatcacgatatttgttagcaagtccttgactcacgtccacgtcacctacctcatctacctcagcaacctggatgactgccaccctggggagtcattgcactag

SEQ ID NO: 89937 - DNA, 812 bp, Glycine max
  Peptide Sequence Number=SeqID_206715
gatatggtgaagttatcgggggaggcgttgggggttgtggagaaagtgaacgacccgaagaggttgagcgcgtggcggaacatgctgttgaaggagtagccgaggagcatggcgttccacgtgaaggtgtttctgtggggggtcgtgtcgaacaccttacgcgcgaagatgaggcgagcgtggagctgcttgccctggcggaggaggcggtggtcggagcagtgctggagggccgagccataggcggcgaagtcgacgccggggggggagagccttcgtcggaggttaccggttactgtcgattgtgtttgaaattgaagggtgggtgccaccagaagatgccaaatcctgcggagcatgttgatttggcacgggtagtaactccacgagatgactcacattcaggggaagggcatgttgtgtttctggccgtggtcttgccctttatggggaagctgggactcgagcgtgagatggtgtatgccatgttcagagcatttcttcagctttctattattgggctgacgtgtgtattggagtgccacgtagcatgtgatgagtattttgtgcaccctagacagtacataagccccccaagctttgggctagcttgcgagaaaaagagattgtccgatgtcaagggtagtagccttgacaagtgggagggatgcgagttcatcgagcccccaagcataaataagtgttattcggtgtcaagagtggttaccttgacaagtgcgagagttataggtctgtcaagccccctatcctggacaagtgttgtccaagccgcttctatcaagttgtccagg

SEQ ID NO: 89938 - DNA, 1539 bp, Glycine max
  Peptide Sequence Number=SeqID_206716
atgcttagtttaattactactttgttcttacttgatgttattattactactactgcaggtgttgatattgaaaggccggttttggagttctccccttccgttcttcccggtatttcgggttctctaggtgttaaggacgctttacgatgcgagcgtgttcgggtttcgggcatctcgagagtgaaacttgggagctacgctaattcgtaccatgttactttggctccctccgtttcgatccccgagaagttgcatagcaaaattcaggtttgcttccacaggaatgaaacagttggatggtgtcagtgtgagaaagatgagtggaggggggtgcagaagggggtctggaatgctgttatgtcaccttatgaaacgagatatgttgatgtgaggatcaatggagaaatattgggttctgttacagttgctattgaagaagtaggattgatactgttgttgttggctccaactgttagcagatgggttccgttttattatagcacttcaatggctatagggatctttcttgtcattataatccttctttttcagggcatgaaattaatgccaactggaagaaaaaatatcttctaccttaccatatatggttcagtggttggagctgggtcattccttttgcaccaattttctttgatcttaaattcaatttttcagagtcttgggatgagtgaagagatgcacaatccagttgctgtttttgtaatactgggcatcatcttggctggagctgctttaggctacttgatcgttaggaggtttgttatttcaaaagaagatggtagtgtggatgctggggttgctcagtttgtgaaatgggctatgcgcattattggatccactttcattttgcagagcactcttgatcctcttctagcaattggagctttgatctcttgtggagctgcttgcaaacttatttctgccataaaatggctttgtggatgggcgagccctggtgcaacggtaaagttgtgccttggtgacctgttggtcatgggttcgaatccggaaacagcctctttgtatatgcaagggtatgaaacttcaaatgacgactattcgctgcaatggatgagaggaagacgcggtcgtgcggaattccttagcaagtcaacccctaaagggaaacattggagtagccctaaaggaaaattgtggaatagccctagaagatcagcatggtctgactctcctgtcagaggtgttgtatcaccatcttccgggatttcgtcacaatcttcagggactcaagcagggcagaattattattcaactttccacaagacccggaacagaaagaagttcacaaagcaagagtgggatgagttcacaagagaatccactaagcaggctctagcagaatgggcagcttctccagaattcactgattggatcgttgagcatgcagaccggatacaagtccttccaagcgagagttcggatgagacaatgggaagtgaatcggattccacagatcgaggaagtggaagaggatttgggctttttaattggcagtga

SEQ ID NO: 89939 - DNA, 666 bp, Glycine max
  Peptide Sequence Number=SeqID_206717
atgaggaagaggtggcatcatgcggcgagtgaatatcataaatttaggccatgttcggatacacttctccataaacacttgataagagaagaaaacgagcttttgaagaaagtttctatactaagaaaatacgaagaaagagcgaaccgcgcggggcaagacgcgtacggtctcgacgaagtcatcctcggagtcgaagtgggcgcggacttggaggtggaagaggcgggagaggaagaaggagcggccgaggtggttgacgagttttctgatctggtcagtgcggacggagatgaggcgcttgttgccgccgtgctggccgtcttcttgctcgaacacgatgctcggaagccgcccggcgcggcgttccttggcggagatgttcttgccggagtcggcgcgggggatggcgaggatcgtctcgtcgtgcttgggatcggggcgggggaagccgtccaggtaggtgaggggctccggccccggaggccggaggacggcggcggcggagtgggagaagtggcggcgataaggggagagtctggtgaggatgtggtggcggggaagatacatgatggtttgggattggagaaagaaagggttgaagagaggttttgggttgggaaagtggctggggagcctcacttgctcgctcactcacttcactag

SEQ ID NO: 89940 - DNA, 432 bp, Glycine max
  Peptide Sequence Number=SeqID_206718
atgtctcccgccctcaccactctgtcaccgccgttatctctttccgttacttcggcggcgcgtcgtccacggctgacagcgatggtgaagactgagaaaaagcaaagcctcggcttcggcagcgataagaaggaaacaaagtggcactgcgtggagggttgtggttcctgctgtaagcttcaaaagggtccatcttttccctctcccgaagaaattttcgacgacccttctgacgttcagttgtacaaaagcttgataggtcctgatggatggtgtattcattatgagaagagtactcggaaatgctccatttaccctgagcgtccatatttttgccgtgtagagccagaggtatttaaatctttgtttggagttaaagagaagaattttcacaaggaggcctgcaggaatagggaaattttattcagatga

SEQ ID NO: 89941 - DNA, 717 bp, Glycine max
  Peptide Sequence Number=SeqID_206719
atgtccttgatgcccaattctagggttcctcttctcctcttcatctcttccatattcttcacctcttttcccgggttgacgtttggtgcaattgtgtcgctgagatcaattgagatttttaaaacgcacgagtggctgaaagccactacaacggtgtatttcctatgcaaaggggagaacgagacggtgcttccagatgtcaagaaaccccacgccatttatgctttcaatggtcaagaatcttggcaggggactgtgtttgtgatcttgagtcctggaaatggaaattttggatgcagcaatgcaaatcctttaagcagcttttcaagtaaaaaatgcaagcggtgtggattctatgaggaggacagcattacttcggatgatgcatttgacgaatgggagttttgtccttctgactttgctgcacccaacggtgaatatattcggttcaaggaaaaggaattcaatgctactttcctgtgccctgagtgcttatctcttgctggtgttgatgagcatgatgacggaaaaggaatgcatatagctgttgtcgttttgctgagtattttggtttcagttacactgattcttggagtggtgggtgcatataagttctggcgaaagaagttaagggaacaggaccaggctcggcttttgaagttatttgaagatgatgatgacattggggatgagctgggccttggtagtgcaatttga

SEQ ID NO: 89942 - DNA, 1569 bp, Glycine max
  Peptide Sequence Number=SeqID_206720
atgtctttcatctttgactccaccataggtatgggcgatggcgactctaagggttcaattcaacaacccatggtggaccgaaaggtcatccaaattggcgactcctcggaggaggagacacgccatgaagcctctgatagcgagtcctcttcctcaaagacgttgacagtctcgagtcgtgttggtggaggaacttctcgcctccataggaggacacaactttctactgcttttctggacgaagaaccggttccaattaccatgattttccccctttctatttctggggaagagttgtgtgtcatagccatagaagttgcatccaaaagttgcgtcatagccacagtgttggcgagtgtcgctactctcgagcgacaagtgaaattggccaatctggaggattcctgcaagatagtcatccaggcatgtgggattgacgatatcccctttttgagggtgatgtcgggtagttctcccttctttttcatgtatagatgtctcttcaaggttttgggtttgattccacccttgagctcttttcaatgtgctcttcttgagtacttaaatgtagccccctctcagcttcaccccaatagttgggctatgataggttgtgtctccttgaacaacgtgtccaagaagttgttcgagttcaactcgaatgtgtttcgtcgcttaaaggaccatttcttcaaggtcctggctactgatgtcgtggtcgaacctacgggtgggactatgccaccttctgtcgatcctccttttggagaaggggatcaacctactgttagggttgaccctaatgatgatgaagttgttgaggtctcccctaatgtacctttctctattttggctaagaggaagcgtgatgacaacactgggactgctgggttgatgcctggttcaggtcacccctctagttcgcaaggtccacctatagctccgccaaccgaggtttctgcttctcctactgttgtggttactgcgctgatctctttggtcggtcttgttgtggctcctctgtccaccattgttacgtccttgttgagtgttggtgtgacgatcacgagtgctccaaaaatgctgcatctttcttcttcagctccatcgattctcccctcaattgtgttaacatcagcattgccttcctctttttctcaccctaacgtctccttatgtcacatgtacacttcttgtaacagtaattcactatggggtcttcctccaaagaagtttagtgattctggaggaaaatggatagcggcactaggaagctttgagcaagtgaagcgtcttaaggtggctaacgctactattgcctttactgagatcgtgaagtcgaaccatcagctatcatccaagagggagaaaaatgacttgattggcaaggtggaaagcattgttgttgagaaggacgagttcaccaaggtggttgctgacctcgaggcccacttgaaagattctgagtctaggttggaggagtttgagctcaaggcgtccaaggagatggaggccaacaaagagcttgaagaggagttgttggtgtacaagaaagaggacgttgagtag

SEQ ID NO: 89943 - DNA, 423 bp, Glycine max
  Peptide Sequence Number=SeqID_206721
atgagctctgtgtgcatatcgaagtgtgtaaacgacgcacgtgtgccggtacgtgcgacgtacgtgaacctctacaagtggccggaatcggacgcggagtttgtgaggagaaggggtggaggttcgcacgtgtgtggcgggcacccgagggtggtggatagcatctcgtgcaggcagatgtacctaagaagctacaagttttcgaggaaagagagtgtgccggagaaaacccagaaatgtttcgggagggttaaggagagagtgaagaagcagggaagctctcaacataatcatggcgttgggagaaggaagtgtttggtttggaggaaaatgagggaaatttcatgcgctgctttgtttaggatttttcataggttcttgtcttgcggcgctagtgtagatgttgtacatgcaaaatcttga

SEQ ID NO: 89944 - DNA, 904 bp, Glycine max
  Peptide Sequence Number=SeqID_206722
atggatgaagacgcagcaaaggtgtggaaaatctgtgggactgaggctagttatgggtgtagttatatgtacgatgaatatgcatgcaatatcaaaacaaagaagaatattgatgcggcatggggagttgtaggggaatcgggacacagcgacattgcttcaaagctcaaattcttcatccctaagcgcaatctcggcagcctcttcttcctcttcgtcgagcacaaagtactcattcttctccacaggcctaaacatatagaacatgacaacataaaacgcgagactagcagcctcctcggcgagattactaacccactggtatttgtaagcggcaatggtcttcaacgcaaagaccacaatgcgggtgaaatacaagtacccaatgacaacaatgtagaactgcctgaagagggtcaacttggccaggttcctggctgccttcccgtcggtcttggaggtctccctgagcgacctgatggaccacacaatagggaaaatgatggcgcagcagcagataatgtcaacaagcaggaagacctggttccaagtaacccaatccttgatgaagggaccggtttcgccgatgacgacggaggcaacgttggcgaggacctggagagggatgacgatcatgaggaccttcttctcgcgctcctggaggaagggtttgaggaaggaccagccagtgccgaccaggacgatgacggtgaagaggaggacgacgcggatgaactggaagatgtagaagaggacgtcccagccgtgcggggtgccggtgacctttacgtagtgcttgtcctcggcggcgcagaggagcttgttggagtagcagatgtaaatccacagggcaaggaaggcgaagtaggcgacggagaagagagagaagagagtggggagatgg

SEQ ID NO: 89945 - DNA, 1476 bp, Glycine max
  Peptide Sequence Number=SeqID_206723
atggggactctaacgagttgcagcttcatgcctctgaactcggagttccgctccaacccggttcgccgcgccttcagggagaggattcagtgccataagctcacgcgcttgaggggcgcctcctcctgcttcttctcacgcgcgcgagtacccaaatggggcaagtcgaagctctccaattttgatagccttaggtgttttgctactaataatgacaacaacagtgacgacggcgacaaggacagtaacaacgttggtgccgccggagaggaaagtggtggcgacgattcgaaatccaacgttacgacgacgatgcccgaagaagagagaggattcacttcgcagaaatcgacgcctccttccacttctcagaggtcgtctttgtcatcgcttggaccagcatacaacacttttcaagttgattctttcaaacttattgagctccttgggcctgagaaggttgatcctgctgatgtaaagctgattaaggataagctttttgggtattcgaccttctgggtgacgaaagaggagccttttggagacttgggagaaggcattcttttcattgggaatttaagggggaagagagaggatgtttttgccaaactccagaatcagctagttgaagtcacgggtgataagtacaacctttttatggtggaggaacccaatgcggacagtcctgatccacgcggtgggccacgtgtgagctttggtttgctgcggaaggaggtttctgagccggggccgatgacgctttggcaatatgtcattgcattgctgttatttctcctaactattggttcctcagtggagctaggaattgcatctcagatcaacagacttcctccagaagttgtgaaatatttcacagatccggatgctgttgaagctccagatatggagctgctatttccatttgttgactcggctttacctttagcatatggtgtcttgggggttcttctgtttcatgaggttggacactttctatcagcatttcctaaacaagtaaaattaagcatacctttcttcattccaaacatcacacttggcagctttggtgctattacacagtttaaatccatccttcctgatagaagtacacaagtagacatatcacttgcgggtccctttgctggtgctgtattatcattttcgatgtttgctgttggccttcttctctcatcaaatccagatataacaggagatttggtgcaagtacctagcttgttgtttcaaggttccttgcttcttggattgatcagtagagcaacccttggttatgcagcaatgcatgctgaaacagttccaattcaccctcttgtgattgcaggctggtgtggcttaaccatacaagcttttaacatgcttccagtggggtgccttgatggtggaagagcagtgcagatgccattcttaggagttaaagctccgtttatctccctttcttatcttgctaacaatttatag

SEQ ID NO: 89946 - DNA, 219 bp, Glycine max
  Peptide Sequence Number=SeqID_206724
atggtttacttgaatgagttgagattttgcctagagcttcctaagacattcttccacagtctgaccattgggattttgaaaataagaacttttgatgtgtccctaagcgccaagggcgcgctaagcgcaattccaacccaagagggaattgcgcttattatccacgtgaccttgttggatatccctggtgggggaaataaagtggttaaagagttttaa

SEQ ID NO: 89947 - DNA, 759 bp, Glycine max
  Peptide Sequence Number=SeqID_206725
atggcgcaccggcgcaaatttggcggcggacgtggcgaagcggtggcgaaagcggtgggcatcaaaggggattatctgcccgacgtggtggatgcgacggcggggctgggacgtgatgcctttgtgctggccgcgctgggctgtcgcgtgcgtatgctggagcgtcatccggtggtcgcggcgctgctggaagatggtttgcggcgtggctatgaagatgcggagatcggcggctggctgcgcgagcgcctgacgctgctgcatgtggtcagccagcaggcgctgagtgatatcacgccggcaccggacgtggtgtatctcgatccgatgtatccgcaccggcagaaaagcgcgctggtgaagaaggagatgcgggtgtttcagtcgctggtggggccggacgaagatgccgatgcgctgctcgaaccggcgcgccgtctggcgaagaagcgcatcgtggtgaagcgcccggattacgcaccgccgctggccggcgtcgccactcaatcggcggtggtgaccaaaagccaccgtttcgatatttatccgccgttgtcgtgcttcgcaacggtaaaaaatggaaaaccagtaaaaatcaaagccattgccaatgggaaatatatccttgctgaaagtgagaagggtgttgcacctgaaaacatcaccgtcaagcgcgtaggcaaaatctctggggttatcctggaggatggcgatctggataaccccgacctcatcattgagatttttttgtctaccctg

SEQ ID NO: 89948 - DNA, 179 bp, Glycine max
  Peptide Sequence Number=SeqID_206726
gaacgaggataagggctacgtgggagtgtgtgagctcaatttgaaggtgggcaactggggatgtggtacctggagatatgtcgcgggggtcaggagaccttggggacgtcagggtgatagggcactggtaatcgattaccagtttggtgtaatcgattacacagtgctacctgccactg

SEQ ID NO: 89949 - DNA, 2055 bp, Glycine max
  Peptide Sequence Number=SeqID_206727
atgaatgttgtaggcaaagttggaagcttgataactcaaggtgtgtactcagttgctaccccttttcacccatttggtggggctgttgatgtgattgttgttcagcaacaagatgggacatttcgaagcacgccttggtatgttcggtttggtaaatttcagggtgttctcaaaggtgcggagaagtttgttaggataaatgttaatggtgttgaggccaattttcatatgtatcttgacaattcgggggaggcttattttttgaaggaggtggatgatgataaaggagttgattcgattgaggctgttcaagattctattgacaaaaagaatggctatttgattaatgttcatagacttgatcatagcatctcggattctggggtgcttcggttgaaagatgagagtgattccttggttgtgtctcaacttcaaagggcagaatccgacattgataggagattttatgaattcccggatgatcgatcttctttagaagattcagttgagttgtcagaatatgagtctaattcatatgagagcctagagggagacaattttggggagtcacagggttcacatccagagatggtcttggtgagtgttgacggtcatatattgactgcccctatctcagaatcagagcaggctgaggagaatgtgcagttaaaaactcctcaatttcatctgggaccgggtgaagagactgacttatgtgaaggcaacggagagtttagtactggtgaaaatgcttgggctgctggttatattaatcagttgggtgctcaaacaactaatgtccaacccagactttgcgacactaatggtgatgataatacttctaagcttttgcttaaactttgtcaaggagaggaagcacatatctgtgaagcacaggataccttggagattaaaaatcaagatcatataaaaactgattcaaaaggggctgcatcaggtatcaagagggagaatgttttcaaaagctatttggagctacaagattttggtcagcaggctagaaatgcttatttacaagatatagttgataaaaatgaacaagagagcattgcaatatctaaaaacggtgatgagttatcacctcatagtgatgagagtcaacaaacccctgcactcaaagatgttagggctacaagtgaggtggtggagcctcaaacagaaacttcaaataaaggggatcaaagccatttgggtttgggatttgagatgtccctttgtggtcatgaacttaaggtgggcatgggttcaatagcggctgctgaagtgtttgaagcacatcgcatatctgtagttgacttcacaagttctgctccatcaataattaaaaatcaaaatcttgttatcaagtttaaagagaggtacatgacatgggaaaaggctgctcctcttgttcttggaatggctgtttatggtttagatttacctgttgagtccaaagatacaattcctgtggaacaggatcatgcattgaagtccagggatgatgatctgggatcatcttcgtctggacgcagatggagactttggcctattccttttcggaaggtcaaaacatttgagcatactaatagcaactcatcaaatgaggaggtatttctagattctgagtctggatctctgatagaaccaactccaacatccagtacccagggatcttctcataagcaatttctaagaacaaatgttcccactactgagcagatagcatccttaaatctcaaagagggtcaaaatttggtaaccttcagtttctccacaagggttcttggaacacaacaggttgatgctcatatttatttatggaagtggaatgcaagaattgtaatttcagacgttgatggaactattaccaagtctgatgttttggggcagttcatgcctttagttggcaaagattggacacaatctggagtggcaaggcttttctgtgctattaagcttcggcttgagattgctctacaaatgagcctggagcttgctcaagtcatttttgctcaatcaacaagcatagtagatagtaaggctaatgactag

SEQ ID NO: 89950 - DNA, 564 bp, Glycine max
  Peptide Sequence Number=SeqID_206728
atggggaagaacaagggtcgtcaattgcactcagctgcaaagcaaattatggtgaaaggtatcacctcaggttcaggtaaatcccaaacatctgctacttctggtctggctggttgcttggatgttgtccaagcaaatcagaatgttcatactgcttcacaggataatcttgtaggcaaggtgctcgtaaaaaaggcagggacaagttctgcaaaaactgatgatgtcacacaccaagtgtttgataatttgtcggaatgcagtgctgaatttgaatcttccccagaggtttcttgcaccttaggggacaatgattcaactacttatgatgattcatctcactcctatggctctaagtcatcaccacagctagacgacaataaggctcccactcattgggtcaatctgttcaaagataacagaaacccttccaaagtttttggaatgaagttctcccctccaccctctgatgatgaagtgctgttggaagaaactgatttgcaacccctggaagaggcttggggacatagccttattggatatgtggctggccgcttcccatga

SEQ ID NO: 89951 - DNA, 144 bp, Glycine max
  Peptide Sequence Number=SeqID_206729
atggaggcccaaaacctatacatttcacatgagatgcagagagtggcaccattaattggtcagactaatcttgattggggcgaattgtgtgaagaattgttgggcgtcagaccacaggaaggtgacttcaaggcagtgtggtaa

SEQ ID NO: 89952 - DNA, 1392 bp, Glycine max
  Peptide Sequence Number=SeqID_206730
atgatcagcagaaactcccgtattctcgccggtgaccaccgtcaactcggcgcgaccgtggaccgagatggcgtgaatttcgcgctgttcagcgcccatgcggagcgggtggaactctgcctgttttcaagcgatgggaccgcggagatcgaacgcctcgagcttccggaatacaccaacgaggtctggcacggctatgtaccgggcctgaaagaaggcgcactttacggttaccgcgtttacgggccgttcgaacccgaaagcgggcaccggttcaaccctaacaagcttctgctcgatccctatgcgcgcgaagtcgtgggcgacatagagtgggggcagccgcaatttgcttacgtgacagacagttcggacaaggacttgtccttcgacgacactgacagcgcgtcgtttgtgccaaaggctcgcgtggtcgccaggtccgatgcgccaaggagtcaacagcgccctgacgtcccctggtcgaagacaatattttatgagacccacgtcaagggtttcacgcagcttcaccccgctgttccggaagctctccgaggcacatttgagggccttggggagaaagagatcgtcgactacgtcaagagtctgggggttacctccattgagctgcttccggtacactggtttccggacgacgcccatttgctggaaaaaggtctgaaaaactattggggatataatacgcttgccttctttgctccggcgaaccgctacatgggtccgcggggcatccagggctttcgtgacatagttcgcgcttttcatggtgccgggatcgaggtcatcctggacgtcgtctacaatcacaccgccgaaggcaatgagatggggccaaccctctctttcagaggcatcgacaacttctcctattaccgcacaatgccggacgagccgcgctactacatcaacgacaccggcaccggaaacacggtaaacacttcccacccgcgcgttttgcagatggttacggactcgttgcgctactgggcgcaggagatggagatcgacgggttccgatttgatctcggcacgatcctgggacgcgagccggaagggttcgaccagcgcggcggtttcttcgatgccgtcgggcaggatcccgtgctgtcacgcctgaagcttgttggagaaccatgggacatcgggccaggcggctatcaagtcggtgggtttccgccaggctgggccgagtggaacgacaagtaccgtgataccgtgcgggattactggagaaacagggatggcacgacccgggatttcgccgcccgcatcctcggctccggcgatgtttatgacttgcgcggccgtcgtccctggtccggcgtaaatttcctgacagcgcatgacggcttcacgctcaacgatctc

SEQ ID NO: 89953 - DNA, 398 bp, Glycine max
  Peptide Sequence Number=SeqID_206731
atgggaatttgcttagaggatatgatttgtgaccttggacaaatgccttttcagcaagcatatgcccctatgtatgatacattacaaactaattcaaagaagcctctgtatccagggtgcaagaattccttgacgttgttgtcagtggtgttaagtctggttaatgtgaaggccatatatgggtgtggggtatcacggtacaaagtgaaggatgatgacgagtgtagtagtgatgaaaactcaaagaagggtttgccagcgaaggtgttgtggtatcttcccatcattccaaggtttaagcatctatttgctaatggagatgatgaaaaagacctgacatggcatgtgaatgggagaaactgtgatggaatgctctgtcatccagctgattcattcca

SEQ ID NO: 89954 - DNA, 241 bp, Glycine max
  Peptide Sequence Number=SeqID_206732
aaacgttggtggtgactccgcgcgtattcctttcttggaagacgcacccgtgagtctcgcatcgccctcccgccgaaggacatttggtggcgactccgcgcgtattcctttcttggaagacgcacccgtgagtctcgcatcgccctcccgccgaagggtaggttgcgacaatggctcttgggtgaaaaagggtgctcgacccattgatgacgaaggacatttacatggtggagaagattaa

SEQ ID NO: 89955 - DNA, 336 bp, Glycine max
  Peptide Sequence Number=SeqID_206733
atggagttgctcgaggatatctatttgagtagatgcgaggcccgacggtggattgtagcagctcgtgcttatctcctccacttggttggttgcactcttttcgctaacaagagtgcaacacatgtccatgtagtgcatctggaggcttttcaagacctgggtgagagtgggagtgctagatatatgagcactttcctagtgttcatgactgcgtcactgacgatgtatacgatgagacatccacacgtgcctgccggtggcttacgacgaaggcttatatcaagggattacgagcagcgcgtaccagacacgtttggatgctttgacgatcactaa

SEQ ID NO: 89956 - DNA, 1671 bp, Glycine max
  Peptide Sequence Number=SeqID_206734
atgccaccgctggaagcacgcctgagtgcgaactgggaaggccagcgctggagcgccggtgcactgctgcgcgcggtgacccaccagcatcgtgtcgcagatggccaaggcaatgtcgtcgcgcaggacctcggaccgagcgctggctttgccaccttcgcgctgaatgccgcgtaccgtttcagttcgcagctgcagctcagcgcgggcgtcgacaacctgttcgaccgtgcctacagcgagcatctgaacctggccggcagcgccgacttcggcttcccggccgacccggtgcgcatcaacgagccgggccgcagcctgtggatgaaggatccgcccccgcccgacgccctccgtcgggcagcttcgactctacgatggctgtcgccgccatgggcggctggatacacctcgacacacgccgacaccgccgcgaccagccttgcatggaacggattcaaggcgctatcacggcactggttccacgccggtaaacgcttggcacataccgcttttgcgggcccttgcctacactcggcggccgtggatcaatcaggaccgttcatgttggctcgtatcgcttcgaccctggcccttggcctcagcctggccgtgctggccgggtgcgcaggcaaacaggaggccgccgcacgtcggcagggagaagcggtgccggtcaccgcgcaggtcgtgcagtcccgccagtggagcgacaccctgcaggcactgggcacggccaaggcccgtgaatcgatcagcgtgaccgccaaggtcagcgagatcgtcgagaaagtgcatttcgagagcggccagcacattgcggcgggcgcgccgatcgtgaccctgcgcggccaggcccaggaggccgcactggtccaggcgcaggccaccttccacgaggccgaccagctgtacaagcgccagcgtgagctggccacgcagcggctggtgtcgagtgccacgctggatacgcagaagtcgatccgcgatgccgccgaagcgcgcgtggcgcagatgcagtcggacatcggtgaccgccgcgtgcgtgcgccgttcgccggtgtgctcggcatccgccaggtcagcccgggcacgctgctgacgccgaccacggtgatcgccacgctcgacgatatcgagcacatgcatatcgatttccaggtgccggaagtggagctggccgcgctgggcgtcggtgacaaggtcagtgccaccagcgtggcgtggcccggccgcactttcgagggcgtggtcagcaccatcgatgcgcgcatcgatccggccacccgtgcagtgacggtgcgcgccgatttcgccaacggcgaccatgcgctgcgcccgggcatgctgctggacgtgcgcctgttccgccccgagcgcccggcgctggtgattccggaaatcgccgtggtgcaggtcggccgcgataccttcgtgtatcgcatcaccgcagacgacagcgtcgagcgcgtggacgtgatcaccggcgcgcgccgtgccggcgtggtcgagatcaagcagggcctggaagcaggccagcgcatcgtggtggacggtacgggcaagctgcgcccgggcttgaaggtcgcggccaaggacgcggcaccggccagtggtgcaaagcccgctgacgccgctgcaccggtcgcggccgagggccacggcggatga

SEQ ID NO: 89957 - DNA, 583 bp, Glycine max
  Peptide Sequence Number=SeqID_206735
atacatatgtccctgtgaatctacttggagaatctttgggtttccaatacatggcagaaaacttgttgttgaaagattgcacttccatcttcttggccaacatagtattgtctatgaagaccatgatgatattgatgatgtattgtctaagccaagtatctctgattcaaagtttatttcatggatgaacaccaaccaaaattctgttggaaatcttacttatgcagaatttgtttctaagtttgtatatagtaagaagaaaagatgttggcaccttaggaagaaaggctacaccattggcaaattactatgggtcccaccaattacaggcgaattattttacttgaggatgatgcttactgtttgtaaaggacctgcctcatttgaggatttaagaacaattggtaatgttcaatatcctacatatagagaagcatgttttgctatgggttttttgcaagatgataaagaattcattgaggcaatcaaagaagcaaaagactggggctcagcacattatataagaaagctatttgtgttgttacttttaactgcaataatgaacaaacctgaacaagtttag

SEQ ID NO: 89958 - DNA, 1021 bp, Glycine max
  Peptide Sequence Number=SeqID_206736
aaacctgcgtgggaaggcgccgacaaagcgatgtatgaagcgaaagagacgggtcgtaatcggttcatggatgttttgctcaaggcgtgcaatgaggctgatgagcatttccagctccgccggtttgtcgggagatcagtcccttctcttccagctgatcaagtgtgcgcaccagcgacggttgctcaatgccgatcgcttttgccagttgaatttgtgactgatcgggcggcagctgatgaatattgtgcagcccgttctggtgggctttatgctctggctcattgcacatcgtctgcttcgcgactggatgtactccggcgaaatctggcatcccatgttgatggatctctccctgtttgccctctccgtatgtctgggccttgctgtcttgctggtgtggtgactatacctatgaaaacgctgaaatacttttccacgctgtttgttcttgccctcgcgctggtggcgggctggtggttgtggaatttttatatgcagtcgccctggacgcgagacggaaaaattcgcgctgaacaggtcagcatcacgcctcaggtgtcgggtagcatcacgatgctgcgggttaaggataaccagtacgtgaaaaagggagaggtgttattccggatcgacgataccccttaccacattgccattctgaatgccgaagcgcagctggcaaaagcccagtctgatctggcaaaagccaataacgaggctaaccgtcgccggcatttatcgcaaaattacatctcagcggaagacttagacactgcgaatatcaacgtgaaggccatgcaggcgaacgtcagggttgccgaagccacgcttaaacaggctcagtgggcgctgacccaaacggttataaccgcacccgttgatggatgggtgaccaatctttccgcccgtgtgggcaattatgccaccaccggacaacccgttttcgccctcgttgatagccactccttctacgttgtgggctattttgaagagaccaaactgcgccatatccgcgcgg

SEQ ID NO: 89959 - DNA, 441 bp, Glycine max
  Peptide Sequence Number=SeqID_206737
gttctccccttcagagagctacacgccctcgccttcagaggactacacgtcctcccctttagaggactacacgtgctcaccatcagagggctacacgccctcgcattcagaggactacacgtcctccccttcagagagttacttgccttcgccttcgcaagagacctccccttcagagagcgacacaccctcgccttaagaggactactcgtcctcaccatcagaggactacacgtagtcgccttcagaggacaacacgtcctcgccttcagaaggctacatgtcctcgccataagaggactaaacgtccttgtctttagaggactacacgtcctcccctttagagagctacacgccgtcgccttcagaggactacaagtcctcgccttcagaggactacacgtcctaaccttcagaggactacacgtcctccttttctga

SEQ ID NO: 89960 - DNA, 100 bp, Glycine max
  Peptide Sequence Number=SeqID_206738
atggacatggttgagtggggtcttgaactttacacatcagctaggagaggtgtctttgacgggaggggagacctgcaaaataaaagactccgacagtcaa

SEQ ID NO: 89961 - DNA, 270 bp, Glycine max
  Peptide Sequence Number=SeqID_206739
atggtggcacctccagactctattccttcaatagagcagtttaatgaggaagatgaaggtcccacagcccaggtaccacaacatatggaggatgagtcatccaagactaccactccaaatcccttggtcagaaggaagaaggaagatgaagcacaagaagctgcagccacttctgagaaatctcttgaggccacttctgagccttcagaaccagtggcaaatacagcttcacctcagcaggcagcagacccttccactcctgaggattag

SEQ ID NO: 89962 - DNA, 767 bp, Glycine max
  Peptide Sequence Number=SeqID_206740
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattaatttgcaatggccaccaaatggtgggcgtctcttagttgcagagtatgttgatcctgaagaagtgaaaatgaagttagaacctcctcctactcaggctgcatcggacagcactgatcgagcagttcctcctgctccccccttctcacagccagagccttccccccatctgcacagggagcagcatccagttccagtcattctcccacctccaccaccattgtcaaaacccccaccagtagcaagagaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 89963 - DNA, 294 bp, Glycine max
  Peptide Sequence Number=SeqID_206741
atgaggtcagacaccgatactggtgttcgaggaagagcctcgtttctattgatagcttgtgaaaggagaggggagtataggcctaagaaacataatttggtaagaacatgcactggcagtagaaaatgtggatgtccgttaaagttccatgcgaagccagtttcgggaggaggaggatggatggtgaagtttagaaagatgaagaaggagaatgaagaagggggttggaagaatcactcctccggaattggtgtcacacacaaggtggtgttccttgataaaccaatttcttga

SEQ ID NO: 89964 - DNA, 687 bp, Glycine max
  Peptide Sequence Number=SeqID_206742
atgatggaagccgtgatgagtatgagaaaaatgatggaggtcaacacggctacagtcgttgttgcaagtactaccactgggttggacccgactcacccatctagcatcaagcaagcaagtcatccagtcccggatatgaacaagcattccttcccaccatatggcttgtctcccaactatacaccacccaatgttgtacacactcataacttcgctcccatacccattgagagccaacaaccccaatttggtcaggcacatgtctctcaacccatggaggagacacatgaagcaccccgagaccataatctagtcaacttcgagcctcacctcggatatgccgctgaggggcaggcgttttgcagcgtacccttgacaaacactttagggggccctcagtatcgcccacaaccacaaaccttgcattttgaggtgggaagagccccttctgctatggtggaaagggagagatttgatcatatagaggagaggctgagggctattgaaggaggcggagattatgcctttgctgacatggcagaactatgcctagtgcccgacgtcgttatccctccgaagttcaaggtgccaaatttcgataaatacaaggggactacttgccccaagaatcacctaaagatgtacaacaggaaaatgggtgcatacttgaaaaatgaaaattattga

SEQ ID NO: 89965 - DNA, 862 bp, Glycine max
  Peptide Sequence Number=SeqID_206743
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatagcaggccgcgtggaagagggactacgtctgcggagacagcgctggaggcttcctttgaacgggcccgcgacagtgcggccgaggaacgcgcattcttcaagcgactgatggatgcgatcgtgtacgtgcatgcgcccatctcggacgacgcgcagacactgcggctggtccagttccgccatcctgacggtttcgatgcgatccctttctttacctcgctcgacaaggcgcaggcggccagctcgtctgctgtcagaattctgggagtttcaggccgtgagctgctaaccggtactcgcggcgcgacgttgatgctcaatcccaactacggcggcgttgtcctgtacccggaagaggttgcgacattgttggatacgggctttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 89966 - DNA, 816 bp, Glycine max
  Peptide Sequence Number=SeqID_206744
atgaagcacttcactgacaccctcatcagtgccaacataggaacaaaagctggtaccgggccccccctcgaggtcgacggtatcgataagcttgataaagcccgtatccaacaatgtcgcaacctcttccgggtacaggacaacgccgccgtagttgggattgagcatcaacgtcgcgccgcgagtaccgcagacgagctggccgcctgcgccttgtcgagcgaggtaaagaaagggatcgcatcgaaaccgtcaggatggcggaactggaccagccgcagtgtctgcgcgtcgtccgagatgggcgcatgcacgtacacgatcgcatccatcagtcgcttgaagaatgcgcgttcctcggccgcactgtcgcgggcccgttcaaaggaagcctccagcgctgtctccgcagacgtagtccctcttccacgcggcctgctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 89967 - DNA, 240 bp, Glycine max
  Peptide Sequence Number=SeqID_206745
atgcttcaggaccgcgctgatgagtggaaggattacggcatcctcatccccacagatctcataccgtcggattccgtgatctggctgcgcaagggtgaaagcgacacgcaggcggctctcgacaagatcgtcaaggaattgcacgcttccggcaagatgctggaattcgctaaggcaaaccgtctgccgagcatcggctatatggaagaacagcagaagaagctgtccgccgcgcagtaa

SEQ ID NO: 89968 - DNA, 981 bp, Glycine max
  Peptide Sequence Number=SeqID_206746
aggactacacgtcctcccttcagaggactacacgtccttgccatcggagggctacacgtcctcaccttcagagagctacacgccctcgccttcagaggtctgcacgccctcgcctttagaggactacacatccttggcttcagaggactacacgtccttgcctttagagggctacacgccctcgccttcagaggactacacgtcctctccttcagagggctacacgccctcaccttcagaggactacacgtcctcgccctcagagggctgcacgccatcgccttcagaggactgcatgccctcccctttagaggactacacgtcttcgcctttagagggatgcacgtcgtcgcattcaaaggattacacatgttcgccttcagagggctgcacgccctcaccttcagaggactacacgtcctcactttcaaaggactacacgtcctaactttcagaggactccacgtcctcgccctcagagggctacacgtcctcgccttcagaggacttcatatcctcgccttcagagggctacaagccctcgccttcagaagactacacattctcgcctttagagcgctacacaccctcgctttcagaggactacacgtcctcgccttcaaaggactacacgtcctcgtcttcagagggctacacgccctcgcctttagaggaccagacgtcctcaccttcagagggctacgcgccttcaccttcaaaggagtacacgtcttcgccctcagagggttgcacgccatcgccttcagaggatatcatgtcctcccttcagaggactacacgtcttcaccatcagagggctacacatcgtcaccattagagggctacacgccctcacctttagaggacgacacgtcctcgccttcagaggactacacgtcctccccatcagaggactacacgtcctcgccatcggagggctacacgtcctcaccttcagagggctacacgccctcgccttaa

SEQ ID NO: 89969 - DNA, 781 bp, Glycine max
  Peptide Sequence Number=SeqID_206747
ttgcgtcttcttcaacgcctgctgccggggcaacgatcgttgcgatcgtgaagtcacggtcggcgataacgggcgtgatgttcttcggcagcttgacgttcgagatgtgaacgctgtcgccgatcttcaggccggagaggtcaaccgtgatggcttccggaatgtcgttggccgggcagtggaattccaccgtgtggcgaacgatgttcagaacgccgccgatcttgatgtccgacttttcttcgttttcgaagtgaaccggaatttcgacgttgacgagcgtgttgcccgaaacgcgcaggaagtcgacatgcatggtgaagtcgcggaccggatcaagctggtaatccttcgggagaaccttgatcttcttgccgtcgacgtcgatcgtcgcaaccgtcgtcatgaaaccgccggcgtggatacgcttggtgacttcgttggtggacagggcgatagaaatgggggcctgcttgtcaccatagatgacagcgggaatcaaaccgttgcggcgaagttcacgagaggaccccttaccaactcgttcgcgcgcctcggccttgagctcatacgattctttgctcatggcaattcctttcgaggttatatggagagttcatgcccgcgggcgctgaactggggaggcggcaagcgccatcccacccgcgttgcctccaagggtgtctacacgggtgcgggcgctataatacaaacgggagacaaagacaagagaggcctgcttttcgatcgcacgccttgcgggtttattaggttgtactaa

SEQ ID NO: 89970 - DNA, 585 bp, Glycine max
  Peptide Sequence Number=SeqID_206748
ttcagagggctacacgccctcgccttcagaggactacacgtcctcgcctttagagggcttcacgccctctccttcaaagggcgacacgtcctcgccattagagggctacacgccctctccttcatagggctacatgccctcacctttagaggactacacgttctcgccttcagagggctacacgccctcgcctttagaggactacgcatcctcgccttcaaagggctgcacatcctcgccttcagaggactacacgtcctcgcctttagaggactacacgttctcaccttcagaggactacacgccctcacctttagagggctgcacgccctcgccttcagagagcgacacgtcctcgactttagagggctgcacaccctcgcctttagaggactacgtgtcctcactttcagtgggctccacatccgcaccttaagagaatttaagggatcgcgcccacaagacacccagtggacccggaggagtccaacagggccctggggtttccagctttggttacgggcctctatcagtcctatagggtgcccgtcccccccccagcaaggtcacgccatcgtgacatag

SEQ ID NO: 89971 - DNA, 955 bp, Glycine max
  Peptide Sequence Number=SeqID_206749
cgcgcggataatgcggcggcttttgcgtttgtccgaactggggcgcaggatctgaaacgccagcccggccagcagcacgccgacgattttagcgatgttgtcattgataaaggactggtagtcatagctcggcggattgctgatggtcaggaacgagcccataaagacgatcagctgcccccagagcgcggcataaggcggattctgcagcttgagcatctgcatggtcaccaggatcgggaacaggaaggcgcagaacacccagaagtcgtcaatctggatcatcaaaccgaatttcaccacaaagcaggcgaccgagagcagcagcaccgccttgagcaaggtgctgacgctgttgatcggcgaaggcgtggaagagtagagcacgcagctgatggcggtgagcgtcagcgccgcgctgccggcgtcccactgcgtgttgatccagtaggcgcagccgatcacgatgcacaaaaaggtgcgcaggccgttgtaggcggcttcgtagctgtcggtatggcgcgccagcgcagtgacgcgcggcggttggaggtcgctgaccgccgtggcgctttccaaccgccgcagccagcggttgcagcgcaggtaaagccaacagaaatcgcgcagccgcagccagaaggcgcgatggcggtagtccgtagcctcttgcggggcgatctgctgaagcaggcgcgccaaacggtatttgtcggtggcgggatcgcgcaactcgtccagcagttgtgtcagcaccggtatcagattggcggggcgatccggccatttcaccagcatgcggcgcaggctggagataacgctggtcatgcgcagctgttggtgcagcacatagttgagcaggttattttgccgccgcagccggtagtggctcctgaatgcctgaatgcgcagcatgttcatggtcaggatctggccgatgacttcttcgtgcgag

SEQ ID NO: 89972 - DNA, 393 bp, Glycine max
  Peptide Sequence Number=SeqID_206750
tcccagacaacaagtttccgaagcaagttagggttcgagggcacctgataaaatttgatattgattccctcaacacctttttggagactccagtggttgtggagcaatgggagagctttccttcttactctaggtttgctagactaaggcctgatctgcaggagcttgcagcccaattgtgtatccttgggaggggatttgttctgaatgtcgagggtctactgtggaagctcttgaggaaagatcttaccactctggcccaaacctggagtgctttaccttattctaacttggccccaacatcccatacttctgatcttaatctggatagggccaagttagtctacaggcttataatgaagatgaatatgaacttaggttcacttatttctg

SEQ ID NO: 89973 - DNA, 745 bp, Glycine max
  Peptide Sequence Number=SeqID_206751
tgttgggattccatataaggaagaagtgctaaggttttgcgatgaagtccatccacttgctcagtctataggagcagttaatactataataaggagaccaagagatggaaaacttgttggttataatacagattgtgaggctgcaattactgcaattgaggatgcactcattgagcatggttgcaatgatggtgaagcatctttaggttcaccccttgctggacgattgtttgtgctagttggtgcgggaggtgcagggaaagcactggcatttggtgctaaaagcagaggagctcgtctagtcatctttgacattgattttgatagagcaaaatctcttgcttgtgctgtatttggtgaagctcagcctttcaaagagttggtcaactttcagccagagaaaggggcaattcttgcgaatgcaacacctgtaggaatgcatcccaatacagacagaattcctgtggcagaggctactttggaagactaccggttagtctttgatgctgtgtatactccaagaagaaccagattgttgaacgaagcggatgctgcaggagcaataactgtggctggggtagaaatgttcctaaggcaggccattggtcagttcaatcttttcactggcctagaagctaaagaggtgttgcttgatattctagtcttaccaaagatcatgactatagcagataggacacgaatcactttggattggattggattggattggattagattagattga

SEQ ID NO: 89974 - DNA, 873 bp, Glycine max
  Peptide Sequence Number=SeqID_206752
atgggagggtgtttttctgatgtgaaaggagggaagcaagcggtgggagtgggagggaatggagcccacaacgacgccctggatttgttttacaagtctcatcaaatgttcacacaacttgagacactaaaactgggagatcaagacttccttggaatggccagttgcacgttatcagagattgtgactaaaccaagtaggagcttatcattaaggctcaaaaacaaaagtaggcatgatgttttgagaaacctaggggaaattactgttcatgctgaagagaccgttgcttcaaggagtgcagttgagatggtcttacgttgtactcacttggataacaaggactttttctctaaaagtgacccttttctaagaatatcaagaatggttgagactggaggttatgttcctatatgcaagactgaagttatcgacgacaatttaaatccaaaatggaaaccactttgtcttagtgtccagaaatttggaaataaagataatccattattgatcgagtgttttgatttcaatagcagcggcaatcatgatgcaaagcgtattgatgtcaaatttattgccatcagtaaaatgcagaagtcagtagcagaccttgaaaagctgtacaaagagagaacaggcgcaaattttgtcataccatccacacgccacagacaagagaaggttctgaagggtcaactgtttgtggatcaatattgcgtaaaagagcaaatcagttttattgactacatatctagtggttttgagctgaacttcatggttgctatagatctcacggcttcaaatggaaatcctcaccattcagattcgttgcattacattgatgcatatggccggttaaattcataccaaaag

SEQ ID NO: 89975 - DNA, 3204 bp, Glycine max
  Peptide Sequence Number=SeqID_206753
atggagtgcaacaaggatgaggctataagggctaggcagattgctgaaaataagatgcaagctggtgactttgaaggggggctgaaatttgctacgaaagcccaaaggctgtttcctgagattcagaacattcttcagatccttgctgtttgtgaggttcactgtgctgcacagaagaaacactctgggtctgacatggactggtatggaattcttaagattgaaaagtccgccgatgaagcaaccataaagaaacagtataggaagcttgcactgctacttcatcctgacaaaaataaatctgatggtgcagaggctgctttcaagttgattggtgaagctaacagagtgttgagtgaccaaacaaagcgtgctttgtatgacttaaagtttggagttcctgtgggaaatacagcagctaaggttccacctcgtcacccaaatggaaatgcttccgggatgggatgtgatggcactgcaagaaattatcagaacagtttttcttcacaataccaagcttggaattcatatcatcggactgataatcagacattctggacatgttgccctcattgtaatactagatatcaatatgtcataaccattttaaatcataccatacgctgtcaacattgttctaaatcctttacagctcatgatatggggaaccacaacgtgtcaccaggatattggtcaccatttaataaccagaaagagcctccaaaacatgcatcgtcaaaagaagcttcaaaaagcaatggtggaaagtcttctggtagagaacaggagggtgtatccatgtcaaaatgctctgctggtattggtacccattctaaagttgcaaagagaagagatagtcatgcggctgcaggagtgacaaaggctggtgttgggatgtccaatcccactaataccaaagccaaggaatcgcaagcctcaacaaaggttggacataagagagcaaggcagtcaacatcagatgatgataacaaagctgcaaatggtaaaggcgtgaaagatgctaaggttcaaaaaaatagggttgatcctaataggagatcttcaaggaaaaaacagcatgtttcgtacacagaaaatgataaagatggtgattttgggaattcttccaaaaggccaaggcaccatgaatccagtaacaacaatccagcctcttttactgacggtgtgggtggtcagaatggaaagataagaaataaagcaagtgcaccgcctgaagaaactgttttaaggaataagaccaaagttgagcagacaaatgtgctaagaaaggaggcatccaactcagatcttaatgatagaaagtcaaaagctgacaattgttctccactgaagtcaaatttacctcccagttcagagatttgctgtcctgatccagacttcagtgattttgagagagataaggcagagggttgttttgctgttaatcaattatgggccatttttgataatactgatagtatgccaagattctatgctctcgtcaagaaagtgtacttccctttcaagttgcggattacttggctggaacctgactcagatgaccaaggtgagattgactggcatgaagcaggcttgcctgttgcttgtggtaagttcaaacttggtcagtctcagagaacttcagaccgctttatgttctctcatcaggtgcattgcataaaaggaagtgacagtggtacttatctggtatatccaaagaagggagaaacttgggcaattttcagacattgggatcttggatggagttctgatccagaaaagcattcggagtatcaatttgaatatgtggaagttctatctgattttgatgaaaatgccggcattaaagttgcttatcttagcaaactgaaagggtttgttagtctcttccagcgaactgtgctaaacagaattagcttattttgtattttacctaatgagctttataagttctctcaccggattccttcatataagatgacaggtgctgaaaggcaagatgttccaagaggatcttttgaacttgatcctgctggtctgcctaatagtctttctgaagttggtgatcctggtgttgtgaagatggatggagtcaattgttcgcaccatgaatactcgaagtgtaaagttgaagaggcaatgtctaatgatagtattcacaaagcaaagttgcgagagagtattggttctgaaagagtagcacaaatcctcagaagatcaccaaggtcaagtcaaaaaagtatggacaatggtcaagcaaacactagtcaatatacagtcagaaaggatgacataaacattggccacagggatgacagtccaccagagggaaacactgctgcatttcagactattaagaggaaggtcaagacacctcagaaacatgagaaaaataattatgaaggagaggcattgaaagcccgaaagtcacctagagatttaagcaagaaaaatgctcaaggagatgcaggtgaatggacagcaggcaagaagactgataaccattcaagcaacagcaaaaatgtgaaggtcagcaatattcctcagtcagtgggagcatcatgttatggctttaagaaggaaaaatctgaagagatgtttcagtgtggtcagatatgggcaatatatggtgatagggatcatatgcctgatacttatgctcaaattaggatgattgaatgcactcctaattttagattgcaggtgtacatgcttgaaccctgcccaccaccaaatgacttaaaaagaacaatatcttgtggcaccttttcagttaaagaagccaaattacggatgctttctctctctgcattctctcatcaattaaaagctgaacttgtggcaaataatagatatgaaatttatcctagaaaatgtgagatttgggctctatacaaggaccagaactatgaactgacttcttcaaatcagggcagaggtgaatgtcatatagtagaagtattagctgatagttaccagagtatccaagttgttgttctagtgccgcatggcaactctgggacaattttcaaggctcctagaatccagagatctaaaactggtgtaattgaaatattaagaaaagaggttggcagattttcacatcagattcctgcttttcagcacagcgacaatgttcatctcagagggtgttgggagcttgatccttcatcagttcctggttctttcataccaatagactga

SEQ ID NO: 89976 - DNA, 2529 bp, Glycine max
  Peptide Sequence Number=SeqID_206754
atggatgtttcagagggggaagaggatagctataaatattatggatgggtactggaaattgttttcactttcctcatgtcaattatagtgtttcagattatgatccccatatccttgtacatttccatggagcttgtccgtgttggtcaggcatacttcatgatccgagactcgagaatgtatgataaggcgacagattcaggatttcagtgcagggctttgaatattaatgaagatttgggccaaattaaatatgtcttttctgacaaaactggtacactgactgagaacaagatggagtttcaatgcgcgagcatcttggggtttgattacagttctgcaaaaatgggtcctgagaatgagcaagttgaatactctgttcaagaggatgggaaggtctttaagccaaagatgagggtgaaaattaaccaagagcttttgcaattatcaaaaattggatttgcaaatagagaggggaaacagatttatgatttctttctagctttggcagcctgcaataccattgtgcctcttgttgttgacacatctgaccctatggtcaagctaatagattaccaaggggaatcaccagatgaacaagcgttagcttatgctgctgctgcctatggtttcatgcttattgaacgaacctccggtcacatagtcgttgatattcatggagaaaaacaaaggttcaatgtcttaggtttgcatgaatttgatagtgaccgaaaaaggatgtcggttatattagggtacaataacaattctgtgaaactttttgttaaaggggcagatacatcgatgcttagtgtgatagacaaatcattgaacacagacatactgcaagcaactgaaacccatcttcactcttattcctctgtgggttttaggacacttgttattggggtgagggacttggatgcttcagaatttgagcaatggcactctgcctttgaggcagcaagtactgctttgattggtagggctgccatgcttcgcaaggttgctatcaatgcagagaacaatctctgcatattgggcgcaactgctattgaagataaactgcagcaaggtgtgccagaatccattgagtctctaaggactgcaggtattaaagtatgggtcttaactggggacaaacagcaaactgccatatcaattggatactcctcgaagctccttacgagcaacatgaatctaattacaattaataccaacaatagagagtcatgtagaagacgtttgcaagacgcccttgtcatgtctagaaaagacatgactgtgcctggggttagtcacaattctgaaggaagatcagatgctgtttcaactccattagccttgattattgatggtaccagccttgtttatattcttgacagtgagcttgaagaagagctctttcaactagcaaatagatgttctgttgttctctgttgccgagtagctccactgcagaaggctgggattgtagcccttgtgaagaataggactgatgacatgacactagccattggagatggtgctaatgacgtatcaatgatccaaatggctcatgttggagttggaatcagtggacaggagggtcggcaagctgtaatggcttcagattttgcaatggggcagtttaggtttttagttcctctcttgttgatacatgggcattggaattaccaacgattgggctacatgataatatacaacttctacagaaatgctatctttgttcttgtccttttttggtatgtgctctttactgctttcactttgacaactgctataaatgaatggagcagcgtgttatattcaataatctactctgcatttccaactattgttgttggtattcttgacaaggatcttagtaaaaggacactcctaaagtatcctcagctttatggggctgggctgagacaggaggcctacaacaaaaagttgttttggttagcaatggctgatactttgtggcaaagcattgctgtcttctttactcccctaatcgcatattgggaaaccactgtagatgtaacaagcataggagatctttggactctttcagtggttattttggttaatttgcacttggccatggatgtcatcaggtggaattggattactcatgcagccatttggggctctatagttgcaactttcatttgtgtcattattattgatgccataccagcccttcctggttactgtttccaagaaactttaaccaatagtacagggtgtgttagaagcagtgtaatagagagtgtgttgctagcactcctctatgttctaagccttggagacaagaccatggctatctttcatgccgcaggcactggattgttctggttatgtttgctcggaactgtgatagctgcgttacttcctcgattagttgtaaaatatatgtatcagtattattttcccagcgacattcagatttcgagagaaactgagaagtttgggaatccaagagacaatggaggtggacagatagaaatgctgcctgtttcagatggtccaccaagataa

SEQ ID NO: 89977 - DNA, 1269 bp, Glycine max
  Peptide Sequence Number=SeqID_206755
atgacgctaaaactgggagatcaagaattccttggaatgaccagttgcactttatcagagattgcgactaaaccaagtaaaagcttatcgttaaggctccaaaacaaaagcgggcatggtggtttaataagaaacctaggggaaattactgttcatgctgaagagactgttgcttcaaagagtgcagttgagatggtcttgcgttgttctcacttggataacaaggatgtcttttctaaaagtgacccttttctaagaatatcaagaatggttgagagtggaggttatattcctatatgcaagactgaagttatcgacgacaatttaaatccaaaatggaaatcagtttgtcttggtgcccacaagtttggaagtaaagataatccattagtgatcgagtgttttgatttcaatagcagcggcgatcatgttctgaagggtcaactatttgtggatcaatattgcgaaaaggaacaattcagttttattgactacatatctagtggttttgaactgaacttcatggttgctgtagatttcactgcttcaaatggaaatcctcagcattcagattctttgcattatattgatgcatatggtcggttaaattcataccaaaaggctataatggaggttggagaagttattcagttttatgattctgataggcagtttcctgcttggggatttggaggaaagatacctggtggtactgtatcccactgttttaatctaaatgggaatccaggtgcatctgaggttgtaggagttgaaggcataatggatgcttatgtcagtgctttaagcagtgtcactctctcaggacccactttatttggcccagttatcaacatggctgcacaaacggctgcacagtcccttacatcagttaacagcactaagtattatgtgttgcttatcataacggatggagttgttacggatcttcaagaaacaataaatgctctggttaaagcatctgaccttcccctgtcgattcttatagttggagtgggaagtgctgatttcacgagcatggaggtgctggatgctgataatgggcgtcagttggagagttctactggtcgtgtagctacaagagatatggtacaatttgtccctatgagagaagtacaaagtgggcagatatccgttgtgcaagttcttttggaagaactacctgatcagtttttgtcttttatgcgaagtaggggcattagcccattgccttcccatttcccaaaagcatccacttccaccatgcaatag

SEQ ID NO: 89978 - DNA, 1041 bp, Glycine max
  Peptide Sequence Number=SeqID_206756
atgggcgtagagtggttattggtgtgccatggcttggtcactgcggtggtcgttgtctctttcctctgcggtcgatggccaatctttgaaggcactttcattcaacgcattcactacttcctcactttcggcgcctacgattacttcctgcgtttcgttggcgctgttttcggtcctaagtgtacggattcggttctctccgtcgaatattactgctgcgatcgtcccaatcctcttctgcagattatatatattgtgataattggtgtaacatattatttcgttgcgaagtcttgctttgcctatatccctggatactatctaagtggaattcacaggtacacaagcttcttggcagttgctgttggaattctgctctttcttttgaccagcttttctgatccggggacaataaacactgagaatagaaagaatgttcaacttgcaaaattccaaaacctgctaggtcaaaacactgcagcatttgtgatcgctgtgttgcacgatttgatcatcactgtggatggatggcatttccttatatgcttgtatggaacagttgccattgtcttggttcttgctggaagactaagagaattaagagttgttgatattctaaccgtttattatggaatagaaaattcttttctggatttagctcctaatgttgtgcagtggttgttgggatcttacaacacccagatacttcttatggtgttccttgcaatcgttgggatgctgttagctggtttctttggttaccatgcaaagctttgccttaccaacactaccactaatgagacttttaagtggcaagattacatggactggcaaaggaagctaaaagaagcaaaggtcagtgctgaagccctgaaacaaagtatcggtggaatgagcggtgagaaacagcccttgttgagcaaatgcagagccttctttcgaaaatcacctctagaagatgtggtagtagttaagaataatgtttacgataaaggtttcttcctcaatattcaggagatcttggtggctagttgcacataa

SEQ ID NO: 89979 - DNA, 1096 bp, Glycine max
  misc_feature (87)..(87): n is a, c, g, or t
  Peptide Sequence Number=SeqID_206757
atcattgaagcgattgaagaccacgttgccggcggcgtggaggacggtaacagcatcaggcgtaacggctataccaacgatgatcanccggtggtacgcgggcaggcggaagccaacgcgctgatttatctctatgatggcaaccaacttctcgcctctgtgcgtgccgatgcgcagggcaactggcaggcgcagctcgatctgccgcaggacggaacctataacctgacggcgcaggccgaggaccgcgccgacaaccgcagtcagccgtcgccgaagtggacttttcatctcgatacgcttaccccggaaacgccgatgttcagctattacgacgacaatcgcgggctgtatcagggccagtttggccgcggcaaacccaccgatgatgtccggccggaactgcacggtgaagccgagcccggcagcgtggtgcgcattcagtatgccgcaccgggcggaaagtgggttgtcggcggtacggccaccgtcgacagcagcggccactggcactggacaccgccgcaggatctgctgccggacggcgactggcgttttcgcagccgcagcagcgataaagccggcaacgtcagtcaatggagcgacagctggacgctgaccatcgacacccgtatcaacacgcccgccatcctgcaggctatcgatgacgtcggcaccatccagccggtgctgccgggccagaccaccgacgataagcggctcgatttttccggacaggccgagccttacagtcaggtgacgctgtaccagaacggcgtggcagctggcagcgcgacggtgggggccgatggtcgctggcagattaccccggaccgcgacatgcagccgggcagcaacaactttacggtaaaagcggtcgatgtggcgggtaacgtcagtgactatgcgcccaactgggcgattaactatgactctggcgtaaagcacagttctggtgaagagaactggaactgccgtgccaataccagctggcaaaccggccgggtgtatcagtacggcgggttgaaagtcaccgaactgaaacatggcaccagcaacaactgtttctataccggcatcatgaaccggccggatg

SEQ ID NO: 89980 - DNA, 453 bp, Glycine max
  Peptide Sequence Number=SeqID_206758
atgtatggtgtgtctcagttgcagagacagttggctcaatacacttcttccctgtttgaagagggtttcctagatgatcaatttaaccagcttcagcaacttcaagatgaaagcaacccagagtttgtggttgaagttgtgactcttttctttgaggatgcagagaggcttcttaatgagctggcaaaggcactaggccaggaaaacattgattttaaaagggtggaagctcatgttcgccaattgaaaggtagcagctccagcattggcgcacaaagagttcagaaagtttgcattgccttccgaaactactgtgaggagaaaaatgttgaagggtgccttaaaagtttacaggaaataaaacaggagtgttccttggtgaaaagcaagtttgaaactctcttcaagatggagcagcagctttttgccgcaggggggtcggttactaggtag

SEQ ID NO: 89981 - DNA, 210 bp, Glycine max
  Peptide Sequence Number=SeqID_206759
atggatgcgttctccctccacctcaccctccaccacgacctcctcccccttcccccttctagaactccgttgcagcctcctttcccaacgctgatcttaagggttcttgtgcaagaacccattctccatgctggagatatgcccaactcctttattgggagatcttatgaagaccggatcttgagcttaaaattcttgttgaaaatctga

SEQ ID NO: 89982 - DNA, 1304 bp, Glycine max
  Peptide Sequence Number=SeqID_206760
aatggactgaagaatcaactaacaatgaagtagatgttcctttgaatgaagtatctaacaaactgattgatccacacaaatatggttatggtactccaaacttgaataaaaatactacactgaaactggtgcctaaagtagttcataggactaatgaacacaggaatgctaaaagagaaattgatcatcaagaaaaagttttcaagaagccagacaaggtcctgccatgtcctcgttgcaatagtttggaaacaaagttttgctacttcaacaattacaatgttaaccaacctaggcatttctgcaaaaattgccaaaggtattggaccgctggggggacgattagaaacattcctgttgggactggcaagcgtaagaataagcactcggctcagtattgtcagatacctatgactcctgatgctgcatctgtgatccagacagattctaaacctgctagtgatatgcttctcttatctaatgaacttcctgtgacttcaagacctatcaaaggaggggaggaaactcctcttagtgaatctttagaaactgtgttaagtctcaatggcctgacaaagattgaagtggactcctccactctcaaagatgatgatgatgaggagccttccagctcttctatgagatctagtgaaatagagcagcttggtttgccacaacactctaatggtttagttcctttacattcatttcattattatcatgttccttcatggccttaccaatggaatccatgttggaatgtcaaggagtttaggcctagtaacatcagttctagagctgtttacaccgattcttcaactatgatggcagttcctggcttctccataccaacagtaatacttccaggggtgccttattcgtatttgggttttatgtcaagctgggctgagcaaaaagaagaggcttcattggttggatctgcatttagtggcatctcattgtcttcatgttcagttagcaacagcacttgttcgggtaataggtccccaaccttgggaaaacatcctagagatggaagtacaccgggggaagatgcaatgaaacagaatctttgggtgcctaagactgtaagaattaatgacccagaagaggcagcaaatagttctatatggtcaactttggggacaaagtctgaacagaacaaattcattatgaaaggaagtgtttttaaatcatttgaaccaaagtcacaggccagtcctcatattttagatgataatcaaattctaagggctaaccctgctgctttctcgcgctctgaatcttttcaggaaagaatgtaa

SEQ ID NO: 89983 - DNA, 2196 bp, Glycine max
  Peptide Sequence Number=SeqID_206761
atggcatcaaaaccagtttccctttcacatttactccttttaaccttgtttcttgccaccatccaactctcagagcagttagagttttctcagtctcaaacactactcaaggttcagcaacttcttggctatccatcagcactaggtactctcagcagcaccacagacttttgcaacattgaacctacctcatatttgacactagtctgctatgaggatagcttgacacagctgcatgttgttggcaacaatgagtataatccactgcctcaaaacttctcctcagatactctatttgctacactaggcactctttcaagcttgaaagtcatttccttagtttctcttggactctgggggaacttacctgaaagcattgctcaaatgtcttcattggaaatacttaacattacctcaaaccacttcagtggagccatcccttctcagctttcacttctgaggaaccttcagtcagtggtgcttgatgataacaacttcaatggtgaggttcccaactgggtaggctcacttcaaggtttggctatgcttagtatgaggaacaactggcttagtgggagcctgccaacttcattgaatgctcttcataccttgagggtgttagatctatcaaataatcagttatctggggaacttcctcatcttaagaatttgccaaaccttcaagttcttaacttggaaaacaacacatttggacctcattttccttctctccccaccaagttggtttcccttgtgcttagaaataatagcttcaggttaagtgtcccttctaatttaagttcattctatctgctccaaaggctagacctttcattgaatggttttgtggggccatttccaccatccttattgtctctgccttccatcaattaccttgatatttcctcaaataaattcactggcatgcttctcaataacttgtcatgcaatgatgatctccactttgtaaatttgtcttcaaatcttctgaaaggggaacttcccacttgtttagaaccaaagaccagggttgttctgtatgctagaaactgcttatcaaacaagaaccaagatcagcacccttcagatttctgcagcaatgaggctttggcagtgacgatcataacccatcaacagaagcacaagagaacaactagtaaagcaattattgtatctagtatgggaggtcttgttggtggagtgttgattgtaggagtggtcatcttggttgttagccgagttcataagaaacaagtagtgaaaataccttcaaagtctactttggagcatgctatcagtcaggaacataatgaagatgaagtgaaaactactacaaggtccataatggagcatatcatcaaaagggttcctgacaaacgtgctgtggaaacactaacaagatccataaaggagcatgtcatgagccgggtgaatagcaagcgtgttgtgagggcatcaacaaggtccataatagaacatgtatcatcagcaaacacagcaaaacttctcaatgatgcaaggtatatatcagaaacaatgaagatgggagccagccttcctgcttataggacctttgctttggaggaacttaaggaagctacaaacaattttgatgaatcatctttcataagtgaaggcccacgtggtcagatttataaaggggtgctttctgatggaatgcaaattgctattagaggtttgaaaatgagaaagaaacatggccctcagacttacatgcaccatgttgagatgatttcaaaactaaggcatccacacttggttagtgcacttgggcatgcttttgagagcaaccaagatgattcaagtgtaaacaatagaataacagctgcaattggagtggtgaaaggcattcaatttttgcacacagggatagtgcctggactgtattcaaataatctgaagataacagatattcttttggataacaatcacaatgttaaaataagcagttataatctgccactctctgctgaaaataaaagaatgatcagcaatggaacttcccctggctttaaaggaaatgtccaagcaaggatcaaggatgaagacaagaatgatgtctatgacattggggtaatcttgctagaaatcattctgggacgaccaataatgttccacaatgaagttggaacactaaaagatcttgtgagtattaccttcaagtttcatgcttaa

SEQ ID NO: 89984 - DNA, 438 bp, Glycine max
  Peptide Sequence Number=SeqID_206762
atggtcccaattgaccccgctttcaacgacaagcacaaaaaacgaggcattgtgtatacttgccctgcttctgtttctgcccaagatttgggagaatttgatttggagaaagagaaaagtgtggtaactctaaaagaacttttagaagactgcattagagatactgacaactctcaacaactatctgaattggctgttagttgtccaagcttaaggacacagttttattggagcaagtttttgaaactatggaaaagaagatcttttaagcacctaccatcttttcctccgagttgtgtgccaaacataacaaagactaaaaacagaaccattcaagaaatttctgttgtatgtaattcatactgttccagaactttgatgaattttagtctcgataacctgagaaatgcaaccaacaattttagcaatggtttgtag

SEQ ID NO: 89985 - DNA, 126 bp, Glycine max
  Peptide Sequence Number=SeqID_206763
atggaacatgaactacccagaaagaagaatcaatctttgcttatgtcatctggttgtggagttgtggtaaagcctccgcaactagttgtgctcgtagacttaacccccactgggagtgtgacataa

SEQ ID NO: 89986 - DNA, 549 bp, Glycine max
  Peptide Sequence Number=SeqID_206764
atgaagagagtggtggatgaggtcatcaaggcttatggacgcattgacattctggtcaacaatgcagccgtgcagtacgagagtgattccctggaagagattgatgatgcaacacttcaaatggtgttccgaactaatatcttctcctatttcttcatgaccaagcatggcttgaagcacatgaaggaaggaagcagcattatcaacacaacatcagtgactgcatataagggttatgcaacactggtggactacgcatcgacaaaaggtgccatattggggtttactcggtccctagcacttcagctggtgagcaagggaataagagtgaacggggttgcacctggacccatctggactccattacaagtagcaagctttagggaggaagaaattgttcgatttggttcggatgtgacgccaatgaagagagctgggcagcctattgaggttgctccctcttatgtctttcttgcaagcaaccaatgctcctcttacgtaactggccaagtcctccaccctaacggtggaatcattgtgaatgcttga

SEQ ID NO: 89987 - DNA, 1488 bp, Glycine max
  Peptide Sequence Number=SeqID_206765
atggacaacaaaaccgatttttcaactcctcttctccccacaagctacggtcccgttgactctcaggggaaaggccataccggaccttcttcttcttcttctttttcttccataccaactactcttatactcactaccctcgtcgctgtttttggttcttacgtttttggctccgctattgggtattcatcacctactcaatctagaatcatgcttgacctcaatctcggagtcgcccagtactcaatttttggttcaatattgacgattggagcgatgattggtgccgttgtgagtggtagaatagcagattatgctggtcgtcgagttgccatgggattctcccaggttttctgcatcttgggatggcttgccataacattctcaaaggttgcttggtggctttatgttggaagactgttggtaggatgtgggattggccttctatcttatgtggtaccagtttatgtagcagaaataacacccaagaatcttcgaggggcattcactgcagttcatcagttaatgatttgttgtgggatgtcattgacttatcttattggagcatatgtgaattggcggatcttggctacaataggaattattccgtgtcttgtgcaacttctgagtcttcccttcatccctgattctcctaggtggctggctaaggttggtcgcttgaaagagagtgattctgctttacagcgcctcagggggaagaatgccgatttttatcaagaggccactgaaatcagagattatacagaagcctttcagaagcaaacagaagctagcatcattggcttatttcaaatacaatatttgaagtcacttaccctccttttctatgctttcatccattgtatgacaagtaataaaatgaatatgagaatatcagatttcacacaaaaacaaaaactcttatccatgacagggttttcagaaagtatcggaacaatagcaatcgttgccgttaagattccaatgacaactataggagtacttttaatggataaatctggaagacgaccacttttgctggtgtctgcagtgggaacatgcgtaggatgcttcctggcagccttgtcattcattttgcaggttcttttaataacagaatctgatctagacttacataagtggaaaggagttagtccaattttggcactagtgggtgtactggtatacgtgggatcttactctataggtatgggagcaattccgtgggttataatgtcagagatatttcccatcaacgtgaagggttctgctggaagccttgtgactttggttagctggctgtgttcttggattatatcatattcttttaacttcctcatgagttggagttcagcaggaactttcttaatgttctctagcatatgtggcttcactgtgctattcgtagcaaaactagtaccagagaccaaggggcgtacactagaagaaattcaagcttctttgaactcattttcttctaagagatag

SEQ ID NO: 89988 - DNA, 654 bp, Glycine max
  Peptide Sequence Number=SeqID_206766
atgaccggctccattgtaagcggtaaaatagcagattatgcaggtcgccgagttaccatgggtttctcagagcttctgactctcccctttatccctgattctcccaggtggctgagtcagcacatctcattagataaacctagcacaagtgataaatgtaatcttctgctggctaaggattatacagaagcccttcagcaccagacagaagctagcattattggcttatttcaatcacagtatttaaaaacacttactgtgagcattctaatttctaaattaaccccattcgtgcagcctatcttaaccttttgcaggctcttatggaaattagttacttggttaggttggagtaggcttgatgatactgcaacaatttggaggggcttttgggatagtcttggaacgatagcaacggttgctgttaaggtcccattgacaactttaggagtgcttttgatggataaatgtggaagacggccacttttactggcttgcctgatacaggatttacataaatggaatggaatcagtcccattatggcgcttgttggtgtagtggtgtatatgggatctttctcgctaggcttggcaggaattccgtgggtaataatgtctgagatattttccattaatgcgaagggctctgcttga

SEQ ID NO: 89989 - DNA, 543 bp, Glycine max
  Peptide Sequence Number=SeqID_206767
atgtcgagaagaaaggttagagagccaaaagaagaaaacgtgactctgggcccagctgttagagatggcgaacatgtctttggcgtcgctcgcatctttgcctccttcaatgataccttcattcatgtcactgatctgtccgggagggaaacacttgtacgcatcacaggtggaatgaaggttaaggctgacagggatgaatcgtctccctatgctgctatgcttgctgcacaggacgttgctgccagatgcaaggtcatgctatgtgaaatcattgtagtatatgttgttattttctgtgaagttgtcaagcttaatgcactgtttcaaattattgtggagcaggaactgggcataactgctcttcatatcaagctccgtgcgacgggtggaaacaagacaaaaacacctggtcctggtgctcaatcagctcttcgtgcccttgctcgctctggaatgaaaattggccgcatagaggatgtgacccccattccttccgatagcacacgtagaaagagtggtagaaggggtagaaggctttaa

SEQ ID NO: 89990 - DNA, 190 bp, Glycine max
  Peptide Sequence Number=SeqID_206768
aatacaacagccgtgtgcaactttagagggtgctactgtcattttcacctacgtgaagggggcaagaggacagggaagcgagtgcacgcttgagattataaaaaaggctaaggctgaagatgccaaagatccattggctatacctgttcatgatttgggttatgaagagaattgcaagagtggtggatga

SEQ ID NO: 89991 - DNA, 177 bp, Glycine max
  Peptide Sequence Number=SeqID_206769
atggcttcaattggagaacaggaactgaagttgatgggtaagcaagaaaaatcaagtgcaattaaatactgtgagaggatgttcacaagaaaagggcaggaacaaccaaagttgctggagtctgcaactgcaaccaaagatgtcggagcttgtaggattgtccctaaagatgtttaa

SEQ ID NO: 89992 - DNA, 420 bp, Glycine max
  Peptide Sequence Number=SeqID_206770
atggctctcattcttctcctcttcgccatggctctaagcgaacctctcaccctcacccccgtccaagactctcccctcttcgattgccatcgcctcgatcaacaattcctccacactctcgcttacgatgccctagtttggagccctctccacggcctccttgtcggcgacaaatccgttcagagatcgggaagcgttcctggggttggtttggtgcatgcgccgcttgccttgttacccacgccatttccggaaaagcagtgtagagaagcgactgagttggatgcaaagtttctgcaggaatcgctctcaaggttaattacctggttgtttctcaatgctgaactaaaaacacggatgagtacaaaagtaagaggtgaactcatccccgttcttaattttgcattgagaaacaaatag

SEQ ID NO: 89993 - DNA, 561 bp, Glycine max
  Peptide Sequence Number=SeqID_206771
atggctccgcctcttgggaagagtgccgcattcgagagcaggacttgtgcaatttccaggtcatcaacgaaactcgccaacgcttcggaagattcttctttcgccgacgtcttcgatcgcgtttccagtttccttgaatctctgtggagggacgttgacatgaacaggcttaaccatcatccttctgatgatctggatttgataattgtgtcacatgggctggcatctcgtgttttccttatgaagtggttcaagtggacagttgaacagtttgagcttctgaacaattttggaaatggtgagttccgggtgatacagttgggagtggtggagattggagaatacagcttggcagttcatcacacggacgaagaactgcttgaatgggggctctctcctgatatggtagctgatcagaaacggcgagccagtgccggcaagggtgactggaatgatcaatattcctggtaccttgatgcttttttttatcaccttcctgactctgatgatgagaatgtggacaaacatgacgagacagattctttgagtgaatgttcatag

SEQ ID NO: 89994 - DNA, 510 bp, Glycine max
  Peptide Sequence Number=SeqID_206772
atgagggtgtggagggttcacccacaagagcaaaagctttgtccaaatggtgttttgaggtgggttttggtttggatgagtgtttgttttcttgtgttcacggttggtccaccgtctcgctcgagggtgaggaagagtgtatcttctcaactttcttgtcctccatgtgattgtttctgctcttcagctgaatatctcctcgatcctctagattgtggtaaacatgatccgattttgaatgaggaaatgaacaagggtctactgacaatgctatctgaggagctaaatttgcagaaaattgtggccaacgagaccatggaacacaccaaacagttaataatggatgccaggaaaaccttttcacattaccagaaggaagcagaaaagtgcaacattggggtggaaacttgtgaagaagcaagggagagggcagaggcagagctcattgaagaacacaagctgacaacattatgggaaaatcgtgcaagtgaatatgggtgggtggaatga

SEQ ID NO: 89995 - DNA, 1572 bp, Glycine max
  Peptide Sequence Number=SeqID_206773
atgggtagtagatctggcggcttggtttgttctacttgttcttacactgggattaggacgagacgtttctacactaacaataatacctttccctctttctcctttaccttcccccaccaacctcaatcattctctttccctaaacctctcagactcatgtctcagcctttgaccaccaactctgctgatggtgattcctccgtcgccgcacctcccatcctcttcgattatcatcttatcgaccaaaaacttctccaaaacatagtctacgatgctcttgtctggagcaccctcaactgcctccttgttggtgacaaatcagttcagagatcaggaacagttcctggtgttggcctggtgcatctcccgctttctttattacctgggccatttcctgaaaatcattggaagcaagcgtgcgaattagctcctatatttaatgaacttgttgatcgggtgagtttggatgggaaatttctccaggaatctctctccagaactaagaatgcggacgaatttacctcaagacttttagatattcattctaagatgctacagattaacaaaaaagaggacatacgcatgggaatagttcgttcagattatatgattgatgagaagactaaatcacttttgcaaatagagatgaacacgatttccacttcatttgctttgattggttgccttatgactggacttcataagagcttactttctcaatatggaaagttccttggactagattccaatagggttcctgccaataatgctgttgatcagtctgcagaggccttggctaaagcttggagtgaatataacaatcccagggacggacaagaaatttcagttgtttacttccgggctggctacacaccaaaggactatccttcagaatcagaatggagagctaggctactgatggaacaatcttctgctatcaaatgccctactatatcttatcatttggttggcaccaaaaagattcaacaggaacttgcaaagcctggtgttcttgagagcttgggatcatggagtatttgttatcagaagcttgtgttatctaaaggcataaaaacttcgtaccccattgcccagaggctcttcgctatgcgaaggtttgtagaaaacaaagaccacattgccaaattgcgtgcatgctttgcaggattgtggagtttggaagactcggatattgctaaaaaagcaattgaaaatccagagttatttgtgatgaagcctcaaagagaaggaggaggaaacaatatttatggtgatgagttgagggaaaccctccttaaattacaggaagcaggttctgaagaagatgcagcatacatccttatgcagaggatatttccagccacttctccagcaattttggtgcgtgatggtaattgggatatgggtcatgtcatttcagaagctggagtatttggtacttatttaaggaataaggataaggttatcattaataacgaaagtggctatatggtgcgtacaaaaatatcatcatcttatgaaggtggagttttgcctggttttggagtggtagatactgtatacctaacttga

SEQ ID NO: 89996 - DNA, 1485 bp, Glycine max
  Peptide Sequence Number=SeqID_206774
atggacgaaactaaaagcacagaaccaagtgaattttcaagtcctctgcttcccataggagcacaagggtatggtggcaaccatggcaatgactatgaggaaaagaggcagaaagaaacttggtcggtaccacctattcttatacttaccactcttgttgctgtctctggttcttacgtttttgggtcggctgtgggatattcatctcctgctcagactggaatcatggatgatctcaatgttggtgtggccgagtattcactttttggatcaatactgacaattggagcaatgataggtgccattataagtggtagaatagcggattatgcaggtcgacgaacagctatggggttctctgaagtattctgcatcttgggatggcttgccatagcattcgcaaaggttggttggtggctttatgttggaagattgtttgtgggatgtgggatgggccttctatcctatgtggtacctatttatatagctgaaataacacccaagaatcttcgagggggattcaccacggttcatcagttaatgatttgttgcggggtatcattaacttatcttgttggagcattcttgaattggcggattttggctctattaggaattattccatgtattgtgcaacttttgggtctattcttcattcctgagtctcctaggtggctggcaaaatttggtcactgggaaaggagtgaatctgtattacagcgccttagaggaaaaaatgctgatgtttctcaagaggccactgaaattagagattttacagaagcccttcagagggaaacagaaagcattattggcttatttcaattgcagtatttgaagtcacttactgtaggagttggtctgatgatactacaacagtttggaggggttaacggcattgctttttatgcaagttctatattcatctctgctggcaaaaaattcttatccatcacagggttttcgggaagtattggaatgatagcaatggttgctgttcagatcccaatgacagctttgggagtacttttgatggataaatctgggagacgaccacttctgctgatctctgcatcgggaacatgcttaggatgcttccttgcagccctatcattcaccttacaggacctacataaatggaaggaaggaagtcccattctcgcgcttgctggtgtactggtatatacaggatcattctctcttggcatggggggaatcccctgggttataatgtctgagatatttcccattaatgtgaagggctctgctggaagtcttgtgactttggttagctggttgtgttcttggattgtatcatatgcttttaacttcctcatgagttggagttccgcgggaacctttttcatattctctagcatatgtggcttcaccattctattcgtggcaaaactagtaccagagacgaaggggcgaactctagaagaagttcaagcatctctgaatccatattcaacaaagacatga

SEQ ID NO: 89997 - DNA, 831 bp, Glycine max
  Peptide Sequence Number=SeqID_206775
atgatcaaattgttcaagaggaacaccaccaacactgacaagtgtcaccaccaccgttaccaccaccaccccgtcttgggcctgggccttgccaccagggaggcctgtaggcctcccaatgttctggaatccgccatgttgaggctcaacactcctccaccgagctggaagagagtgaataatactggatcactccacaacgtcgttactgggttggcgtcttgcaccgagagtctaggctttgaaagctccgacgaaattcacaacaacaacgataataattgcagcgaccagaaagataattacgacgatgagatttggcggaggaggacgatgaaggcggaggggagagggaaagtgcagtcgtttcctccgccgccgctgtcgtcgttgaaccggaacggtaaaccgagtttttatctccggccggtgaggagagacgggaggttacagttgacggaagtgagaatacagcgatcagagattctgcatgcttcgaggcataacggacgcttgacattgcacctggtgccagatctagaagaagaagaagaagaagaagaagaagtagaagaagaagaagaagaaaagagggttgaggagtggaagttgcgtggtgtgggagggagtgaagggttaaagaggtgtcacgaaatggtgaagcaacatcaccatcataatgttcatggaaacctgcgaatgtgtggaattagcattgtaacagaacagaacaaaggtttgaggatgctgcgctgcgctgcactgcactgcatgcacccaccgtgcatggctgcatgcggtgttgtttccttacgggaaaacgacatgtaa

SEQ ID NO: 89998 - DNA, 699 bp, Glycine max
  Peptide Sequence Number=SeqID_206776
atggggaaaatggcacttgccttaactatagatttactttttattgatatctcgctttacatttatgtatgtcttcccataaatgaaacagatgctgttgatgcaatcaatgggacaattatcacttatggccagactggagctgggaagacatatggtatggagggatctggtatatttgaatgtgatgaacagaagaaggggctgcttccaagagttgtaaaaggactttttgatttcttaaattctttggatgaagagaaaacatattcaattaaattgtcaatgggaggaaaagtagtggtaggagctaggaagcaagaattttccagagacaacaaaggtcacgcttcttccaaaatatgtggtactacttatgcatcattcttaaacaccgagactttgaacaggatgaggtccgttaaattaattctagtagacttggctcagtcagagaaagtagagaaaacaggtgctgaggggagagtactagaggaagctaaggccataaacaaatccttgtctgctctgggaaatgaaatgctagaactgcattgctctgttgttgctcacccagggcttttaatgcatccgagagtctgttcactcttcgtttcggttccaggttgggttacacttctccaagacaattgcagtaactgttcattcatataccatgcggtccatgccttgtcttga

SEQ ID NO: 89999 - DNA, 477 bp, Glycine max
  Peptide Sequence Number=SeqID_206777
atgacaatgacatgccgcaaagaaacaaaaatccaaacacgtttaggtgcagatgtgatatatgatccagtttgcctgccacatcttgttagagtacttgccatggttttgatgaatcagacgaatttgggctcctgcagacagcatgcaagttgcaagggccactctccaaacattgaacatgagaatggtgaacataatcatgaagatgctattaacaaatctgatggtggatgcaaagcgatttataatgatggtagtaatagcctgtcaaaggaagcaccggtggcttatattgcatatgttatccggaatattgaaactttcaactattttctctccctaggcatacaggctaaccttgatattggggaccttactgattcattgaagccggtaaatctcctctgctgcatgaaatcatacaatcaagccactgtaagactattgcgtatcaccagcagtaatatacaataa

SEQ ID NO: 90000 - DNA, 1203 bp, Glycine max
  Peptide Sequence Number=SeqID_206778
atggcggagagtgaagtggaggtgattcattcttggtctgctccaagatccctcagtactagtctcatgtattctttttctcagagggatgacatagaagtgcttgatgagcccctctatgcaaatttccttagagtaactggtcttgatagaccctacagggaggagctactctccaaaatggaagctgatggagataaggtcactaatgacataatttttgctccaggaaagaagaaatatagattctgtaagcatatatcaaagcaacggttacaaggtttgacagatgatctgatgaagaaaggaaagcacttcattctgataagaaatcctcttgatatattgccatcctttgataaggttgtccctccatctttctatgagttgggtttggcagagctggtttgtatatacaacgagcttcgtgaaattggaaaggcaccacctgttattgatgccgcagaacttcaacaagatcctgaggctactctacgcagtctctgtaatgatttggagattccttttcaatctgcaatgctcaagtgggaagcaggtccaaagccaatagatggcttgtgggccccttggtggtataagtctgtacataaatctactggttttgagaaaccaagaaagtatccccagccatttcctttttctctttatgatttgttggagcaaagtctacccctgtataatatgctacgacgccatgtgaagaaaaagtcatctcttctgagccctcctttacctaatcctgatcttcctgttcctgcaaacgagaaattgcttgcttgggttggtgatgagattgtgacacgtgatagtgcaaaggtttctgtgtttgattctgttgtccaaggaggtgactcagtttgggaaggacttcgagtatataatggaaagatatttaagcttgaggagcatctagacagcactcaatcttttccagacagtgcgataccagtatggttatttgattcagcaaaagctttagcttttgaaaatgttcctactcaagatgagattaaggaagcaattttcagaactctaattaggaatggcatgtttgacaattcacacatccggctttctctaacacgaggaaaaaagactatatgcacaaaaaggactctcaacctgcttcttgatattatgcagtgtcctgattattatattgaccagaaatctcaatcataa

SEQ ID NO: 90001 - DNA, 990 bp, Glycine max
  Peptide Sequence Number=SeqID_206779
atgactttttcagcacatcctagttgggcaaggaaagcccttcgagcgttgaaaggattggtgaagctacaggcattagtgagaggtcacattgagaggaagcgcacagcagagtggctgcaaagagtgcaagcactcttacgtgtacaggcccaaatccgtgctggccgggcccaaattttgcactccccctcttccacttcccacctccgtggtccagctacaccagacaaatttgaaatccccatcagatccgagagcatgaaatatgatcagtactcgtcaccactactcaagagaaacagctctaaatcccgtgtacagatcaatggcggcaatcaagagagatgcaggagtagatcatcagatagtcgcattgatgaacaaccatggactcaacgaagatcatggaccagaggctgtagtatggatgaagagagaagtgtgaggattctagaaattgattctgtaaaaccacacgtgacatcaaaacgtagaaacctcttctactcccctagccaagctatggttgtttcggatcattacagtgggtgtaatttaaccaccacaagtccatcttcttataatagccctctaaaaatcaacgagcttgaggagagttcattttgcgctgctgataatagtcctcaagctttatctttatcttcctcttctaaagatggtgcctccaaaagaagccctcttactcctaccaggagtgatggctcaagaagcttcttaagtggttattctgaaccaaactatccaagttacatggcttacacagagtcttcaaaggcaaagttaagatctctgagtgctccaaagcagaggccacagtatgagaggtgtagttcatcaaacaggtactcgcttcatggattggccacacaaaggatagccgcattacacgcaagcttcactaacaaagcttaccctggttctggtcgtttggacaagcttggaatgcatgtcccgtataaatactga

SEQ ID NO: 90002 - DNA, 828 bp, Glycine max
  Peptide Sequence Number=SeqID_206780
atggtgctcaatctgtttggtcctgaaagccttaaaaagatgctcccagaacttgaacaaacaacgtgcagaacattagagcagtggtcatgtgagaacagtgttgaattgaaggaagcaacagcaaggatgatatttgatttgaccgcgaaaaaactcatcagttatgattcaacaaagtcctcggagaatttaagggaaaactttgttgcatttatccaaggactcatctccttccccctagacattccaggaacagcttatcacaaatgcctgcagggtaggaaaagggcaatgaagatgctgaagaacatgctgcaggaaagacggagaatgcaaaggaaagagcaaacagatttctttgactatgttgttgaagaacttaagaaagagggaacaatcctcactgaagcgatcgccctggacctcatgtttgtgctcctctttgcaagctttgaaaccacttctctcgctctcacttatgccataaaattactctcggacaatcccgtagtgctcaagcgattacaagaagaacatgaagccatcctcaaacaacgtgaagatcctaactccggagtcacgtggaaagaatacaaatcaatgacattcacatttcagttcataaatgaaaccgtgagactcgcaaatattgttccaggaatcttccgaaaggcactgagggaaattaattttaagggatatacgataccagcaggttgggcagtgatggtgtgtcccccggctgtgcacttgaatccagctaaatatcatgatccccttgctttcaacccatggagatgggaggtgcgtctaaggcatgtttga

SEQ ID NO: 90003 - DNA, 1731 bp, Glycine max
  Peptide Sequence Number=SeqID_206781
atggtgatggagcttcacagccagaacaaccctttctctatttacttgattacctcctttctgtttctcttgttcctgttattcaaattagttaagaaatcgagttccaacaattccaccagcaaattacccccaggaccaaaaacactacctctcatagggaaccttcaccagcttgttggttcaaagagtcatcactgctttaaaaaattggcagacaagtatggtcctctaatgcacctaaaactgggagaagtatccaacatcatagtcacttcaaaagaattggcacaagagattatgagaactcaggatctcaactttgcagataggccaaaccttatatccacaaaagtagtttcctacgacgccaccagcatttccttcgccccacatggagactattggaggcaactacgaaagttgtgcacagtggagctattaacatcaaagagagtgcaatcttttcggtccataagagaagacgaggtgtctgagcttgttcaaaaaatacgtgcaagtgcaagtgaagaagggtccgttttcaatctctctcagcacatttaccctatgacttatgcgattgcggcacgagcttcttttggtaagaagagtaaataccaagaaatgttcatatcgttgattaaggaacagttgagtctcataggagggttctctattgctgatctctacccttctattggactgctccaaatcatggccaaggccaaagttgaaaaagtgcacagagaggttgatagggtgttgcaagacatcatcgaccaacacaagaacagaaaaagcaccgaccgtgaagcagtggaagatctggacatgtttattggtggtggtgaaacatcatcttccactgtggaatggtcaatgtcagaaatggtaaggaaccctagggcgatggaaaaagcacaagctgaggtaagaaaggtgtttgatagcaaaggatatgtgaatgaggcagagttgcaccagttgacatacttaaagtgcatcatcagagaagctatgaggttacacccacctgtgccaatgttaattcctagagtaaatagagagaggtgccaaatcagtggatatgagataccagctaagaccagggtctttatcaatgcttgggcaattggaagggatcccaagtattggactgaagctgagagtttcaaacctgagaggtttcttaatagctctattgattttaagggcacaaactatgaatttattccatttggtgctggaaggagaatctgcccaggcattacatttgccacacctaacattgagctgccacttgctcatttactttaccattttgattggaagcttcccaacaatatgaagaatgaagaacttgatatgactgagtcatatggggctactgcaagaagagcaaaagacctatgcttgattcccattaccgacagccctcggcaaccgcaggatttggggagaaatattcctatgtggatgctgcttgagagagtgagatttaccttagatggtatcgaatgtaacaaaattggtgtcaactatgaagcttttaatcaattgtggaattttcgggagtatgagagtctatccagtcttaactttggccattcagagaagtttagtcctaaaaacttcattgatagagtattggataatgaacctcatgcatttagtgaggtggaacagagtatggatcagttatttggctcaaacgatgggaagcaatga

SEQ ID NO: 90004 - DNA, 2532 bp, Glycine max
  Peptide Sequence Number=SeqID_206782
atgcctatgcgcattgcgcacctcacctccagaactccggcgacttcaatgagcagcggcgaggaaagagaaactgcggccttccgtgctctcgcggatcgctgccggagcctcgaggagaagcagaccaagctcagggaggagttcgatgagctgttgcagaagaacaacctcacagtcagggacgataacgatcacgttagcggtaacggtaacaataacgaggtcattgctgattcaacaaccgacggttttctttccggtttcatcttctccggaaatccctacgcaaccgtgttgaaatgcatgggccacgccgttcacgttcttagagttccctcctccgagatcgtatactggaatcactcagcagaaactctgtatggatggaaggactacgaaatcattggccaaagagtagctaaagtcctaattgctgaagaaaattatgcatctcttcaaaaaattctggaagggttggtcacaggcgtaccatggtctgggcagtttcctttcaagaagaggtctggtgaagtatttatggcaatggtaacaaaaactcctctttatgaggatggtgagcttgttggtgttatagctgtttcaagtgacgcagctatattaaacactacaaattcagaaaatcaaagaacttaccaatctggtaacaatggccaacctggagtacagaggttaaacttaaaaagaattcagtggcctccacgaccaatgattgcatcgatgccacagattgcttcaagtgtttccgatctggcatccaagctcctcccggtgctgaatactactgatgacacagtttcccagaatacttcaacagatgcaaatgatgaaaaactagagaagcgtggcatatatgaaacaaaacctcattccagacatcaccataaagaaaacacaactgtcactgaggcctctgagaaggatgagtctactacagaatttggtcaaccttctaatattgcagccagagtccttgccaagcttcaaattggggcacatgcaaaatgtgggaaggataatggaaatatcaaaaataattgtacagctgataattcaggaagcaatagagtgaataatgaaaatgatttgcttggagatttattgtcattaaatcgacaccaggacgttgctaatggagcagataaagaagaaaatcttcataaatgtaattctttatttgcaatgaagagagcagatacaaaagtttgtgcatgtagagcttccaatgttgtcaaagatagttctggtaaacctttctcaggggagtggtgtgaatgctttggttctcccattccccatgacccgttgttaagattacgctgtcaatttgatcagaagaaattggagccagaggctatgaatatggcaacaggagatgaagtgcaaaagcagcaagaagggttgcaattgccaagttcgagggagagtataggcagccatgaaagttcatcaagcaaaggagataatgagtcaaactctgtttcaaagtgtgaaatccattgggaacatcttcaattaagagaagagatcggacaaggtaattatttctattgcaatgttatcaatgatggatggcagaaggccaaaattctgccatataaacatgccattgtggcctttggcgctgccatagtgggcatcccttcacaaattgtcaatggaggatgggtcaaaaaataccatgttatagcgttatggaggcgctataatggttatttaacaacattgttctgttgtgcattttataattcctctatgttgaggagtttaaatgctaaaaatgcttttatttgttcttgtgctgttgtttatcatggaatttggaatggatcggatgttgcagtcaaggtttacttcgggaatgaatacacagaggagactttacaagactacagaaaagagattgatataatgaagagattgagacaccctaatgtattgcttttcatgggagcagtatattcacaggaaagacttgccattgtgacagagttattacctaggggaagccttttcaaaaatttgcacaggaacaatcagacattagacatcagaaggcgcctaaggatggctcttgatgttgctagaggaatgaattatcttcatcacagaaatccaccaattgtgcatagagacctgaagtcttctaacctgcttgtagataaaaactggactgtaaagcctcaatggatggcccctgaagtcctaagaaatgaaccttcaaatgagaagtctgatgtgtacagttttggtgtcatcctctgggaactaatgactcaatctattccatggaaaaatttgaattccttacaggttgttggagtcgtaggctttatggatagacgactagaccttccagaggggcttgatccccatgttgcatcaatcatcgatgactgctggcgaagtgatccagagcaacgcccatcatttgaggagctgatacagagaacgttgttccttgtcaacagagtaacagcagtgtcaattaggagaatttcagaatcctga

SEQ ID NO: 90005 - DNA, 384 bp, Glycine max
  Peptide Sequence Number=SeqID_206783
atggcggtctcatttatacaagaagttgaggggtacaaaatccagtctcatattggtgatcagtgggtgtgggcggcagatcctagtggccagtattcgattaggagtgcctatagtgtgcttagagaggacatatcagaggaggcccaggatggagagttcaaggaattatggaagcttaaggtcccacctaaagtggctgtgtttgcatggaggttactcaaagataggctaccaaccagagataacttgagaaggaagcaagaaagtacttccagtatggtgggaatcgctgtcttgggtgaatctggtggcaatatggaggacattgctcgggatgctggcagtgtggatatcgaagatgttttgtatagtatgttatga

SEQ ID NO: 90006 - DNA, 306 bp, Glycine max
  Peptide Sequence Number=SeqID_206784
atgggatttttgagtgagaaaggaggggtgcaaagtgaggtattagttacaaaatatggaaggtggaagaggcttaagagggaggaagcaactcaacatgcttcattctggcagagagatttgtgtaaaatttgtggagggtgttgtaatttaaaatggtttgatgatatggtgagaaggaaagtacggagggggaacaacactaaattttggagtgatatttgggtgggagatcaagcttgggagtgtggaggtgggatttctcatgaaggagggagtggtttgtgtgagaagaggaaatggtag

SEQ ID NO: 90007 - DNA, 426 bp, Glycine max
  Peptide Sequence Number=SeqID_206785
atggtagaaattactgatgtacctgccgatacgaaggacaaagacgagattcttgagagtgaattctttgacactaggcaggcatttctgagtctctgccagggaaatcattatcagtatgatactctaaggcgggccaagcattcctctatgatgattttgtatcatcttcataatccaactgcccctgcatttgttacaacatgtaatatttgtcgtcttgacatagaaacaggccaaggttggcgttgtgaagtttgccctgaatatgatgtgtgcaatgcttgttatcaaaaggaccgtggcgctgatcatcctcataaattgacaaatcacccatcaatggcagatcgtgatgctcagaacaaggaagcaaggcaacttcgagtattacagcagcagcaacaaaggctgtatatctactag

SEQ ID NO: 90008 - DNA, 450 bp, Glycine max
  Peptide Sequence Number=SeqID_206786
atgacttatgaaaagaaatctggtggtaatgtttcgatgggtaacaatgctccttgcaagacagttgggataggttctatacaaatcaaaatgcatgatggaattgttagaaccttaaccaatgttcaccatgttccaaagcttaagaagaatctaatctctatgagagcgatggattcaaaaggttttaacttcaatgttgaaggtggagtgatgcaaatcaaagggaaaggcaagtctgatgtaatgcagggaaccaagcaaggaaatctgtatatcctgcaaggttccacagtgacagactcagcttcaactatttcacaagctggaagtcctgcgtccaatgataattctttgtggcatacgcgtctaggtcacacaagtgaaaatggactgaaaattctgagaaagcaagggctacttgcaaatcacaagatggaacctctttag

SEQ ID NO: 90009 - DNA, 1566 bp, Glycine max
  Peptide Sequence Number=SeqID_206787
atggctaggaggccaacagttctgccacaagatagtatggcccatttctggaagcatgcaagggcagccaatggtaacaggagaaaaggagcctggcaacaaatgaacagttttcaccatctttttatgagtggcaaatggatccgtgctgggtacacattttacagtgggtcaaggttagtttccagatgtgggtcgttttatggtgcttacaagggtctttgcctttgtaaggctggttgccctttatttgatcttgacaggtttattcagcctcttgtagcctcacatggagaaaacatgaggcagaagggcaactcgaagtcacttcctttcactagggaacaattagagcacttgtccaaattcctttcagctagaatgtcagttaatccaacctcttctctagcccaacaaggtcataaaaagatcagaattgcaggtggtgctttgtctaccatagctggtgttggttccattcctatatctaaatctctaactctatataatgttcttcatgtcccaaatttgtcatggaggatgattggcagtgctaaggaggttgatggacactatctctttgaggatgaagttgtctttaaggaaaaaaaactcaggaatgacaaatctcaaagaatagagccaaatgatcctcaagactgccatgactctgagaacccatcagaactgacaaaaaaagaaattccaaaagatatacaggctgctctaaaggttcctgagtggaaggaagctgtcttggaggagatgagagccctggagaagaatcagacttggaaaaaggtagacttgcctagaggaaagacaattagagttcttttgtcactaagtgcaaatttagactggccattgcagcagctagacgtgaagaatgcctttttgaatggagatttggaggaagacgtctacatggatgcacccccaggtttggcttttcggtggtctatcgaaactgcaaggaacatgttgttccaacaggtactttatgaatctgactgtaagtgtctcgctgataactggagaagtggcacctttggccagcgtgattatttcaccgacactaggatgatgggttgtaggccagctgaaactcctatagatcctaacaaaaaacttggaaatgaagacaaaggagatccagttgatatggcaggaaaaccgggcagcaaggcatcaaagtattcacacatggagattgggctggatccattattaaccaaaagtccacttccggctattgtacatttctttgggcttaaaaggattctagaagagttacaactttctatgactctttccataaagttgtactgtgataacaaggttgcaataagcatttcccagaatccagttcagcatgatcgaaccaagcatgtagaaatcaacaggcatttcataaaagagatggtggatggaggcttaatttgcatgccatttgttcccacttcacagcaattggcagacattcttacaaaaggactgtttagacctaattttgaattttttgtaagcaagttgggcatgctggacatctatgcaccaacttga

SEQ ID NO: 90010 - DNA, 2610 bp, Glycine max
  Peptide Sequence Number=SeqID_206788
atggcgtcaaccttgtggcaaaaagcttggttgttgttgtttgtaggggtaacaatctcattatcaggtgacagatatggattgcttaatgctgacacttttacttctgtaagcttttatgcatctgcgacatcctctgggtctatgatgaacactcagaacatgaatgcagtaaaattgccatcaatacccattaccagctcactgataagtggtcattcaaatttgaacagtatgcatcagacttctcatcaaaagtctcaggcaataaattcattgaaaaatttaaaataccagtcttcattgacttcaagagatggtcatgtgcatactcaacagcaatatgagcaaagaccccaacaatgtcaccagtcagagcggtatactccacagcaatttcaactgaagctgcaaggtcagcaacctcagcatttggtcaacaatgatgccttctctcagtctcagctctcttccaatctagacaatatagtaaagtctgagtctggagttgaaccacataaagaagttcttgattctcagctttctgaacagttccgtgtatctaagatgcagaaccagttccagcaaatttcttctaatgattgctctaaggttgctcaacatttttcattgggccagaacgactcatcctcatcaccacctcagatttcacaacaaatgttgcatccacatcgattgctttcagagtcacaaaataattttagctgtctttcagctgggtcacaatccacatccatacttataaatcaatggcctcgatcactagatggacaccacattcctcagggtatgccacatgaacagcatcttcccatggattttcatcgaagaatatcagggcaggacgtagctcaatgcaatactttatcatcagatggatctattattggtcaagctgttgctcccagaagctcaactgagcagatagacccaagcagtaatataaagaagtcacacaggaatcaacagagattgatctcgaagtctccactagtggttgaaacttcagaagacctaccatctctaaagcgtatgaaaactgagcagtgcacccagtccattaatcctgaatatgacaattcttcttcatctgttctaaattgtgactcacgggattcaaaggatactcagtgccaagtctatctcagtggtgaaatgtctatatcaactaaatctgagcctactgaagttaaagaagaagttctggtgcattcaattcatgaaaatcttagtgagacaaaaatggatgaggatagtgcacatgataaaatgcccactggtaagcctgtcacacatactgagcctgctaatatagctaggccagaaaatattaaaactgagaaacaaaatggacaagataagcaagaaaatgtggaccagccatctgatcatggggctggaaccaagtctggtaagccaaaaataaagggggtctcattgactgagttgtttactcctgagcaagtcagggaacatatcactggcctcaggcgatgggttggccaacctcgtggagacaccattgttgttgatggaactccttttcctaagtcaaggttagaaaagaagaaaaatgacgaggaaacagaggaatggtgggttcaatgtgataaatgtgaggcatggcaacatcaaatttgtgccttatttaatggtcgaagaaatgatggtggacaagctgattacacttgccctaactgctatattcaagaagtagaaagaagtgagcgcaagcccttaccgcaaagtgctgttcttggagccaaggatttaccaagaacaattctcagtgatcacatagaacaacaattatttaggagactaaagcatgaaagacaagagagggcccgacttcaagggaaaagttatgatgaggtgcctggagctgaagctcttgttataagagttgtgtcatctgtagacaagaagttagaagttaaacagaggtttttggagatttttcaggaagaaaattacccaacagaatttccatataaatcgaaggtaatcttgttgtttcagaagattgaaggtgtggaagtatgcctctttggcatgtatgttcaagagtttggatctgaatgtcaatttccgaatcaacggcgggtttatctttcatatctggactctgtaaagtattttaggcctgaggttaaagcagtaactggagaagctcttcggacatttgtttatcatgaaattctgattggataccttgagtattgcaagaaacgtggttttacaagctgctacatatgggcatgtcctccattaaagggtgaagattatattttatattgtcatccggaaattcagaaaactccaaaatctgataagcttagggaatgggctaaggttacagcagcaaggctcccatattttgatggtgactactggcctggggctgcagaggatttgatttatcagcttcgtcaagaggaagatggaagaaaacaaaataagaaaggaacaactaagaagactataacaaaaagggctttgaaagcatctggtcagtcagatctttctggaaatgcctcaaaagaccttctcctaatgcacaaagtaatttgccattttgatctttga

SEQ ID NO: 90011 - DNA, 954 bp, Glycine max
  Peptide Sequence Number=SeqID_206789
atgcctgagaagcggtaccagcatcccgttacagaagcacatagaaggaaggttaaggatcttgcaaaacgcctcgaagagggcatgtttaaaactgctatttctaaggaggactacatgaacttggacacactagagagtcgcttatctaatttccttagaaggtcatctatgactaatcaaaaccaacaacatccacagcttgttagctcttctccaattggtacaatgataccaacccctggtatgtcgcatgttacaaattcaaccatgatcatagcatcttctgtggatgcctcaatgattgctgccggtgggtgtaacagcatagcatcctcatctgtcaatagtgtaagcatgttacctgctggtaacatgcttggaagctctttaaatagatctgatggtaattctagttgttttgattccttagtcctttcagtttgtttttctttccctgcatttgtgggtctacttattgcaggaggaaacatgtcatcggtgggggtgccaagagctactagccagatgattccaactccaggatttagtgtcagtaataatcgttcatatacaaatctggatccttcaactaacagcagttctttttccgctgttgattctacaaaactatctcagtcacagtcacaaccgcagcggcaccagaagctgcaagatagtggccacaacaatcatgcattgcacaaccttggcagtcaaatggatggtggaatgagatctgatttgctgcaaaattcatttgcatatccaaatgattctataaataatgggctaggcttgattggaaacagcatacaacttgcaaatgaacctggcactgatgactattcttcagcgtacactaattcccctaaacacttacagcagcactttgatcaaaatcaacaactggtagtgcagggtaatctttctaaatctttttgtttgatttaa

SEQ ID NO: 90012 - DNA, 156 bp, Glycine max
  Peptide Sequence Number=SeqID_206790
atggagttttcgaaggattgcaggcaaagagatggcagcagtggtgttgatgacaatgcaaggagagcagcaacgtgggatgcttgttggtgtcggtcaacagcagatgagggtattgtgctgaggggtgacatggttgtatgttgcaatatgtag

SEQ ID NO: 90013 - DNA, 351 bp, Glycine max
  Peptide Sequence Number=SeqID_206791
atgcatgctcgtgttccttatgttagtgcaattggaagtctaacgtatgtcatggtatgcacaagaccagatctagcacaaacagccagtatagtgagtagtatacggtaccttaagggtacaactgatattggactcatctaccaaggtgacacatcttgtgcacttactggttatttagattctaaccatgctggagatttgagtgcaagacaatctgtgacaggttatgctttgacaggtggcaattcccttgtaggtcggaaagctacacttcagcccatagttgccttgtcaaccacagaggcagaatacatggctttggcaaaagcagctaaggaagaaatctag

SEQ ID NO: 90014 - DNA, 396 bp, Glycine max
  Peptide Sequence Number=SeqID_206792
atggagaagtggcaaggtgggcatctatggtccatcacagacacagaaaaacaaaggcacattgttcacaagaaccatattgagatggaggggacttcttgggaagtatatcatccaaaacaggttaaaggcctagatattgcagtggagaatgccttctcatggttctgtgacatcacctcttcagcaatccttttcatcacctctagagcggctggcggtgttgctgagaaccacggttggcgcaatgaagggaacgacggggttttgcgtggtgagggggaacgagattgttttcagatcgagggcgttgcacgtggtgacgaccagactgacaaaatcttctcaatcgaggtagaggcgacacatgatgttggaggagggtggcagggttag

SEQ ID NO: 90015 - DNA, 366 bp, Glycine max
  Peptide Sequence Number=SeqID_206793
aaaatttcgatacatcaactaatcgactttttgggcaaactgatcgagcatcaagatatagtggatttgaatgagcgcaagatcgagttgctcgaggacacgtacaatctgaagcagtcgaagaatgccgaagtgcgtttccgcctcaatcgcttgattatacgcgcccgccttatcaaacgtctagatgagatcattgagtttgccaactcgaatttccgaatgaaattctgtcgtccaatttatcgcgatttggctgcctggcctgaggccaaacccattgccgtgcgtaattttgtgagtgtgcgcgaccaaatgatggccgtctgctcgcacacaatcgagaaggatttgggacttaagtag

SEQ ID NO: 90016 - DNA, 1530 bp, Glycine max
  Peptide Sequence Number=SeqID_206794
atgtggcttcccaatcctaaagcatcagggattagaaagggaggaggaggaaatggattagtggcagtggctatagacaagaataaaggaagccaatacgctcttaaatgggctgttgattgtcttcttaccagaggtcaaactgttattctaatccacgttttgcacgggacatcctcacccgtctctaggggtaaagaggtcattatatgtaacatcagcaattcatctgcatctccggggagttaccaacttgataacactatcaaggatctgtttctcactttccattgctattgtacacgcaaagatatacaatgccttgatgtcctacttgaagacactgatgttgtgaaagcaataacagagtatgtctcttatgcagcaattgagaacttggtggttggtgcaacatccaggcatgggtttattcgatttaagtcatcaagcgcatcaagtagcatttcaaagggggcgccggatttttgtactgtgtttgtcatttcaaagggcaaagtctcttcagttcggaatgctactcgcccggccgctcatacatctccacttctgagccatatacatgatctaattagccaggtccaaactcaacctgcagagatatcctccagacgtatgaatttgagagacaggacatcaatcaaacctcacagccaggcggatgaatcttttaagtctccatttgtaagaggaagaggcatgggtggaatgtcatgtgtggacttcccagaatcagacacagacatatcatttgtaagctctgagaggccaagcagtggacgttcatcctccgtttatgactacattgacacaggccgaacttctcgactttctaccaattcagatcatagctttggatcaactcgattgggactcaagttcaacccctattcaccagatacgtcattctcacatgaaagctgtacaacatcattttcatattcatcacagagcgtggatgaagtagtagaagctgatatgaggaggctgaagcttgagttaacgcaaaggatggaaatgtacagtacagcatgcagagaagcatatatatcacagcagaagtttatggagttgacccaccagagacttgaggaagaaaaaaaaatagatgaggcacgattggctcaggaagctgcaatggcaattgctgagaaagagaaagcaagatgtagagcagccatggaaactgctgaagcatctaagaaaattgcagaggtggaaacacatagaagagcgagtgttgaagttaaagctcttaaagaagcagaggaaatgaggaagctattggaaaatctagcccaaactgatgtgagatataggagatactgtatagaggagattgaaacagccacaaacttcttttctgaatcccagagaatcggggaaggaggttatggccttgtttataaatgttaccttgatcacactccagttgctgtcaaggttctacgtccagatgctgctcaagggaagtcacagtttcagcaagaggtgatcaaccaatggacatga

SEQ ID NO: 90017 - DNA, 1890 bp, Glycine max
  Peptide Sequence Number=SeqID_206795
atgtcttcagatgctgaggcactgttgaagttccgggattctttgagaaatgtgatagcccttagtagttgggacccatccataaaccgaaagccaccgtgctctggcaacatccccaactgggtgggcctgttttgtatgaatgacaaggtttgggggttgcggcttgagaacatgggcctaacaggcaacatcgacgtaaagtctctgggttcaatccccgctctccgaacggttagcctaatgaacaatacctttgtgggtcccttgcctgacgtgaagatgctaccaaatctcaaggccctctacttgtcctataatcatttctccggacagataccggatgatgcgtttacgggtttgaatagattgaggaaactgtatatgtccaacaacgagttcacaggtcaaattccttcctctcttgccaccttgcccagtctcctcatcctcaggctcgactcaaacaagtttcaaggtcaaatcccccaatttcaacgcaataaaagtttgaagattatcaacctgtctaacaatgacttagaggggcccatcccggccaatctaagcaccttcgacgcctcctcatttagcggaaacccgggactatgcgggccgcccctgaccaacgagtactgccaaaggggagccccagaggcgtccaaaatgcgccttctaaaaattttacttgctgtgatcgccatagcattgataatagccatcatcctggttgcagtcctattggtgatatgtcggttgaggtcacagaaacatcatacgttgcagggccaagcctcccaaaattacgctcctcccatttatgtcaaaactaaaagcctagctgatcactatgctgctagtcccaggctggtttcatcatcagatcgcggtggccatggacattccaggaggggggaacaagctggcaaactgacattcctcagccatcaccaacccaagtttgatttgcaggatttgctaaaggcctccgccgaaattttaggaagtgccggttttgggtcttcctacaaggccgttgttttggacggtcaagccgtggttgtcaagaggtacaagcacatgaacaatgtgccaagagatgagttccacgagcacatgagaaggctgggcaacctcaaccatcccaatcttctccctcttctcgcctattattatcgaaaagatgaaaagtttttactcacttcctttgttgacaacggttgcttggccagccatcttcatggtaatcgtgactatcaaaggccaggacttgattggcccactcgcttgaaaatcgtgaaaggtgtagccaggggtttggctcacctatacagttccctcccaagcgtgattgtgcctcacggtcatatcaaatcttccaacgtgcttttggatgaatccttcgagcccctactcactgattatgccctcagtcccgtcatcaaccttgaccatgcccaacaaatcatcatgccttacaaatctcccgagtatgctcaacttggtcgcattacaaagaagactgatgtgtggagttttggaattctgatactggagatcttgaccggcaaattcccagaaaactatctcacacttaggcataatactgattctgacatagccagttgggtaaataccatgattactgagaagcgcaccactgacgtgtttgacgtagagatgggaggaatcggaaatagtaaagctgaattgctcaaacttttaaagattggcttaagctgttgtgaggagaatgtggaaagaaggctagatatcaaggaagctcttgagcaagttgaagacttgaaagagactgaaaatgatgccattattggagaatactcctccactctcatcaccaccgaaagaaatgcttatatagctgtgtga

SEQ ID NO: 90018 - DNA, 453 bp, Glycine max
  Peptide Sequence Number=SeqID_206796
atgaagggatgtctggaatctttagagaaaagtgagtcattgaggaaggagattgaggcagaacaggggcttcaagaagcctggctcaagaagattgaagagatattggagagcctcagaaaatgtggcccacaaagcaaactactacagtggaagatttttaggacgaagtttgagttgtatgctgaaccaattttccccaagtgcttgggaattgggtccttatcaatttttttcttaaaagggcataagctgtttggcaagtcatttgggttgtgttttatggcctatatgggtcttcagtacagaaatggtatagtcttcaatgatgctgttttggcttttgagaacattctggttaggttcagaactttgacatggctaaaagtaagagttcggggatttccttgttcgttttttgaatgggtcaatagccttggcctctatttgtaa

SEQ ID NO: 90019 - DNA, 150 bp, Glycine max
  Peptide Sequence Number=SeqID_206797
gctaacgaagagaaggtgtttgaaatgttgctgaaggactcgctcagcaagccagattggctaagcgaggctttttcgcttagcgaggcagctagctcactgagggaatgcaaaaccctagagaatgttaagccagagaacagtgcgtag

SEQ ID NO: 90020 - DNA, 438 bp, Glycine max
  Peptide Sequence Number=SeqID_206798
atggagaatgtatttatgcaattcatggaaacatcccatgctagctttaaagccaatcaaaactcaactcaaaatctagagattgaggttggcaagaattactccatggaaaattgttggcgggagcaagagttacaaccttgcaatcaatatgaagatgaaagaatttataatcttgataatttgttgatgcaactcatgaaaacatctgaagctactcaacacgcaattcaaaatattgaaattcaagttgaggttgaaagtcataaggaaagtcttgtagaagagtatgattcaagagaaaaagacaaagaaaaaagtgagcagagaacacaacaacaacgggagaaatgctcacaagtagaaattcaacaagaaagtattctccaagtcaatacccctcctcatcaattgattggcaaggaagaaaggcatgga

SEQ ID NO: 90021 - DNA, 780 bp, Glycine max
  Peptide Sequence Number=SeqID_206799
atggtccaccgctacttcgccggcaccctggcgatggtgatcgccctgctcgccttgcaggcgctgcgccggcatgcccgcgatggccagccttaccgcctgcccttgctgctgctgggcgtggtgctggcccaggcagccttcggcatgtggacggtcaccctcaagctgtggccacaggtggtcaccgcgcatctactcggcggcttcactaccctgagtttgttgttcctgttgtccctgcgtctgtcccgggcctttgcgcctttgccaaagctgccattgagcctgcgccggatcgccgcgctggccttgctggtggtgatcggccagatcgccctgggcggctgggtcagtgccaactacgcggccgtcgcctgcatcgacctgcccacctgccacggccagtggtggccggcggcggacttcagcaacggcgcgcacggccatccacatcagccaccgcctgggtgcactgctggtgacctgcgtgctgctgatgctcagctggaagctgcaccgctgcggcctccctggcctggcgcggctggtgctgctggcgctggtgatgcaagtcggcctgggcatcagcaatgtgctgctgcacctgccgctggccgtggccgtggcgcacaacgctggtggggcgctgttgctgttgagcatggtgctggtgaactaccgcatccgcgtggtcgacaaggttcgcgtgggtgtcggccatggctggcgcctgcggcccgtggctggcgtgggcatctcccaccacatgaggaatga

SEQ ID NO: 90022 - DNA, 1197 bp, Glycine max
  Peptide Sequence Number=SeqID_206800
gcccggtcgtgagcggcgacaccaccgatgacaacaccccgaccctgagcggcaaggccgagccgggcagcacggtgaacatcatcgacaacggccaggttatcggcaccgcgaaggtgaacccggacggcacctggagctacaccccggaccagccgctggcgaacggcgcacacgacctgaccaccaccgtcaccgatccgtcaggcaacaccggaccggaaggctcacacgtggtcatcaccgttgacgtggtcccgggcaaggtggaaatcaccgccgtgaccgatgacaccggcagcgtgaccggcagcctgtcccagaatgcggtaaccgacgacacccgtccgcaaatcagcggcacggcgaaggcgggcagcaccgtgaccatcatggacggcagcaacgtgctgggcaccaccaccgcgggcgcagacggcacctggagcttcacgccgagcgtggacctgggccgcggcgaccataccttcaccgccacggcgaaagacccgatgggcaatgagtcgagcagcagcagctggaccgtgaccatcgacaccgatgcgccggtgaaaccgaccatcgatgcggcgctggacgacgtgggcagcgtgcagggcgcactgtctaacggcagcagcaccgacgatccgaccccgaccctgagcggcaaggcggaagcgggcagcaccgtgaagatctacgatcagaacggcctgctgggcgaagtgacggcgaaggccgacggcacctggagcttctcgccggtggcgaagctgccggaaggcgagcaccgtttccacgtgacggcgaccgacagggcgggcaacaccagtgcagcgtcggacgatttcgtccttaacctggaattcaccgcgccggatgccagcaaagtgagcattaccgatgtggtggatgattttggttccgtaaccgggacgattgcctcaggtggtaagacggaagataacacgccgctgatcaagggaacgggcgcagagccgggcaacaccatcaccgtctataacggcgacaaggtgatcggcaccgctaaagtacaggctgacggtacctgggaacttcaggtcacgaaagccctgcctgacgggacctacaacctgacggtgaaagagacagacagcgtgggtaacaccacggcggcatcacaggaatacattattcagatcgatgccggcg

SEQ ID NO: 90023 - DNA, 792 bp, Glycine max
  Peptide Sequence Number=SeqID_206801
atgaagaggggtagtagtactagtagtaaagtagagccatttgtgctacccaacaggctcacactgcttcagattttcatggtggtgatgctcctttaccttctcttcatgagcttcgaaatccctctagctttcagagccgaaaacggggtcgttttcctcaccgacgcattgcccatgcccatgccactcatgctcgaagaatcacgcaacagtgtcaaaatcagagcaccgacagggttaaagttggagaaagtttccaccttgaggttcaacgagagcttcacggagggttcggagctgcacaaggtggcgcggcacgcgtgggttgccggggagaagctctggggggaagtggagagcggcaaagtgaagagctttgcgaaaattaaggtaaaaaacgggtcggattcgtgtccgaattcggtgtcggtcgccgggacggagttccgggacaaaggggtgttggtgctgccgtgtgggctgacgctctggtcgcacgtgacggtggtggggacgccgcggtgggcccacgccgagagtgacccgaagatagcggtggtgagggacgggggagaggcggtgatggtgtcgcagttcatgatggagttgcaagggttgaaggcagtggacaaggaggagccgccgaggattctgcatttcaatccgaggctgagaggggattggagtgggaagccagtgattgagcagaacacttgctataggatgcaatggggttctgctatcaggtgtgatgggtggaaatctcgtgcggatgaagaaactggttag

SEQ ID NO: 90024 - DNA, 723 bp, Glycine max
  Peptide Sequence Number=SeqID_206802
atgatggtagactggccatatccttttgcggagggcaagttatttgttctcaccataagtgctggcttggaaggttaccatgttagtgtggacgggaggcatgtgacatcctttccctatcgcacggggtttgcccttgaggatgctactggactatctataaatggggatgttgatgtacactctatatttgctgcttccttacctacatcacatcctagctttgctccacagatgcatcttgaattgcttcctcagtggaaagctcctcctcttcagaatgtgaatgtggagcttttcattggtatcctttctgctggaaaccattttgctgaacggatggcagtgaggaagtcctggatgcagcataagctaatccaatcttcacgtgttgtggctcgattttttgtagccttgcatgcaaggaaggatataaatgtggacataaagaaagaagcagagtattttggtgatattattatagtcccatacatggatcattatgaccttgttgtgttgaagaccatagctatctgtgaatatgggattcggaccatgacttctaagtatataatgaaatgtgatgatgacacgtttgtcagagtggattctatcctaaacgaagcaagacaagttcgaagtagaagtctgtacatgggaaatatgaattatcaccataggcctcttcgccatgggaaatgggctgtaacttatgaggtataa

SEQ ID NO: 90025 - DNA, 219 bp, Glycine max
  Peptide Sequence Number=SeqID_206803
atggtgcagttattcaaaatggaggacgtgagcatgggaatgtgggtggagcacttcaacagcacaagaccggtagagtacatgcacaacttgaagttctgccaatttgggtgcattgaagagtactacactgcacactaccaatcaccaaggcaaatgacatgcatgtgggaaaaattgcaacatcaaggaaaatcactctgttgcaacatgagatga

SEQ ID NO: 90026 - DNA, 699 bp, Glycine max
  Peptide Sequence Number=SeqID_206804
atggctcaaagggacttgaggcttttgggtgcttggttcagtccatttgtcctgagggtgcagattgcccttaacctcaagggtttggattatgaggttgttgaagagactttgaatcccaaaagtgaattgcttcttaagtccaaccctgtgcacaagaaaatcccagttttcttccatggagataaagtcatatgtgaatctgcaatcatagttgagtacatagatgaggtttggtccaacaatgctctctccatccttccacaaaatgcatatgatcgagctaatgcccgattttgggtttcttacatcgatgacaagtgggttacgtccttgaaaagtgttctactggctggagatgacgacgaggcaaagaaatcacactttgtggaaatggaagaagcacttgagaggatggaagaagtgttcaacaagtgcagtgaaggaaagacatactttggaggggatacaattggaattgttgacattgtttttgggagcctttggagttggatgagagtgatagaagagatgaatggaagaaaagtgtttgatgaagcaaagaacccttctttggctaaatgggctgaaacgttttctgctgatgctgctgtgaagggtgttcttccagagactcacaagcttgttgagtatgccgagagtcttaagaaaagatgggctgctgcagctgcaaagtaa

SEQ ID NO: 90027 - DNA, 726 bp, Glycine max
  Peptide Sequence Number=SeqID_206805
atggatttcaccaacccttcacttcttctctccattttccttctactacttccttctctgatctcatcacaaatctgccagagaaactgtggcaaagaaactctcaagtacccttttggaagtggccctggttgtggtgaccctcgtttccaaccacatgtaacatgtagcaaccaaaagctcacattcaccactcacacaggctcctaccctattacctcaattgactacacaaaccaaatcatacacatctcagatcccaccatgtcaacatgctcctgcactgtccctagcaaaggctttggcctaaactgggatgcaccatttacttttgctgatagcaccatctttgctctggtggattgctcaatgaactcatcatctatatgtcaatcaaatggctatgatgatgggagcaattccaattccaagcttttatgtgatcaagagacaccaatttgtagtcttctatactcatgcaggcctattagcaccaccattaaccttccaatctcgacgtgctgcgtttacacgccggttaatctcggtccagcgtttgagatggatctgcagaagctgcaatgcccttcttacacggggttctacaacttcaatgatcaagaaatggatcctgagaagtggaactatggtatagcactcaagtacaagttcagtgtcacaaatgactatcctggctcgtgtgatgcttgtgaaaggagccatggg

SEQ ID NO: 90028 - DNA, 267 bp, Glycine max
  Peptide Sequence Number=SeqID_206806
atggctaaaaatgacttgtggcttttgggtgcttggttcagtccatttgccctgagggtgcagattgcccttaaccttaagggtttagattatgaggttgttgaagagaccttaaatcccaaaagtgagttgcttcttaagtccaaccctgtgcacaagaaaatcccagttttcttccatggagataaagttatatgtgaatctgcaatcatagttgagtacattgatgaggtttggttcaacaatgctccctccctccttccataa

SEQ ID NO: 90029 - DNA, 678 bp, Glycine max
  Peptide Sequence Number=SeqID_206807
atggctgaaagggacttgaggcttttgggtgcttggttcagtccatttgccctgagggtgcagattgcccttaacctcaagggtttggattatgaggttgttgaagagactttgaatcccaaaagtgaattgcttcttaagtccaaccctgtgcacaagaaaatcccagttttcttccatggagataaagtcatatgtgaatctgcaatcatagttgagtacatagatgaggtttggtccaacaatgctctctccatccttccacaaaatgcatatgatcgagctaatgcccgattttgggtttcttacatcgatgacaagctaaaaaccaaacatactgttagcaaagcatcagataccgaggcaagcacaggggtaattacaggaaatcatacagagaaggttctggaccctcgaagtccaggttctgtgttgttaacattttggtgctctcgtgccatgtctgaccctctccactccaccacatccactaaaaagctggaagatgccatccttaagctcacttccttgaacctcaccctaggggaatcaatccattctatgaaccttcgtttcgacgcctcttgcaacgactatcttccccttcctcattatcaccttcgattatcccctttgtgcccgtttcttccaccacacctgtcaccaaccacagaatga

SEQ ID NO: 90030 - DNA, 285 bp, Glycine max
  Peptide Sequence Number=SeqID_206808
atgggggtagcggtaagggcgcacgttgaccgagatggcagaagtgtcatccctgaggaccacaatgtgatagaaaacaccaggactttgtttcctgagtaccttattgaattggggtggcaacagcaagtgggagatggtctcatgatctcctttcagctccaccaattgacccgcatagaagaacttcatgcacaagctgttatagttagtgagtactggtccaagagacttgagccactgaacactaagcacgacattggcatcggagatgggaggatgtag

SEQ ID NO: 90031 - DNA, 993 bp, Glycine max
  Peptide Sequence Number=SeqID_206809
atgatgctccagaaagggctcattcagccaagcaccagcccgttttcttctccggtcttgttggtgaggaagaatgatggctcatggcagttttgcatggattatcgagctcttaatgcgctcacggtgcgtgatcattttcccattccgactattgatgaacttcttgatgaattggggcatgctcgttggttcttagagcttgatttattgcaaggctaccatcgaattcgcatgcacgccggtgacatccctaagaccgcctttagaactcaccatgggcattatgaattcaaggtaatgtcctttggtctgtggaatgcgtcgtcctcttttcaagcaacgatgaatcagattttcagaccatttctctggcgatttatcatcgtcttctttgacgacattttaatctacagtgcctccttccatgagcacttgcagcatttagagactacgtttcagtcacaggtcgaatattggggccatattgtctctcaagggggagtggcatcggtagctgccaaaataggaatcattgaccagtggcgcacacctcaaacaaccagagcacttcgcagctttttggggctcgctgggttctatagacgctttatccaggggtacgccaccatcgctgcccctctggttaaggccacaacaacagaaccacttaagtggagtgcagaagcccaatctgcttttgatcaactcaagagagtcttgtctcaggctcctgttctgcccaattttcaattgcctttcactatggagacggatgcgtcgggggtgggcatgggtgcagtcttatcccagcaaggccacccgattgccttctttagtaaacccttcactccaaagcttctgcgggcttcaacatatgtcagagaactctttgcaattacggcaactgttaagaaatggaaacaatacttgctcggtcaacgcatcactattctcaccgatcaccggagtttaaaggagctccttacccag

SEQ ID NO: 90032 - DNA, 228 bp, Glycine max
  Peptide Sequence Number=SeqID_206810
atggttctcgcatgtcatcgggtccgccgcctctggatgacaaagggaaaaagtgtgggaccaaatggttcccgcatgtcatcggatccgccgcctctggatgacaaaggtaaaagtgcgggatcaaatggttctcgcatgtcattgggctcgccgcctctagatgacaaaagggcgcagaatgaccataatttgtctctgcgtgccatcggacacgactgtgtctga

SEQ ID NO: 90033 - DNA, 1005 bp, Glycine max
  Peptide Sequence Number=SeqID_206811
atggtaacctctttaaccacttacttggcaaaagaaattttccctagttacattagtcaactagatgaagagagggttacaggaattcagtcatctgctagagtattatggctacatgtcattgatttgatgatagcttttgacaaaaggattaagtctttggtagaccattctgggatcacaagtctcatgatttataatgcctttctttgccatctagcatctgttattgatcgatgtcgatcattgcctagtgtatttttgaggtcaaaatttcttagatttgcaagtatttgtattataagaaatttttttgattctatacttatccactgccaagaagctgaaggtttgactgccttaacagatgatgatgttgtaattaaagttacaatctctatcaatgttgctcattactttgaatctgttctaaaggaatggtctaaggatgtctttttccttgagatggggatggatgaggatgataaaatagaaatggaaagtaattcaaatagttatggtgaatttttgccagagagttccaaaagggttattttttatgatgagataaaaaagttagaagagtatagaacacagtgggttgaaaagatttacctagtcattttgagaggttttgattgtcattctcgagattatgtgaagaacaagaggcaatggcaaaagggtatagaaggatggattgtgtcaaagactctaatagaagccctggattatcttcagagtaaaatgtcagtggtagaggtaagtttggatggtggggattttgttggggtttggagaagtttggcagcaggaattgatcgattcatttttaatggtattctcataagcaatgtaaaatttcacaattttggtgtcgaaaaatttggtagtgagttggaagttttatttgggatatttagggcttggtgtttgcgacctgaaggtttttttttcccaaaatcaagtttgaatagaggtgtaaagatgagattacaacagtag

SEQ ID NO: 90034 - DNA, 414 bp, Glycine max
  Peptide Sequence Number=SeqID_206812
atgtacaaagataagtgggctcatactaagcccatgggcccgaaatctaccctaaggctcatgagaaccctagggccttctcttgcatctttggcccaatcttcttggagtcttctatccaatgcccttgggggtattcaatcatgttcttgcacaaccgccgaagttggaggcactgaagaagaagcaggagattcacacgcgcctcgccgccgaaggcaagaaattcttgcacaactggaagatcatgttcttcaagagggtttcactttttgtgccccatcgacgattgagttcatgcaatccgaatcgcatggagcagtgacaaccgagaacgacgtggagctcgtcacggaagtgggtgatgctggtggccaaggcaagaggaagcgcaagaagctgaaggggctctag

SEQ ID NO: 90035 - DNA, 210 bp, Glycine max
  Peptide Sequence Number=SeqID_206813
atggcgattttgctgggtttaaatttgcggaaccagggaggggagagaggagcagttggtgaaataaggatcacgagtttcgtcccagtcgagctggattccggtctggaggagctcttcgaggaagccgaggatgtcggtctggcaggcggaggactggtcggtgtcggaggaggagtggtggtgggtggaagcgcagtcgtggaggag

SEQ ID NO: 90036 - DNA, 1569 bp, Glycine max
  Peptide Sequence Number=SeqID_206814
atggcagaaggtgtgaaattggaggacagatggggatactatgttgcaacttcttctcaggcatgcgtttcagccatcaactcttactaccatcaggttctcatctatggcagagagaggtctgtgattctggaagcagtggcacatgacaaacactgtgtcttggccaacatcttggcagcacatttccttcactcttctggctcttcccgtgctctcacttgtcttcatgccgctaagtccaaccttgaacatgccaccttgtacgagaaactagttttcgatgccatcagttatatgctatctgaagatagagacgatgatgtagctgttgaattgcattccaaggacgatgttcctacctataccgaaggaggtagtgcgagaatcttacattggttatactctaacgctcaagaggtgcaccccctagggcattggatagttgatcgtgtgggtgccattaggctaggatccagtagggacctcctagtccagattagttttctgcttctgaaagagttcccaagagatctggtttctctaaagagagcacaagtcatatgcttctacatgggtctgcctggtctttctttatctcttattcaaaaggttctgcctcacaatgaaggagaaaatttcatatatggcatgcttgcttttcctttgcttgagcttggacggatggaggaagctgagaaagctgccaaaaggggatttgaaatcaataagcaagacagctgggcacagcatgctttatgccatgttcttcagtataagtgctgttttagagaagctgttaagttcatggaagaatgttcatcatcatggggttcttcatcttttatgctgacacacaattggtggcatgtagcactttgctacttagaaggtaatgccccgagacaaagagtgctagagatatatgacaattatatatggaaggagctagacagaaatgattctatgagtgcagaggtttacttaaatgctgcgggtctgcttttgcggttgtatgtacgtggtgaattggatatcattggtgatcgtctcaagatgcttgcggaatgcctaactaatcaagaaaactggtatatggagtggcactttgatgtattgatagtgtggactttggcaaagactggagaaatttcaaaagcagaagatcttcttaagggcttaaaaaacaggtttttgaggatgactaaaaagaagcaacaacggatgcagagaggaatgatgcttgcagaagcactttatgcgtatggaatagctgatgataggcgtgggctagaattacttgatccagatttcgatgccactgattataagatcattggggcatctgatgaacaagtggacgtattcaatgaagtttggtataatatgttactgaatattggaaatgcgttgaaggcaattgaagtgttagagaagcaaatcaagaagagggatggcgtcccctacttgtggcgtctactagagagggcatacaaactagctaacaagccagaagaaagaattgcgaacgagaaggccacggctttggagagtcgttacttcaattaa

SEQ ID NO: 90037 - DNA, 1461 bp, Glycine max
  Peptide Sequence Number=SeqID_206815
ggattgcccatcatccttaccctgcttactgagtaccactcaactcccacagggggccccaccggcatcgcaaaaacattggctaggctctctgaaaacttttattggtctagcatgcgtgtagatgttactcaatttgttaccacttgcattgattgccaacatactaagtatgagacaaagcgaatcgtaggcctattatgtcctctgctagtgcctcatcgtccttgggaaaacctctccttggacttcattaccagtctgccgccgtatcatggtcacacagtcatcctcgtggttgttgacagattttccaaggggattcatttggggatgcttactccttcacatacagcccacactgttgcttgtttattcatcgaaattgtggccaaattgcatggtatacctcgaagtctggtctcggattgtgacccactcttcgttagtaacttctggcaggaactttttcgtttgagtggcaccaaattgcagatgagttcagcttaccatccccaaagtgacggacaaactgaagttctaaatcgagttattgaacagtatctgcgagcctttgtccaccggcggccgggaacgtggggcaaattgttgtcgtggatagaatggtcgcacaacacttcttggaatgttggaactagcaccactccatatgaaataatgtttggccgaaaaccttgcacgattccagattacatcacagacatttctgacattgccgtcttcgaaactatgttaactgacagggaggataccttcaagtacattaggaagaagcttcttaaagctcagggtttaatgaagcatcacgccgacacgcgacgtcgtgatgtcgaataccaaagcgcattggtcaagttgcttacagactccaacttctggcaggagcgtgcatacatccagtttttcaatgaagtattggtccaatggcaaggactccctcttgatgatacttcgtgggaagactggtccacatttttccaggattatcaccttgaggacaaggtgcttctgcaagggtcatggagtgttagcaaagcatcagacacagaggcaagcacaaggtggcttacgtccttgaaaagtgttctagcgactgaagatgatgaggcaaagaagctacactttgagcaagcggaagaagtgcttgagaaggtggaagaagtgttcaacaagtgcagtgaagggaaggcctatttcggaggagatacgattggatttgttgacattggttttggaagctttttgagtttcattagagtctcagagaatatgaatgaaagaaaattgcttgatgaaacgaagcaccctggtttgaccctatgggctgaaacttttgctgctgatcctgctgtgaagggccttctgccagagactgaaaagcttgttgagtttgcaaagattcttcagctaaaatgggctgctgcagctgctgcaaagtaa

SEQ ID NO: 90038 - DNA, 252 bp, Glycine max
  Peptide Sequence Number=SeqID_206816
atggagggcaggtgtggagaagaggaggaaggagaggagaatgatggtgaagatggatggagacatggattggggagagaggactcatcaatgaatgggaggggtggagggatgagggaatctaatttgggtgaacaatattgcatatgtacccagaactcccatgaattgtgttttggcaccaacccaaacaaaaatctcgaaagaggaaactggtgcgcgccacttccgctcgtggggccttccagctga

SEQ ID NO: 90039 - DNA, 180 bp, Glycine max
  Peptide Sequence Number=SeqID_206817
atgggaagaggcagtcaacagtggcgactttgggggataacgcgtttggatgcccgcggggagttaagagtaggtggaaaaagatatgaaggtgggatcatgggcattgatgatcattcacatgaggttttaggaacgtatgtaggagcatgggaatgcattattgcatcatcaagttga

SEQ ID NO: 90040 - DNA, 1470 bp, Glycine max
  Peptide Sequence Number=SeqID_206818
atggcatggtcatcctcctcctcctccacctccaatactcctccacaaaagcatgaggtgttcattagttttagaagtgaagacacccgcaagacattcaccagccatcttaatgctgctttggaaagattagatatcaaaacctacttagacaacaataatctagatagaggagaggaaatacccacaacccttgttagggccatcgaggaagcaaagctatccgtcattgttttctctaaaaactatgcggattctaagtggtgtttggatgagctcctaaaaatacttgagtttggaagggctaaaactctaattataatgcctgttttctatgacatagatccttctgatgtgaggaatcagaggggaacctatgctgaggcatttgataaacatgagagatattttcaggaaaagaagaagctgcaagaatggaggaaaggtttggtagaagcagccaattattctggttgggactgcgacgtcaacaggacagaatctgaaattgttgaggaaattgccaaggacgtgctagaaaagcttaatcgtgcgaacgtcagtgacctagatcgtcagataactaagtacgagcaacttgcacaacttcagcatcaatattttatgtgcataccttctttggaaaattgtcaaaatcatcgagcaacggttcaacgcatcacagaacttaaaatggagagaaggtcatcctcctcctccacctccaatactactccacaaaagcacgaggtgttcgttagctttagaactgaggacacaggcaagacattcacaagtcatcttagtggtgctttggaaagagtagatatcaaaacctatgtagataacaataatcttgagagaggagaggaaatacccacaacccttgttagggctattgaggaagcaaagctctccatcattgttttctctaagaactatgcggcttctaagtggtgtttggatgagctcctgaaaatacttgagtgtggaagggccaaaaggcaaattatagtgcctgttttctatgatatagatccttctgatgtgaggagtcagaggggcacctatgctgaggcatttgccaaacatgagcgaaattttaatgaaaagaagaaggtactagaatggaagaatggtttggtagaagcagccaattatgctggttgggattgcaaggtcaacaggacagaatttgaaattgttgaggaaattgtcaaggatgcgctggaaaagctagatcgcgcgaacgttagtgacctggatcgccatatcaataaaatggagcaacttgcacgacttcaacatcaattctatgaggacatacgtacttatgaaaatatgctaaaacgtgatgcgaccgtacaacgtgtcacagaacttaaaatggagagaagtatccgtttgcttcgtctcacgccagatatgctctcccatttgggaaattcaagcactaatgactttttttga

SEQ ID NO: 90041 - DNA, 424 bp, Glycine max
  Peptide Sequence Number=SeqID_206819
agcttcttcttcttctgatgaatgctttgaccctgctgatgaagcccaaagggatgctaatgctgctgttgaatcctccatcaaagcctctggctttagcttaaacattgcaaattggttgaggaaatttggtttgcctgattgggttggggtgttcacccttgccactcttcctgtgcttgagtttcgtggcgctatacctgttggttactggatgcaactcaaccctgtaactttaacagtgttatccattctggggatcccttctgcgtcgcaattccttgacatgctgtttgagaatgccaaagagaaggctggtccagcagaggagtttcaatggcttggtctgatgctgtttgtggccgttccttttcctggaacaggagcatggactggatggagcctttatagcatccattcttga

SEQ ID NO: 90042 - DNA, 498 bp, Glycine max
  Peptide Sequence Number=SeqID_206820
atgatgtccaactataaagacgttaaagaagcgctcctgggaggcaacctaatggatccaaagaaactcgcctctaagagagctaggaagactactgcaagagaaggatctagcatagctccaacaatacaatttgaatttgatggacactgctttcatagtgaggaacatcaacaccgctttgaagtgatcaaagattggtctttcctcaaggaaagaatggagctgagggcaaatgcatggcctactaaggaaggtgttatggataagcgctccaaagtgcggggccaatggattccttatgacacagatgccatcattcaatttttagggaatccattgatcttagaggaggggcaacaatgtgaatacattgcaagaagaggtcaaactacaggttttgatgaagaggctataggtcaaatactttgcttcctaggacgtgattttgtttggagcaccgaattccattatttccataattttgttattccatga

SEQ ID NO: 90043 - DNA, 240 bp, Glycine max
  Peptide Sequence Number=SeqID_206821
atgttagccctcaaccattctctccgtcaaactcagccacatcaaagcggagcatacgtcaaacagtctgtccctcaaacccctttttgctttgttagcttagcagccattaaaagtgtgtgttcgtgcgcctctaaaattcctaggtggcaattgcaaggtttcaagcggctgcagcaattcgagaagcaactattagagaatggggttttcttagtgctgatgacaagaaaggcttga

SEQ ID NO: 90044 - DNA, 282 bp, Glycine max
  Peptide Sequence Number=SeqID_206822
atgcaaacaaggaattgtctccttgacaagaaaactggctttccaagagagaatgtaaagattataggagaaagaccacttcaaggcaatagatggaacagaatggaccaatcatatcccattcctgactattgtgagcctcaggcacttcagggaaagtttgagattccaattctcacccttacaatgccaaagaagacaacttctcaagttgctcctaaacaacaagaactgggaacttcccaagagaatggtgaagcaaagcccacagaaaatgtataa

SEQ ID NO: 90045 - DNA, 1566 bp, Glycine max
  Peptide Sequence Number=SeqID_206823
atggaaagaagggttgcaattatcggggcaggaacaagtggccttgttgcctgcaaataccttttagagtttggatttaatccaattgtctttgaagttgaggatggtgttggaggactatggagacatactatagagtccaccaagctccaaaataagaaacaaatgtaccaattcctggattttgcatggccttcttcagttaaagaagataatcctagtcacgagcaagtgctagattatcttaactcctatgctgaacatttttctctcattccttacattagattcaactccaaagtcattgatatagattatgttggtggagagtctagtgaagaaatgaaatcatgggaattgtggggtggtaatggcaggcccttctgctccaagggaacttggcatattgctctgcaacataccaagaatttatccatagaggtgtataaggctgagtttgtcattctttgcgttgggaaatacagtggttttccaaatattcctgaatttccacccggaaaaggcccagaagtttttaatggcagggtcatgcactacatggactactcaaatttggacaatgagactgctgctgaattgatcaaaggaaaaagagttacaataatagggtcacagaaatctggtcttgatctagcagctcaatgttcaaatgcaaatggagtcacctatccttgtacaattatccaaaggaccgcacactggtttcttccagattttgacacttggggtgttattgttggattcttattcttaaatcgctttgcggagctgttaattcacaagccaggagaacccttcctacttggccttgtggccactttactttcaccattgagatggggaatttctaaacttgttgaaactattctaaaatggaagctgccattaaagaagtatggattggtacctaatcacaactttcttcaagacctctccacgtgcttgcttagtctgctgcctgataacttctttgacaaactaaaagaaggatccatccttataaagaaatcacaaagctttagtttcagcagagaaggtgtaatcattgatggagaagctaaggtcctagaaacagatgtagtaatttttgccactggatacaaaggtgatcaaaaaatcaaaaacatgttcaaatctccgatcttccaaaattatatcattgggccaacaatctcaacagttcctctctacagacaagtaattcaccctcggatcccacagttggcaatggtaggatatgccgagggcatatcaaatatttttgcctcagaaatgaaaagcatgtggctagtgcatttcttggatggaaacatagggttgcctagtataagagagatggaaaaggatgtgaaattgtgggaagacaatatgaagcaatatggtggacgatattattggaaatcatgcattgctaattgttgcatctggtatcaagatcaattgtgcaaagacatgaagcataaccccagaagaaagaagagcctttttgcagagttgtttgaaccatacagcctcgctgattatgtgggtcttactcgtaattga

SEQ ID NO: 90046 - DNA, 255 bp, Glycine max
  Peptide Sequence Number=SeqID_206824
atggttgatctgcagctcgcacaggcgacctgtttcttcaacctaaagcaaccttgctcgcctaggcaagctggttacttcacccctaagttatttgggggcccaagcgagccagaggctagcctaggcaagccaggggtcaggaaaagctccaaaatgacctttttgccctcccatttgagtatttaccgcatgttttgccgaaacgtcaaaaaacctttcgtattgcacgacaactggtgtcaagcagcttaa

SEQ ID NO: 90047 - DNA, 771 bp, Glycine max
  Peptide Sequence Number=SeqID_206825
atggagattgtaatttttgaggtgttggatcacattccaccgcttcatggagtaagaattggtattcttcaagccatgctaatcttcaacaattcgacacaaattagtaactgtcgagggaatctcaccggaaaagctcaaatcctccggagggggattggagattggagagcacaacccatttttgtggtggctgtcgtggtgccatggaggtggtctcggtggccactaactatcaaggatgaaaggagctgtacggaggctataagggattgggatagagatgcaaagtacaatcctttgtactttgtaggatttcggatactatgtgggtgcactaaaatcttcttcttcttcttgaggatgttggttggtgcttttatgatgatcaatgtttgcagaatcgcgatctatctcataggattgtttggttctacgcaccaaggaactatctctgtgttgaatcgacatcatgatggatggctaattgtgggaatgatgaagagtgagcgtctctatgaatcccagggtggccctatcttactctctcagcacagagtaaatttacttggactcgttggccaaaattatgtgaactgggctgcaaaaatggttatggaaatgggaactggggtcccctgggtgatgttcaaggaagatgatgcaccagatcctgtggtgagcactctcattcttcctcattcttatgttcttaacaaggactatgctcaacaacaacaaatccactttaaccatagattcttgaattag

SEQ ID NO: 90048 - DNA, 537 bp, Glycine max
  Peptide Sequence Number=SeqID_206826
atggaatccacgaaactccaaaacactaaaccaacgtaccagtttatagattttccatggccttcttcagttaaagaacataatccaagtcacaaccaagtgctagattatcttaactcctatgctgaacattttcccctcattccttacattaggttcaactccaatgtcatcgatatagattatgctggagagtctagtgaagaaatgaaatcatgggaattgtggggtggtaatggcaggcccttctgctccaagggaacttggcatattgctatgcaagataccaagaatttatccatagagagatcgggaatttctaaacttgttgaaactattctaaaatggaagctgtcattaaagaagtatggattggtacccaatcacagctttcttcaagatctcttcacatgtctgcttggagtgtttcctgataacttctttgacaaactaaaagaaggatccattcttatgaagaaatcacaaagctttagcttatgtagagaaggtgtaatcattgatggagaaagcccctag

SEQ ID NO: 90049 - DNA, 1635 bp, Glycine max
  Peptide Sequence Number=SeqID_206827
atgaatgaagcttcgatcaataacgcagaaagttatttgtatctccatccaagcgaaagtcctaccatagctcttgtatctccagtcttagactcaattaattaccattcatggagtagatccatggtcactgcactaagtgccaagaacaaggtggaattcatagacgaaagtgcgcctgaaccactgaagatggacagaacctatggagcttggcgccggtgcaacaatatggtcgtatcgtggatagttcactcggtggccacctccatacggcaaagtatactttggatggacaaagctgaggaaatttggcgtgatttgaagtccagatattcacaaggagaccttctacgaatctccgatcttcaacaagaggcgtcaacgatgaaacaagggtcgctttcagttacggagtacttcacctgcttgcgtgtaatctgggacgagattgaaaacttcagacccgattcaatctgctcatgcaacatcagatgctcttgtaatgctttcaccatcatcgcgcaacgcaagctcgaagatagagccatgcaattcctacgaggtttgaatgatcaatatactaacattcgttcccacgtgcttctcatggatcccatacctgccatttccaaaatattttcttatgtagctcagcaagaaagacaattgttaggcaacacaggtccaagcatcaacttcgaacccaaagatatatccattaatgcggcaaagaccatttgcgacttctgcgggcgtgttggtcatgtagaaagcgtttgctataagaagcatggggcgcctgcaacttatgatggaaggaacaagaacaataatggaagaaagacctgtactcactgcggcaaaataggacacacggtggatgtttgttatcggaaacacggatatccaccgggatacaaatcttacggtggaagaaccaccgtgaacaacgtggtagcagtagaaggaagagccacggatgatcatgctcagcaacatgagtcacaagaagttgttcacttctcacctgagcaatacaaggcacttcttgccttaatccaacagccacaggcaggaaacacggcacccaatcagcccaaacaggaaacgaacaatcatatgaagattggtatagttgaagcaaagcatggactctatcacctgatacccactaaagctgtaaactccattatcactcatcctcagtgcaatatcatccctatagacctatggcattttagaatgggacacccatcagttgagagattacagtgtatgaaaaactattatccgcttttaagaaatgataaaaaatttgtctgcaacacatgtcattatgcaaagcacaagagaatgcctttttcttctagcaaatcgcatgcatctcatccttttgatctgctgcatatggacatatggggcccatgctcaaaactatccatgcatggtcacaaatattttctaaccatcgttgacgatcattcgcgttttacatggatatacctcatgaaatctaaagccgaaacacggcatatcatcaccaacttcattgctttcattgaaacccaatataacggcaaaattaaaataattagaagtgacaacgggatagaatttttcatgcatgattag

SEQ ID NO: 90050 - DNA, 491 bp, Glycine max
  Peptide Sequence Number=SeqID_206828
atggaatgttcatcttcctcctcctccagtactacttcacaaaagcacgaggtgttcataaacttcagaagtgaggacacgcgcaagacattcacaagccatcttaatggtgctttggaaagagtagatatcaaaacatacgtagataacaataaccttgagagaggagaggaaatacccataacccttgttagggctattgaggaagcaaagctctccgtcattgttttctccaaaaactatgcggattctaagtggtgtttggatgagctcctgaaaatacttgagtgtggaaggaccaaaaggcatattatagtgcccgttttctatgatatagatccttccgatgtaaggaatcagagaggaagctatgctgaggcatttgttaatcatgagcgaaattttgatgaaaagaaggtgctagaatggaggaatggtttggttgaagcagccaactatgctggttgggattgctacaacaaggtcaccag

SEQ ID NO: 90051 - DNA, 342 bp, Glycine max
  Peptide Sequence Number=SeqID_206829
atggatgtttatcattcccagcttggtacaaaggtgttggaagatggctggggtcagagctttagtgaaaatatccgcgagttgcagagaggacgaaactggaagaagcttgatgagacccgaagtgactttgttacgaacaagatggcaatcgatctcaatatgcttgatcctgaagaagatatgtcagccattgtatctcacaggtggtggatgcaagagcccgatactcagcctcggaggagctgcgggagacagtggattgcttctttgactgccatgaaacaagtgaagagcctaaccgttgaagcttttgatgtagatgaagcaaagtttctgtga

SEQ ID NO: 90052 - DNA, 312 bp, Glycine max
  Peptide Sequence Number=SeqID_206830
atggatagggatttcgatggttctgaatgcagatatgcgaagtcagtttcatcagttttgtggtttggtaggtggttgtggactggatggggagaagtggagggtgattggatgcagaatccgattgtgtgtttagggtgtagaaattatgaaaaagctccaactttgcaggagaggcttgaattttgttctgtcattattgatgtcaatgattggtttgtggaaacttctggtgcaggttgctatgttgatggggtctggaagggatatgttctcgtgacgtatggattgttttggaatagcaaacagtag

SEQ ID NO: 90053 - DNA, 927 bp, Glycine max
  Peptide Sequence Number=SeqID_206831
atgtatgaagatcctgtgagaatagttgaggaattaagaggaattcaaaaaccaatttcttccaagtctcaaaaggggaagaacactcctcatgtagatgatcatttcatgcctagaacaattcctgaagctcaacctaacttgaagagtgtcttgcaaaatatgcaaattgtagaaaagtgtgacaaagccattgcaaaatggatgatagatgctttagtgccatttaatgtagttagctcggcatattatcaacctatgattgatgctattagtagcataagtctagggtataaagctccaaatttttatagaatttgtgatcctttgttaaatatgtgggttgatgatgtgaggaaccttattgaaagttacaaagaagtttggaaggaaactggatgtactctgatggctaatgggtggactgaccgctctaggagaactctcattaattttcttatttattgtcttaaagggactgttttcttaaggttattagaaaaagagtttcctaaattatatttgtcttcttgtgctgctcactgcattaatttgatgttgcaagactttgggaaatttgaggaagtatgtgagattgttttacatgcctcaaaaattactaagtacatatataatcattgttatgcattattcttgatgagacaccatacaggtggaagagatatacttcatccagctccaactcaatttgcaactaatttcattgccttgcaaatcatattggctcaaaagaatgcattgatggctatggtgacatctaaggattggataggatcaacttatgccaaatactccaaggctaaaaaatttgtggaacaaatcttggactctggtttttggaaacaatgtgctaatattgtgaagcttacaaaatcattggttatccataaggccagagaggagatg

SEQ ID NO: 90054 - DNA, 690 bp, Glycine max
  Peptide Sequence Number=SeqID_206832
atgggtgataacactgtacccgaaatacagcggactaaccttgcaaatgtgggtttaactttaaaaagtcttggtattgacaatgtaatgcagtttgattttatggatcctccacctgatgaagccttattgaaagctcatgagcttctatatgcattaagttcattgaataagtttgtggcctcagaaaagtacaagtgttcggatgatattatctctattgctgctatgctttctgttgggaagtcaatattctaccgtccaaaggataaacaggtaaggagcatgagacagactagggatatccgtgatcaacttgcaggtcttttagagagggttgagattgaactaacttcaaattctagtgatgtagatgccatcaagaaatccattacatctgggtttttcccacactctgcgagactgcaaaagtttggattatataagactattaaacatttacagaatgttcgcatacaccctggttcgggactggcgcaggttcttcctagatgggttgtgtaccatgaactagtactcacaaccaaggaatatatgagacaggtgacggagataaatccagagtggttggtggagatagcccctcactattaccagctgaaggatgttgaagattcatattccaagaagatgcctcgtggagcaggacgtgcatatttggacagatag

SEQ ID NO: 90055 - DNA, 717 bp, Glycine max
  Peptide Sequence Number=SeqID_206833
atggcttgcatgggtaatgaaataagtgaagacaatagatggtaccaagacattggtgcaagcaatcatatgtgcagaaaaaagagcatgttcatggagcttgatgaatcgatgagcagcaatgtggcctttggagatgaatctaagaaattcaagaaaagcttcccaaaggagtctagctcaaaagctaaaaagccgttggaactcatacatacagatgtgtgcggtttgattaagccaagctcacttgaaaaacatgggtatattttgaaacataaatcagaagtgtttgagaatttcaagaagttcaaagcctttgttgagaaggaaaatggtcttaagattgaagccatgccatctgatcatggaggagaactcacatcaaatgaattccaaaagtattgtagggaccatggaattcgaagactattaactgtgctgagatctctccaacaaaatgcagtggtagaaaggaagaataaaaaaatattagacatggcgaggagcatgcttaagagcaaaagactgaagaagcaaagctgcatgaacaattcaagatttcaagataagaatcaagaagaaagtttagagtcaagaatcaagattcatggttcaagatctcaagaatcaagatcaagattcaagactcaagattcaagaatcaagagaaggcttaatcaagataagtatgaaaaggttttctcaaaaattgagtag

SEQ ID NO: 90056 - DNA, 1068 bp, Glycine max
  Peptide Sequence Number=SeqID_206834
atggatcgccaacaggtctcacaagtgcatctatatgtactcaccaacacaacagaggttatcccatacatagatgctaaaaaagaaaatgtcgcagctagtcacccaaacatgaatatgatgagggtgttgcaagagcacaataagactttcattaattggtttagaaaaacaatattcgctaatgatagtgcttctaaaaaattaagattgttagctgttggaccaaacctcaatgtcctcacttggaagggatatgatatcaaaaactattctttctacacaaagtcacaagatgataaaagtacaatgcaaaatagtggggtgactgttgatgctcattctgataactttagtagtgcattagataacaatctgattcaagcatccatgtcttattttggagggaaaacaagtggtatcccttacgattttgatgcttcaacacttgatgttaacgagatgcccatgttctccctacaaatgccttccaaaaatgctgaaaatgaggacaatgatgtatatgcaaatcgtatcgatcatgatgaaggtttatgggagaacacggctacggccatggcaacacccccgagttcccctccaccttcagatgctccaagtgcaactacaaaaaggaagactagaaaaactacccggctcagaagattgactggcagaagtttggatcaaccacgacctactatcaatgtcaaccctattactggtagaggatctgactctcgtaaagaaaagttgcatagttacctgggggtagtagcgcgggagaaaatccctattgtacattccagttggaaagttgtccctgaatctctaaaaaatcttatatgggatggcattttggtaagtgcacttaagatcaattgccaagaagaggtcatgttgacggttgcgacgagatggaggcaatttaagtcctcccttaccactaaatatgtatatgctgacaaagacagtgaagataaccatgatccatctgctaagtatgagcatcctggtcgtgttcgtgtagctggacatggtgtcaccatcggtcattactttggatag

SEQ ID NO: 90057 - DNA, 1476 bp, Glycine max
  Peptide Sequence Number=SeqID_206835
atgagagcatataatttcttagaagttggtgctgcaactctacttgaaggagacattggagctaagatgaaggggcaagcatggaaagtttttgggactgatgacatgccttatctggatcaactattgcagggttctctagtaacatcatttactaattttgcatctgcttgtccctatctgagagcaataacaacatctaaacacacaaaagcaggccctcatcaactttggcatgttcttctatcagataagtttctgctaacatattttttattctcattttatatgaggttatgttttccaattaatgtaccagatgggtatcatagatttgagggaaagaatatggagatagagattagtggcatgcactttgttgggaaggactttgtggctgtgggttgcttattcaagtttttgttgggattcactgaagagaaggagtccttggctgtggggagtgaaatactggttttggatcgggaattaatggatttttccatttggaagtacaacttgatttcttgcaattgggtgaagtgtaaggagatgaacagtcctcgctgcttgttcggatctggaagtcttggttcaattgctattgttgctggtggaactaataaatatggaaattttcttgaattggcagagttgtatgactcaaattcaggtacatgggaactattgccaaacatgcatacaccacgtacattgtgctctggtttttttatggatggcaaattctatgtgattggtggcatgtcaagtcctattgtttcattgacttgtggggaggagtatgatcttaagactagaaattggcggaaaatagaggttgtggataaccagctgtatgtcgttgagcatcgaagcaacatggtgaataaatatgacaaggaaaggaacacttggagtgaattgggaaggcttccaatacgggctgattcttctaatggatggggcctggctttcaaggcttgtggggagaaacttctggttgtaaatggacaaaggggtccagaagctcttgctattttgaggccccaagaaattgctgagcatcatgcacttcttactttacttggatggcccccacctctttttgccttaacctccttggattcagatgcaaggactgcaaatcaagttgtgaatcctctactgatcatgcaagtggatcttaaagtccagagttgcaacgacaaaggaaacattgacaacttgagggccgtgacagggaagttgctctacgacaatcactttggggattatgttgactctatggatgaattgttgcagccattggttgatgaagcagagttggtagctgtcgcaacctacccttcggcgggagggcgacgcgtgacttgcgggggcgtcttccaagaacggaatacgcgcggagtcgccaccaacatttatttgaggaaaacatcggaaaaaccaaaaaaagacgtggtctgcgaactttaa

SEQ ID NO: 90058 - DNA, 249 bp, Glycine max
  Peptide Sequence Number=SeqID_206836
atgatgaaagccctcacaagctcttgttctaaggccatggtcgagactctaggacccttctctcccagagttcccctttgtgtttctgatagacccgaattctgcttcacccttcgttccaaaaatgagaaaaagggatggaatttattgctcctgaaactggttcgaaacaatgatctttaccctgttcatgcagtgccaccaaaggaccagcttggtacgattctttccagcatatttcgggtttga

SEQ ID NO: 90059 - DNA, 984 bp, Glycine max
  misc_feature (964)..(964): n is a, c, g, or t
  Peptide Sequence Number=SeqID_206837
atctgcaccgacgaccgctccgcccgggctcgcgccctgggttttgcagcgaccgccgcgccctcctactcatcggggcttggtccttgccccgacggccggtctttcgcccctatacccaagtcagacgaacgatttgcacgtcagtatcgctgcgggcctccacagagttcctctggcttcgcccgctcaggcatagttcaccatctttcgggtcccgacaggtatgctctcactcgaacccttcacagaagatcagggtcggtcggcggtgcaacccacagggtggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtntcttttcctccgcttattga

SEQ ID NO: 90060 - DNA, 297 bp, Glycine max
  Peptide Sequence Number=SeqID_206838
atgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaattcctgaaccgggacgtggcggctgacggcaacgttagggagtccggagac

SEQ ID NO: 90061 - DNA, 444 bp, Glycine max
  Peptide Sequence Number=SeqID_206839
atggttgtcgatgttgaagatcttaattcaggatattacacaattgatgatgtaatccttcccatgccaggggaattacttacatatagtgatagtaataaacaattggtagagacagatttagacaaagttaacaagtctaagcctatgggcactgtcaaacaaatgggtgcagcaaatgggaaaaatgaagaagcctttgattgcattagagaattagagagctccaatgatgttgtaaaggttgagaattatagtgagattgcaggtgaggaaataaaattaccacacgacgaatctctcagtggctccagctctcaagattcccaaatcgctctaaaattgagctttactcttcctgcttcatgttatgcaacaatggccataagggagctgctgaagacttcaacatctgttgcatatcacaagacattaaaccaatag

SEQ ID NO: 90062 - DNA, 1872 bp, Glycine max
  Peptide Sequence Number=SeqID_206840
atgttcgatggagcaccggaccagttccaccaattcatagcaccaacaaggaccactcttcctcttcacatgtccttccctctccaccatcatgcctcttcaacccctcctccaaataccttcctaccctttgatccatataacccttcttctcatcatcatcacttgccatcactccaaacaaatcatctcttgcacccattgcacccccctactactattatttctcccactcccacccacaaacatgaacaagacaaggttgctccaatcaacaacaacaacgacgttgagattcaaagagatcaaaggcaattaccagatcagctaaccgattcctggaccaacgatgaagtgcttgcactttttagaatcagatctagcatggaaaattggttcccggagctcacatgggaccatgtctcaagaaagctagcagaggttgggtttaagaagagtgctgagaagtgcaaggagaagttcgaagatgagagtagatatttcgacaacattaataataactacggaaagaacaatttccggttccttattagcgagctggaggagctttgtcaaaaccctgatcctggtggtggtggtgataatcataatggggttgaaaagactcaccccctgggaggagacaacatgggccaccacgcattggaagaaaataaaagagacattgaaataactacagcgaccaaacaatgtgatgacattgtggtggagaagtcaaatatttcaaaggtgcgcaagaggaagaggcgtgataggttcgaaatgttcaagggtttttgcgagagtgtcgtcaacaagatgatggctcagcaagaagagattcacaacaggctcctcgaggacatgctcaaaagggaccaagagaagttcgccagagaggaggcgtggaagaagcaagagttggataggatgaacaaggagcttgagattatggcacaagagcaagccattgccgggggtagacatgccaccataattgaattcttaaagaaatgcgcaacaacaacaacttcattatcatcccctccaagccaaaatgccaagtactacaaaacaaatggttcaaatcttccaaattgtgcattgcacccgcaaaaccctaatgatccttccaatgaagacaacaatcttgagccaacaccttctcctaaaatgattcaaaatcatgatcaagctacgttattgggagcagaaaaccctagcgcaagtgacacattactacaagttccttcttcctccaactcttccccaacacccggccacaaccctagttcttcactcaatagccacaataacattatcccattagactcaaattcagtttcaacatataagcccacctcaacaacccctatggccagtaccagtgagaattcgaaagatgatattgggagaagatggccaagagatgaagtgttagcactgataaacctgaggtgcacaagtctaagcagcagcaacaacaacaacaacaacaatgaagagaaagaaggaaacaataagggtcctctgtgggagagaatctcgcaagggatgtcagagctgggatacaagagaagtgcaaagaggtgcaaagagaaatgggagaacataaacaagtacttcagaaaaaccaaggataatgttaataagaaaaggtcccttaactctaggacatgtccttatttccatcaactgagttgcttgtatggtcagggaaaaatcgtgccacagtctgatgaaagggaagggaaaaactacttgaatccaaccgcgaattccggtgatcaagtgccaccggatcatgatcaagtccaagctgatgagtcttatcaagtggggtctgctgctttggttcagtatgcatgttga

SEQ ID NO: 90063 - DNA, 863 bp, Glycine max
  Peptide Sequence Number=SeqID_206841
atggaggttcacgaccacacctcttacttaatttacttcattagctctattattgtcttcgcgttattcaaattagttcaaagatcggattccaaaacctcctctacctgctgcaaattgcccccaggaccaaggacactaccgctcataggaaacatgcaccagtttgttggctcactgccggttcatcactgcttaaaaaatttggcagataattatgggccgctaatgcatctaaaactaggagaggtatctaacatcatagtcacttcacaagaaatggcacaagagattatgaagacacgcgatctcaacttctctgataggccaaaccttgtatcatctagaatagtttcttacaacggctctaacattgtcttcagtcaacatggagagtattggaggcaactacgaaaaatatgcacagtggagctactaactgcaaagcgcgtgcagtcttttcggtccataagagaagaggaggtggcagaactagttaaaaaaatagctgcaactgcaagtgaagcagaagggtccaatatttttaatctcaccgagaacatttactcggtgacttttgggatagcggcacgagcggcttttggtaagaagagcagataccaacaagtgttcatatcaaacattgataaacagttgaagcttatgggagggttttctgttgctgatctctacccttctagtagagtgcttcagatgatgggggcttcggggaaacttgaaaaagtgcataaagtgacagatagggtattgcaagacatcatcgacgaacacaaaaatagaaccagaagcagcagcaacgaggagtgtgaagcagtggaagatctagttgatgttcttctcaa

SEQ ID NO: 90064 - DNA, 159 bp, Glycine max
  Peptide Sequence Number=SeqID_206842
atggctctgtctgaaggtaaagtgaagtgtaatgttgacgcgactttctttaaggaaactaatcctatgtgcattggagtttgtttgagggatcatcaaggctttgaacttctacccccacgttcaccggcaggctttagcattgatggaagctattag

SEQ ID NO: 90065 - DNA, 549 bp, Glycine max
  Peptide Sequence Number=SeqID_206843
atgcataacttctttaaggaaaactttaagttcctggtcactgatgtggttgatggacccgatgcttcatcaaaatgtatccgtgtgagattgaattctgctgaaccaaacaacaaaggcaaaaactccaagaaacgcaaagaaagaggtgataagccctttgacagccgaggttcagaaaattggcctaaaaatgttggcaagttccttaggtttcatctttacaaggagaacaaagatacccacgaagccttgggggttattggaaatatgctcagtgtccagccaaaatcatttggatttgcgggtacaaaggacaagcgtgctgtcacgacccaaagggttactgtttacaagcagcgagcaagtcggctagcttcccttaacaagcgcttgtttggtattaaattgggtgatttctgctttatatttgtatccatagcattgacatattttctcagaggtattgttgcagattctgaagatatcataaaagcatctgcagatgccttaggaaggcacggcttcattaactactttggtctccag

SEQ ID NO: 90066 - DNA, 402 bp, Glycine max
  Peptide Sequence Number=SeqID_206844
tgaagaaatctatccccaagaagaaggacaaccattagtggttaaagagaagtgtaaggaggcacttgctagaattgccacacctcttgggcttgagtttattcctcaagtaaagaagttgttggatgagggtttggttcacaagagcttaaatccttgtgctttgttggtgcccaaaataggggttcccatgaaccctaagagaataaaggtcattcctgagtggccctctccaccaacaccactcattgagttggtgagaaaccatgttccttcatgggaagatgcccaggaaatgggtgttgagggaaggagcccagagtatgaagaacctcgggatttgaggtcaaatcctttccaaggtggagggaatgatgcaatcctatcctgcaaaggcattgg

SEQ ID NO: 90067 - DNA, 213 bp, Glycine max
  Peptide Sequence Number=SeqID_206845
atggaaaataacgtacctgtgttgatgtataagttagaacagatattcccagcaagcttctttgattcaatggagcatcttcgagttcgtttaccttatgagacaagacttggtggtccggtccaatatcattggatgtatccttttgagagtatttatgagaattttttgagggagatgaatcccactacttcagatgctcaacttaactaa

SEQ ID NO: 90068 - DNA, 429 bp, Glycine max
  Peptide Sequence Number=SeqID_206846
atgcactacgaggatcatatcgtatctgcaggtgaggtgtgtgtggtgccaggggcgtgttccagtgactacatcgactggttcttccgcatctcccatcctttcatgacaccaggccacacagtagatcctctgcctcatggtcatgccccgcagccccgagtcgtccctcaggccccgcagacggatatccctcgcgtgccggagccagaagcatcgtcgacatctacggaggagcccagacatgcagtggaagtttgtgatgacattgctgagcggttggagcgtcatctgagtctaggggtggtcacgcctggctcatcgacacatgaggtgatcgaagaatgtctcagattggccaggagtgtcacacaggaccatctagtatacgttaggtgtagacgcagacggcacactgatcaggcttag

SEQ ID NO: 90069 - DNA, 471 bp, Glycine max
  Peptide Sequence Number=SeqID_206847
caccatcagaggtcttcacgccctcacctccagaggactacacgtcctcaccttgagaggactacatgtcctcaccatcagagggctgcacgccctcacctccagaggactacacgtcctcgccttgagagggctactcgccctcgccctcgccttggaggactacacgtcctcgccttcaaagggtcatgtaccttcaacttcagaggactacacgtcctcgccgtcaaagggtcatgtgccttcacctttgtagggctacatgccctcaccttcagaggactacacgtcctcacctttagaggactacacgtcctcgccatcagaggactacatgttccccattttcaaaggggggcatgccctcaccttcagaggattgcacgtccttgccatcataggactacactccctcgccttcgaaaggcgacacgtcctgaacttcataaggctacacgccctcgcctttag

SEQ ID NO: 90070 - DNA, 226 bp, Glycine max
  Peptide Sequence Number=SeqID_206848
ggattgtgcccgcaagacacctagtggacccgaagaaggccaacagggtcgtggagttgccagctctaaatacgggtctctgtcagttctagggagtgcctgtcgcccccagcaaagtcatcaggcccccataccaatcgagctttcatcaagaagtactgtgcccccaggcaggcgcagggcgaaacaccacagcagcattgggatggccagtagcgggcaatag

SEQ ID NO: 90071 - DNA, 1038 bp, Glycine max
  Peptide Sequence Number=SeqID_206849
atggttaccaaatcagaggaaactcaactgagcaggctagaaaatcaggtcgataacggcggcggcggcgcgtgggagtacctctgcctcgtgcgaaagctgaaagttcggcggtcggagaaagttctgaagcatggtctctctatccttaacgaccccaaacaccgatcctctctcggctccgatgaatggaccttgtatgagcaggttgcagttgctgctatggattgccaatgtctcgacgttgccaaggactgtacaaaggttcttcagaagagattcccagagagtaaaagagttgtaactgtaatgtttacttgttccataacacaagtaattgcttgccctactctgattgttgatgcccagttcttgttctcttggaacaaacatttagactggtggatgactgacttggatgatttgcattccattctttcaggagggatgctatgtaggctggaggcaatgttgcttgaagcaaaaggatcctgggaattggcagaaaaggcttacacaagccttttagaggacaatcctcttgatcaagccatccataagaggagggtggcaatggcaaaggcacaaggcaaaatttctgtggctattgattggcttaataaatatctggaaacctgcctttattttctgccattccgtcctcccgttaggtataaacaagcagcgttttgctacgaggagttgatattatctcagcctactgttccactctaccacttagcatatgctgatgtactttatacgcttggtggattagaaaacctccaaactgccaagaaatactactcatctactattgacttgaccggaggcaaaaataccagagcactctttggtatatgcttgtgcacctctgctgttacacagcttacgaaagggaaaagcaaggaggacaaagaagggtcccagttacaatctctagcagccaaagtattagagaaagattacaagcagagagctcccgacaagcttcctcaacttacaactgccttgaagagtttaacattgtcatcatga

SEQ ID NO: 90072 - DNA, 204 bp, Glycine max
  Peptide Sequence Number=SeqID_206850
atggcgacgcaaaaaataacggaagtgaagagaatggagaaaaggggacactatactacggaagaaaacggaaactgggtattgtgcgagaccaagtttttacctgacacgaacaagagagccttttgttcgcgtgctgctgcgtccttcgtcaaaaaatccaatgagacactgttcatatgtactatacacagtttaatgtga

SEQ ID NO: 90073 - DNA, 402 bp, Glycine max
  Peptide Sequence Number=SeqID_206851
atggcgatgaaaactgcagaagaacacgaagtgggtatctcctgcttcatttccgaccttcctggcttccgcggaattttaaagcaaaggtattctgattttatcgtgaatgaagtggacagagatggaacagttgttcaattgtcctcgcttgatgcccctcaagaggagccagagagttctcaggaaaatggaaccaacacatccgacaatgttgtaagttatgcctctcagattgaatctttcaagtctcttgctggggactctgatgctgttcttttggaagaatttattaataaaattaatgccggtggagaagatggtgtttcgcccattgttctttctccagattctgataaatctcatcgaaagattcaggaaacatttgtctatattggctag

SEQ ID NO: 90074 - DNA, 900 bp, Glycine max
  Peptide Sequence Number=SeqID_206852
ggctcaaaatcaatcaacaagcgcaaaatcaagctccactggaacttcacccgcgcagagttcattcaaaactccgcagagccagagtcacgcttctaccttgcaatctcacacaatgacaaactccaattctttctcggagaccttctccgagatttgaatcggcgcaacaaaagggtcgacgttgaggctaacaacgttgttgacccggttctgctgtcgaggagagagcacgtgttcggaagaaggtgttacgtgtcacgtgcggtgttcatggggtcgaagcacgtgatagagatcgagtgcggagggggtgtgctaggagtgaaagtggacggtgagacgcggttggtggtgaaaaggttggcgtggaagttcagaggctacgagaagatattcatcaacggcgtccaagtggagttctattgggacgtgctgagttgggtggttaacagcaacaaagggaacgggcacggcgtttttgtgttccaagtgggagacggaacggtgtggccagaaatggtgggtgcggagaagaaattaatgaacaagagcgtgtccgcttctagcgtcttgcaatggccagaggacacttgtgacttcttggttagaagtgtatgtttaaagaggggagaacaactaatagcaatccaggggtgcaaccagaagttagccaacaggagcatatcctcctcgcatcaccatacgtttggacacgacttggttgtgatcgaagggaagaagagtgtttggaatctgaccaaggaacagaggtacgatcttacggttggggattacttgttcactccgccaggggatgtgcatagggttaagtattacgacgaggatattgaaactgctaaaaacgctattcataaggaattaggcttaattaactaa

SEQ ID NO: 90075 - DNA, 867 bp, Glycine max
  Peptide Sequence Number=SeqID_206853
gttgaggagcaaaagaaattggatgtgctttcaaatgaagtatttgtgaaagccttaatcagcagtggacgcacatgccttcttgtttctgaagaggttgaagaggctatatttgtgccatcatcacatcgtggcaaatacattgttgtgtttgaccctctggatggatcctcaaacattgactgcggggtttctattggaactatctttggtatttacatggtgaagaatgaggctgaagtaagtcttgaagatgcattgcaacctgggaaccaaatgttagcagctggttactgcatgtatggaagctcttgcacgttcgtgcttagcacagaaaatggagtgaatggttttacacttgatcctagccttggggagttcatattgactcacccaaacatcaagataccaagtaaaggaaagatttattcggtgaatgaaggaaatgccagaaactgggatgaaccaaccactaagattcctttcataaatgtcaaaattcttgacacttttcattctagatatgtacaaatgtgcaagtttcctcaggatggttcaccaccaaagtctcttaggtacataggaagtatggttgctgatatccatcgaactttgctttatggtggtatcttcatgtacccagctgatgcaaagagtccaaacggaaagctacggcttctctatgaagtctttccaatgtcatacttgatggagcaagcaggaggtcaggctttcacaggaaaacaacgggctcttgatttgattccaaaaaaaatacatgaacgatcaccagtattccttggcagctacgatgacatcgagcaaatgaaagagctttatgctgcatccaaagaagatgatgcatga

SEQ ID NO: 90076 - DNA, 450 bp, Glycine max
  Peptide Sequence Number=SeqID_206854
atgccacccaaaacaataactccaccagccaaaaatgtcccaaaggagccttataaaagtgacgtagctaggaatcaacatgcaaaagcattccttctcgatcatcgagggagaacgtacaatcaatcaagaagagaccttgcttgctaccccaagaccaacgaaggtgatgaggccccagtgcctgggcctgtgcctgtccccgccgaggaggtcaaggttgagcagcaagagaacaaggctgaggaaacccctgtcgcctctgctgacaactctctagtcaccttgctcaatgagaatgaagaaaagaaagaagagcaagttgaggccgaagaggaagccaagaccgaggaggtgaaggctgaagcccagaaagaagagaaagcccagacagaggaggcaaagcctgaaaccaatgaagagaaacccgcagccaaggctgacaactga

SEQ ID NO: 90077 - DNA, 353 bp, Glycine max
  Peptide Sequence Number=SeqID_206855
acggtaagccctggtaccacgacatcaaggggtacgtagagtgtaaggagtatccacagggggcttctgacaatgacaaggggacgttgcggagcttggcaactgatgctaaggaagccgagtggatgctcattgaggtgcatgaagggtcctttgggacgcatgctaatgggcatgccttggtcaagaagattctaagggcgggctattactggcttaccatagaaagcgactattgcatctatgtgagaaaatgccacaagtgccagacattcacggacaatgtcaatgctccgcccatgcccttgaacgttttagcagcgccatggcccttctctatgtggggaatagat

SEQ ID NO: 90078 - DNA, 291 bp, Glycine max
  Peptide Sequence Number=SeqID_206856
atggagttagctaaggtagatacgaggctcccctgtgggacaatagtagtagaagagaatgacaaacttgcaaaggaaagcaagattatccactatgaaaaagaattagaagaaatgaagaacatggcaagggtacagtcgaagtacctcaactttcagttactcataacaatagcagtgttgcttcatacagaacctccaaatcctatatttcccacaaaaaagcttaggattgaagtcctaaatgatgatgatgatgatgagtattttactgtgtttgatcttagctaa

SEQ ID NO: 90079 - DNA, 803 bp, Glycine max
  Peptide Sequence Number=SeqID_206857
gtataggcaaaagcacaagagagttaacattagggcagtgaagcattggtgtagacagatcctgagagggcttctctatcttcatagccatgacccacctgtgatccatagagatcttaaatgtgataatatttttatcaatggaaaccaaggggaagttaagattggggatcttgggttggcagcaattctccgcaagtcccatgctgctcattgtgtagggacgcctgagttcatggcaccagaagtttatgaagagtcatataatgaattagttgacatatattcctttgggatgtgtgtattagagatggtcacgtttgaatatccttatagcgaatgtagccatccagcacaaatctacaagaaagttatttcagagtggcaagatatcaatcgcattttacatttccaggggaagaaaccggatgccttgtataaagtgaaggatccagaagtacgacaatttgttgagaaatgcctggcaacggtgtctctaaggctctctgctagggagcttctagatgatccttttcttcagattgatgattatgagtatgatttgggacccgtggacagtggagcatttgatgacttgggtcctcttacccatcagccattctttgatctccaccagagttttagtaacatgagtactgaatactcaaatggcttcgaatatggagactggtattctcatccagctgatattgaacctagtggaattgaacttttcgagtgccatgatgaggaagcctctgaagatgttgacataagcatcagaggcaagaggaaagatgacg

SEQ ID NO: 90080 - DNA, 159 bp, Glycine max
  Peptide Sequence Number=SeqID_206858
atgtcaatagtgatattaaacctagatgttagaacagatgactccaacgatggagacaaggcttattggtggttgatccagcttgaactgtactttgcatccattggaatgtgtgaggaagagaggctatcaaagatagcaaaggctctaagagactaa

SEQ ID NO: 90081 - DNA, 990 bp, Glycine max
  Peptide Sequence Number=SeqID_206859
atggttgcagaactcgacattactgatcaggatgttaccagtattgcagatatgatagatggggaaattgcttccttggtacctgaatggaagccgggaccaggaattgaagaaaccaaccatcatttaaataattttttttgtcacaattgtgtgtctattcatacttcgggtggcaatgttatggaatttctttcacataatcaatgtggaaagaactcgcaacttcctcaatgctgtaggcatggatgtacttcaatgcatgggcgttttgaggagattaccttcccatccgagtgtgacaatcatgttagaggggatgcacctatcaaatcaagccaatcagactgcttgcagcgtcaggaatcatggaatcatcatgaaagttgtgaactgagtccagtagagtctgatgaaagtcattctggtgagcaatttgataaaccagtattagcagaagacaaaggaaaaaaaggcatttgggaaaacaagttcgcacatgatccaggaaatcccccacgaagtttatcaggaaattatttctctgctatccgttttttgtgttgtggccctgagattgaatatgagaaagaggttcgacaagaaatgagatggatcaaagcaaaacacaatagggagtcaagggaacttggagataaacggtttggtatagcaactgaatcttcacatactagtaatagagagcacaaaactgaacaatgcattatgccaccactgccacagacagcaaacggtgtgcacaatgggattcacttgaaacccttaggtaatatctggaattatgaatccagttgccgttctcaagtccaaaagaaccaccccaatttggacacccaaagggcccaaaattgtgaggtgatgtgttctcacaaagaaggtatggttactgagaagagtttttacacaggctcgcttagagacactctacacaggacagtttcccttcctgttgatgctgtggatgtttag

SEQ ID NO: 90082 - DNA, 165 bp, Glycine max
  Peptide Sequence Number=SeqID_206860
atggagaggagatctgtgttgccgtttaatgtacgggcggctgcggtggccgccttatttcatgagaccataatgccccgtttaagtgcgccctcgccgaaccgatactggcaacttttaactgtcatgaaacacataagggtgatattggatacacagacctag

SEQ ID NO: 90083 - DNA, 1965 bp, Glycine max
  Peptide Sequence Number=SeqID_206861
atgggagttccagcgttctaccggtggctcgcggatcggtacccactctcgatcgccgacgtcgtggaggaggagccatctgtcggctccggcgccgttgatgtgtctaaacctaatccaaatggcatggagttcgacaacttgtacttggacatgaacggcatcattcacccctgttttcaccctgatggcaaggtaaccatatgcttcgcttcacctcactttcattctattcacttttttctcgtgactcagaatattgcaaccgacggtgttgcaccaagagccaaaatgaatcagcaacgttcacggcgttttcgagccgcaaaagatgcagctgagaaagacgcagctgaggctgaagctgaaattgaaagacttagggaagaatttgagggtgagatgaaactcttgtcttctaaagtcaagccagagacttatgactcaaatgtcattacccctggcactccatttatgggagtgctgtcagtggctcttcagtattatatacagactagattgaactacaaccctggctggcggaatacaaaggttatactttctgattcaaatgttcctggtgagggagaacataaaataatggattacatacgattacagcgtaaccttcctgggtttaatccaaatactcgtcactgtttgtatggattggatgctgatttgattatgttgtccttagccacacatgaggttcatttctcaatattgagggaggtaatcactttccctggacaacaggagaagtgttttcagtgtggccaagttggccattttgcagctgaatgtcgtggtaagccaggtgagaaagctgaggactggaatccagttgatgataccccaattcacaagaagaaatatcagtttcttaacatctgggtgctgcgtgaatatttgcaatatgaaatggagattcccaaccctccttttgagattgactttgaacgcattgtggatgattttgtatttctatgcttctttgttggcaatgactttcttccacatatgccaacattagagatccgtgagggggctgtaaatttattgatgcatatttatagaaaagaattcaccgccatgggtggttatcttactgaagcgggtgaggctacagaaattaatgaagagatgaaagctagggcaagaggagagatgcctggagaaccacgggcatcagttttggacaaggttaagttaggagagcctggatacaaggaaaggtattatgctgaaaaatttggtgcattggatctggagaagattgaaaaaatcaagaaagatacagtatgtcctgtcttaaaatatgtagaaggcctttgttgggtttgtcggtactactaccagggtgtctgctcatggcaatggtactacccataccattatgctccttttgcttctgatcttaaagatctagctgatctggagataactttttttttgggagaaccatttaaaccatttgatcagctaatggggaccctacccgcttcaagttcaagtgcacttcctgaaaaatatagggatttgatgattgatccttcatcacctattcttcaattctaccctgctgattttgagattgatatgaatggaaaacgatttgcatggcagggtgttgccaagttgccattcattgatgagaagaaattgctttctgccacaagcaagcttgaagccacattaacggaggaagaacagctccgaaatagcaagatgcttgatttgctttatgtcagcagtgcgcataatttggctccacatatcttatcatatcatcaatattcttgtcaattgcctctacatgaaagacctgctctaccaattgacccaagagctagtgatggtatgaatggatatctctggttgtacgaaaggaatgtgctcagaaccactgtatcttctcccatcaagggattgcaagacattgagtttaatcaagttttgtaa

SEQ ID NO: 90084 - DNA, 225 bp, Glycine max
  Peptide Sequence Number=SeqID_206862
atgggtcgcacacttcaaagggatctgaataggattgcagcagttgcggatacatcaccttcagaaggtctgcattatgtattgacagagacaaccctagctttgcttcggcatcctgattactgtatctcagcgtattcatctgtaagtgactttaatctcaaatcttcttggatttcaagatgttattgcagacggcacagcttagtgctattgtgctgctaa

SEQ ID NO: 90085 - DNA, 1068 bp, Glycine max
  Peptide Sequence Number=SeqID_206863
atggtggattgtactggagagggcgtcttgttcattgaggctgatgctgacgtaacacttgatcagcttggtgatgctctccaacctccattcccatgcttcgaacaactgctatataatgttccagattctgaagaaattactgacactccccttctactcatacaggtgacacgactcaagtgtggtggtttcatccaggccctccgcttgaaccacaccatgagcgatgcagctggtcttgtacaattcttgaacgcatgggctgaaatggctggaggtgcaaagagtccttccattgcacccgtgtggcgtagggagcttctaatggcaagagatcctcctcgcatcacatgcaagcatcacgaatacatggaattcgtagacaccgagatcgaggaaggaagccttactttgcatgatgacgacatggttcttcgatcattcttctttggaccttcccaaatagcttcccttcgtcgcttggttccccattactgtgccacgtttgatctcatcacagcatgcttatggcgttgtcacacaaaagcattgaagatagatgcagataaggatgttcgaatgatggtcgccgtcaacgcacgtgctaagttcaatcctcctttacctgttggttattacggtaatgccattgcatacccagcagcagtcaccacagcagggaagctttgtggaaatccatttgggtatgcagtggaattaataaataaagtgaaaggtaaggccacacaagagtatatgcattctgtggcagatctattggctattaagggacgatacataccaagaatggtgaggtctcttactgtgtcagatttgagaggttttgatcccagacaaattgattttgggtggggccatgctctctatgctggaccagctcaaggaggccttggaccctttccaggagtaacgtttatcactccttttaagaatgcaaaaggagaagatggtttagtattgccgatttggttgcccacagaggctatgaataggttttccaaagagttggatggcatgtttggtttcatttgtagctcattatga

SEQ ID NO: 90086 - DNA, 420 bp, Glycine max
  Peptide Sequence Number=SeqID_206864
atggcctcgtcttcttcctttccctctctaatgtttgcagtgcggagatgccaacctgagttggtggctcctgctatacccagtactccccatgaacttaaaccaccattatccgacatagatgatcaagaaggtcttcgtttcctcgttccaatgattcagatttatcgaaacgagccatcgatggcagagaaagacccagctaaagtcattcgacaagcactcgcaaaaacacttgtgttttatcacccatttgaaggtaggcttagggaggagcctgaccgaaaattgatggtggattgtgctggggatggtgccttgttcatcgaagctcatgttgacataacacttgatcagattggtgatgcactccaacctccattgaccattcccatgcttccaagaatttatattgtttga

SEQ ID NO: 90087 - DNA, 966 bp, Glycine max
  Peptide Sequence Number=SeqID_206865
atggcggttgagaagttgagcattgcaaaagatgtgactgaattaattggcaaaactccattggtatatctcaaccgcatcgtggatggctgtgttgccaaagttgctgcgaagctagaaatgatggaaccttgctccagtgtcaaagacaggatagggtatagcatgattgtagatgctgaggagaaaggattcatcacaccgggtgaaagtgtcctcattgagcctactagtggaaacacgggcataggtttggcattcatggcagctgctaagggttataaacttattataaccatgccttcttcgatgagtctcgaaagacgaaccattcttcgggcttttggagctgagttagtcctcactgatcccgccaaaggtatgaaaggagctgttcagaaggcagaagagattcgggataagactccaaattcttatattcttcagcaatttgaaaatcctgccaacccaaagggctctagtgggaaggttgatgctcttgtctctgggattgggactggaggtacaataacaggtgctggaaaatatctgaaagatcagaaccctgatataaagctatatggcattgaaccagtagaaagtccaatactgtctggaggaaaacctggccctcataagatccaaggaattggtgctggcttcatccctggtgttctggatgtcgatttacttgatgaagttgttcaaatttcaagtgaagaagccattgaaactgctaaacttcttgctttgaaagaaggtttgctggtgggaatatcatctggtgcagctgcagctgctgcaattaagatagcaaagaggccagaaaatgctggaaaactcattattgtaagtttgtctgctgttcatctggcggtcttcccaagctttggagagcgttatttatcatctgtgctctttgaatccgtgaagcgagaagcagagagcatggtcttcgagccttga

SEQ ID NO: 90088 - DNA, 270 bp, Glycine max
  Peptide Sequence Number=SeqID_206866
atggaaaaggcaaaacttgttggggttctggagtatctctatgacgagagagtgggaggtaagggttcaagaggactgcatgttatcactccaactctagaagaattgcaacaagctcatttgtatatactgaataacagtaatgaagctttagtcaaggaaactaacccaaaaatgaccaagaatagggtgttgaaagagcataacaagactttcctaaattggtttaaagatataatcttcgatgaccataatgcatttgaaacataa

SEQ ID NO: 90089 - DNA, 420 bp, Glycine max
  Peptide Sequence Number=SeqID_206867
atgcttgccttggacgaactcgagggtttgggttttgaggcccaggctttgggcctgggctttgaggaaggagaccgcggaggtgtagtcaggcgttgggtgggctgtgttaatgcggaggtagcgctggaagtgcgtgatgggagtgtcttgttcttcgaggagcggttgttgggttgcggttgtggagaggaagagagagatatggatgatagagacggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgctcttctcaacagttgcgcagcctga

SEQ ID NO: 90090 - DNA, 720 bp, Glycine max
  Peptide Sequence Number=SeqID_206868
ggcgcgtcccattcgccattcaggctgcgcaactgttgagaagagcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcgctttctcactctctatcatccatatctctctcttcctctccacaaccgcaacccaacaaccgctcctcgaagaacaagacactcccatcacgcacttccagcgctacctccgcattaacacagcccacccaacgcctgactacacctccgcggtctccttcctcaaagcccaggcccaaagcctgggcctcaaaacccaaaccctcgagttcgtccaaggcaagcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 90091 - DNA, 336 bp, Glycine max
  Peptide Sequence Number=SeqID_206869
atggagaacaaagatgctacacgaaagcaacggctaaaatgcttaaataagaaatgctctcgggaacggaagcttcaagcacactccagatatcttattaaagatcccaacggtcagatcatggaaaagtttcctgtgaagcttcagaccaaatttagagaagatccaacggttaacaaaagctgggcagcgtttttaccgaggaagcttcatgtagcttcctcaagaagcttcattaagaggcttcctcaaaaagcttcattaagaggcttcctcaagaagcttccccgtggcttctttgagaagctttctcaagaggtttctttgagaagctag

SEQ ID NO: 90092 - DNA, 249 bp, Glycine max
  Peptide Sequence Number=SeqID_206870
atgaagagttggatgcagagttcaaaatgcgatgactgccttggagtatacctgaatgggccagacaactaccttaagggaaaaattaacagtgctttgaaaggacttgataatactccacaacctaaatccaaggctggtgctaggtggattattgttaagaccattgaaagcagagagattgaaggcgtttcgcatccagtgggcacgatattatctcaaagtgagaaatcaaacttgggatgttag

SEQ ID NO: 90093 - DNA, 669 bp, Glycine max
  Peptide Sequence Number=SeqID_206871
atgtctgaatcgaacgccttaaacgctctccatcaacgcttccgtggtttttatcctgtggtgattgacgttgaaaccgccggttttaatgcgcaaaccgatgcgctgctggaaatcgccgccactacgttaaaaatggatgaggatggctggctgcaccgcgatgaaaccctgcatttccacgtggagccgttcgaaggggcgattctcaatcccgaagcgctggcgtttaccggcatcgaccccagcaatccgctgcgcggcgcggtgagtgaatatgaggcgctgcacgccattttcaaaatggtgcgtaaaggcaccaaagacagcggctgtaaccgggcgattatcgtggcgcacaatgccacctttgatcataattttctgatggcggcagcagagcgcaccggcatgaagcgtaacccgttccacccgttcgccacctttgacaccgccgcgctgagcgggctggtgctgggacaaacggtactggcgaaggcctgtaaagcggcggggatagattttgacagcactcaggcgcactcggcgctgtacgataccgaacagaccgccacgctgttttgcgaactggtgaatcgctggaaacgcctcggcggctggccgctggcggtgagtgaagagccggccgaagacgatgcctcggcctga

SEQ ID NO: 90094 - DNA, 222 bp, Glycine max
  Peptide Sequence Number=SeqID_206872
atggtagccataaccccagccaaggttcatcaacctccatttctccgaggatacgactcgaacgcaatgtgtgcttatcatggaggagccccggggcattccactgagcattgtagggccttaaagcataaggtgcaaggagaatcgcttgttgaaatcctaacattgacaagcgacaccacacatggggcaattttgaaagctgttattagatgtctctag

SEQ ID NO: 90095 - DNA, 1407 bp, Glycine max
  Peptide Sequence Number=SeqID_206873
gactacacatcctcgccttcaggcggctacatgcactcgctgtaagagggatgcacgtcctccccttcagagggctacacgccctcgccaatagaggactacacatccttgccttcagaggcctacacgccctcgccttcagaagactacacatcctctccttcaaagggcttcaccccctcaacttcagaggattacatgtcctcaccttctgtgtgcagcacgccttcgcctttggaggactacacatcctcaccttcagagggctacatgccctcatctttagagggttgcatgcccttgccttcatagggctacacgccctcgccatcaaagggctacatgccctcgcctgtagagggttgctcaccctcgccttcataaggctacacgccctcaccatcagaggactacacatccttgccattagaggacttcacgtccttgccatcagagggctatacaccctcaccttcagagggttgcacgccctcacgtccaaaggacagcacgtcctccccttcagagggctacacgccctcacctatagaggactacatgtccacagcaccagaggactgcgcggcctcgccaccagaggactgcacgtcctaggcactagtggactgcccgactacacgcactcccctatagaggactacaagccctcgccatcaaggggctacatgccctcgccttaccttcagagtgctacacgccctcgccatgcctttagagaggtacacaccctcaccttcagagaactacacgtccttgccttcacaggggtacatgccctcgcctttagaggactacacgtcatcgccttcagaagactagacgtcctcaccttacgaggacaacacgatcttaccttaagaggactacacgtcctcacctttagagggctagacatcctcgccttcagaggactgcacgtcctcgccttcagaggactacacctccttaccttcagaggactacacctccttaccttcagagggctacacgccctcgacttcagaggacaacacgtcctcgccttcatagggctagacaccctcgccttcgtagggctacaccccctcgacttcagaggactgcacgtcctcaccttcagagggctaaacatcctcgcctccagaggactgcaagtcatcgccttcagaggactacacgtccttgccttcagaggactacatttcgtcgcattcagagggcaacatgcccttgccttcagaagactacatgtcctcgacttcagagggctacacgccctcactttcagaggactacacttcctggccttcagagggctacagaccattaacttcagaggactacacatctttgcctttagaggggttgacgccctcccctttagaggactgcacgtcctcgccttca

SEQ ID NO: 90096 - DNA, 432 bp, Glycine max
  Peptide Sequence Number=SeqID_206874
gtcaagccaaagctgattgcctcgctgactgacgacgacagctgtgacaatctcgcgccgtccgacgatcagccagaagagggcgcagaaccgcctacgctgacgccggtagatgcgcagcaggtgctgatcgccgcgctgtgctggcgcggggcttacaacgaaggctatggtttctggctgctggataacgcgctgcagggcacgccgcagctgatcaccgattccggatctgattatcacgacggcgtgatcagcgaagcgcagaaagggcgcggcattggtgactgctggagcaccgctgcatgggtgtgggatggccgccagttcgtgcagagcagcgaggccaccaccggcatgtgccgtgccatccgcgccggcggcgcatggcagctgccaacgctggtcaccgaagtcaaaccggcggggtaa

SEQ ID NO: 90097 - DNA, 1024 bp, Glycine max
  Peptide Sequence Number=SeqID_206875
atggcggcgggcctcggtatttccaccgcgctggccgggcagaccgtaaccgtctatgcgcttggctcgctgctggcggcgattccactgaccattgccacccagggctggcgccgccgtaacgtgctgttgctggctatcgtcggtttcctgattttcaactccatcaccaccggcgggactcgcctggagcctgctggccggctatgcgcggcgcatggtgccggtccatcagcagggcaaagcgctcgccgtggcgatggtcggtacgccgattgcgctggcgctgggcgttcccgtcggcacctggctgggcacggcggtgggctggcgcacggcgttcggcatcatgtcggcgctgacgctgctgctgatcggctgggtgctgctgcggcgtctgccgctgcgcacggtgttcatgacgccaggcgtgcgtccggtgctgggcgtggtggacagcgtgctgctggtgtttggcatcgcggcgctggcggctatcggcctggccggtcgcctcgtcgatcaccacctgcgcgtcgccgtgctcggcagtctggcgctgtttgcgctggtctcgctgctgttcatctggctggcgcgcttgccgctgctggtttatgtcggcgtggcgctgtggggactgacgtttggcggggcggccacgctgctgcaaacggcgctggcggatgcggcaggcgagggcgcggatgtggcgctgtcgatgaatgtggtggtgtggaacagcgcgattgccggcggcggtctggccggtggcgtgttgcttacccattggggcgtggcgtctttcccgctggcgctgctgttgctgctggcggttggcttcctcatcgcactgcaggcgcgtcagcacggtttccaggccggcgcgcggcaccagcgcgtacaagcaccgacgcggatgaattcccgctgcccggccggtttcaccagcagctatcaaactgtggatggcgtacgccctgcattattgtgacgggcggcagcggacccgctggtgtatctg

SEQ ID NO: 90098 - DNA, 981 bp, Glycine max
  Peptide Sequence Number=SeqID_206876
atgggtaagcaacacgccaccggccagaccgccgccggcaatcgcgctgttccacaccaccacattcatcgacagcgccacatccgcgccctcgcctgccgcatccgccagcgccgtttgcagcagcgtggccgccccgccaaacgtcagtccccacagcgccacgccgacataaaccagcagcggcaagcgcgccagccagatgaacagcagcgagaccagcgcaaacagcgccagactgccgagcacggcgacgcgcaggtggtgatcgacgaggcgaccggccaggccgatagccgccagcgccgcgatgccaaacaccagcagcacgctgtccacctgcccggcgaggcccgcctggctaacgaacggcgcaatgtaggtgtagagaatgttgtgcgccgtcatccacgccagcaccacgcccagcaccggacgcacgcctggcgtcatgaacaccgtgcgcagcggcagacgctgatcgctgctttgtcccggatagtcaggcacccgcagcagcacccagccgatcagcagcagcgtcagcgccgacatgatgccgaacgccgtgcgccagcccaccgccgtgcccagccaggtgccgacgggaacgcccagcgccagcgcaatcggcgtaccgaccatcgccacggcgagcgctttgccctgctgatggaccggcaccatgcgccgcgcatagccggccagcaggctccaggcgagtcccgccgctgcgccggcgaaaaagcgcgccaccagcgtcagtgcgaagtgggtcgagaacgtggtgatggagttgaaaatcaggaaaccgacgatagccagcaacagcacgttacggcggcgccagccctgggtggcaatggtcagtggaatcgccgccagcagcgagccaagcgcatagacggttacggtctgcccggccagcgcggtggaaataccgaggcccgccgccatctgcggcagcagtccggccggtaa

SEQ ID NO: 90099 - DNA, 1017 bp, Glycine max
  Peptide Sequence Number=SeqID_206877
atggcggataccctgccagtactggatctggccctgctggaactaccggacgcagagcaggcagcttacctggcacagctgcgggagaccgcgcgtgacgtcggtttcttctatctggttaatcacggcatcaacccgcaactgctgcacaacgtgcagagtatcacgcgggcgttttttgccctgccgcaggcggagaagcagcgcgtggcgatgatccactcgccgcattttcgcggctacaaccacgccggcgtggaatacacccgcgaccagcgcgatcagcgtgaacagtttgatatcggtgccgaacgcgcggcgctgacgctgcagccgggcgatccggcgtggaaacggctgcaggggcctaacttatggccggaggcgttaccgcaattgcgtccggtgatgcacgcctggcagcaggcgatgaccgccatcgcgctgcgcctgctgcgggcctttgctaaagcgctggcgctgccgccggatgcgttcgacgcgctgtatggcacccagcccaatgagcacatcaagctgattcgttatcccggtcaggcagcagaagccagccagcagggcgtcggcgcgcacaaagactccggcttcctcacctttttgctgcaggacgatcagcccggtttacaggtggaagtgtcacccggtcactgggtggatgcgctgcccaagccgggcgcgttcgtggttaacatcggcgaactgctggagattgccagcaatgggtatctgcgcgccaccgtgcaccgcgtggtgtcgccgccggctaatcgtgaacgcgtgtcgatcgcttttttcctcggtgcgcagctggatgccgaagtaccgctgtatcagctgccgccacagctggcggcagaagcccacggcccgaccagcgatcctgacaatccgctgctgcgcgaagtgggctggaactacctcaaagggcgtctgcgttcccatcgcgatgtggcgcagcgctattacgctgatgcattaagcacagtgaaatcataa

SEQ ID NO: 90100 - DNA, 969 bp, Glycine max
  Peptide Sequence Number=SeqID_206878
atggagatcaatcacgtgttcaaaaaattactgttaaccctgctacttgcctcagccgcgctgttttccgccgccggcaccgccgcggatgaattcccgctgcccgccggtttcaccagcagctatcaaactgtggatggcgtgcgcctgcattatgtgaagggcggcagcggaccgctggtgtatctggtgcacggtttcggacagacgtggtacgaatggcaccagctgatgccggaactggcaaaaaaccataccgtcgtggcggtggatctgccggggctggggcagtctgacgtgccgcattcgtatcgcgccaccgatgtcgcgccgctgctttatcagctggcacaacagttcgccggcggcaaaaagttcgacctggtagcgcacgacattggcatctggaatacctatccgctgctggtgaaacatcaggacagcatccgccgcgccatctttatggaagcgccgatcccggatgaaagcatctatcagttcccggcctttacgcctgaaggcgaatccctggtgtggcacttcagcttctttgcggcgcagggacagctcgctgaacagctgatcgccggtaaagagcgcctgttcttcgagcatttcatcaaagaacatgccgccaacaaagcggtgttcaccccggcgctgctggatctctacagcaaatcctatgcaaaaccgcacagcctgaacgccgcctttgaatattaccgggtgctgaatcagggagtggcggacaataaagtgctctcccgcgagaaaattgctgtgccgatgctggcgattggcggtggcggtcacggcggactgggtgcttatgagcagcaggtggtcagccgctacgcctcgcaggtcaccggcaaagtgttacctggctgcggtcactggttacctgaagagtgccccgcgccactgaatgcggcggtgatggcgtttctcgcgtccgggaaataa

SEQ ID NO: 90101 - DNA, 234 bp, Glycine max
  Peptide Sequence Number=SeqID_206879
atgaggaagccaatcgccagcagcaacagtagcgccagcgggaaagacgccacgccccagtgggtaagcaacacgccaccggccagaccgccgccggcaatcgcgctgttccacaccaccacgttcatcgacagcgccacatccgcgccctcgcccgccgcatccgccagcgccgtttgcagcagcgtggccgcaccgcccaacgtcagcccccacagcgccacgccgacataa

SEQ ID NO: 90102 - DNA, 621 bp, Glycine max
  Peptide Sequence Number=SeqID_206880
atggaagctgctgctggtcatgccgagcggaccaaacagctgatgctgcgccagcgtttcaatgtcctgatgcaggcgatgctgcagaatatagcccagcagcgcatagccgagattggagtactgcgccgccgggtgcgcgggggcgctgaaatcggccagataactcagcacggcatcgctatccagattgccgtaaaaattttcgccgctgcgcagctgcagcagcgtgatgcgttttgcatcctcactcagcggcacgccgcgcggcagcagcgtggccagcgtgtcgctccagtgcagctcgccgcgatccaccagcccgataatgacctctgcggtaacgcccttgctcagcgagcccagcgcaaacagcgtatccggcgtgatgggataacgctggcgcgcatcggtgatgccatagctgtaaaactgcggcgcgccgcgctggtgaacaatggcgatgctgatgcccgctacctgcttttgctgcatgtagtggcgcacaatgtcatcgacgttttcatggaaggaggcatgggaaagatagacgcgatcgcccaccggcgcggacgtttgcgacagcgttccgcagccgctgagcagcagacacagggctga

SEQ ID NO: 90103 - DNA, 3051 bp, Glycine max
  Peptide Sequence Number=SeqID_206881
atggtggcggccgccagcctgtacagcaatgcgcgcgatctgattcgctacctcgatgcgcatctgcacagcgatgcgcacggcgcgctcggtcaggcgctggcgcaggtcaattatccttatgagcagcatggcaaccaggcgcagaatatcgcctgggtaaccgatacttatggtcaacagcagatcacttatcaggtggggtatattggcggttatgccagctttattggctacgatcgcgcccacggcaatgccatcgtggtgctgcaaaatgccttcaactggagcaactatctcggcattgcgctgctgcgtgatttggcgcgtaaagatcgccgggatatgaacacggttgcttgcaattttgctgctcagcaaagcgcgccgcctgaggtatgctgtggagcgaaatttgacgcgcaaagcgcggcgcgggaaccttccgcacgtggcgcttgtcacctgacgccagcagcactggcagaaggtgagcaaaccgatagcgtaccgatgccgccgcaggtgcagcaaaccgcaccggacgcctcagcgccagcggccaccagcgatgcgcccgccagcagtgaaccggcagaatccagtggcgatgtcgcgccgattcgcccgtcacaaaacggtccgggtgaagcgccatccgccgccaataattacgatctgcacactatcatcatcgattacaaagagtataaagtcggtgacgtcgtgccggatgagtaccgtaaaaagcagtacaccatcgttgagtggcagccgcgccacctgcctgcgccgcaggaaggcacgcactgggcttatatcaacgccaactacatcctgatcactgacgacagcggcaagatcgtgatgggcaaatccggcgacattttcttcaagggcgcgccaactgcgccacgcctgccattatctgactggtgctggtattaccgtatcccagcaccagtccctgctgtttttgcccgcccagataaaagccggacagcgcgccaggcgcatagccatggcgaaacagctgcgccgtcagcgccacatcatccaccgtatccgccagcggcaacaccagatgcataccgcactcaccgcccagcagcggcacctgagtaccaaatgtctcctgtagcgcagcccgcagtgtggcctgccgctgacgatacagacggcgcattttgctcagccgatgcgcagcgccggaaacagggtcttgctgaaggagccgatgtaaatcaccggcgtcgtctgcgccatgccctgcatcgcggcgatgggctcgccgctgtagcgaaaatcgctgtcgtaatcatcttcgataatccacgcctgatgccgctgtgccgccgccagcagtgccagccggcgcgcggcgctcatgatcgcgccggtgggatactgatgcgtcggcgtggtgtaaatcagccgcggcgggcgctgctgccagtcctgcgctgtcggtgccagtccctgtgcatccaccgcaatcggctcgatctgcagatcgccgaggcgcatcgccgctttggcgccgcgatagcccggctcctccacccagccggtgtcaccacgattggtgagcagcgcgacgcacagcgtcagcgcctgctgcgcgccttcggtaatcacaatctgctgcggcgcacagcgcacgccgcgcgccagcgccagatgctgcgccagtgcctcacgcagcgccagctcacccagcggatcgccgtagcccagcagctgtgcctgctgcgcggtttgattgagcgcgcgacgccactgcgccagcgggaaatgcgccagcgccggcgtgctcgggcgcagcgccagctcctgactggagaggcgatgcagcgagtgcaatccggcagcgcgcgcggaaaccggccagtcggtgctgtcgtcggacgcctgcgcgggcagcggcgtgtgcgccagccggctgacgcggcttccctggcgccgccagctggcgggtcgccggcaggcgcgtgcccgccgccagctgaccattcagtatcgcctggcgcagccgctgatacagctgctgttgcagtgtcaggctgccgtcggcctctagcggtgccagcagcagcgattgccggtttaatgcacgcatcggcgcctcccaaagtggcacgctgcacgctgtcactctcacacagaaggaatcgccgtatgtcatcgcagaccaatcgttatggacaacccatcggcccggcgctggaggcgtggcagccgcgcccgctgccgcaggggcagattttcaccggacaatattgccggctggagccgctggatgccgcacgtcacggtcgcgagctgtatgcggcttatgcgctggcggaagatgaccgcgactggacctggctgccggtcgggcgctttgacgatgaagcgtcttatctggcgtttgcgcagcagtgccagcagagtccggattacctgcacttcgcggttattgaccggcaaagcgggcaggcgatcggctcgctggcgctgatgcgcattgaaccgcagcacggtgtgatggaagtcggctttgtggtgttctctccgttgctgaagcaaacccgcatggccaccgaagcccactatctgctgatgcgttacgccttcgaacaactcggctatcgtcgctacgagtggaaatgcgacagctgtaaccagccgtcgtacaacgccgcactgcggctgggcttccgttatgaaggcacgtttcgtcaggtggtggtgtataaaaatcgcagccgggataccgcctggttctctatcatcgacagcgaatggccgcaggtgaagctgggctttgaacgctggctggcggcagacaatttcgacgctcgcggacaacaacgcgccaggctggagacattacgcactggccatcgccatcatcagccgccgatgccagagattatcgcgtttgagctcattgaaaccgagctgcatgcgatggtcgagatccagcaggcgctcatccactttttcaaagcgtttatcgatttctctgaattgtgcatctactttttcaaagcgttgatcgattag

SEQ ID NO: 90104 - DNA, 807 bp, Glycine max
  Peptide Sequence Number=SeqID_206882
atgatgaacacccataaggcattcaaagcgctgcagcaggcgggcgtggccgatcaccaggccgaagtgatggtcgacatttttgccggaatgcagcaggaaaacagcctgaccaaaacgcacctttcgcaggccatggaaggcgtgatgcgggcaaatcacgccaccgcgcagcgtgtcgataaactggcacagagcctcaggcattttgaaaatgaggtccgccatacgtttaaagccattgagctgcggtttgacaacgtcgatgagcaattccggaaaattgatcaacgctttgaacaaatcgatcaacgcttcgaaaaggtggatgcgcaattcagatcaatcgataaacgctttgaaaaagtggatgcgcaattcagaacaatcgatcaacgttttgaacaaatcgatgaacaattcaggaaaattgatcaacgctttgaaaagatggatgagcaattcaggaaaatcgctcaacgctttgaacaaatcgatgagcaattcaggaaaatcgatcaacgctttgaacaaatcgatgagcaattcaggaaaatcgatcagcgttttgaacaaatcgatgagcgattcaggcaaattgataaacgctttgaaaagatggatgagcaattcaggcaaattgataaacgctttgaaaaagtggatgagcgcctgctggatctcgaccatcgcatgcagctcggtttcaatgagctcaaacgcgataatctctggcatcggcggctgatgatggcgatggccagcgcctttgtgttgtcagccgccaaatatatttttgccggttag

SEQ ID NO: 90105 - DNA, 288 bp, Glycine max
  Peptide Sequence Number=SeqID_206883
atgggaggccgatcttggtatctggggcaaaacaaattcgtgggtcaaggtgtcggtctcgggctgaacttccatattattccacaaggcacgcgcaacaatgatgatttggaaacaacgtgcaaaattagtcacggccacagccaggtgggcactcaagcatcccgtttatggcattgtgatactacggttgggaatttacacaaacagacccaacgtttccaaattatgttctttcatcagttcaatgaattcatccattcttatctctgttattcaggaaaataa

SEQ ID NO: 90106 - DNA, 139 bp, Glycine max
  Peptide Sequence Number=SeqID_206884
atgacccttccatcacccactactttacattatcagaccatggttcatttctctcccaccttcatttcaactctaatgaaatttttctctcaaagcgactaccaccatgtctaccgcttcatccaccgctttaagcaag

SEQ ID NO: 90107 - DNA, 402 bp, Glycine max
  Peptide Sequence Number=SeqID_206885
atgcatatcgaggcaagatttcacccagaccgctacagggagacgagtgcggatcatgcgcaccaccacaactttgatctccctttgccgaagtggatcacggccacaagacactcagtggacccagagaagcccaatacggtcctggggttttcagctctgattatgagcctctgtcagttctacggagtgctcatcacccctagcaaggtcatcaggccccctgttaacaggactttcatcgagaagtactgcgcccctaggcaggtgcaaggcgaggcaccacagcagcctagggacgttcaacagcaggcaacaaacgcaccgccaccacttctagagtccaccttagctcatctacaaaggctgaagcgtcgttgcctacgacccatggccgactag

SEQ ID NO: 90108 - DNA, 929 bp, Glycine max
  Peptide Sequence Number=SeqID_206886
agggttgggtccaatctgatatgaccagccgcattatggcgcagctggcagatgagcccaccatgctcgccccacaggcggtcgcggcatccgaaaagattactcatatccgtcctcgattcagcaagtatacgtggtcaattgctgcttcagtagccgctgccttctttgttggcctgttcgtggtcaatcaacccgaagtgactgctccggcacagattgcggataacgatgcagatactgatcaatatgtattggctcatcataactatgcccctaatagcgcaacatactacatgcacaatgtagctcaacctgtggtggccgaggaggatctctgggcaaccatgcagaaaaccgcttctgctgcccgggagctcaattaccaggggttatttgtctaccagaatggagcggtgatacgctcagtccaaattacccacatctatgaaggtgggcgtgaatttacgcggaatgttgtgctggatggcaggccgcgtgaagtgtttagcgaaggcgatgatatcgtcattttcaatgccaagaatgacaaggttgtcatcgaaaaacggcgcgggcagaatttgtttcctgccatgctccccacacaactgtatccgctcaagcaaaactacaagctgaaatttgttggccaggaaagagtggccggacgcctgacgcaagtcttggatatgattcctaatgataacctgcgctatcaataccgtatctggtcggatagcgagtatggtttgctgcttaaaatgagcatgatggacgtgcaggggcataccctggagcaaataggcttcaaccaagtgtctatgctacagaccaaggaccttgattggttccagccgaaaatcgatgccaccaagccttatgtcatggatgacaccacggatttgacccatactgtggaaaacctg

SEQ ID NO: 90109 - DNA, 444 bp, Glycine max
  Peptide Sequence Number=SeqID_206887
atgggggtctggattgcttctggaggaagcaacccagctcgcctgggcgagctaaggtcgcctgggcgagctgggcggcaacctcctctccctttttcctataaaaaggctgaagggggctgttctaaggatccctcagccccctggctatgtatttcagctgttttgggtgaaaaaaattgtttccgtaaagaaaatccaagccgaggtgcttccgtaacgctttcgagatgtttccgtaagcaaatctgtgaaggttttcgtccgttcttcatcgttcttcatccgttcttcgttcttcaacggaactacgtaggtctgatttcctcatcgcaattgaggatacgtaggagcaaaagccccgcttttgtcgaccaccccaaaagatcgttaatggtccaatgccttaacgtttctctcctttcaaaaacaagagatcgttaa

SEQ ID NO: 90110 - DNA, 288 bp, Glycine max
  Peptide Sequence Number=SeqID_206888
atgaacattgttcgtgggagcagaatgacagcagcagggtgctacaatgttcctctgtgtggtggtccagaggcaagcaacgacagctcgtggtggccactggtgattgtgggtggtggaggaggagtttctaggatgtcgctaagcgggaatccacttttcacattaagtgcgacatttcgcgctgagtgtaattcctctctgattggaattgcgcttagcatgcttgtctcactaagagagatgtccaagagtgttattgggaaaatcccaacagtcaaagcatga

SEQ ID NO: 90111 - DNA, 399 bp, Glycine max
  Peptide Sequence Number=SeqID_206889
atgccacctaccggtggaattggagaacaaagcctatatggccattacgataaccctatgcacacctactggagcccctctagattagggttcccagtgttgatcacaacactatgtgacgctcagggggttgtttctgacaccctgacttttgagtcattaagtcctgtgattaacttagcctacataaaaaagaattgttggaaccccgcagatccatccatcacattctcctggccccgttgtacccgcactagagctgccacaccagacgccctgcctcccgcacaaccaccaccacaggccgcacgtcaccaacacccagccactttagcccagccggatctacacagtcagatgctccagtccatctatcagggccaacagatcatcgtctag

SEQ ID NO: 90112 - DNA, 162 bp, Glycine max
  Peptide Sequence Number=SeqID_206890
atggttggagaattctcgcaaaaaagtgtgaccctgactagtctccctgtgattttacctagtaagagtgacctaacttactattgtgtgatggttaggtggatgactatggagaaccccatgctagaggatgctggaacacaatgctctgataggatgtga

SEQ ID NO: 90113 - DNA, 177 bp, Glycine max
  Peptide Sequence Number=SeqID_206891
atggataagagcttgaaggtaggagaagatgaatggagggagaaggagagagggagcatgaaattttatgcctctaatgagattaaacaagtaaataacacaagagaattgttaacccagttcggtgcaacgtcacctacatctgggggctaccaagccagggaggaaatgcactaa

SEQ ID NO: 90114 - DNA, 129 bp, Glycine max
  Peptide Sequence Number=SeqID_206892
atggccgaccagcgggctaccaagtccaaagccaaaggtaagcaaagtactaggacgcacctagttgctcatgatcctggggatttaaataaaacaagcgcaagctcggaaggtagaaagataccttag

SEQ ID NO: 90115 - DNA, 450 bp, Glycine max
  Peptide Sequence Number=SeqID_206893
atgcagccaaagaaatacgccctgccgctgatggtcctgtcgctggccgccacctctgtggtccacgcgcgcggcaccatcgacaaggtggacatcaagggattggacaagggcgacgacgccgcaatcatcgagaacatccaggaatcgctgtcgctgtacgacacgatcggcaaggaacagggcgaatcgcgcctggagtacctgctgtcgcaggccgagcggcagacccgccaggcactggaaccgttcgggtactacaacccggtgatcaaggtcgaggcgccgcgcgaggacgagcacgtgcgcgtgctgatccatgtcgacaagggcaccccggtgaccgtccgccgcgagcacatcgacatcaccggaccggcgatgtacgaccagtacctgcaggacgacctggccgcgttcaagccgcgcaagggccgtgggatcctctag

SEQ ID NO: 90116 - DNA, 1203 bp, Glycine max
  Peptide Sequence Number=SeqID_206894
atgcatcacgtcattggggatcggttgttaagtggcggcgaggatgccggcatcgtgcgcgatgccggcaatgaccccgatggacatccaccggcactaccggtgggtgccaagcatgcttggcactacatctcagctcgacagatgctcgattgccgcgaccttgcccaggcgctcgcccagcatcgtcagcagcgccaggcggttgccacgcagcgccggatcttccgcgttgaccatcacgccatcgaagaacgcgtcgacctgcgggcgcaggcgcgccaggcgcgccagcacggccacgtaatccttctggtggaggctggcgccggtgtcgtcgatggcggcggtgaccgcttcggccagcgcgcgctcggcgtcttcctgcagcagcgccgggtcgatctggctgggaatctcgccttcggccttgcgcaggatgttgcggatgcgcttgttggccgcggccagcgcttcggcttccggcagcgcggcgaaggtgccgatcgcatccaggcggcggtcaaagtcatacagcgaggcgggcttcagctcggccacggcgttgaagtgcgtggccggcacgcccttgtcagcgtagtagcccttcaggcggtcaaggatgaagtcgtacagttcgccgatgtcggcctgcacgttgcgcgcggccaggccggcgttggcactggccagcagcgcgcgcaggtccagctcgaagccgctttcgatgatcgtgcgggccaggcccagcgcgttgcggcgcagggcgaacgggtccttgttgccggtcggcttcaggcctgcggcgaaaccaccggccagggtgtccacgcgttcagcaatcgccagcaccttgcccagcggcgacagcgcgatgtcgtcaccgccgaagcgcggctggtaggcctcgtcgatggccagcgccacctcggccgattcaccgccggccacggcgtagtggcggccggcgatgccctgcagttccgggaattcgttgaccatgcgcgactgcaggtcgttcttggccagctgcgcggcgcgcctggcctgcgcggcgtcagcaccgacctgcggcgcgatcacttcggccagggcggccacacgcgaaaacatatagatcaagtggccaagcttgtctcggtaggtaactattttcaggaggttcaaacaaagataccaagccttgtttcaggtcatcattga

SEQ ID NO: 90117 - DNA, 243 bp, Glycine max
  Peptide Sequence Number=SeqID_206895
atgtttgggaaccctaacagagcaatcgaaagaggagctttagagagcataaaaaatgccacaattgataacggagaatgcttgagcgactatatcgaggtgattcgatgtgaaccttataatgaaaagtgtgatgtgtacagttttggggttatattgaacgagcttttaactagaaattacctatacgttgagacaaaatatggtcccaccaagattgtcatggaagttgtggagggttaa

SEQ ID NO: 90118 - DNA, 108 bp, Glycine max
  Peptide Sequence Number=SeqID_206896
atgatgttgtgcgctctttcagaagaggagtacacaaaggcacacaacttcaggagtgccaaacaaatgtgggacactctagctgtaacatacgtaggaacctcacaa

SEQ ID NO: 90119 - DNA, 303 bp, Glycine max
  Peptide Sequence Number=SeqID_206897
atggcatctaagaagaggaaagctccttctacacctacccagggcagatttgataggtctagattcacatccctagaggcttgggagagatacactgacattgtggtgcctcgaaagctactaccagagtggaatgtggtagtttattacatagagtttgatgagttcaaggaggaactcgagagaaaacattgggatgagaagctgactgattttttttacagtagcatagacatcgctattgtgaaggagttttacgccaacctctatgaccccgaggataaatcacctaagcaagtgagg

SEQ ID NO: 90120 - DNA, 185 bp, Glycine max
  Peptide Sequence Number=SeqID_206898
atgacgcagcccaacctgatccccgagagcaaactaccggcgctcggcaccaccatttttacccaaatgagcgccctcgccgcccagcacaacgccatcaacctgtcacagggctttcccgattttgacggcccgcgctatttgcagcagcgcctggcacatcacgtcagcgaaggcgctaacca

SEQ ID NO: 90121 - DNA, 393 bp, Glycine max
  Peptide Sequence Number=SeqID_206899
atgtattgtcggaagatgggggcatacgcaaaagatgaggaactactgaacatgggtaaaaaggggcatgaatccttcaaagaatacgccaaaaggtggagagacctggcagctcaagtggcacctccaatgacggagaaggagatgatcacaataatagtagacacattaccaatgttttactatgaaaaaatggtggagtatgcaccttcaagctttgcagatttggtcttcgtcggtgaaaggatcaaagtgggtctgaaaagaggaaaatttgatcatcctgctttgatgaattcgaaaactagggcaaatgaagaggatgagaatgagggagaaacccttgccgtgactaccattcctacacggccaaatttcccatcagcccaataa

SEQ ID NO: 90122 - DNA, 693 bp, Glycine max
  Peptide Sequence Number=SeqID_206900
atgagtcatcattcatctagtgttaatggtgagggtactagtcataaggatcctctatctagaatcttagatgagttgagttccctcaagttatggaaagaaaaaaaagaaagaaaagaaaactcctcccctcatcttctcctccttcaagatcttatccatggcttcctatggtgtggcgtctccaatcatctttcttccttctccattccgttgccattcatcttcaagaagcaaaggactccattgatgaagaagatccaatgcctacaagctccacatggagctacatcacctattgctagagataggttggatacatggttcactaatgaaaacaagaagactgacttcaagatgatttatgccatggagaataagataaaaatcttctaccttgagttggtaaaggttttctacacatgtgcccgtgttgatatggaaggcaatttatactctactgttaatgatgtagagatgatcattgatgttgcagtttggaaagcagttgcaggactaaatatgggggagtctgcaagtttgaggaatcaatggaaggctacatcaagatggagacatacagaggccttggatcttgttcatcaatggagtccattgcttcttgaagttcactggcagcggaatggagaaggaagaaatatgattggagatgccacttcaaggagaagatga

SEQ ID NO: 90123 - DNA, 363 bp, Glycine max
  Peptide Sequence Number=SeqID_206901
atgcatgctttgttagggtcattcaatagtggaaactggtctgactctaaagtccttggtagtgcagggctgagttgtcgtgctttcacgaggaatcagggtgcgataagcaatttagttcctttggacttagaaattgaagctacattgcgaaggaatagggccgagaggagaaggaaacttttgcaagatagaacagttgcatccattcttgaggaggagactcatttctccgacttattatcacctgattcaccatcatcaagggaatctgccactcaattacttgaagccattaccatggcagaagagcatgaccagaggattacccttgaggattattcaagtagttcagtaccataa

SEQ ID NO: 90124 - DNA, 955 bp, Glycine max
  Peptide Sequence Number=SeqID_206902
atggggccctgctgtggggaggcggcgctggaggcacagcaacagcccgaacaggccgacgccgccatcgtcaccgcgctgcagttgggtgcaccgactgtcgaagcgctgcgcgcgcggcgcgtgacactgggccgccaacgcgcgctgctgcaggcacagcaggcctatcaattgctgtccgcaggtgaggatgccgccgccattgagcaggcgcacgccgccgtggaactggcacccgacgttgcttcataccggttgctgctgatcaccgcgcagctgcagggcgatcagctggccgacgctgagcacagtgctgatcaggcattgcaggtggacgccaacgatctcaatgcccgggtgatgcgtggctacctgcgccagcgccagggcagtacgctgcgggccaatgaggatttcgatgccgcgctcgccacgccgggatcaaccgcgcagcagcgcaacgtgcggctgctggcggtggatgcggcgctggccgcaggtgatcgggtacgcgcagctgcactgctggcaccgttgcaggcggcgctaccggcaggtgaaggcgatgcacggacacggcagctgctgcagcagggcatcgagcagcgcagccgggcgacccgtgccagtcgcgagcctccccgcatcagcgccgaggcctacccggcaccggtccagcactgccagtccggtgacagcggcaacgtctgcgaactggtgccggccgatctgcagggggatggcggtgccgcacagcgtgcctacgctgcctacgcgcgccaggattacgccgatgccatcggtgaggcgcggcaggccgtgcaactcgcaccggacgacgcgaacctgcaaggcctgctgaccaccacgctggcggcgggcaaccgtgcccagcaggacgaagcgcggcagcgcctggatacggcactggcacagcgtcctgatgacgcgg

SEQ ID NO: 90125 - DNA, 1666 bp, Glycine max
  Peptide Sequence Number=SeqID_206903
atggagatgtatttccaaatcctccatggcgagacaccgcgtacaaacgattttctgcaattctccgactatgcattggcagaagaacagtggtatgccacggcagaatatcaaaagggtttggcgtattgggctaaaaagtttgatgacgcgcaaggcctgcttgagataacgaccgatcgcccacggccagctaaaatgagcaccaaaggcagtatggcaagccacacttttgatcgggatttcacccagcgtttgcagatgcaggctgcacagctgggcgcgacgcctttccacatgattctttcggcctatatgctcttgttgcacaaatacagcaaccagcagcaaatcattatcggttgtccttttgccaatcgtaaccaacccgagactcagaatatgctggggttgtttatgaataccttacccctgaaactggatatcgttccagaggcgacgttacgagaaatcattggcgacgttcgctcagagagtgagcaagctcagctgcaccaggctattcccctcaatgatattcttgaggaaattggccatatccgaaatccgcaggttaatccgctttttcaggcggcgctgacgtatcaggtatttcctcattttcataacaacacgttgtttacctataaaccgcttaaaatcgattatggcgtatccaaactggatctaaacctgtgggttgaagaaagccgcggtagtttactgtttaccttaaactacaatcccgatttgtttaaccgcagtacgataacgcgtatgttgagcgatctgcgcacggtgttggaaacgctcatcgaacggcctcaaataaccgtgcgcgatctttcattggtgactcgcgaggaacatcgccacttgctgagcgggtgtagacgcttgcttgacgccgttcccatggcggttcatcggcagtttgagcgtcaggccgatgctttgggtgccgattcggtggctgtacgttgcgatggccgtcttttgagctatcgacaactgaacgagcaggctaaccgtctcgcgcactgtttgctggaacatggcctgttgccggggcagtcagtggcgctgtttatggccaaaagcgaacgctgtgtcgtggctctgctggcaatattgaaagcagggggatgctatgtgcctgtcgatatcactttgccgatggaacaggtcgactttattctgcgggacgcacaggcgcgcttcgttgtggtggatgccggatcgccggcggtttcacagccgacaatctcgattgaccagtgccacggcgccgcgctgagcacgaatccccaattactgacaatgccgacagacgctcccgcttacatcatttatacctcaggcagcaccggtaggccaaaaggcgtcagggtcaatcatgttcagctaagccgatattgccaggtcatcgcctctgtcctggatcaacctgccggggcgcgatatggcatgttttccgccttcactaccgacttggcgcataccatgctgttcccggcgctgatctaccagggacaactggaggtgataagcactcagcagcttaatgatccgcaggcattgttctcctatctggagagtcatcccttggactgcatgaagatcacgccaacgcacctgaccgcattgctcatgtcaccccatgcgg

SEQ ID NO: 90126 - DNA, 216 bp, Glycine max
  Peptide Sequence Number=SeqID_206904
atggccgcggcaccggcgcttgctaatcccgggaacggtaatggcaatggtgaacatggcaatagcgataaaaacatctatcatggcgataaaggtaatcatggtcatagcgccagccaaagcgataacggcggcggcaagggccagcgtaagaattacggcaaaccggatcacgtcgatagtgatatcagctataccaccgctcgcgcgctagcg

SEQ ID NO: 90127 - DNA, 987 bp, Glycine max
  Peptide Sequence Number=SeqID_206905
atgtctactacccaggttctcggcgacgcctcctttagcccgccaggacaacatcccgatagcttaaccgcgcgtatcgacgctctgccctcctcccccggtctttggtcctttatcaccctactggcattaggcggctttttcgaactctacgacctgttccagaccggttatatcagcaccggcctgctcgccgagggtattttccataccgggaaagatggggtatttggtattgccgatcaggcagccttcgcttcctcgacctttatggggctgtttatcggtgccagtctgctcgcgccgctggcggacagacttggacgccgcctgacctttatgttcgcgctggcgtggtatggcatcttttcgctgattatggcgctgcaaaatagcgctgaaggggttattttctttcgtttcctggtcggggtcggcctgggaattgaactggtgactatcgatacttatctcagtgaatggatgccgacgcatttacgtaataaagccttcgcttacgccttctttattcagtttctctcggtaccgacggtggcgctgatgtcctggctactggtgccaatgaccattctcggcctgagcggctggcgttgggtgatcattctcggcgcactgtgttcactggtcatttgggttatccgcaaaaagctgccggaatccgcccgctggctggaaagcaaaggtcgccacgatgacgcgcaccgggttatgggtgaaatggaacaacgctgcggtttatcgccttcccggcgccatgccagtcaggcggtagcggtgccgcaacgcagcaattttaaagagatttgggcgccgcagccatcggcttcttcggtttcggtaactggctgcccgcgctgctctccggccagggcgccagtattacccatagccttctgtacgctttttttatcacccttgcctacccgcttggctgcctgttctgtactcgctttgtccatcgtttga

SEQ ID NO: 90128 - DNA, 678 bp, Glycine max
  Peptide Sequence Number=SeqID_206906
atgaccgctaaaaaaaccgctcaggactatcctattttaagcatgaccggctttgccgcagcggagtcacgcttccatggtggcctgctgctgattgagttgcgcgcggtcaatcaccgttacctcgaactgaatgtcaaaattgacgatagcttgcgccagtacgaagcgcaaatccgcgagcaattacaaagccgcctcggtcgcggcaaggtggaatgccggatgagcctcaaaagtgatcatgccgcgacgcatctggcattgaacccggccatggtcgcgcaaatttcacaaacgctcagcgagttacaacagcatttcccacaggcacaaccagtgaatctggtcgaggtgttcaagctgccgggcgtgctgcagagcgaagccgtcgatgccgatgccctggcacacggactgctcaacggattgacacacgcgattgacgaattgattgccgcccgtcagcgcgaaggagaaaaactcaagcaggaaaaactgacggccaaactgcgtgaagccatgcaagccgatgatgaccgtgtgcgccaggaaatcgtactctatgcacaacgcattgatgtggatgaagagctggcgcgcctgcaatcccacattgttgaaatggaccgcatcctgagtgcaggcggtgctgtgggcaaaaaactggattcctga

SEQ ID NO: 90129 - DNA, 1871 bp, Glycine max
  Peptide Sequence Number=SeqID_206907
atgtacccgctgaccaaagcgcagtacacctcgatggccaagatgcgtatgctgcagccgaagattcaggccatgcgtgagcgtctgggtgatgataagcagaagcagagccaggagatgatggcgctgtataaggcggagaaagtgaacccgctgggcggctgtctgccactggttatccagatgccaatcttcctggcgctttactacatgctgtccggttccgttgaactgcgtcatgctccgtttgtactgtggatccatgacctgtccgcgcaggacccgtactacattctgccggtcatcatgggtatcaccatgttcttcattcagaagatgtcaccgaccaccgtgaccgatccgatgcagcagaagatcatgacttacatgccggttatctttaccgtgttcttcctgtggttcccatcaggtctggtgctgtactacatcgtcagcaacctgccgcgacaagaagaaagcgtaacgcccggcaacgctgagcaggacgcaacatctccaggggcggcatttatgccgccctgttttttttggaagaaggtacttatgagccacagtgacactattgttgcccaggcgacgcctcccggccgtggtggcgtcggtattctgcgtatttccggtggcaaagccgctgaggtggcgcaggccgtgctgggcaagctgccgaagccgcgctacgccgactatctgccctttaacgatgctgatggcagcgtgctggatcagggcatcgcgctgtggttcccgggtccgaactcctttaccggcgaagatgtgctggagttgcagggccacggcggcccggtgattctcgatctgctgctgaagcgcatcgtggcgctgccgggtgtgcgcattgcgcagccgggcgagttctcggaacgcgcctttctgaatgacaagctcgacctggcgcaggctgaagcgattgccgatctgattgatgccagctccgagcaggccgcccgctccgccgtcaactcgctgcagggtgccttttcactgcgcgttaatgcgttagtggaagcacttactcacctgcgcatctatgtggaagcggcgattgattttccggatgaggagatcgacttcctttccgacggcaaaatcgaagcgcagctgaatgcggtgatcggcgatctcaacggcgtgcgcgccgaagcgcgtcagggcagcctgctgcgtgaagggatgaaagtggtgattgccggtcgtcccaacgccgggaaatcgagcctgctcaacgcactggccggacgcgaagcagcgattgtcactgatatcgccggcaccacgcgtgacgtgctgcgcgagcacatccacatcgacggcatgccgctgcacatcatcgataccgccggtttgcgtgaagccagcgacgaagtggaacgtatcggcattgaacgcgcctggcaggagattgagcaggcggatcgcgtcctgttcatggtggatggcaccaccactgacgccactgaagccgccgccatctggcctgatttcgtggcgcgcttaccggccgcgttgccaattaccgtggtacgtaataaagcggacatgaccggtgaaacgctgggcctgacagaagtaaatggccactcacttattcgcctgtcggcgcgcaccggtgctggcgtcgatacgctgcgcgagcacctgaaacagagcatgggcttcgccggcaatatggaaggcggcttcctcgcgcgtcgccgccacctgcaggctctggagttagcagccactcacttacagcagggcaaagagcagttgctgggagcctgggcgggcgaactgctggccgaagagctgcggctggcgcagcaggcgctgagcgaaatcaccggcga

SEQ ID NO: 90130 - DNA, 252 bp, Glycine max
  Peptide Sequence Number=SeqID_206908
atgggtgccaagtacctcgaagtagtcaaacgagggtcgcatcccaacaacggatggtccccagatgaaattaggaatgaccataatttgtctctgtgttttgttggacacgttcgagcctgggcggtgagacacagaatgaccataatttgtctctgtgtgccaccggacacgaccgcctctggatggcgaaaaggtgtgcggaatgaccctaatttgtctctgcccccctctcaacttgttgtttcttga

SEQ ID NO: 90131 - DNA, 669 bp, Glycine max
  Peptide Sequence Number=SeqID_206909
atgcgcttgcggggcagcgagccggcccacttgcggcggaagtaccagtcgtacatcgcccgggccgttctcgatgttctccatggtcaacgccggatccagcaccgggcacaccgaggccacgcgcagcagcggcacgccggcggccggtgcacgcagagccaggcgcagcacgaagttgccacccagcgaatagccggcggccaccagcggcagctgcggccagcgctgggcgatgtcgcctgcggcgtgcaccacttcatcgatgagattggagtggaagatgccgggattgagatgatgggtgttgccgtggtcgcggaagttcagccgcaccacgtcgaagccctgctcgatcatgcgcgcggcggccatgcgcatgtaactggattcggcactgccttcccagccatgcagcagcagcgcgacacccttcggctcgcggccttcgacatgactgtgccagccctgcaggcgcacgccatcaccgccatcgaggatcagctcttcgctgactgcaccggtggccgccagcagcagcaggccgcgctgcaggcgcatgcggctggaactgagcatcgactgcaggtgcggattgcgcagccagcgcggcgggctgatagtcagccgcatgcagcgtcggcgtaccggcgtccaggacaggtggcg

SEQ ID NO: 90132 - DNA, 630 bp, Glycine max
  Peptide Sequence Number=SeqID_206910
atgaagcacttagaggggaaggcgaaagctttggcagatcaaggagaatggacttcatttgttgatgttttagcactgtcggtatttgggatcgtgctctttcagaatgttgatgagctagtggatttagcagtgaccggcgcttttcttgcttatcaccacaacaaggaaagcctggtcattgctgttttggatgatgcttatgacactttcgacctaagatgcgaaaagagtagtgctagaatcgtctgttgtacacccgctctttatgtatggctggtctcccacatttttcgtcatgaaagtagacctgtctgtcccctacaaggtcatcgcatgtgtgccgagaaagggaaaacaaattgggaggaacttttggcagcttggctcctgaagctaaagatttcaagtggggaagaagctgaagtccctgcggagagagaggaagtgcaagccttgaaagcgaaactggaaaggacgagagtggtcaaagaaaagttcaagatggcagccactagggtcaggaaagagtatgacgagttgagggatgtcaacatggccatgaccgaagctttggagcgagaaacaaagagagcccgaaaagaagagtggggccgaaacaagttctga

SEQ ID NO: 90133 - DNA, 321 bp, Glycine max
  Peptide Sequence Number=SeqID_206911
atggaggccatgaaagagcaaatgatcacaatgatggaagccatgatgagtatgagaaaaatgatggaggtcaacatggctacagtcattgccgcaagtaccgccactgaggtcagagaggcgaagcgctgggaagtgcgggtggcccccattttgtgcaggtctagagcaagcattccttcccaccatatggcttgcctcccaactatacaccactcaatgttgcacacgcttctgatgagaatgtcgataactctgctcccatacccattgagaaccaacaaccccaatctgatcatgcacatgtctctcaacccatag

SEQ ID NO: 90134 - DNA, 375 bp, Glycine max
  Peptide Sequence Number=SeqID_206912
atgtcggctgaaaaatatcagtcgcggctttacaacgaccgatgtcggctattgggaaatgtgcgatcggcgtcatccggtgatacttctttttcaaacctcgatcggtcatctttcctggccgacgtcggtttgcattgttttcgatcagtatcggttaatcacatttttttgccgaggtgggctaatgttttcctggccgagaaaatgagaacataccagtgtcggccgaagcacaatctcgatacagctcgcacgaaaaactctagccgacctacattgctaaaggcccaagtggagaaggacgaagacccaagtggagaaggacaaagcccccaagtggagaaggatgaaggcccaagtggagaaggatga

SEQ ID NO: 90135 - DNA, 654 bp, Glycine max
  Peptide Sequence Number=SeqID_206913
atgcaagtctctttgtcaaatcacaagagcactgagtcaactatcaaaaacctggaggtacaagtgggccaattagataagcaattagttgaaaagtccatgtgcaattttgcggtcaacactaagaagaatcccaaggaggaatgcaaggtagttctcactagaagccagaggaagaagagtgttgagaaggagaagagagctgggggaatattggaggataccaaaagtcagttggctcaagaggctaaaaaggagataccatcaatctcagtgaaggaagccccatatcccttagtaccgtcaaaaaaagagaaggaacattattttgctcattttcttgacatctttaagaagctggagatcaccattccttttggagaggccttacaacagatacccttgtataccaaatttatgaaggacctcctcacaaaaaaagggaaatacatcaacaatgagagcatcatgagaattgggaatctgagaattgctcctaccaaaatgactcttcaactagcagaccattccattaccaaaccatatggtgtagttgaagatgtcttggttaaggttcgccaattcacctttctagtggactttgtgatcatggacatagatgaagattctaatatcccctcgatattgggctga

SEQ ID NO: 90136 - DNA, 165 bp, Glycine max
  Peptide Sequence Number=SeqID_206914
atgatgcttacctctgtgtcagttgagctttgctggagaagacaatcagggctcattagaagtagaggaaatattcaaatcatttacatgatccttgatcacaatgaattacaacttgctatggtcatcttcaatttcaagatgattatatcagcacgttcatag

SEQ ID NO: 90137 - DNA, 135 bp, Glycine max
  Peptide Sequence Number=SeqID_206915
atggcattaggggtcatggcagctcgcccaggcaagctagttacttcacccctaagctatttgggggcccaggcgagccaaaggctagccgggctaaattcggctagcgaggatcaaaagatcaacaaacaatag

SEQ ID NO: 90138 - DNA, 339 bp, Glycine max
  Peptide Sequence Number=SeqID_206916
atgggtttcaagggtcctgagagaaaaggagttgctgattttttacaagtaacatccaagaaagaccagcaacaatattggtctagaaaagatgaaccttacaaatatgtttccgttccagaatttgtgcaagcttttagttcatttgacataggagagcaacttgccaccgagcttggagttccctatgataagagccaagcccaaccaactgccttagtgaaagacaagtatgcttctatgattgagttggttgctaagatgataagtgaaggccgaggtttagagttaatgccaatggaactagatcctactaccccaataacttcctataggtga

SEQ ID NO: 90139 - DNA, 657 bp, Glycine max
  Peptide Sequence Number=SeqID_206917
atggttaagcctcaatgtttaacatggataagattcaatcaaaagacaattagatctaatgttctaaatggattacaagaagcagtctcaagaggagaaacaaatccttcttctattggtaaaagtgttatcttaccatcatcttttactggtggaatgagatacatgtttcataattgtaaagatgcaatgataatttgtaagaagtttggatatccagatttgttcataacaattacatgcaactcaacctggagtgagatatgtgattttgtgcaaaaaaaaaggatgtacattgttgagtttcaaaaaggaggacttctacatgcacatatattactatggttggatggtgaaaatcggctgcataatggaagtgacattgataaaatcatctcagtcgagcttcctaatcctgatttatatcccaaattgtccaaagcaattgcaccttacatgattcatgggccatgtggatttgctaacttgaagtctccttgcacgaaagagaggaaatgttctaaatactttcctatgaaatttgaaaactccaccataattgatgatgatggatatccatgctatcgacgtagagacatgggaatgtttgtgcaaaaaaatgatgtaactttggataataggaatttttccttatag

SEQ ID NO: 90140 - DNA, 318 bp, Glycine max
  Peptide Sequence Number=SeqID_206918
atgttacggaaccttacggattacgtaatcatcccttttctggcttccagaatgttacggaacttcatgaattgtgcattaacacttccttttgactttcagcatgtcacggaacttcacggattgcctaatgatgggtgccaagtatctcgaagtggtcaaacgagggtcgcatcacaacaaacagatggtccccgaacgaaattaggcctggtccaggaaaaacatagttggttgctggcacggatcatagctcataggtcgagtattgaatatgaagggattgtggaggggcaaaagttagatgcaattatttaa

SEQ ID NO: 90141 - DNA, 384 bp, Glycine max
  Peptide Sequence Number=SeqID_206919
atggatttctacatcatcgagaaaattgatttcaaagataagatgtcaagcctaacgccgactccttcattctacattgacgccatcaagacattgtgggagcatgatgacgcgctccatgtggaccacttctacaggttcctctattgccgctatgtgccggtggaggcgttcctcgttttaacatttggtcactttcgcaactcgaagaaaactaggaaaggaaagagtcccagaaagggtgggaatcgattttggaagtccattgtggttggctttaagactcccagggaagccatcgaaggtgatttcttcgtcttctttagtcgttgtcaaggtttgttgttgattgtgttctgtgtgctggttagtgatcagtgctga

SEQ ID NO: 90142 - DNA, 192 bp, Glycine max
  Peptide Sequence Number=SeqID_206920
atggattcagatgacaaaggtgaaggtgaaattgaaataccaaatgatcttttggttttagacaatgataaaccactactttcattggttgattttgtgtattcaaacatatgggaaaatttgaatgttccaaatttctttgatgagagagcaatcatcgctccaacattagaaattgttgaagaaggatga

SEQ ID NO: 90143 - DNA, 756 bp, Glycine max
  Peptide Sequence Number=SeqID_206921
atgggagtagttagtaatgagtactcaaatggatctgttcaaggctgcaatagtttagaggagaagctcgatgatcttcgtggcctacttggcaaggctgatggtgatcctttgagaattgtgagtgttggtgctggtgcttggggcagtgtttttgctgctttgctgcaagatacttatggccaattccgtgataaggtgcaaatcaggatatggagaaggccaggaaagacagttgatagagccactgcagagcacctcttcgaagttatcaattctagggaggatgtgttgaggaggttgataaggcgctgtgcttatctgaaatacgtcgaagccaggcttggtgataggactcttctggctgatgagattttgaaagatgggttttgcttgaatatgattgacacaccactttgtccattgaaggtggtcacaaacttgcaagaagctgtttgggatgctgatattgtggttaatggtttgccttcaaccgaaacacgcgagatttttgaagagattagtatatattggaaggagagaatcacagtgccagtgataatctctttggcaaagggtatagaggctgcattggagcctgttccccatattataacccccacaaaaatgattaaccaagcaaaagagaatcccatcaagcttttaaattgcatttgcacaactacatcagttgcatttgcctgcaattttgttaatcacagtacaacaacacctatgaccataactgcaacttaa

SEQ ID NO: 90144 - DNA, 357 bp, Glycine max
  Peptide Sequence Number=SeqID_206922
atgacagtttgtggtggctactggtggctgtgggtgatggagaaagttcttgggacgttggaaatggttttggaagaaaggaggagaaagaaatggcgtttttccaaggctacacgaaaagcaaaggctgaaacactcaagtgcttctactcgcgggaaaggaagcgttcctcacacaccagacattgtattaaagatcacaacggtcagatcgtggacttatgtcctatgaactgccaaaccaaatttcgagaagatccaatggttaacgaaggctgggcagcgtttttaccgagacaggttcatgtagcttccttgagaagcttcattaagaggctttctcgtgggcttctttga

SEQ ID NO: 90145 - DNA, 561 bp, Glycine max
  Peptide Sequence Number=SeqID_206923
atggagatgcatcttccttgtcttcaacttggtggcagactcaatgagcgtatctctaagttgcgcatgctgcgtaagataagcctttgttcaaactccttcaacgaaaccattccttcgttgttctccaaatgttcgctcctacggtcagtgttattgcgggatgatttgttttctggcaaccttccaccgaagatcacgaacctcaccagtcttcaaattctcaaagtcgcgcagaatcatatctcagacaacatccctagcaaactccctatcaacctcaaaagcctcggcctttcgtcgaacgctttctccagtgagattccaagctttattgtgagcatctctcatgttcaattgataaatctttcctacaatcagttttccagcgagcctcagggagcttcagcagctaccgtacctctaggtggaccacaacctcatcaaaggaacgcttcctttggcgcttgtcaactgctctatgcttttgcatctgagcatggagggaacgttcttaccggcgtcgttccattggcgatttcggcacttccaaggctttag

SEQ ID NO: 90146 - DNA, 846 bp, Glycine max
  Peptide Sequence Number=SeqID_206924
atggccgccaaatccccccatgactcttcattctccttctcaagaaggtacttccattggaagaagaaagccttggatgaatctgataatgaggaagaaatcctcaacttctcatcttcatcctcatatttccctgaagaagttaatgacaaccaagatgatcacaatcataatcacaatcaccacctcacactccaaatgccatcacagtataatgccaagaaaaaaacccacttctccaagaagtccaagtttaagtccgttctaaccatcttcaccgtcacgcgcgtgccgagactgagactgaacaacatcagcaacagtttcaatctcgacatgcgcgtgatggggacactcttcggccaccgccgagaccatgtgtacttcgcctttcaggaggatccaaaactgggtcctacgttcctcgtcaagctcgccacccggacgagtacactagtccgggaaatggcctcggggctggtgagaatcgcgctggaatgcgagaaaaagaaaaacgccacggccaaagtgaggctgcttgaggagccactctggagaacgtactgcaacggaagaaagtgcgggtacgcgaacaggcgcgagtgtgggccccatgagtggaagatactgaaggcggtggagcccatatcgatgggggcaggggtgttgccagtggtgtgcgggaatgaagctgcggggtccgaggaagaagcttctggggaggttatgtacatgagagccaagtatgagagggttgtggggtccagagactctgaggcgttttacatgatgaaccctgatgcgagtggaggtcctgaacttagcatttacttgattagagtttaa

SEQ ID NO: 90147 - DNA, 237 bp, Glycine max
  Peptide Sequence Number=SeqID_206925
atggatggggtgaaaaaagtagacacggaagaaggttcttctgcacttaatgttacaactatggaagaaccttcttccgtgcgatctcgcggaagaagttcttctgcaagaattcacggaaaaaagttgttccgctgctgtaatttacaactacagaaaaaccttcttcagcaagaagaaccttctttcatggcttttggtgaagacgttcttccgtggatgcttaaacaagcttaa

SEQ ID NO: 90148 - DNA, 1065 bp, Glycine max
  Peptide Sequence Number=SeqID_206926
atgaaattgaatcgaatcgcagcggcgctgtgcgccatcggcctggcaggcgtcgcccacgccgaggccggcatcagcgacggcatcgtcaaggtcggcgtgctgaccgacctgtcgggcgtctattccgacctggccggcaacggctcggtggtcgcggcgcgcatggcggccgaggaaatgggcaacaaggtgctgggcaagccggtcgaggtggtggccgccgaccaccagaacaagcccgacgtcgccgccaacctggcgcgcgaatggttcgaccagggcaaggtcgacatgatcaccgacttccccaccgcgtcgaccgcgctggccgtgatggaaatcgcgcgccagaagaaccgcgtgaccatgccgtccgccggcctgtcgaccgcgatcctgggcgagaagtgctcgccgctgaacgcgcagtggaccaccaacacctatgcgctggcagccggcacggcgcgcgcgctggtcaaggagggcaagaagacctggtacttcatcaccgccgactacaccttcggccactcgctggaaaaggacgccaccgaagtgatccaggaaaacggcggcagcgtggctggtgtctcgcgccaccccttccccggcaacgacttctcgtcgttcctgctgaaggcgcaggcctccaaggccgacgtgatcgccctggccaacgccggcaacgacaccgtcaacgcggtcaagcaggccaatgagttcggcatcaccaagaagcagatcgtggcgccgctgctgacctacatctcggacgtgcacagcatgggcctggccaaggcgcagggcatgtacctgaccgaagcgttctactgggactacgacgacgcctcgcgcgcctgggccaggaagttcttcgagaagaccaaaaagatgccgacggcatcgcaggccggcgtctactcggccacgctgtcgtacctgaaggcgatcgaggcggccggcaccgacgaggcgccggcggtcatggccaagctgcgcgagatgaccatcaacgacgccgtgatccgcaacggcaagctacgcgcggacggcgcgctg

SEQ ID NO: 90149 - DNA, 192 bp, Glycine max
  Peptide Sequence Number=SeqID_206927
atggtgattctcgtgagaggagaggtccattgtgtccactttggtcgagttgaaagtcttacggagatacgtcggcaagtggtggtggtggtggtggttattgtgaccactttggttcataagttatacagtatttatggattgacaatccgtcagttctatataacttatggattaacaatttgtaagtaa

SEQ ID NO: 90150 - DNA, 249 bp, Glycine max
  Peptide Sequence Number=SeqID_206928
atgaaattcgctaagcgagaccaacacgctcagcgcaattaccaacctgagaggaaattcactaagcgagaccaatgcgctcagcacaattccaacatgaggagactagcctggccagtcagaccggttggactggagacaataccaagtcaattgtataattggatcgatcatgctatcataccggtgcttacatcatcaatccagtattgtcgatgtggctacccagactggactgcttcaaaataa

SEQ ID NO: 90151 - DNA, 315 bp, Glycine max
  Peptide Sequence Number=SeqID_206929
atgtacaaagataattggacccaaccttggcccatgggctcagaaatctaccctgaggttcatgagaaccctagggccttcttcagcagctctagcccaatcttcttggagcctcttgctcatggttctagtgactggtcccttcctagggaggattgcatcaagtcttttgctattgtcgagagtgaattagcgggagcatggctctttttcctctttctttcaggaggcaaaaagggtcattttaagcctttttctgaatccaggctagcgtctggctcacctgggcccccaaatagcttaagggtgaagtaa

SEQ ID NO: 90152 - DNA, 276 bp, Glycine max
  Peptide Sequence Number=SeqID_206930
atgagattactgatgatagaagaagatgaagatgcacaaaacaagaaagaggaccccaaagggtgcatagatcgcattcaaatccttaaaacaaaaactaaccggatgacgaacaaagaacaccaaacgaagaatgatgtagaagttgattacagtcgcaatttggtagcgtcgcaatttggaacctttactcatcctccctcacgcatatttatagcaaaagatggcattaggggtcatggaagcttgcccaagcgacctgttgcttcatcctga

SEQ ID NO: 90153 - DNA, 1302 bp, Glycine max
  Peptide Sequence Number=SeqID_206931
atggcaagccttgaaaagaaaaatccacgaaaggctctatcttcaaccattggaccaatggggcacaaaatgctcaaatttatagcagtgcaacttgttgacgaccaagatgttaaaggtatgatttatattattcgccaaagtgagattaagcgtaatacacttctcaccccaaaccctcaactccaatatcatgagagcaaaggagctaactataagatacaaccatcaaacccaacaaagctaattgttatttgtgatgatgatagttgtgcttggaggtgtagggcatcatacatccttacaatgctagccttgataacacacatcaaaagaactgaaggatacaccaccacgcaccgcaaagtatggttgacaaagcaaaaggctattgaaaaaatctatgacgactgggaaagatcgtacaatgatttaccgagattgttacaagctatgcaacaatttattctcgatatggtcatggagaaggaaacactaccaataccaccacaagaaggtcaagcagtagagggtttcatgatgtcctgtcatcttttttggagtttcagaccatgtatcgatgggtttcaatattgcaagctcctggttcaggtagatggaacatggttgtacgcatatgcaaggacaaagcctattctcaatcattactacaacattctgagggatgaagtagatgttgaccaagcaattaattggctcagtgagattctgcttgaaaaatggactcttgcatgggatggtggccgacgatgggggcacatgaccaccaatcctactaagttgattaatatgatactcaagaaatcaataaatctaccaataggtgcactagtaaaatcaacatatctaaggtgtaatgcattgttcaacaaaagagggacagaagccacaacaatgcttgcatctagacaactttatatgcaaataataaacctgagagaggttcgatctgcaggagatttcacaatcaggctggatgaaaggtggtgtgactatggcaaatttcagaaattgcacatgcattgttctcatgttgttgctgcttgtaagcaagctcaccatgagtataggaactacatacatcttgtgtatacgttagaaagtgattccaacgtatacaaaggattatttgcagaattgcgcaacgaagcattttggtcatcatgtcacgagccaatgatttatcccgacccaaacaagaaaagaaattctaagcgtcatcttgtctcctctcgtatccacaccaaaatggatatcagagaatcgggtcaaccaaagtga

SEQ ID NO: 90154 - DNA, 894 bp, Glycine max
  Peptide Sequence Number=SeqID_206932
atggctgctctcacttctctatctttctcagcagtgactcattgctcagaaagaaaagtgaccctttcctccactcgctttctggcttcctcctcagagatatttgggttccgaaccgatttctcgtaccactatgttggtgttcgagcttccaattccccatctaaaatggttgttcaatgcatgtcttctgctacagatgttcctcccactgtttctgagacaaagttaaatttcctcaaggcatataagcgaccaatccctagtatttacaacactgtgctgcaggagctaatagtgcagcaacatttaatgaaatacaagagatcataccgctatgaccctgtgtttgctcttggttttgtcactatatatgataaacttatggaagggtatcctagtgatgaggaccgagatgccatcttccaagcctacattaaggcattgaaggaagatccagaacaatacagaatagacgcacgaaagttggaagagtgggctcgagttcaaaagccaacttcccttgttgagttttcatccaaagaaggagaagttgagggaattttaaaggacattgcagaaagagctggaggaaaaggagaattcagttatagtcgtttttttgcagttggactgtttcgtcttctggagttggcaaatgccacggaaccaacgattttggacaagctttgtgtggctttgaacatcaacaaaagaagtgttgatcgggacttggatgtgtatcgcatcctgctttcaaagttggttcaagcaaaagagctgctgaaggagtatattgacagggagaaaaagaaaagggatgaaagggctgaaccacaaaaggctaatgaggccatcacaacatgtttgggacaacaattgcctggtctgtag

SEQ ID NO: 90155 - DNA, 243 bp, Glycine max
  Peptide Sequence Number=SeqID_206933
atgggatcttttggggtggcaaatgatattaaaaagcaaatcagacattccaagagaaaggttcaaatgtggatgtcaaaatttagagcagtgaaaccaggtaaagctgtgttagtggttgcggggtcacccaaattggaagtgtacgagactgattttggatggggatcaatttctctttctgattgtagagacggaaaggaggaattgaggttggattggcgcttgacaagattcgggtga

SEQ ID NO: 90156 - DNA, 1404 bp, Glycine max
  Peptide Sequence Number=SeqID_206934
atggaagaagctagagcacaaaagcttgttgagaaatctgaggtttcaccagctacaagcaccacaacttctcttcccctcacattccttgacttgtctttggcaggtcctgtttatgtgagacgccaattcttctatcactttccccaccacacagaaattttctatgaaactacactcccttctctcaaacacactctctcccttacccttcaacatttcttccctcttgctggaaatctcctttgtccaccaccacctcacaaacccttcattcgctgcaccgatgatgacactgtcaccttaaccatcatcgagtccaaagcggatttcaaccatctctcttccaaccaccccaaaaatctcaaagatttaggtcacttggttccaaagttgacatgcacaaccatgcatgaagaagacacgttcattttcccaattgtggccttgcaagtcacggtttttcccaacaatggcctttgcatagctatcacttattgccacgtgatggatgataggtgttgcggtcatttcatgaagtcttggtcttccatttgtcgaagcggtggagttgacttgacccttgtggagaagtcaccaccttgctttgataggaaaatattgaaggaccccaaaggatcactcgaggctattttcttgagagattactttcaagagaggtcaacttggaaggacaaactcattggtcaaactcctaaacacgtgtgtgatgatgaggactttcttaaggcaactattgcttttggaagagatgatattgagagcctcaaaagatatgtgctgaatcattggaaaaaaaatgctgaactcaaagcgccacaatatctatcaaaatttgtggtaacgtgtgctttcgtgtgggttagcttggttaaagcaaaatatagagatgatgatgaaggggaagagatgaaagaggagtactttcgttttgcagcagattgtagagatcgcttggattaccctataccagaaacgtacttcggaaattgcttaacgagatgttatgcagtgctcaagcggaaggagctaaagggagaaggtggttttgtgaacgcagtgaaggccattgcaagagcaataactgatatgaaaactgaacctcttagaggtgctgaaaactggagggcattatttaggaagatgtttgtattgggaagtactgtgctagttacagggtcacctaagttcagtgtttatgagactgactttggatttggaagacctaccaaagtggagatggtacattcccctaagtgtatgtctgttgccgaaagtggagacaaagaaggaggattagagcttggcttggtatttagaagtggggaatttgagtatttcatttctgtcattgagcaaggatttgtagcattaaaatcctaa

SEQ ID NO: 90157 - DNA, 342 bp, Glycine max
  Peptide Sequence Number=SeqID_206935
atggagttgctcttcaaagatagtgatgaacctattcatcccaatgaatggttccctcagaatttattaatattatggagttgctcttcaaagatagtgatgaagttgctcttcaaagatagtgatgaacctattcattcgaatgaatggttccctcagaatttattaatattatggggttgctcttcaaagatagtgatgaagttgctcttcaaagatagtgatgaacctattcatccgaatgaatggttccctcagaatttattaatattatggagttgctcttcaaagatactgatgaacctattcatccgaatgaatggttccctcagaatttattaa

SEQ ID NO: 90158 - DNA, 468 bp, Glycine max
  Peptide Sequence Number=SeqID_206936
atggcttctcacagcgacgccaattccttgagggacttttggatcccgggccacgttctcgtgccggattccgtggttgaaggaagcaacatcgatatcgaaggacctaagtgtccggtgctcgttttcgttaactcaaggagtggtggccagctaggaggagaactcttgaaaacgtaccgtgcgcttcttaacgaaaaccaggttttcgacttgggggaagaggctcctgataaggttctgagcaggatctatgcgaatttggaaaacctcaggcttcaaggcgatcatattgctatacagattatggagaagttgagattaattggggtgatggaacagcaggctggctacttggagttgtttgtgatctcaaattatctcatccgccacccattgccacggttccgttgggcacagggaataatctaccatttgcatttggttgggtacgaaattgctgtttga

SEQ ID NO: 90159 - DNA, 503 bp, Glycine max
  Peptide Sequence Number=SeqID_206937
aacaaaaggaagaggaaggtaataactatgttacaaaaggttactttgatgaaccatgcaacattggattttccgcagactgtcataaccatcctcagttttcattaccttcaaactactttgggaactgtttgatccctctcctcacaaccctaaagagggctgcaaatgccattgaaaggaagattagagatttcaagagtgatgctttgagattggctgaaacaacgatgtcagatattagaggcttagggaaatgtggtcaatctcttgtggtgattgttggctcgccgaaacttactgcgtacaacactgactttggatgggggaagcccataaagtcagaagtggtgaatcttgattctgtgcgaacagtttctctcactgattgtagagaccaagaaggtggaattcaggttggaatagtactcgagaggattcaaatgaacaatttcactaacatcttggaagaacaccttagtcatattgcagttcttgactaa

SEQ ID NO: 90160 - DNA, 441 bp, Glycine max
  Peptide Sequence Number=SeqID_206938
atgtaccctcgcttgttctctttgaacctagtggatgtaccctccactagaactgatccacaagagatgtatcctctcttgttctcagtcaaactcaaggaatgggaagaatcaaaagaattctcagactgtgtcgtgttgaattctttgacaaggaagaagggagacacaaaagaattcagacggttagtcatttgttcttttggaaaagggagaagagagacacaaaaagaattcaggcggttagtccttggcgaattctttttggcaaagggagaagagaatgaaaggatgaatagcacaagttttcaaggtttagaaaaccagaaaacttcagaaagcttttggtacaaagaagaagaagaaaaagttcaaagagatttcaaggcttgtaaaggattgattggaaaagcaaaagtattcaagatttttgaaatgtaa

SEQ ID NO: 90161 - DNA, 1866 bp, Glycine max
  Peptide Sequence Number=SeqID_206939
atggtggttcttagagaacacaagcttgttggaaaaattcaggttgttccagcagtgagaacaatcaccactcttcccctcacattccttgatttgcctttggcaggtcctatttatgtgagacgccaattcttctatcagttcccccattccacactccatttctctgaaaccacccttccttctctcaaaacctctctctctaaaacccttcaacacttcttccctctcgctggaaacctcatttgtcctccaccaccccacaaacccttcattcgctgcaccgatgatgactctgtcaccttaaccatcatcgagtcccaagcagatttcaaaaatctatcatcaaaccaccccaaaagcctcaaagacttggatcacttggttcccaagttaacatgcacatatacacacgatgacacgttcattttccctttggtggcattgcaagccacggttttccccaaccatggcctttgcatcgcaatcacgtattgccacgtgatggatgataactgttgcagccatttcatgaagtcttggtcttccatttgtcgaagtggtggagttgacttgactcttgtggagaagtcaacgccttgctttgatagggaagtgttgaaggaccccaaaggactcgaagctatcttcttaagagattattttgaagagaggtcaagttggaaggttggtaaaacttctgagatttccaatgaaaatactgaagattatgtcaaagcaacgattgtttttggaagagaagacattgaggggctaagaagatgggtgctgaatcagtggaagaagagtgaggaattcaacacgccacaatatatgtcaaaatttgtggtggcatgcgcttttgtgtgggctagtttggataaaacaagatgcataaatgatgaagaagaaaatgtgaaagagaagtattttggtttcactgctgattgcagggatcgccttgggtatcctataccagaaacatactttggaaactgcttaactctatgttatgcaatgcttaagagaaatgacctaaagggagagaatggttttgtaaatgcggccaaggtcattgaaagagctgtggctgatatgaaaattgaacccttgaaagatgtagaacactggagggagtcgtttatgaagatgtacgtgttggaaagtaccttgatggttacagggtcacccaagttcactgtttatgagactgattttggatttggaaggcctaccaaagtggaaatggtacatctcttcaagtgtatttctctagctgaaagtggagatgaggaaggaggacttgaggttggtttggtgtgtagaagtacagaaaatgatgatgaagaagatgtcaaagaggagttctttcgttttgctgcagattgcagagatcgccttgagcattctgcgccagaaacatactttggaaactgcttaactctatgttatgcaacgcttaagagaaaaaacctcgagggagaaagtggtttggtgaatgtggtgaaggtcattgaattcaaagatgtttgtgttggaaagtggtcaaggtcattgaatgtggtcaaggttattgaattcaaagatgtttgtgttggaaagtggtcaaggtcattgaatgtggtcaaggtcatcgaaagagcagtgactgatatgaaaagatcaccaaagttcactgtttatgagactgattttggatttggaaggcctaccaaagtggaaatgatacattccttcaagggtatgtctctggctgaaagtgaggataaagaaggaggacttgagattggcttggtgtgcacaagtacagaatttgaatatttaaggtctgccattgaacaaggacttcaagtttcaaaattctaa

SEQ ID NO: 90162 - DNA, 231 bp, Glycine max
  Peptide Sequence Number=SeqID_206940
atgttccgtccttcttcttcaccagaagaactggggaagagtatggacttgtgctgggacgtatcaaaccggcgaaaaggagatcggaaacttgcttttctatctcggttttctggaaatgggggtatctatatgggtctgggtggggaagacgatgttgaggaagatgatgatgtggcggttcggtgcgggttatgggtagtaggcttaagtgaaatagggcggaagtag

SEQ ID NO: 90163 - DNA, 2466 bp, Glycine max
  Peptide Sequence Number=SeqID_206941
atgacattccggacgcatcaggggaattatgaatatcgcgtgatgccattcgggttgagcaatgctccctctacgtttcaagctgccatgaacagcttgtcacaccattcctgcgacactgtgctatgtaagaccctatctttacatgttcagcatctggaaatgatcttcaaagctctattagatggtcagttctatctcaaatatactaagtgtgttttcgcgcaaaaacaagtggattatttgggccacgtcgtgtcaggcagaggggttgaacctgaaccctctaagattcaagccatgttacaatggcctactccgacttccgtcaaagaactccgaggtttcttagggctaacggggttctatcgaaaatttataagagattacgcgtccatagcctcaccacttacaacactcctatgtaaagatgccttcgagtggaatgaagtttctcaagctgccttcgatgcccttaagtcagctatgactcaagcccccgtactagctctccccattttctctgaaccatttatcgtggacacagacgcgtcgaagaccgccatgggtgtcgtcttagtgcaaaagaaccacccagtgacattcttcagcaaggtttttggtcctcgactaacccatgcttcaacatacatacgcgaactccacaccatagtcacggcagtacgaaaatggcgtcaatacctcttaggaagatctttcactatcctaacagaccataagagcatccaagaacttatgacgcaggtaattcaaacccctgagcaacattactacctctctaagtttctggggttcgattacaccattcgatacaaggcaggcgcttccaacatcgtagcagatgccttatctcgagcaccaccaccttccggccagctacttttactcttagtccctcacttggacttcatttcagatctccgacgatccttacatgatgaacaggagtttcagacattactctcaaaggtccaggccaaaccttcagattaccttgactatcaaattcacaatggccttctcttttttcagggacgtatctggttaccaaaaacaaacccttacatacccaccatcttactcaaataccacgcgaccccattaggaggccacatgggtgttgccaaaacaacacatcgtctcgagtctagcttcacttggcaaaaccttaaggctgatgttaaaagctttgtttgtgaatgcaaggtctatcaacagaccaagtcaagcattcgccggccgggaggactgttacaaccacttcctcttccaactgggatctgggaagatatctcaatggattttataacccatttaccagcttctcacggttacaccgtcgtcctcgtcattgtggatcgtttctccaaaggtgtgcacttgggagcactacccacgcacttctcggcttacaaagttgcaaccctcttcctcgacctggtgtgtaagcatcacgggttcccccgcagcattgtttcagaccgagaccctgtgttcttgagctcgttttggcgagagctttttcgattgcatggaaccctcctccgcatgagtaggacataccacccgcagaccgacggccaaacagaggtaatgaaccgcatcctcgagcaatatctgcactcctttgttcactcgcagctagcaaactggttccgctacctagccttagctgaatggtcctacaacacgtctcttcataccagctctgggttcaccccctttgaggtcatttacggcaaaccaccgccagcactacctcactaccttcctggcaacaccactaacgaagcagtcgacaccatgattaccagccgtcaggagatccacaccaaactctggcagcgtttattaaaagcacaagctgctatgaaactccacgcagattccaaacgcgaagatgtatccttcacaattggccagtgggtctacgtcaatctccggccacatcgtcagcgttcagtcgcaggagatacccactccaagctttcaaagaggttttttggacccttccagatcgttgatcgcataggtcaagtcgcatatcgcctccgattgcccgacactgcacgcatccaccccgcgtttcgttgttctctcctccgcactcatcacggtcgtctgccatcttccttagacacatggcccttgcaagttgttgatcacaaaccaatcccacgccctttatgcttcttagattcgaagatggatgactccacatctccccccactcgtttggtcctcactcaatggcagggtcaaccccccgaagacaccacctgggagtcctggcctgagttacgcgactcctacctccttgaggacaacatggtattcggggaagggagtattgatacgtccatgcataaaccagaactcaaaggaaccagaacccgaagaggagccaccacacctcgttacctacgcgattacatactcgaataa

SEQ ID NO: 90164 - DNA, 954 bp, Glycine max
  Peptide Sequence Number=SeqID_206942
atggcattgcaagccacggttttcccaaaccatggcctttgcatcgccatcacgtactgtcatgcgattgatggtaaaagttgcagtcatttcatgaagtcttggtcttccatttgtcgaagtggtggagttgactttactcttttggaaaagtcaccaccttgctttgatagggaagtgttgaaggaccccagaggactcgaggccattttcttaagacagtattttgaagagagaacaacttggaagggcaaactcggtggaagaaaagatgatagcgatgaagactttgttaaggcaactattgtttttggaaaagatgatactgagggcttaaaaagatgggcactgactcaatggaagaaaaacaacgagttcaactcgccccaaaatctgtcaaagtttgtggtgacgtgtgcttttgtgtgggctagtttggttaaaacaagatgcagaaactatgatgatgaagaagaagatgtcaaagaggagtactttcgtttcgctgctgattgcagagatcgccttgggtaccctataccagaaacttactttggaaactgcttaacgctatgttatgcaatacttaagagaaaagacctcaagggagaaagtggttttgtgaatgcggccaaggtaattgaaaagtcagtgagtgatatgaaaattgatccttttaaagatgcggaacattggagggagttgtttttgaagatgtttgtgttgggaagtgcactgctggttacagggtcacccaagctcactgtttatgagactgattttggatttggaaggcctaccaaagtggaaatggtacatcccttcaattgtatgtctctggctgaaagtgaagatgaggaaggaggactcgaggttggcttggtgtgtagaagtacagagtttgaagatttaaattctgtcattcaacaaggacttaaaacttcaaaatcctaa

SEQ ID NO: 90165 - DNA, 987 bp, Glycine max
  Peptide Sequence Number=SeqID_206943
atgggaagagcaccctgttgtgacaagaatgacctcaaaaagggtccatggactcctgaggaggatctcttgctcaccaactacattcagacttatggaccaggaaattggcgaaccctccccaagaatgctggtctacaaagatgtggcaagagttgtcgccttagatggactaattaccttagacccgatatcaagagagggaagttctcatttgaagaagaagaggccatcattcagcttcacagtgtcttgggaaacaagtggtcggctatagcagctaagttaccggggagaaccgacaacgaaataaagaactattggaacacaaacattaggaagaggttgcttcgaatgggaattgacccagttacacacgctccacgccttgatcttcttgacatgtcctcgattctaaggtcagcaataggaaccgttaacccatcgtttctgaatctgcaaggcctattgggtgcccaagcgttgatgaacccagaattttttaagctcgctgccactgccacacttttatctttgaagaatcatgagaacgcatcaaacttagtttcacaagtgcaacaacaattcaataataatgctgggaatggtcaagtacagaaccaagttgctgctccaaatcagtttcagacaccaactctaagcaacaacaacgtgaacaatggcttatcatcaatttccccagagaattcatcaattccttcttatcttggggagaataattaccagctgaatgctcaacaaattaaccaagttgatttgcttctggaccccgaattggaacattacttaaacagtataaaccaaaacataggccatgaatcagttacacctttgtcaactcctacctcattgaattcatcgtccacgtatgtgaatagttgcgcggaggaagagagggacacctattgcagcgatgtattcaagttagaaattccagagagtcttgacattagcgatttcttgtaa

SEQ ID NO: 90166 - DNA, 495 bp, Glycine max
  misc_feature (225)..(225): n is a, c, g, or t
  Peptide Sequence Number=SeqID_206944
atggcggccaattcctggacatacgctgatgccatgaggagttttgtgttgaaggctatttgggctgactggttccagacgaagctatccttagtcaacacggtggtcaaagggccaatgttgtatagcttgcactttcgcgtgtattggttcgaccccttgagcagaaacgaagtggccaagatgccggacatgctcctcgataatggaactatagatcaaganatcgtcaaaaaacacaataaagagccccgtgcccggaatgagtttgcatcaatcaacgaagttgggggggctgatggcacaaagctcaaaattggtatcccctttgagctcgaccacacgaccggagtgaaggaatttcatggtgaggtcattgtagtttgtcaagacaggtcccagagacttcaaccattgcactccgagaaccaagtcggcaccacagaggtcgagactccaaattggccaacttctgtaagagttcatcaagcttga

SEQ ID NO: 90167 - DNA, 1140 bp, Glycine max
  Peptide Sequence Number=SeqID_206945
atgccacattttgagtttataaatgaactcaaacgtgaactagttcgacatcctcagttcattgagctcagacagaacatcatcgagctacctcagcaccatgctgattacaaaatcacccaagacttgattttaaaagacggatgtatttggctgccatcaggcttccaactcatttcatcgttgttgatggaatttcattcaaccccctccggtgaccacatgggcatcatgaaaacaatggccaagctcagtgatagtttcacttggtcaggtatgaagagggatatccaagaattcattgtggcatgcttagattgtcaacatactaagtatgagtcgaagcagtctgcagggttgctctaccctttaccggtgccggcaaggccgtgggaggacctatccttagatttcattgttgggttacctccatatcggggccacaccacaatcctagtagttgtggatcgtttctccaaagggattctggcaggagttgtttcgtttatgtggcacgacactacgcatgagttctacgtatcacccatagttggacggtcagacagagaatattattacaatactttgtgtcattctggttctggggtctctctttatgaggttacttatggcaagaagccattaacaattccgcaatatattaccggcacatcgagagtagaggcaatagatgactttctaagtaatagagaatcagttttcacagaattgcggaagaaactcttaaaggtccaggagcatatgaagctatctgcagatatgaagaggcgcaatgtgaattttgagtgtggagacctggtgatggtcaagcttaggcctcaccgacaaacatctacttcaggatccaacgttccatattccaaacttgccaaaagattctatggtccttatcgagttctggaagactggaacgcattgatgataccacatgagaagattgggaggaactcaagtctagttatgaccttgaggacaaggtctttcttgatggtgcaggggatgataaggaatgcaaaaccagcagaggagaggccattgagagacccaagaggaagatcatgccacccaaatatttacaagattttgtttaacaaattagttagtggaaatgatacttag

SEQ ID NO: 90168 - DNA, 174 bp, Glycine max
  Peptide Sequence Number=SeqID_206946
atgtggaaggagaagcagacagctgggaccttggagcagatatggtattgggcgtgtaatggatgttctgttttatcttctaccattgttgctagtgacttagtggctaaactttcattttacatgacccaagtactgcctatacacttggtaatgagtatattatgcatatag

SEQ ID NO: 90169 - DNA, 327 bp, Glycine max
  Peptide Sequence Number=SeqID_206947
atgtggactgtcttgaacattattgctgggttagtggatattggcatattttacttttctgaatatttctccataattggtaaatattggcaatttagcatatctgattttcatatacattctggaacaggtgcaggattttatctcaatgctacacaagagaaatggaagaattggcgcatgtatgactatgttgtcaaggagttgccaaagcttctgagcgataattttccacaccttgaaacatcaaaggcttctatatttggtcattctatgggtgggcatggtgctctaacaatctacctaaaaaatcaggataaatataag

SEQ ID NO: 90170 - DNA, 696 bp, Glycine max
  Peptide Sequence Number=SeqID_206948
atggcacaaacggatccaagctcacatcaagcagctaatcgtgtctacgaagattttgaaccatcttatgaatgggctcaagatgaagaaagtgacacgcttattcttatgcttaaaggatttagaaaggagaatttgagggttcaaataggcacaaaccgtagactaaaactcagtggtgaacaacagataagtgagaacaaatggcatagatttaacaaagaatacaccattcctcctcattctaacaccaatgggatcaaagccaagttacaaggtggcctactatatataaggcttcccaaaatcatcactgaagctaagtcaacaacaaaatcaccaacaccaaatcttgaagctgatgacaaccaaagaggaaccaaagagacaccaacacaagaagaaccaaagacaagtgaggtttctcagacaaaggagatggggaaagtaggggaagatgataactgtgttgctcagaatagagccaaagctaccacttctgaagctcagaatatgcatgaaacaattgatgagttgagtaataagaaggttgaccgaaggttacctacaaccctttatggcttggttggggaggttgttaagcaaaagaaactggctaacttggtggttgtcatcttgttccttggtatgggaatgtatgtcaaaaatgcaatcaagtcattttttggaggataa

SEQ ID NO: 90171 - DNA, 336 bp, Glycine max
  Peptide Sequence Number=SeqID_206949
atgtcgtttgcccttcagttcccatggattgatatccatgatcatctggatgagttatacccaatgatccctgaggagattaaggcactcattgaggaggagaacccaagctttgttgagggtacgtcagatttatgggtatggagtcataggattgatgaagttactcatgcaagagtgcctatgactttcttcaagtggttgaggaggcacgctcaacgtggctggaataagtgtggtatatcaagaaacaacctcctagtgagtgaggagcaagttccgtcttgggtcgacaagggtgttgcccttgctcctatgtatcctcaggtgcaatga

SEQ ID NO: 90172 - DNA, 267 bp, Glycine max
  Peptide Sequence Number=SeqID_206950
atgcagttaaggcacactcaaagtggctggaataagtgtggtatatcaagaaacaacctcctagtgagtgaggagcaagttccgtcttgggtaagtagtcaagtaaaaaagagagttatgatagtatccattattttgtggatgatatggcatgcgcaaaatgcccaaatctttgatggtaaggaggttacaacaacaaagacctatgcttatatccaagtgcattggatccgattaaaggaagcttttgtaaggagcggggagtaa

SEQ ID NO: 90173 - DNA, 351 bp, Glycine max
  Peptide Sequence Number=SeqID_206951
atggacaccactttatgcttcagcagtaccactgcctccaaaaaactcatcaccaacaatccttatctcattgtctacgttgtcaataccattgtgacatgttcccacatgatcttgatcttacaaaacccgacatggaatgagcatttcaagattcccttcacacacttggcactacaggttgagttctacatcaaggacaatgacatgtttggtgtcgaccttatcaaagttgccactatcccaatcaaatggatccacgcaagtgctagtcgaattgaagaggaagatggagagaaaaagagagtgagtgggagtgtaagattgagactttacaaattttgcatgtga

SEQ ID NO: 90174 - DNA, 165 bp, Glycine max
  Peptide Sequence Number=SeqID_206952
atggtggtttggtacaacgtggcgtttggtggttgcagtggtggtgttgggtggaggcgagatgcggtggccatcatggaggtttggacgagaggtggtcatagaggtttgcttaggatattagaaaattcgaaagtcaaccaaccaaaaaatgggaggcattaa

SEQ ID NO: 90175 - DNA, 714 bp, Glycine max
  Peptide Sequence Number=SeqID_206953
atgtggctatgtggcacctacgtggccttagcgccttatccagcaactgttgtgttgacagttgtggtgctatgctcaggaaagagtgggattttcagtccctcacaggcacttcttgtgaagccagtgaagaggcagatgatggggaagagcaagggaatgagaattgcatgccaagccaccagcattcctgctgatagagtccctgacatgggcaaaagacagctcatgaatctgcttcttcttggtgccatttcactcccctctgctggaatgcttattccctacacctacttttttgtccctccaggttcaggttcttcagctggtggtactgttgccaaggatgctgttggaaatgatgtaattgcagagaattggctcaaggcacatggacctggtgaccgaacccttgcacaaggattgaagggagatcctacctatcttgttgtggagaaagacagaacccttgcaacatatgcaattaatgccgtgtgcactcaccttggatgtgtcgtgccatggaatcaagcagagaacaagttcatctgcccttgccatggatctcagtacaatgaccaaggaagagttgtgagaggacctgctcccttgtctctggcattagcacattgtgatatagatgatgggaaggtggtgtttgttccttgggttgaaacagatttcagaacaggtgatgctccatggtgggcttag

SEQ ID NO: 90176 - DNA, 528 bp, Glycine max
  Peptide Sequence Number=SeqID_206954
atgcatgtaggctcacatgcacatatagacttaacctgtgtctcgcatctcgttgtccgtcgtgcgtgtctattgcgcgtgttaccagcagtcatcccttgcttgagttcgtgtgcttccaacagtcatccctgtctagttcgacgtggtgtggctgggttttttggtggtctgagttcgcgcggtagcaggagtcatcccttgcctcctacagtcccttgttcgaccacagggctagggtttaggcatattcaaaatttcttaaaagggttgtacaaagttagtctgagcccaatagttactgaggacgaaaaggttgtagaaattgcttactttaaggctcaacatggaagcacaagtttgataacacaatgggtgtacttcacttcagtttcaaacaaagttagtgggtgcaacactaataatattctctctcgtcgcactagaagctcctgcaatacttcgttcctaaggtacacttgggttgtcaaaaatttcttttctttggcttctcaaaagaagagttaa

SEQ ID NO: 90177 - DNA, 993 bp, Glycine max
  Peptide Sequence Number=SeqID_206955
atggattttgacctcgaaaaccctcttggaaacttccacgaccttccttgtgacgctgtcccttccctcttcctcatcgaatccgaccacatccctccacccaactactgtcagagtttcaaggccagcgacttcgacatctctgtaagaagagacgttgtctctttgatctcgcagttgtcctgcaccttcgatccggttcttccttacttagctattaactacttggatcgcttcctcgctcaccaaggaatattgaatatgcttcctcaagatctaactgaaaatgggtatgagcaacagcaaccaaagccatgggcaaacaagctccttgcaatctcttgcttttctctagctgccaagatgttgaaaacagagtactctgccactgatgtccaggttcttatgaatcatggtgatgggggtgccatttttgaggcacagacaattcaaagaatggaaggcattgtcttgggggctctacaatggcgaatgcgttcgatcacccccttctctttcattcccttcttcgtcaacttgttcaggcttaaagaccctgcattgaggcaggttctgaaggatggagcatcagaaatcatactcaagtcacaaagagagataaaggtcttggaattcaagccatctacagttgctgcgtcagcccttctgtatgcttcacatgagttgtttccctttcaatatccgtgcttcttaagagcaatatccgattgttcatatattaataaggaaactgtggtgcaatgttataatgtgatacacgacataaccagggaggagtacgaatcagtgttgaatataaattcaacttcagacacaccggttaatgtgttagacgaacattttctgagtttggaaagtgaaaaaaccaacggaaccaacgttgtgacacaagagcaggatttcaaaagaaggaaaaccaccgattatggcaacaatcgcacggtcccgttttcacattttcatcaatgctga

SEQ ID NO: 90178 - DNA, 679 bp, Glycine max
  Peptide Sequence Number=SeqID_206956
atggtctgtgattgccactcatttacccggaagaacagataacgaaataaagaaccactggcacaccactctcaaaaaacgttttggaaagaacacagttcaccccaataaaaaagtgaaagccacaaaatcaaatagttctggatccaaggaaattcagaaagttggtttctttcacagtagttctacaataacaacttctgaaacctctgattctgtccctttgtccccaagagaattctcgtccacaacctcggactataccacagttgtcactaacgaaaatttcttactggaagacgggttcgattttctagaagcatgcttagaggacgtgaacgagaatatttggacagagacaaatgcagctagcatttccaattccaagaccccaatgctagataatggtaatggtagtaattttcatggttcagatgctgcagggcccatcatggaatataacgaaaatttggttctggagaatgatgaatttgcgtttctagaagcattgcagccaacagtaacaactgagaattttttgacagacatgtcccttgttccaaacgaattacttgcccctttggtgaacgaatctgaggaatacttttcttccttgtacgatgtggacctttggtgtcccagtaatttccatgatttgcacgtgggcttattgcaatga

SEQ ID NO: 90179 - DNA, 759 bp, Glycine max
  Peptide Sequence Number=SeqID_206957
gatggaactgctaaaggaaaagcatcggggcaatcaaatcatggtggtggtgcagcatcaaagctttcacccctgtctcctgagccttatgattgtgcagcaactgttgacattcctcttgattcctcaaaggacctcaaagccaaggagaaggagctccaagctagagaggctgaattgaaaagaagggaacaggagctaaaacgaagggaagatgctatagcacgagctggaattgttatagaggagaaaaattggccacctttttgccccatcattcatcacgacattgcaaatgaaatacctatacatcttcaatcaatccagtatgtagcatttacaacatggttaggtttggttggatgtcttttatggaatattgcagcagttactgtagcttggatcaaaggagaaggtctttcaatctggttcctatctatcatatactttatttccggtgttccagcatcctatgtgatgtggtatcgccctctttatcgtgcgacaaggacggatagtgctctaaggtttagctggtttttcttgtcttacggagtgcacattctcttttgtgtttttgctacaattgctcctccaattgtcttcaaagggaaatctctcacaggtattctgcctgcgtttgaggtattggactacaatggattggttgggcaagtatacatgtacttccggggcagtggaaaggctgcagcgatgaggcgtgaagctgcgcaaggggccatgagggcagctctatga

SEQ ID NO: 90180 - DNA, 489 bp, Glycine max
  Peptide Sequence Number=SeqID_206958
atgagaaatttgatatgtgtttgggatggtctcacaaagttacagcaatctgttctgaaaaagaagataaagtttgtcagagaaaaatttgaaatgaagatcgcttatgtactgtattctcaaatgaagctattggaagcttggggaggaatggaaaggcaacacttacaagcaattactgccatcaaagtgaacatgcaatcaacatccattgctcttcggcatgcatctgatctcacagcttccatcaagttaattttaactacttgttcatcttcagaggctgaaaagattgttgcaatgctatcagaattagcgaaagttattgcacaagagaaacagctcttagaagagttctatgatcttttccagaccataggtgtctttgaggttcaagaaagaagtgtaaagtgcaatctcgttcaacttgaaggttggcaacaaaaatatcaactgcagcaattcctactaccggagatcacttcatag

SEQ ID NO: 90181 - DNA, 2289 bp, Glycine max
  Peptide Sequence Number=SeqID_206959
atggatcaagggaggcaggtattcacagtggaccttcttgaacgatatgctgcaaaagggcgtggagttatcacttgcatggctgctggaaatgatgtcattgtgattggaaccagcagaggatgggtcgtcaggcatgattttgggtctgataacttgtctgtttggagtgtagagattgatctctccgtgggtcgtcctggggaccagtcaatccatagggtttttgttgatcctggagggagtcactgtattgccactgtagttggtcctggaggagctgaaactttctatactcatgccaaatggaccaagccacgaattttgagcaagctgaaaggtcttgttgtaaatgccgttgcatggaacaagcagcagataactgaagtttccacaaaggaagtcattcttgggacagaaaatggtcaacttcatgagttggctgtggatgagaaggacaagaaagagaagtatatcaagtttctctttgaattaacagaacttcaagaagcttttatgggtttgcagatggaaacagctagcatgataaatgggactagatactatgtgatggctgttactcctactcggctttactctttcactggaagttatttagatcgtacggtgcattttatggaacttcctggtgacatagcaaacaggcaacaacgaagagctgtacattttgcatggctttctggtgctggtatgtaccatggtggcttaaattttggaggacaacaaagctcttcaagtggaaatgaaaattttattgagaataaggctcttttggactactccaaattgtctgaaggagctgaagtagttaaaccaagttcaatggctttgtctgaattccatttcttgttgcttttagggaataaggtcaaggttgtaaacagaattagcgagaagatcattgaggaacttcagtttgatcaaacttctgattcagcctctaagggtattataggattgtgtagtgatgccacggctggtttgttttatgcatatgatcaaaactccatctttcaggtgtctatcaatgatgaaggccaagatatgtggaaagtatatcttgacatgaatgaatatgctgctgctttagcaaactgccgtgacccttttcaaagggaccaagtatatttagtccaggctgaagctgcgttttcttttaaagattatttaagagctgcttctttctatgccaaacaaggagaagcaaaaaaagcattggaagtgcttcagaaaccttctgtgcctatagatcttcagtataagtttgctccagaccttgttgcccttgatgcatatgaaactgttgaatcgtggatgactacaaagaatctgaacccaaggaaactgattcctgcaatgatgcgttattcaagtgaaccacatgcaaagtactccgaagatgatagttcacttctacgtttcctacaaagcaaatttgggaaaggaccagaaaatggtcctgagttcttctacgatcctaaatacgccttgcgtctttgcctcaaggaaaaacgaatgcgtgcatgtgttcatatatacagtatgatgtcaatgcatgaagaagcagttgctcttgccttacagattgattcagagcttgctatggccgaagctgataaggttgaagatgatgaggatttgagaaagaagctttggctcatgattgccaagcatgttgttgaacaagaaaaaggaactaagagggaaaacataaggaaggcaattgcatttcttaaagaaactgatggcctgctaaagatagaggatatattaccattctttccagattttgccctgattgacgacttcaaggaggctatctgctcatcattggaggattacaataagcaaattgaacagctgaaggaagagatgaatgatgcaacccatggtgctgacaacatcagaaatgatatcagtgcacttgctcaaagatgcactattattgatcgagatgaggagtgtggggctgagtatatactggatctgcagaagcaactttctttgatgggcagtgaagcaaggagagaatccaatggtaccctttctccagaggagtccattcctagcatgaccactatagacaagctccgatcacaactggatgatgctatagctagtgaatgcccattttgtggtgacctgatgatccgtaagatttttttgcctttcatcaatcctgaggaagagcagcatgtgctatcatgggagataaaaccaagctctggaagccagagaaatagtatctcgttacctgcatctgcatga

SEQ ID NO: 90182 - DNA, 345 bp, Glycine max
  Peptide Sequence Number=SeqID_206960
atgagttacttgaaccgtgtttggatggcggcgacggtggcggtggcgcagggccacaccgatcccggccacaagtgcaagacggcgctcacctccatccaccacaaccggagccgcctcttctccggcggagccctgtcagatctccggcctctttccggcgtcgtgggatctgacgtggccggctcggtggcggggagctccgacgtggagaatagggtgaggcaagccgacgactctctgaggaaagtgatgtcaaggtttgagttgaagaaaaggtcctttaagaaacagttttacaaggaaaaaatcattgagaatgaagcaatcatgattggaatatga

SEQ ID NO: 90183 - DNA, 273 bp, Glycine max
  Peptide Sequence Number=SeqID_206961
atgggaatttggcactttgatgagcaaagagatcaagtggcaatagagcaaattctgcgggttatgtttctggaccctgaaaggcctagtcctgtcctggataagcttaaacgaatgttggccgaggccgacgctgcacttgaagcacgaaagaaaccgccagaggagaaaggtccccgtgttgctggggaaggccttgttatagacgaatggaaagaaagaagagaaagatacttggctcaacagcaggtccaaggtgttgattcagtgtaa

SEQ ID NO: 90184 - DNA, 444 bp, Glycine max
  Peptide Sequence Number=SeqID_206962
atgagttcaacaagccgtgcttggacttggaccgtggcggcaagtgttggagtggtggaggccttgaaggaccaaggtatatgcaggtggaacagtgtgatgagatcagcacaacaacatgctaaacataatatgaagtctttgtctcagaccaagaagctttcttctcaatcatctgttatggcttcagccaaattgaaagatgagaaagctaagaagtcagaggagtccttgagaaccgaagatgagaaatggaagactcagaagatacaccaatcagagaagagtttcaactctcaaccaacaccatgttacttgcatgctatgcttgaacacctgttgatcaaaccgatcgaatcaaaggctgaactaagaatatatagtctgaagcatgtcttctgcctttatttgatcgataatcatctttggaatgatgaaatttga

SEQ ID NO: 90185 - DNA, 294 bp, Glycine max
  Peptide Sequence Number=SeqID_206963
atgacagacacgtggccttcaatttgcaagatgatgatttcaagtaggagagcatggactgtggcggttagtgttggagttgttgagagcttgaaggaccagggcctctgcagatggaattcaactttcaagtcagcacaacaaagtgtgaaaagccatatgagatctttgtcacgggcaaataagctctcttctgctatgctttctagcacactactgcatggagagaagacgaagcagtcagaagaatccttgaggaccgtcatgtacttaagttgctggggtcccaactga

SEQ ID NO: 90186 - DNA, 144 bp, Glycine max
  Peptide Sequence Number=SeqID_206964
atggatatttgtcttcatggaacaaatgatgatattgttgattggtctcatggcaagcgattgtgggaactctccaacgaaaaatatgatcccttgtgggttaaaggtggggtcacaaggggtgtgagaaggtatgtgaagtaa

SEQ ID NO: 90187 - DNA, 254 bp, Glycine max
  Peptide Sequence Number=SeqID_206965
tggttcaaaacatggaggaaggaatcaaagatggaactccaacaaaagacaacctcattagttcttctcacaaaggtagctcctcaagaatccctggtctctctaagccagagaaccgtgttgctgggaatggttatgaaaatgtgattcatcaagcatccaagtgcagtaatgttgatgctgctgataaatttaaaaaagctgaagaatctcttagaactgtcatgtacttgagttgctggggtcctaactaa

SEQ ID NO: 90188 - DNA, 369 bp, Glycine max
  Peptide Sequence Number=SeqID_206966
caaaataggggagaagcttgccgctcagctcgcccaagcgagccaggttgcttcctccagaagcaacagccttctggaggaatcttctggaaggcccaactttcgaagaagttacggaaacttacggattgcgcaaaaacatctcttttcgacttccgccacattacgaaatttcacggatcgtgcaagcctgcttcctttagatttctgagacgtctcgggacttcatttattgtgcaacaaaggacgccaagtatctcaaagcggctaaccaaagattgcatgtcatcaagtaataatccccggacgaaattagggtatgacaatactatccagacgttaaaaagtgttgttagacgcctaccttga

SEQ ID NO: 90189 - DNA, 399 bp, Glycine max
  Peptide Sequence Number=SeqID_206967
atgccaatctccccctgcagatgtatcagttgggatcgcgcctacaagacacccagtggacccgaagaagtccaacagggccctggggtttctagctctggttacgggcctctgtcagtcctactgggtgcccgttcccctagcaaggaatggcacccacaaagacacccagtggacccggagaagtccaacagggccctggggtttccagctctggttgtgggcctctgtcagtcctacagggtgcccgttccccccggcaagggatcgcgcccgcaagacacccagtggacccgaagaggtccaacaggttcttggagttgccaagctctaattacgggcatcggtcagttctacggagtgcctgtcgcccccagcaagtcatcagccccatactaa

SEQ ID NO: 90190 - DNA, 396 bp, Glycine max
  Peptide Sequence Number=SeqID_206968
atggggcagatggctactcagttgaatcaagctcagtcccaaaattctgacaaattgccttcacaaactatgcagaatccaaaaaatgtgagtgccatcaccttgaagtctgacaaccagattcaagtgcctccactagtagcagcacctgcacctgaacctgtcaagcttgcttctacacctgagaaagaggatgacatagtcgcacaaaagagaaagcttcctaacaaaaaatttcatgcagattgttcaacaaacaaagccttgtttcaagattcactaaagaccaagccttgccttaaaacaaagtgctttcaagacatgcaaggctctggtaatcgattaccaggaagtgtaatcgattaccagaagacagggttgagaaatagctgttga

SEQ ID NO: 90191 - DNA, 261 bp, Glycine max
  Peptide Sequence Number=SeqID_206969
atgaagatctatttatgcaattcatcggcttctttaaagttccttcgtgcacgtgtttttgatcttcagaaccgccgtggcaagcacagcacattgcccgggacaaatgctgattctcttgggtctgttgtgctagtgtcaccatctgcatgcaaaggcaatgacgcctgcaatgcatcgactcctataaagttccttcgtgcacgcgcttttgatattcagaattgcatctgcatgcacattgtttgggatgaatgttga

SEQ ID NO: 90192 - DNA, 103 bp, Glycine max
  Peptide Sequence Number=SeqID_206970
atgccatatgggaaggcagctaaaactgaactgaccaagattgttcaagacaagccttttagggtccttgtttatagagaagatcgctatggtcgttctgtag

SEQ ID NO: 90193 - DNA, 225 bp, Glycine max
  Peptide Sequence Number=SeqID_206971
atgacggcgacagcgacaaagtctatttcattgaagcccttaggaagagacgggaccgtgaggcgccatttggcggaggagattccgattgtggtgcctaggtacgccatcaagcctctagcgacaatggcattggaaatcgccgccagcgacgggcatgtcgactacaaacttggtgtagcagaaggcggagtggagggcgcaaaagccggcaatggcaattaa

SEQ ID NO: 90194 - DNA, 249 bp, Glycine max
  Peptide Sequence Number=SeqID_206972
atgggcagcaaaactacgaagcgtgcagtgcagttcaggctaagacaagaaagagggcttcgaaccattgggcgaatcgagctggcgtatggtagaatcgaagtcaaggcaacaagatttctggacttagcgcaatttctgacaaaacttcacaaaattagttcgacttcgagcgatatggataaccgttctaaggagcagttatgtgcatgcaaggtgtacgtagcaggacacttggcattaggatag

SEQ ID NO: 90195 - DNA, 192 bp, Glycine max
  Peptide Sequence Number=SeqID_206973
atgagggtgtcgtttgtccgaactcgagagcttcttcttcacaaggctgcaaaatccaccgcagcaaacaatgaaaagcctcaaaatggcagagagcgagaaacacttgtgcttatcagtcagcccccacaggaacaagggttcaagtcatggggcactgggaagaagaacagtcacaactcaaccatttaa

SEQ ID NO: 90196 - DNA, 627 bp, Glycine max
  Peptide Sequence Number=SeqID_206974
atggaggccagtgctccagaattgccaatggaagtggcacatgggttccccatgatcagtgttgtagaggatagcttctgtgtgacttacccaacagaaataactgtgaagaagaattaccgtggattcttcttaaaccaacgatacgaggtgttagatgttaacggtgatctcttgcttcaagttgatggctcaagccttgacgtgcgcaagaagagggtcatgcgtgatgctgccggttcccctatacttacaatgcgtgagaaagttaagctgataacactgcggcatcggtggatggttcatagaggcaaaagctcggaggagaaggatctgatttttggggttcaacgatcccaccctcttgacatgaaaccgcggcttgatgtgttcatggccaccaacatcaatgaagatatcagcagctttcaacttgttgggagccacagtgacaagtcctgcaaagtttacaaaggagacaccatgattgcagaggtaattggtgtatatccaaggagcaacttcagcaattggacagaaagttttaaggtcaaaatgaatgcaggggtggattatgctttcattgttgcgttgcttgtaatactcaccgtaaatgattacatataa

SEQ ID NO: 90197 - DNA, 345 bp, Glycine max
  Peptide Sequence Number=SeqID_206975
atgttcgttggctttgttttggaagaagaagtgctctgtggaaatgagtcaaaaggaaccacacactcgggagttctgcaagaatggtttggcatcaactggtggacctctcgtgcttttgctcttcttattgttgcacgcttcataatgtttccacttgttatgttaaggcgtgttgttcattcaattagagcagagcttggaaaagttgcacatatgggtttggccacgcgaatttcattaacaatctgtgtagcaatttactttgctattggcttctttggggattccatcatgcctgacgtgttgataaactttgaccaaaactccaacacaagttcttaa

SEQ ID NO: 90198 - DNA, 249 bp, Glycine max
  Peptide Sequence Number=SeqID_206976
atgtatataaactctgcagagttgatagcaaaaagaaaagcaccagagggaaagaaagccagaagaaggatcataagaggagagagagagagagcacacaaaatggtttccaaagagcaaaagagagcagcactgcatgagaagctgcaacatcttcgttctattactaactctcatgctgtaattccctacattatctcctctgatatctttctttccattggatttctccgtgaacattctcaatga

SEQ ID NO: 90199 - DNA, 564 bp, Glycine max
  Peptide Sequence Number=SeqID_206977
atggaagcaagtaacgaaagacgagtgctacctcgcagaaagcctctctccgatcgcaccaacacttcttctccctccgctgttcccctcaaacctctcaaaaccaaaaccccttcttccgcacccgctaaatgcaccgccaccaatctcgatagtgccccaaaccctacctctccttctccatcgctcaaaaccccctctccctctctccacgagattgttgatgttgaagcttccgagcctatcacagtcgtgtacagccgaagacgttcttcaaacaaaagaaagaaggataaagggaagactgtggctgttcctttcactaccacgcccaatttcaagatctctcatacttgcgatacagaggatgagtttgaaggtgtgaacctacccaaggccaaggcaatgacagttcctcgtacaaagaaacagcgtgctttgtcatctgaaaaagatgagttcaaggatcaccagctgcaagaatttatacaaaaacagaaagcttactttaaagagattgatgaatttgaactggaggttgaatctggtgatgagttggattag

SEQ ID NO: 90200 - DNA, 168 bp, Glycine max
  Peptide Sequence Number=SeqID_206978
atgaagttgagagtgcggaaatttaacagggaaaagaagaagaagaagaacaaagcacggacaacgcaatttgggttgggtaatatgaatacttcgtacggaggccttctcatccaatacgggctaggccttacggtctcttttgtctctcttggtaaaattttctag

SEQ ID NO: 90201 - DNA, 219 bp, Glycine max
  Peptide Sequence Number=SeqID_206979
gatgaaggaaggaggaagggtgcgtgatgatggtgtcgcggggccacacgacgagcgaaaggggaaagcagaaaagagagaaaaaagtaaaggggggatagtggtggcggaaagcgcttctgggggacgtggagttacggtgtgggctatggtatggttggttagtgaggaagaacagtcaaaggttgtggttacgtgttgtgaagtgtggccaatgag

SEQ ID NO: 90202 - DNA, 225 bp, Glycine max
  Peptide Sequence Number=SeqID_206980
atgggagggattgctgagcaacaaaaaagaaagatgaaacggaaagtgaaacaaggtactagtattgaattggagaagaaaattgttgtagcgttcgacacgtgcgcacgcgcgcattcaattccgacgccacggcgtgttcatggtttttctggccccaagagaatgtaccacggctgggattggattggcacatgtaaagagctaaaaatggcacaaaattaa

SEQ ID NO: 90203 - DNA, 1311 bp, Glycine max
  Peptide Sequence Number=SeqID_206981
atggaaggtttggcttccctcaaggctccctttccggccaccccatttctctcttccagacccagaacctctattcttccatcccaagccagttttcgtaaaagaagctcctttttatccttttctgttcatgcccaggtggagtctgatgatggttcagctgtagtagccacatctggtgaatctgtgacagaggttctgaaaattaaggagtgggaggtgggaatgttccaaaatgaggttgcagctagccaggggcaatacgccccggacattttggaagagattgtgtggaataaggacacagaagtctcacagcttaaagaaagaaaaccccttggcgtgctgaagaaagctcttgaaaatgcacctcctgctagggattttattggtgctctaaaggcagccaacgaacgaactggacttccagggttgattgctgaagtgaagaaggcatcaccaagtagaggtatcttgagagaagactttgacccagttgtttggagtgaagatgttgttgttgttcaccgaggtgggagaattatctgtcatgaagatgcattggttgttgggagctcaatgtcagattgcagcgtcaacatgttggcagatgagtttgtaatatcagtcaggaatatgctatgttttctcattgagtatcttggtctcttagttttgttgtatcagtcaatgtatcatgcccttcaagttgaaattgctaaggcttatgagaaaggtggagcagcatgtctaagtgttttgacagatgaaaagtattttaagggaagctttgaaaatcttgaggcaataagaaaggctggcataaagtgccctttgttgtgcaaagaattcatcatagatgcatggcaactctactatgctcgaactaaaggtgcagatgcagtccttttaattgctgctgttttgcctgatcttgacatcaaatacatgattaagatatgcaaattactcggattgactgcgcttgttgaggttcatgatgagagggaatttgatcgtgttcttgcaatagaggggattgagcttattggcattaacaaccgcaatcttgaaacatttgagttggatatcagcatcacaaagaaacttcttgaaggagagcgaggcaaaataatccacgagagaggcataattatggttggggaatctggtctctttaccccggacgatattgcctatgttcaggaagctggtgtaaaagctatattggttggagagtctattgtaaaacaaagtgatcctggaaagggaatcagcaatctctttggcaaagatatctctttgggttga

SEQ ID NO: 90204 - DNA, 1518 bp, Glycine max
  Peptide Sequence Number=SeqID_206982
gaagcggcgaagttggaaaaggatttgatagtgaaagaactcgaaacacttgacgtgcttgaagaactgggagctaccaaagcaattttggaggaattaaagcagcagctacaatcagaagcattgaattgttttgcaactccgggtggaaattcatatgaacaggttggagctgctgttcaaaattgtgtgaatggtatcaataatgaagagcaggcattgcaatgtcagagtccgtgtgctacttcatcccctgatatgttcatgatggagttaggacaagctaaaataagccttggtaaaactataagtgatctcggggtgatacagtcttctgttgaagctttaaataagaagatgaagaaggagaagctttttgttgagaggacgcgcgagaagctagcatcaaagtttgcaactgtatctactcaagaagtggccaagaaagaaacaaggttaaatccacctgaagctactgtaggaacaggttgcacttgtcatcatcccctaaatattgcgaggagtttgaaatttgatactggacagtgcaatctaatgagtgaaacaagaagctctgaagtttcaaggccattgcctgagtttggagaaaatggatttagtatcaagactgctgagatgaggtggtttgccgctaagaagatggaggaagctgcaatggcagcagaagctgttgctctggccgaaattgaggctctatgtaaccctgagatatcattggaatttgctcctccacaacatcagaaagtgccatttgccttaggggagcgctctcctctgcaccccatagttcaaattcctcaagagtcaaccttggagaaggtgattgattccaagttccaagttgataaaataagttcttctaaactgagtattttgaaaaaattggaggaagcaacagaagaagttacacgcagcaaacaaatcttaaatgaggcattaaacagtgttgaaagtgcaaacagaaagcaacatgctgctgaagaggcacttcggagatggattcctcaggatgatctaagaggtcagccagtgtacaactatattaagcccaagaagttcaatcaagctggaaattgtcaagattctcctctaccagatgtaaccaggtcgattacagtgaacaatgatcagaagccgatcttaaagtcttcagtttcaatgagagatgtacttagcaaaaagcaagttcctgaagaatatacaactaaggagatggaagagcacactgaaagaaaggtagcattgagtcaaatgcttcgagcattgaggcaggatcaaactctgcctacaataccagagaaagatgggagcaatcaaaggcagttcatagcacagaggaaaaagtttggattcatccaaatatcactccccttgggaaagcgaagaaaaaggcatgaatttaatcctattgcctatgcatggatcaatatccagaattcatgcatcagtgtcttgccattctttattgattcttatgttttgctgcttttttgttaa

SEQ ID NO: 90205 - DNA, 264 bp, Glycine max
  Peptide Sequence Number=SeqID_206983
atggtatttccaaggctgttaaaagatggtaatcgcaagggtggtgggaaagtcactgaatgtggtgttgtcgctagtgcttcaggtcgtggcgctgatgtagacgcgtccagacccctacacacacagctacattcacagataggtgcagggagcggtggaagccagctgggatgcactgtcggtggtcacgccttgggtcgcgctgtcagagtaggcgctactggtcgcgctggcgtggcaggcgcgtccaggcctatataa

SEQ ID NO: 90206 - DNA, 576 bp, Glycine max
  Peptide Sequence Number=SeqID_206984
atgaatctgatgcttgatggcagcgttgctgagcaggatggtgtcattgtcgtaagggattttgcggcaatggccgtgacgagaagtgtcagtggagccatgggtacgactattttgagttcgggatggtgggaaacagccaagggaggcggagctgacgtaggtgctattgttggtggtggtttgggaggagatggagatggagtgggtgctgttaaggtctccacaggtggtggtgcgtctgttggggatgagttgggaggaaagggaatgggtatgagagcaaaaggtcgatcaaggatgatgtcaagcttggcagtcatctctagagtctgggtggtcatggaggagaggttcaaggtgaggtggtatacagcctcttcaagacggtctagggtggcctggtggctgtatggacctaacaacctctatatggttgtaactaactactatggtagtgctcttcctaaactgaaccaacgtggtgctcctcttagcctcttcctgcatcttcttcttaagagaacagcacaagaacaacttgaaaatggacaacagaaaagtcagaatcattaa

SEQ ID NO: 90207 - DNA, 1341 bp, Glycine max
  Peptide Sequence Number=SeqID_206985
atgatgaatcacgattccaacaacgaacaacatcagattctccatgtctcgcaggacgacgagataatggaatcgctaatcctcgatgacgacagctcttccgttcagcagcaccaccgtcctacgtcgccgcagagccctaattcccctttcaactcgttcctcgaccctccctcctacgccgacgcgatcttcacctccttcgattccaacggtcacgaccaagccatcgaatcccccgccgcccgatccggctccgaagactacctccacatctccgtcaccgatcctcagaaggagcaggacatcgccacctccctcgtccccggcgccgccgccttctacacctacctcatcaccacgcgcactaacctccccgaatatggcggcatcggtgctgagttcgccgtccggcggcggttccgcgacgtggtgacactctccgaccggctctcggaggcataccgcgggttcttcatcccggtgcggccggacaagagcacggtggagagccaggtgatgcagaagcaggagtttgtggagcagcggcgcgtggcgttggagaagtacctcaggaagctggcggcgcacccggtgatcgggcggagcgaggagctcaggttgtttctcgaggccaaggggcggctgccgctggccaagaccttcgatgtcgcgtcgcgaatgctcgatggcgccgtgaggttgccaaggcagctgttcgggggagaggcggagctgggagaggtggctcagccggccaagggcgggagggacttgctcaggattttcaaggagttgaagcagtctgttgccaatgactgggttgggagcaagccacttgttgtggaggaggataaggagttcatggagaggaaggataagttggtggattttgagcaccatcttagcaatgtttctcagcaggctgaatcccttgtcaagtttcagcaagacatgggtgaaacggttggtgaattaggtctggcttttgtaaagcttaccaaatttgagacggaagaagccatatttgagtctcagagagttcgagctgctgacatgagaaatgtggcaactgcagctgataaactacatgaataccttgggacaatgctagctgttaacaatgcattttctgacagatcgagtgcattgttgactgttcaaacactctcatcagaactagcttctttacattcacgggtggaaaaacttgaagttgcttcatccaaaatatttggtggagacaagtctaggatgcggaaaattgaagagttaaaagaagccattagagttactgagaatgctaaaatttgtgcagatagagagtatgaacgaatcaag

SEQ ID NO: 90208 - DNA, 177 bp, Glycine max
  Peptide Sequence Number=SeqID_206986
atgaataccaagcccgttttcttcttgtgcttcctctgcgcactgcttctcatctctgttgtggcaactgagccatccaaagatgagacacaagcagaagaaccaaagacacagctagatgcctggggaagaggtggaagtggggggcctgatggaagctggggtgggatcctctag

SEQ ID NO: 90209 - DNA, 156 bp, Glycine max
  Peptide Sequence Number=SeqID_206987
atgaggagagaagagagacaatatgtatgtggagattggcccgaggcccaggcaggggaggcgcctgcaggaactcccgacgatgcagaggaggcccgcatggatgagcagatgacggacttactcggtttcatgggagggagcagagccacgtga

SEQ ID NO: 90210 - DNA, 954 bp, Glycine max
  Peptide Sequence Number=SeqID_206988
atggctgccaagaagtacttcgtcacagtcttcaaaccggaggaacactccgaaagcatgcttatcccagatgcttttgtgaaatctacacgcttacaaggatggaggatccctgaggatgtcatcctcacaaatgttggtaggagagtttggaatgtgaaaacacgtcttgttggaaacaaaatttactttgaagagggttggaaggtttttcaagaagaaaactttttaggaaaagaagattatcttgtttttaagtatgatggggccaacattttcaaggttgtaattcttgaacaatcatcacggtgtgaaaggacagaagctgaagaagaggatgaggtgatagagattacagatgatgaagaacatgaagaagctgaggatgatgaggatgaaggtgatgatgatgatcagtatagagaaatggaagaagaacatagtgctgaatacatgaggagtcaaagtcatcctcgtagagcttccaaaaggttgagtgcaacaagttacagtcctacggttgaaggtcctcatcttgaagactatgaatttgatccgcaaatgtatattcagcctggaaatccaaattttgaagcaaagctcttcaaaaatagacccaacgaattgcatgttccaaaaaatgtgattaaggactcgtcccttacttttggagaacagattaccctttcacgttgccaatgcttccaattcgaggatactcaaagagatgaattacgagactatcatggcttgccacaatggacacccatatattcggaagtagcaaaagtgtctgagtggcgtgatggtcgagtatgtatcaaagggtggacaagtttttgtaaaaagaacaagataaataaaaatgatgcatgcatctgtgaaattatatcaggagaagatcgaataataagaacaattcaggtgcatgtgcttggtgctagaaacggatga

SEQ ID NO: 90211 - DNA, 2394 bp, Glycine max
  Peptide Sequence Number=SeqID_206989
atggtaccagtggcgagtgaagagcgttgggatggggtggttgtgacgcaatcaaacttcctagcacttcaagcgttcaagcaagagctggttgatcccaaaggcttcttgagaagctggaacgacagtggctatggagcttgttctggagcttgggttggcatcaagtgtgctcagggacaggtcattgtgatccagcttccatggaaggggttgaagggtcacataactgagaggattggccaacttagggggcttagaaagcttagccttcatgataaccaaattggtggttcaatcccttcagcacttggacttcttctcaatctaagaggggttcagctcttcaacaataggttcacagggaccatccctccttcgttagggtcatgtcctttgcttcagtctttggacctcagcaataatttgctcactgggacaatccccatgagccttgggaatgccactaagctttattggcttaacttgagctttaactccttgtctggcccaatgccaactagcttaacttctctcacctacctatctcttcaacacaataacctctcgggctctattcctaactcatggggtggtagcttgaaaaataacttctttcggcttcgaaatctgatcatagatcataacttgttgagtggaagcattcctgcttctttgggtggcttgagtgaactcacagagatttctcttagtcataaccagtttagtggagctatcccaaatgaaataggaaacctttctagacttaaaactctggatttttctaacaatgccttgaatggaagcttgccggccgctctctctaatgtttcctcactcactctcttgaatgtagagaacaaccaccttggcaatcaaatcccagaagccttaggcagattgcataatctttctgttctagttctgagcagaaaccaatttagtggccacattcctcaaaatattggaaacatttcaaagcttaggcagcttgatttgtcactgaataatcttagtggagaaattccagtcgcctttgataatctgcgtagtcttagtttcttcaacgtttctcataacaacctctctggtccagttcccaccctacttgctcaaaaatttaactcgagctcatttgtggggaatattcaactatgtggctatagcccttcaaccacatgtccctccctagctccttctggttcacctcctgaaatatcagaacaccatcatcataagaaattaggcaccaaagacataattctcatagtagcaggagtgctccttgtagtcctggtaacaatttgctgcattctgctattctgcttgataaaaaaaagagcaacatcaaatgctgagggtggccaggccacggggagagcatctgcagcagctgctggcaggacagaaaaaggagtccctcctgtcgcaggcgaagccgaagcgggtggcgaggtcggaggcaaactagtccattttgatggaccattgacctttacagctgatgatctcttgtgtgcaacagcagagataatgggaaagagtacatatggaactgtgtataaggctacattagaggatggaagtcaagctgcagtgaaacgattgagggaaaagatcactaaaggtcaaagagaatttgaatctgaagttagtattataggaagaattagacacccgaatcttttggcattaagagcctattacttgggacccaaaggagaaaagcttctagtatttgattacatgcctaatggaagtcttgcttctttcctacattctcgtgggccagaaacagccattgattggccaacaaggatgaaaatagcacagggaatggctcatggcttgttataccttcattccagggagaacattatacatggaaaccttacgtccagcaatgtgctgctggatgagaatgtgaatgctaaaatagccgattttggtctttctcggttgatgacaactgctgctaattctaacgtcattgccactgctggagcattgggataccgagcacctgagctctcgaagctgaaaaaagccaacacaaaaacagatgtatacagtcttggtgtcatcttgttagaactcctaacggggaagccacctggtgaggctatgaatggagtggatttacctcagtgggttgcctccattgtcaaagaggagtggacaaatgaggtttttgatgtagagttgatgagagatgcttcaacatacggcgacgagatgctgaacacgttgaagcttgctttgcactgtgttgatccttctccatcagcacgaccagaagttcagcaagtccttcagcagcttgaagagattagaccagagatatcagcagccagttcgggtgacgatggagccatcccttcgactagtgaatga

SEQ ID NO: 90212 - DNA, 252 bp, Glycine max
  Peptide Sequence Number=SeqID_206990
atgtctaaaataaggaatgttagtgaaaataataggagtgaacttgaaagaattgaccaagagaggaatagcgacttcctaagcatgctgcgagggtttgttgtcaatcaagtaaagctcatttatcttctatgttttaacagtaactattctacttcatccattttacaggcaggctatgcagagaagacggcttctgtgtgggagaagcttgcggaagaaacggctgcttactcgagtgacagcagctaa

SEQ ID NO: 90213 - DNA, 330 bp, Glycine max
  Peptide Sequence Number=SeqID_206991
atgaggaagaacacgaagcaactgaggacgaggaaaaggatgagaatgagaattaggatgatgatgatgacgacaataatcatgagtataaagaaatggaagaagaaagttaagaagaaaatagtgctgaatacacgaggagtcaaactcatcatcgtagagcctgcaaaagggagaatgcaacaagttccacttccacccatgattggaggtcttcttcatgaagattatgaatttgatcacaaatgtatatttagtcttcaagactacaaccttcaatcatgggtgaaagtggaacttgttgcattctctcctaagccagataaataa

SEQ ID NO: 90214 - DNA, 403 bp, Glycine max
  Peptide Sequence Number=SeqID_206992
atgggagtagaggaatttttagattggcagattgatgttgacagatttttcgacgtcatggacgtccctgagcacaagcaggttaagatggtggcaatcaggctgaaaagtaccgccgctgtctggtgggacagactcgtcgttcagaggacgaggcagagaaagaatcccattcgaacttggcggaagatgaaacaattgatgcttgagagatttttacctgaagattatgaacaaattctgtataaaatgtatattgaatgtgttcaaggcaagcgatcagtgacagagtataccgctgaatttctgcgtttttctgaacgtaatgaattgggtgaatcagaaaatcagaaagtggctcgttatatcagtggattgaaaggatccttgcaggagaagatgg

SEQ ID NO: 90215 - DNA, 744 bp, Glycine max
  Peptide Sequence Number=SeqID_206993
atggaagtgatttccgcttcgagcttgaatcccaacgctccgatgttcgtgcctctcgcctatcggacggtggaggatttctccgaccaatggtgggacctcgtccactcctccccctggttccgcgactactggctccgcgagtgcttccaagatccccagtaccaatacgacgacgttttcgacttcgactttgacctagatctccaagataaagatgaaaatgaagggaaggaagggaaagaggtggtgtcgttgggggtgctcaaatggcgaagctgtggaggaggatgggccgaagcgccgaggtatgtggaaaaggcccctaagtttgtgaagcccaagaagcttcaacaacggtggcacgcctccttcttcgatgatgagtttcccgtaacggtcgttgtcgcgagcaagggagacgagggaagcggctgcgtcggaacgttcgtccaaggaagcaccggggagaagaatggcgacctgttcccagatgaggcagagaatgggctcgttggcggcgatgggagggaggcccaggtactcgtcgtagcgctcgtcggcggaggcacgtgggacgctcgtagaggtcgttgctgttcctggcggcctggcggaggaggcccgccaacttctcagttttggatttcagctccagacattcctgtcggaaattctgggcctcttccgcaagcttcgaaacctggtccgccatttgtatcgggctcgccaggacctccttga

SEQ ID NO: 90216 - DNA, 276 bp, Glycine max
  Peptide Sequence Number=SeqID_206994
atgactgaagttgaagcaggaagattagttggtgtgcgaggaatccatgaaggggtacaagcaggcagagagcttgtcccaaccacattaggcataacattagtaagaggttatcaaacaatagatccagatctctgcctgcctgatgttcgtagcttcattgagcaacaaattactcttattgccaagggtcaggtggatcatggtcatgtggtgcagcatgtaatccaacagttcacacagaagtttagttactttgtcaaaaaggttggctaa

SEQ ID NO: 90217 - DNA, 1743 bp, Glycine max
  Peptide Sequence Number=SeqID_206995
gagcagagttttgccttgattaaagaaaagttgtgtaccgcacctgtcttagctcttcctgattttgataaagtgttccaagttgagtgcgatgctagcggaattggaataggggctgtgttgtctcaggagaagaaaccaattgctttctttagtgaaaagttgagtgaagctcgtcgaaaatggagtacttatgatcaagaattttatgctgtttttagagctcttcgccagtgggagcactacttgattcatagagaattcattttattcactgatcaccaggctctgaaatttctccatagtcagaaactgatcaacaagatgcatgctcggtgggttagttttctgcaaaagttcccttttatcattcaacataaatctggagcccttaacaaagtagctgatgctttgagtaggagggattcgttgcttgtcactttagcacaggaggtagtaggttttgaatgtctgaaggagttgtatgagaatgatgctgagttccaagaattatgggctaaatgccgtgagcatccttgtgacgattttcatgttcgtgaagggtttctttttaagggaaaccgactgtgcattccatgttcgtccttgagggagaaattaattagggatctacatggtggtggtctgagtgggcatatggggagggataaaaccattgctagtctggaagaaaggttttattggccacacctgcgaaaagatgctggaaccatagtcaagaagtgctatacttgccaagtttctaaaggccagtcacaaaatactggtctttacatgcctctacccattcctgatgacatttggcaggatttagctatggattttgtgttgggtctacctcgtacccagcgaggcgtggattccgtgtttgtggttgtagaccgattctccaagatgtcccattttattgcttgtaagaagacagctgatgcatccaacatagccaaactgtttttcagggaggttgtgcgtcttcacggagttccaaaatccattacttcagacagggacaccaaattcctcagccatttctggatcaccttatggaagttatttgatacatcactgaacaggagttctacagctcatccccaaactgatggacaaactgaggtcacaaacagaactctgggaaatatgattcgatgtgtttgtggtgacaaaccgaagcagtgggatttggctttgcctcaagttgagtttgcttataacagcactatgcattctgctactggaaaaacacctttctcacttgtttacacctctgttcctaggcacgtggttgatttgattaagctgcctaaggctcctggatttagtgtggctgctgaaaatatggctgaagagattatagctgtgaaagattctgtcaagtccaaattggaagctactggattgaaaaacaaaattgcggcagataaacgccgaagagtcaaagtgttcaatgtgggagatgaagtgatggtgtttctgcgaaaagaaagatttccagttggtacctacagcaagctgcagcctcgcaaatatggcccgttccaagtgactcgcaagatcaatgacaatgcttatgtcgtggcccttccagcatcaatgaacatttctaacactttcaatgtggcagatatatatgagtaccatgcagatgaagtcctttatcgagatgagaactcggggtcgagttcttttgaggtggaggagactgatgtaggggggtttatttag

SEQ ID NO: 90218 - DNA, 801 bp, Glycine max
  Peptide Sequence Number=SeqID_206996
atgtcaacatggtctctgaaaattggcgtagttgggtttggttccttcgggcaatttctggcaaagactatgatcaaacaaggccacactctaagggcaacttctcgtactgactactccctcttatgcctcccaatgggtatccaattcttcagggatgttgctgcattccttgaggctgacaacgatgtcatactcgtatgtacgtccatcctatctctctccgaggttctcagctctatgccactcacttgtctcaaaagatcaacactctttgttgatgtcctttcagttaaagagcacccaagaaatcttctaattaaggtattgccagaggagtcagacatactgtgcacacacccaatgtttggaccagatagtgggaaggatgggtggcaagatctaacattcgtatatgataaagttcgaatccgagatgaagctatctgctctagcttcctccacatttttgcaagtgagggctgcaggatgctacaaatgtcttgtgaggaacatgataaaatagctgccaagagtcaatttattacacacactataggcaggacattggcagaaatggatatcaagtccacacctattgatacaaaaggctttcattcacttgttcaattgaaggacaccaccatcagagatagttttgacttgtacagtggattattcttacataataggtttgctgtacaagagttggagaatcttgaacatgccttgcacaaagtcaaagaaatgctggttcaaaggaagagtgaggagctgggtctagaaaaaactgaatgttga

SEQ ID NO: 90219 - DNA, 234 bp, Glycine max
  Peptide Sequence Number=SeqID_206997
atgtttctcagcaggtatagaaagttagttgatgcttggaaagaggcaaaaccccctcctaagacacctgacgaagctgctagacttgtcattcagaccttgaaaaggcatcaaaaggcagatgttgagggatttatggtcttcctctaccacacacccttgttcaaaggaactgcccaacccccttcatccttccctaatggagttcaattgaaatgcacacattgcccgtaa

SEQ ID NO: 90220 - DNA, 1089 bp, Glycine max
  misc_feature (397)..(397): n is a, c, g, or t
  Peptide Sequence Number=SeqID_206998
atgaagttactcgggtggatgcatagaaaatttcgccagaatagcgctgaagtaccgttcaaagacttgatcatcggaggagggaattcttgcgatgaggagcacaacaactacccgaaagcaagctttgggaattacaaacatgtgaaacaacaaagtcatctgcagaaagaggtaagaaaatctttggatcatgatgagtatgaggaagattcagcgggagctatgtatgagctgttccatgggttcctagcaattggaactcttggttcggaggcatcaacgacgccaacatttgccatctctgtggagaacataacagaaaaggaagatgaagtgaccgagaatgaactgaagctgataaacgatgagctagagaaagttctggttctgggancggatcatgatgagtcatcatcaatatcatgtgggagaagcagtcatggaagcataataactctgagcggcggcggggggaagccagcagcagctacgttgttggaagatcaatcaaatggaaatgcagtttgtccccttcagggttatctgtttggatcagcgattgaattgtcagaaacaacaacaacagtggcaaagaaggagcacaggacatcactaggggagctgttccagagaaccaaactggcagatcaggagaacaacaactttggaccaccaaaggatcaagcagataaatctgccatgcatctcatgaagaaaaagctcaagaaaaaaatgcgaagctccacatccacaactgttgattctgcttcagcagcagacagaaaactgcataagattctccatatgtttcacaggaaagttcaccctgaaaattcaacaggtgcacaaaagtgtgataaataccaaaagaagaaaacaatgaatgagggagagggagagggagaggaggatatattaatgatgcagcccaaaagagcagtactgtcaacggaaaattacatgcgacagtataagatccaacccaatccactccttggcagctgtgaagaagattcatctgagaataaggagcactggatcaaaacagatgccgattgtaagtacacaatcatatcccctttgtaa

SEQ ID NO: 90221 - DNA, 162 bp, Glycine max
  Peptide Sequence Number=SeqID_206999
atgtgtttgaaagtggcttgtgatattcccatccatcacaaggtacacatcagctgccaggaaggatttcaaataccaaaaaaaaggacattgaaagatgatgtggtgcttgacaaatggtgccgttactgtgcccaaaggacaggagaagtgaagatctga

SEQ ID NO: 90222 - DNA, 1098 bp, Glycine max
  Peptide Sequence Number=SeqID_207000
atgggatcgtgcctctcggtgtcgggggcatcggcctccgtagatgcttttgatgaatcatcttccaattccagttccagaactgcctctgattataacatggaaatgcggctccacagagttcctggcagattattcttgaactgttcgtcccaggttgcttccttgttctgtaagcaaggtcgcaaagggatcaaccaggatgccatgcttctctgggataatttctcttcaaacaaggacaccgttttctgtggtgtttttgatggccatggacctcatggccatatggttgcaaagaagctcagggattccttccctctcaagcttattgctcaatggaatttgcttcatcctaacaacaacagcagcagcaacaacaacagcgatacaccttgtgcggttgccccgggtaacattggtacgctcagagactcctttgtgaaggcttgcaaggtgatggacagagagctgaaagtgcagcatcagatagattgctcgtgtagcgggagcacgggtttgacgttgctgaagcagggtcaggaccttgttattgcgaatgtgggtgactccagagcagtattggccacccaagatcgtagcaatggttctcttgttgctgtccagttgagcactgaccacaagccacatctcccaagggaagcagagaggataaggatttgtaaaggaagggtcttttccattaagaacgaatcagggattcctcgagtatggctccccaacattgattcccctggccttgccatgtcacgtgcttttggagatttttgtctcaaggactttggagtcatctctgttcctgatttctcatatcaccgcctcactcaaagggatcagtttgttgtcttagccacagatggggtatgggatgttttatccaacgaagaagctgtggccattatctcttctgctcctcgctcttcagcggctcgaatgttggttgaggcggctattcatgcatggaaaaccaagcttccccttacaaaggttgatgattgctctgtcgtttgcctcttctttcattcagactcagactcagactcacttagactcgaacctcaacaaaaccaccaatag

SEQ ID NO: 90223 - DNA, 1209 bp, Glycine max
  Peptide Sequence Number=SeqID_207001
atggtggttaagatgattttggaagatgcctatgcaattttaattttcagtgatcagaatcatagactaactgtttacagtgatcagggagtgtctgcttcttttcgagttccttctggggcagttttaccatttggatccatggaattggagctagagaagagcaattcgactgaagcattcaggtctatcctggaaaagatagaaacagccaaacaggagggtggtgaacttgatgttctatgccatcaactccaggaattaatttcttccctgaagccatcaaatgacttcattgaaagcattgggagaatattcccaagcaatgcacgtttaattgttcgatccagtgccaatgttgaggacttagctggaatatcagcggctggactttatgaatcaatacccaatgctagtccttccaatccaacagtttttggaaatgcagttagccaagtatgggcttcaatgtacactcggagagcggttttgagccgccgtgctactggtgttcctcagaaggaagcttcaatggcagttctgatccaagaaatgctttcaccggatttatcatttgtactacatactgtgagcccaacaaaccaggataataattgtgtggaggctgaaattgcttctggccttggtgaaactctagcttctggaacccggggtacaccatggcagatatcatctgggaaatttgacgggcaagtgaaaacattggcttttgcaaacttcagtgaggaattgctggtacgaggtgaagggcctgcagatggggaagttatccgattgactgttgattacagcaagaaaccactgacagttgactcagttttccgtcgacaacttggtcaacgtctttgtgcagttgggtttttcctggagagaaagtttggttgcccacaggatgtggaaggatgtcttgttggaaaagacatctttatctacacatttaatacaggaagcacatacttctgtattgcaccagagctatgttctcctgatggaaatggaatgaagttcgacttcgacaaattgttggatatgaaatcagccgttacggttgacctgtctacgattgtatcttgtgtaaagcttaaaggagtactcaaaccgggtgtatttatccccaaggcctacactccgaagagtccgtcagggtctctccctcctgattcaggtccaacccaaaaaatattttag

SEQ ID NO: 90224 - DNA, 180 bp, Glycine max
  Peptide Sequence Number=SeqID_207002
atggtttttgctgttgcatttagtggtagttcctctcgccctcaattggttgctcttattgcgcaggaagaagttatccaatcaggtggtcagattgagccgcctggaatgcacatgatttatcttccatattctgatgacatcagatttgttgaagaggtagagaactgcaatatttga

SEQ ID NO: 90225 - DNA, 1488 bp, Glycine max
  Peptide Sequence Number=SeqID_207003
atggatttggacggtgatgataatgataatgacatcttcagagacgacgaagatgatcctcaagctcaactctctctcctcgaaaacgagtcgagcaaagaatatgtggtttaccttgtcgatgcttcacctaaaatgttcagcactacttgccctgcggaagaagacgaccaaaatggtgaaactcacttccacattgccatctcttgtatctctcaaactctcgagtctcagatcattaacagatcctacgaccaagttgccatatgcttcttcaacactagggagaagaacaatttacaagacttaaacagtgtttttgtatttaatgttcctgaaagagagtttctggacaggccaacagcaaggctcataaaagaattttatcagctggaggaatcattttcaaaaatcattggaagtcagcatggcattgtgtctgggactcgagaaaattctctctacaatgctatctgggcggctcaggcacttcttcgtaaagggtcagcaaagacagttgacaaacgtatacttttgttcacaaatgatgatgatccttttgggagtatcaaaggggcagtaaaatcagatatgacaagaatgacactgcagagagctaaagatgcacaggatcttggcatttctattgaacttcttcccttgagtcaccctgatgaggtgttcaatgtatctcaattctatgctgatttgattgggttggaaggagatgatcttgtagactttatgccatcagcaggaaagaaacactctaagagtagaataaaaggccctggatggaaccaatgcaacagcagggttggtacagttcctaggcattgtggttttgttttcagaaaagaagcagatgacaaggagaatgcagagggtgaaggagcagaaaaacagaaggaggatataaaaccggagttagtggtgatgcaatatgacctcttgaataggctttactcagccaaatactctgaaattgcgagtagtggcaaattggatcgtagtagtgatgtgtcaaagattttttcacctatttcctttggtcggtgtggacatcatattgggaattttgtggctggagaagttgggatatatgaagacaggaacaaggtatctcccaatgccttactaagggaacaacaacaagaaagttttatcctaccagttgaggtcggctacatggatctccctacgacattcggcacggttaaaaaccaaagattggaggatatgaaagatcagttaagaaagcgcatgtttaccaagcgcatagtcaaaagacttaagttcatgatagttaatgggatatcaatagaactgaattcttatgctttaattcgtcccaccgtcccaggagctatcacatggcttgattctgttactaatcatcctttgaagattgaaagaactttcatttgtgttgatactggtgcattggtggaagaacctactaaacggtttcttccttataaaaagtaa

SEQ ID NO: 90226 - DNA, 909 bp, Glycine max
  Peptide Sequence Number=SeqID_207004
atggctccggcgatgaggatcgttttcggccttctcacatttgtcaccgtcggaatgattataggcgctctctctcaattggctatcatacgaagattggaagactctcatggcactgattctttgccatttagtagattgcgtggactcgacactgatcgtcaccttcaactgccaagaggtattcctttttggaataatgacaaggaagcagaagtcttacgccttggatatgtcaaacctgaagtgcttaactggtctccacgaattattttactccacaacttcctgagcatggaggaatgcgattatctcagggctattgctctccctcgcctgcatatttcaaatgttgtggatacaaaaactggaaagggaatcaagagtgatgtcaggactagctctggtatgtttttgaatcctcaagagagaaaatatcctatggtacaagcaattgaaaaaagaatttctgtctattcccaaataccaattgaaaatggagagcttatgcaagtcctgagacagttcaacttgaagcgtggtgggcagcgaatagccacaatgcttatgtatttaagtgacaatattgaaggaggagaaacatatttcccattgtttgcttattatggacattatccacggacacctaatgattataaggagaaacatttgaccccacacacatacaagcacccggctttagctgatttagcaatagggcagccctactattcttgtgatagaaaatgtcaatgctcaagagtattaaatcatggagagtctgtaattgtttgtgctatggattttttagctggatggaaaatttacgatggaaaattatctacttgtcttgtcagggactggatggacagtcagatccgaatagtgtgcatggaggatgtgaggtga

SEQ ID NO: 90227 - DNA, 186 bp, Glycine max
  Peptide Sequence Number=SeqID_207005
atgaaagtattgaacgagtttacagctaccatgcagcaaccaagttacatcatacaagatatacatggaccaagtattcaagttgaagaaccagtttgcgggcagaatggactagctggcttcttgcatgccatagtcttattcatgaaactttcaaaccagaaactggttatgctcttcaattga

SEQ ID NO: 90228 - DNA, 1797 bp, Glycine max
  Peptide Sequence Number=SeqID_207006
atggcgtcgtccccttctttggcggtggccgtcgtcgtccttctattattggcgttgttcgcagcagcggccgccgatgacgcctcctgccatcatgacctgcaattggtgaagataaagagctggatcgatgggaagaaagatgttgactataacggtatgactgctagattcagctcttatttgcctgaagatgccgatcaagcttccaaaactcctgctcttttttctgatcctattgactgctgttcctcttcaacttcaaagttatccggatcagttgctctctgtgtacggggtacttgtgacttcacaactaaagctacatttgcacagtccgcaggtgccactgccaccttgatgataaacaacgccgatgaactctttgagatggagtgctccaattacaccaggataaatatttcaattccagttgtggagataactaagtcaacaggagacactctcaacaaacttttgacgtctaaaagtaaagattatgtttccaccaagaaggatatccaatttttgagtaacagcaactgtcggagtgacaatcaacattgcaaatggaataatgatattgaggctccgatttggcacctcgagatggatttgattgccgaacagtcatggccgattgatctaagggagaggatcgagaatctgataatgaacgttggcgttcttcctagaatggaattcgcaatggctgggattgtggaatggacaatccttgattggaccatactgttgcagcggacccaaaagagaaatttagagtaccaggttcaggtcataatgattaatgactgctcgactccaagtggggtaattgtcaccattaaggagttgtgtgacaagtgcttgaccaggctgatcagaggaatgaggtactatgtagaggaaagatcaggttcatgtggagaaggtctaggaacgagagtgttgggattgcttgatcatgtcggagagcttctaatggggtcagatgaggccagtgaatattatcctcaatcctccattatatctggtaaaattgcttattggtttggtacggtaacctctcacagaactcatggttgtctcagttgtgctaccgaaggctctagggaagtcggaataggagagtattcatcttgggtggagattttgttatatgctccaactcgcccagttgtagactactcagttgcatttttgtggttgatggctgttggaacagttatatgtgcttcactatggtcagatataactgctcctgatcaaactgatgaacgctataatgaattgtctcccaagagcttgtctgaagcagggaaagatgattctgaggacttggttaacatagatacaaagggtgctatcgtcttcgtcattacggcatctacttttcttgtgctactgttcttcttcatgtcgtcttggtttatctgggtgctgattatacttttctgcattggtggtattgaggttgctcgtggtgacaaggccggtggtgaagcaattcctatgcttttgagatttcctcgtctttctgatccttggggtggctatgatatgattggatttggagatattctctttcctggtttgcttgtttcctttgctcgtaggcctcttcttcacatatctggggctatatatgatgaacggtcatggacaacctgcactgctgtacctggttccatgtacactagtacctttggagctatgatgcagactcctcctcctcgtcttagtccaaagagccttctcaagtttagatggcaactgagaaatggaaatgttctctga

SEQ ID NO: 90229 - DNA, 1287 bp, Glycine max
  Peptide Sequence Number=SeqID_207007
atgtataagaaatggctctgcttgagtcgatgttccgctgtcctcatcgtgcttcaatttctctctgctgcttaccttgtcctcacctcttcccaccatttctccacctctcattctaatcaccactgtcttttagaatccaaatggaaccacacgcccgtatctatattcatcatcctcgtctcttccgttgccgttctccagtgcttcaccggatcagatattatcaaatggaggtctttctatgaaactcatgatcacgcttggaaatgccactacagcgaggtcttcgatcatggcattcgtgagaccttgtgttgtctaggccgcctccaatacttgactacctccgaagaagatgaagtctattcagttgcacgattattagctgatcttgttgcttatcgcgcctccggaaccggccatatggaactcttggcagctttagctttacttcaaagccatggaaactctaccgaatcctatgaagaatccatggaagcaccagagatgaaaattagggaggctgaagctcttcataaatttgctgaagctgcgtacacgggtccattgcttgatgttggacgaaatccatttgtatttccttgtgcatggctgtatagacaagggattttgtctccttggacacgaaacagatatgctacatgcttggagggctctactgtctctggtttgattgatcctccactttttcctttccataaatctatgcacaatatgatttatgttcctatttcacatcttcttagacgacctgtactggatggtgataactggtggcgaggtcatgctgcagcctttctaaagtacgtcaatttgcctccagaagcgcttagacatgggcgagtcagccaggtcaagtgtgaagctgcatattttattgtggttctacatcaacttcaatctgtggtaattgctatacgtggaactgaaaccccagaggacctaataactgatgggttatgcaaggaatgcaccctgtctgtggatgacctggctggtttgataaattgcaactacattcattctaatataaagaaaaatgtgacttcatcattcccccactatgggcattcaggcatagttgaggctgcacgagagctttttatgcagattgaaggaaatcctgaagggcctgactcggaatcctatggacttctttctaaattactgggatttggttgtgaatgctttgggtataatgtccgcatagttgggcattcacttgggggtgctatagctgcattgcttggactgcaagtatga

SEQ ID NO: 90230 - DNA, 402 bp, Glycine max
  Peptide Sequence Number=SeqID_207008
atgtcaaccgtggacaagctattgcacattcctgaagattctgtcccttgtaaaatccgtgctaagcgaggttgtgctactcatccccgtagcattgccgagcgggagagaagaacaaggatcagtggcaagctcaagaaattacaggaccttgtacccaatatggataagcaaacaagctatgcagacatgctcgatttggccgttcaacacattaaaggtcttcaaactcaggttcaggtgaaaatgctggaaaagagagcatcaaaattggaggaggaggtttgtgagatgatcaacagagcagagaaagaaccattaagcttattggaattgatcgacaatgtccagcgtctgggattgacgtacaagtttgagaaagacataatcaaagccctttag

SEQ ID NO: 90231 - DNA, 447 bp, Glycine max
  Peptide Sequence Number=SeqID_207009
atgtcaggatcattggtgttggttttggagcgcttggttgaagttgcagaaaaggcgatggaattgttgtcccagggatccattccgaaggtggtgctggagggatcaacattaacagtgttggaaagagattcgtggaaaaaaggaaggaagaaaggtaccatggtgattggagagatgggaaaggaagccggcgggagagcttttctggcggagcaaggaggaagcgaaggagggggggtggttgtggaaagatctttgctctttgcagggagactcagaagactctccggaaaagtagggactgggacgggatccaccaataagagaatcaaccgtgctggtgagaagagaaccgggggcggaaccgtagcgagtgaggccagcttgggtcatggactgagaggaagaggaggaggaggaagaggaagagggatacatggatag

SEQ ID NO: 90232 - DNA, 1188 bp, Glycine max
  Peptide Sequence Number=SeqID_207010
atgaacgagttaacgccaaacacggaaagttatctctatctccatccaagcgaaaacccagctgtggcactcgtctctccagatttggattccaacaactaccattcgtggagcaggtccatgataacagcattgagcgccaaaaataaagtggaatttgtgaacggaaatgcaccagaaccattgaagactgatagaacgtatggagcatggagccgctacaataacatggtggtgtcctggatagttcattcggtatccatttcaattagacaaagtgttctatggatggacaaagcagaagaaatttggaaggatttgaagtctcggtacgcacaaggggatctcttgaggatctctgatcttcaacaagatgcttcatcgatgaagcaaggtactatttctattacggagtattttacgaagctacgcatcatatgggacgaaatcgagaatttcagacccgatcccatttgttcatgcactattaagtacacctgttcagtcctcaccaccatcgctcaacgaaagctagaagatcgagccatgcaattcttgcatggattaaatgaacaatatggcaacgtacgatcccatgtattacttatggatccaatgcccacaataccaaagattttcttgtatgtagctcaacaagagcgtcaattatcaagtaataattctttaccaaacttcaaccttgaagcgaaggaaagttcttctatcaatgttgtcaagattgtttgtgagttttgtagacgtgttggtcatactgaaagtgtttgttacaagaagcatggtgtaccttcaaactatgatggaaaaagcaaaggatacaatgagaggaacggaaagacgtgcatccattgcgggaaaatcgatcataccgtagatgtttgctataagaaacacgggtttcctccaggatacaagttcagcaatggaaaggcgatagcaaataacatcgtggcagtagaaggaaaagccaaagatgaccaaatacagcgccatgagtctcaagaattggttcgattctcacccgagcagtacaaagcgttgcttgctttaatacaacaaccaccttcaggaaactcagcacctacccaatctcaggttgcctccatttcctcctgttctcctaacaccacgtcaggataccaacacccaagcgaggattggtatagttga

SEQ ID NO: 90233 - DNA, 297 bp, Glycine max
  Peptide Sequence Number=SeqID_207011
atgttccctcaacctcaattcaataactgccacaatgaaatcaccaaagtggggatactactcgtaatcctagatgatgtatatgacatctatggtactttggatgaattggagctcttcacaaatgctgttgaaagatggaaagtgaattcagtaaacactcttccagaccgcttggtattgtgcttaatggccgtctataacactgttaatgccatggtttatgaaatctttaaaggacggggcataaaaatccttccttacctcacaaaagttgtatgtaatgcaacacaatga

SEQ ID NO: 90234 - DNA, 165 bp, Glycine max
  Peptide Sequence Number=SeqID_207012
atggtgtcaatgacaatgatgacagtgatagtgatagaacggtggtggggtgaaatagtggtaacgatgaatggtggtggtgaagacggacaacaagagattgtggtagtgatgacaatggtggtaacaatggcggtgatgatggtggtgacaatgacattgtag

SEQ ID NO: 90235 - DNA, 141 bp, Glycine max
  Peptide Sequence Number=SeqID_207013
atggggaacatgggtgttgcaaagaacccaatgaggaagaagagggcgtggtcaaaggaacattgcggcttcttcgtgtgggcaagaagatgtagcaaagggagtagccaatggggaatgatacataagaaaggacagtga

SEQ ID NO: 90236 - DNA, 369 bp, Glycine max
  Peptide Sequence Number=SeqID_207014
atgaagaaggccattggtcaaactgttagggaacttaaaagagaagtaaataagaaagtattgaaagttcctggaatagaacagaaggttcttgatgctaccaacaatgaagcgtggggtcctcatggatcacttcttgcggatattgcacaggcatccagaaattttcatgaataccaaatgatcatggcagtaatctggaagcggattaatgacacaggcaagaattggcggcatgtctacaagaacggtgcttatgtctatgcattaattgttcaacaacaggctttgacggtattagaatacttggtggctaatgggtcagagcgtgtcatagaggaaattagagagcacgcccaccaaatatcg

SEQ ID NO: 90237 - DNA, 761 bp, Glycine max
  Peptide Sequence Number=SeqID_207015
tcatctcccgcctctcccccaccacgcgccgccacctcctcttctccgtcgcctcctcctccacctcctggccccgccgcctcccctacatcaacctctggtactcccccgccaccacccgcgccctcgcattcctcgacaaaacaccacccaacgccacctcagccgacgattcctcgccgccgttggtgatctccggcgacacctcctctttcccctacacgttccgcggcgggctgcggtccgccatccgcgtggcgcgtgccgtgaaggaggccgtggatcgcaacgagacggacgtgcggtggttcgtgttcggcgacgacgacactgtgttcttcgtcgacaacgtggtgagggcgctcgcgaggtacgatcatagcaagtggttctacgtcgggagcaactccgagagctacgagcagaacgtgaagtactcgttcgagatggcgtttggaggtggtggcttcgcgatcagctactcgcttgctagggttttggcgagggttttggactcgtgtttgaggaggtatggccatttgtatggaagcgattcgaggatttattcttgcattgctgagcttggtgttgcgttaactcacgaacctggatttcatcaggaaatggggagtgagaaccaactgggtttattcccacatttagtcccccacaacatgccaaatcaagtgttaaaatgtgctgaagagttcatagatgtcccattgactattttattccttacttcttttgtggatatttga

SEQ ID NO: 90238 - DNA, 1425 bp, Glycine max
  Peptide Sequence Number=SeqID_207016
atgcagctttttcacaaacccaccaagggccagtctctggttaatttgatcttggtttcttcatcgttctgtgccctctacctcattgtatcagtgctgcttttggggccttcaaagctagttcatgtgaataggtcatcacaagatgtgtccacaccaaccaccattgatcaccttgtgtttggaattgcttcaagcacgagttcgtggggcaagaggaaggagtacgtgaagctgtggtggaacaacaccaataccaagaaagcaatgaaagggtgtgtgtttttggatagtctctcggatgaagacaatgctaggaatgcgaatgatacttctcttcctcctctctgtgtctctcaggacacttcacggtttcgtttcactcacaagggtggtctgcgctcagcaatacgcgtggcgcgtgttgttgcggagaccgtggcgctgtacaatgattcggacgtgaggtggtatgtgtttggagacgatgacacggttttcttcccggagaatgtgcagaagacgctttccaagtatgatcatgagctttggtactatattggtgcacactctgaggtttatgagcagaaccgggtgtttggttttggaatggcttttgggggtgcaggttttgctatcagctcctctctggctaaggtcttggccaaggtttttgattcgtgtattgaaaggtaccctcatctctatggaagtgatggcagggtgtactcttgcttggcagaacttggggtaggattaacacatgaacccggttttcaccaggtagatttaaagggaaatacctttggcctattggcgtcgcatcctttaactcctctgttgtcgctgcatcatcctgattacactgatccaatctttccaaacatgacaactaaacaagctctgaaccatttattagaagctgtaaatgtggattcccagaggatgctgcaacaagcaatatgctatgacaaatggttttcatggacagtttcagtgtcatggggatacgctgttcaggttttcccaaaccatatgcttttgccagatgttctgaaggtgcaagagacattcaagcagtggaggaagggaaacatgctggcaaaatcatatactttcaacacaagagaacttcaccctgacccttgtaaaagatccactgttttctttctagacaatgtgtcttctggcaaggatggcatcattagcagttacaagaaatcttttcagaattgctcaatcgatgacgtatcaccaaagaaactggaagtgatcaaagtggtcacaaataggctagaccttgacatcaaacagttgcatgctccaagaaggcattgttgtgatgttttgcactctactgcccgggacaaaatggaaattgcaataagggaatgcgaagatgaagaattggtttacatgcactga

SEQ ID NO: 90239 - DNA, 694 bp, Glycine max
  Peptide Sequence Number=SeqID_207017
atggaaatatgtggatttctcaatctggaggagatatgtaattgccctgcatggttcaccaggtttcgcagcaattcaactggtggaatgtataggcctggttcattttcaagcagtggatcttatggtgatagatatgaagatgatcgttatggaagcatggaggaagatagaagtggttatggctatggcagagaaaaagaatggggctatagagacgatgatcgttatggcagagatggttacagggacgatgagtaccgtagaagaagtgttgacgatgaccaatatggctcaagaagcaggagatcttttagagatcgtgatcataattttaatgatgatggtcagcattcatctcgaggtagcagtgctaaagctgaagaccattcactggaaggaaggttagagcggaaactttctgagcaaaatgtgagtgctcctcccagttatgaagaagctgtttctcaaagccctttacactatgaaagggatgggggaatttcagctgcttctgccccaaaaggctcttctcctgtaagtgataacccacgccaaacctctgctcctacaggatcttctcttttaagcgataatccaacagaagcaactgctgctgccagtactgctacatctggaaaccgtgaagttaaggcttttgatgaatttgatcctcgtggtcctcctgtatcag

SEQ ID NO: 90240 - DNA, 156 bp, Glycine max
  Peptide Sequence Number=SeqID_207018
atgagggttagggtttcggtttgtggatctattgttgcctctgcgatggatcgcaagaggggaaggcctgaagctgccttcaatttcaatggcggcgccaagaaatcgaggcctggtttgtctttactcttcactccttttctttctacttactag

SEQ ID NO: 90241 - DNA, 1557 bp, Glycine max
  Peptide Sequence Number=SeqID_207019
atgcctgttgagaaaatatcagggcatttcactagtgaagctcgtaattgcacttttcacttatatgcctgtgtaccaactgagaaatataatatgtggaccactgccccagctcctgctaataatgttgaaatggacttgttcggctccctatcagagtcattctcttcaaatgcattggctcttgtgccttctacatcaaaaatcaccacctctcaaggaaatgcaaaccttgattcaacagcatcatttgcactgccaccatctgcatccagtaatttcaacctggtgtttgaagacccatttggtgattcaccatttaaggccagtccttccactgaaactgctcgatctcatccccggactcctcagggtcttgcaccatcccagtcaagtggtcctaatacagaattggtctccaactttgggtttggtgtctcattttctgctcctggtgccagttacactcagcatttgtctttgaactctcagtttttgtccatgccaccaccatcacaggaaacagatattcttgcagaaattcttccccctgcaccattacctgggacaacctcagagcagaactttccagctcctcctgatgctcaatcctcatcctccttttcagcttcatcagggcaaatggcaccacagtctttttttccacagtctggccaacacatgcagcaagatttctcagccgtaaccagtcaacctgcagcacaagccgtttcagctcctggtggccaaccactacaacccccatcatcagttcccactagtcaacatgcacagcaaccctttccatatcaggctgatcaacctgcacagtcaggtagtcatatatatggtggattcccttccctggctgctggttctccgactcaagaagcttcttcaggcatgttccctcaatctcacggtggacatatgaaccaaggatctatggcacttgttccttcacacacagctccccaagcttcaacaggactgagtgcaaactatttgtcttctcaatcccccattgccattgatcaagcatcacagtttaacagtgggagcttgttgggacagtcatttaaccatcaaccacttggtcaaggagtacatgcttcacagagtgctgtttctcaaccgcccaaggacaagtttgagacaaaatcgacagtttgggcagatacactaagcagggggttggttaatttgaatatatcaggacctaaattaaaccctttagcatatattggagttgactttgatgccattaataggagggaaaagaggatggagaagcccaccacgacaacggtaacgtcaactgtaaccatgggtaaagctatgggatctggttccggtatgggccgggctggcgtgggtgctctcagacctccatcaaacccgatgatgggtatgggcatgggaagctatggaggcgtgaacgcaccaatgggtatggggcagatgccaccaccacctagtcgatttcctcctggaaattataactccatgatgggaagaagtggttatcctcaacatccttatgggggctaccgatga

SEQ ID NO: 90242 - DNA, 1791 bp, Glycine max
  Peptide Sequence Number=SeqID_207020
atggccacttcattctctgccaactcccccaatattgcagcaaacaagttaatagaaggagatagcagcaacagagaagaatcagtactcatggagagaactagcagagcgggtgaaaagaaaacaggaggagccaaagttgcaagcctcttgctagtgaatcaagcactagctacactagccttctttggagttggagtgaacttggttctgttcctaaccagagttcttggtcaagacaatgtgaatgccgctaataacgtgagcaagtggataggaactgtttatatgttctcattgatcggagcatttctgagtgattcatactggggtcgatacttaacctgcacagtctttcagcttgttttcgttctgggcttagcactgtcctcattgtcatcttggcgtttcttgatcaacccagttggttgtggtgatggccatactccttgtaaaccctcatcaattggagacgagatattctacttgtccatatatctagtggcttttggttatggggggcaccaacccaccttagcaacatttggtgcggaccaatatgatgagaaaaatccaaaagagaagagttcaaaagtggctttcttctgttacttttactttgccctcaatgttggttctttgttctccaacactgtactagtctactatgaggatacagggatgtggacaatgggtttcttggtatcgttggtctctgctgtcatagccttcttggctttcttattgggaactccaagatataggtatgtcaagccatgtggaaacccagtgatgagggttgcacaggtattcagtgctgttttcagaaaatggaaggtatctcctgcaaaggcagaagaactttatgaggtcgatggtccacaatctgctataaaaggcagtagaaagattcggcacactgatgattttgaattcatggacaaggcagcaacaattaaagagactgaggagcatagtccaaagaatccatggaggctctgcactgtgactcaagtggaggaagccaaatgtgtgttaagaatgttaccagtttggctatgcaccattatttactcagttgtgtttacacaaatggcttctctttttgttgagcaaggggatgtcatgaactcctatataggaagttttcatttgccagcagccagtatgtctgcgtttgacatctgcagtgtccttgtctgcactggaatttatcgccaaatcctcgttccactagctggaagattgagtggtaatccaaagggactaagtgagcttcaaagaatgggaattggcctaattattggtatgctggcaatggttgcatctggtgccacagagattgcaaggctaagacgtattagtcatggccagaagacaagttccttgagcatattttggcaaatcccacagtatgttttggttggtgcttcagaagtttttatgtatgttggtcaattggagttctttaatgggcaagccccagatggcataaaaagctttgggagctcactttgcatggcttcaatttctcttggtaactatgtaagcagcatgcttgtgaacatggttatgataatcacagcaagaggccagagtaaaggttggattccagagaacttgaacacagggcacatggataggtttttctttctccttgcggggctagctgcctttgacttcgtgctatacttgttctgtgccaagtggtacaagagcatcaatattgaagatagtgacatgggagaccaagggcaagagaaggaggaggatgtaaataacaaggtttaa

SEQ ID NO: 90243 - DNA, 375 bp, Glycine max
  Peptide Sequence Number=SeqID_207021
atggcagaacttctgcacaatccaaaagcgctaaagaaagtgcaaatggaaataaggagtaaaatagggccagataggaatatggacgaaaaggacatagaaaacctttcctacctccaagcagtcatcaaggagacactgagacttcacccgcctcttcctcatatggccatgtactcttgcaacatgcttggctacaatattccccaagggtccttcatttcctttggttcgggtcgaagaatgtgcccagcaatgccacttgcctctcgtgtgcttcccccgccaataggctcactcttgtgctcctttgattgggtcttgccagatggcgaaaaccagaggagatggacaccacagaggaaatgggaataa

SEQ ID NO: 90244 - DNA, 270 bp, Glycine max
  Peptide Sequence Number=SeqID_207022
atgagagtggtagtgttgacgtggaggctgtgttttatgacaaactcatgcgattgtggaagttccgatactgctattggaagagcagccaaagttacgtgttcaccagaggctggaatcgaagaagacagcaagggagacaccaaacaagttttgggaaaccaattacaattagctggcagtgaagaaggtgaagatgaagatgcaaacattggaaaggatttcaatgcacaaaagggtctgaggctctttggtgtgtgtatcacctaa

SEQ ID NO: 90245 - DNA, 792 bp, Glycine max
  Peptide Sequence Number=SeqID_207023
atgggttttgagcataaatattggttttgctgttttgggagaagtgtgatgagtggcccaagccagcccatcttccaacgaaccaacaaccaaattgtttcccctgcacacttggcacaaaagaactacacactggaatcgttcaccgtcgaaggcagcgacggagtgaagctccgtacaagggtgttcaagccagatgctggaacagaagcggatgggaagttggggatcgttctggtgcacccgtattctattttgggtggctgccagggtctcctcaaaggaatcgcttctggcttggctctcaatggttacaccgctgtcacctttgacatgagaggcgttggcaagtccaccggcagggcttctctcaccggcttctccgaagttaaggatgtcgttgctgtctgcaactggctttccaacactttctctcttcccaggattttgttgcttggttcttccgctggtgcacctatagcagggtctgccgttgatcagattgaacaagtcattggttatgtaagcataggttatccatttggaatgactgcctcaatcctttttggacgacaccacaaagccatcctacagtcaccaaaaccaaaactcttcattatgggaacacaagatggattcaccagtgtaaagcagctgaggaacaagcttaattctgcagcaggacgtgtagaaacacatttaatcgatggggtaggccacttccagatggaagggcctggttatgatgctgagatggtggatctcatcatcaagtttattgcatcactatga

SEQ ID NO: 90246 - DNA, 1020 bp, Glycine max
  Peptide Sequence Number=SeqID_207024
atggcgattgccatggcgatcagaacccagctactcgcagggtcatacgctcccagttcctccaactcaagaatttcatcaatgtccgacaagttcgacaccatcttggatgagttcgacaagttacacgtccaagttgagaagccgagggagcaagttgcagatgcggaggcactgctggatctcacacgcactctagtgggatctgttaagtcgttgacgaatgagggcgtcacaccttctcaatttgtttcatctttgctcatacgctacgcccacgcccaacactcaattgattggcaccaacttggccttgccgcctccccaatcttcctctcctttcatggctcttctaccatgcttggtcccatggacaaccagtttaagcaacgcaaaactggagtgcccagaaactgcaatcctcgccaaattgcaactactagacctctacaggttgatgaggctgttactgaggaaaatactgataccgacaaaaacatggccactatgtttcacatcttaaggaggacaaagcgtgtcccacttgaaaacttaattttgaacagggagtcttttgctcagactgtggaaaacttgtttgccctatcattcctagtgaaagatggacgtgctgagatcagtcttgatgaaaatcgtttgcactatgtttcacctaaaaatgctccagctgccaacttagtatcatcaaaagaagtttcttatactcattttgtattcagatatgattaccaagattggaagttaatgaaagatgtggtgcctgatggaaaagaattaatgccacgccggactcaatgttgcactgtagttgcctcccaggaaggtatgagtgatgacaatttccaacctgctttggctgtaacacccatcaggaagctatcacggaaccgaggtcgggttgtgcaggaggaaggtgttgtagaagaatctcctgaatgcaatgaggaaaatgcttccagagcaggggcaattcgtaggtgtaagcgtaagcttcattaa

SEQ ID NO: 90247 - DNA, 726 bp, Glycine max
  Peptide Sequence Number=SeqID_207025
atggaatttgatctctgcgatagcagtgatcatgccactggaactggaaacggaagatctgcaattgtaggccttggtccatatcctcggatgcagaacgacatggaaacacaaatccataacattgagcaagaagcatacacctctgtcctgcgggcttttaaagctcaatctgatgcaatcacttgggaaaaagaaagtttaattacagagcttaggaaggagctaagagtatcagatgaagaacacagagaacttctatcaagagtcaatgctgatgacatcatccacaacataagggagtggagaaagggaaatgggctccaatctggagcagtaaatactgctcaacaagttcatgatcacaataccagccctaccattttggcatctcgtaagaaacaaaagaaatcacaatctgtggcttcattatccttgggtgcaccatctcctgcggttcatccatctatgcaaccatcatcatccgcattgaagcatggacctccatcaggaactaagaccaaaaagcaaaaatcattcccttctacaggacttacaagccaaagccaggtcactaatcaggggggttcttcaggtgcctttgcaacaaaaggacctgctgaagcagcttcttatgatccctggattggaaggaaagtttggacaaggtggcctgaagacaaccacttctatgaagctgttataacggattataatgctgctgag

SEQ ID NO: 90248 - DNA, 348 bp, Glycine max
  Peptide Sequence Number=SeqID_207026
atggttgagtgtaaacgttgctatcttacaattgcggccatgaaaaaaccttcttcaagcaaacattccatttccaagaaaagaaaaaccaccattgctactactgattccacttccttcgagttatgctcgttcgatacgcagtttcccgacactaccttctcgctgaaagcttccgttagttctacccgcacagttgtttccgatcactcttgctgcagctccactccgtgccatcagatctgcaggttcgctttgtcaatgaaagggtataaacctaacttaaattttaccgtgaagggcaagctacacttgcagcaccagcaccagtctaaacggtactactga

SEQ ID NO: 90249 - DNA, 312 bp, Glycine max
  Peptide Sequence Number=SeqID_207027
atgatgaaaaagaagaagaagagatacctcatcggagcctacacgtatgctaaatggcaactatatgcaactgcgttgacagaaatggtctcaaaacacttgatagaagtggtgggaagagaggcggggtacttggtgcctggagaggaggctcaagaggtggctaccagagtgtcaagaacagttgcaacagatgtggcaagaacagtctatgaagataatcaactaagacttgtagaagaggtgaagtcaaatgaaaagctaaatatggaagcatgggttttgaggaaggaacacactattacactttga

SEQ ID NO: 90250 - DNA, 2403 bp, Glycine max
  Peptide Sequence Number=SeqID_207028
atggctgcaaaaactgttcttgtttgtgttaccgttatccttctccccttgctgcagcttccatatgtctcagcgactaatgttagcattggtgagacacttgttgcaggtaacgggggtaagcgatggctttctccatcagaggactttgcatttggatttcatcagcttgacaatgacctttacttgcttgctatatcataccaaaatatacctcgtgactctttcatttggtatgcaaacggagacaaccctgctcctaaaggatcaaaactagagctaaatcaatacactggactagtgctcaagagccctcaaggggttgagctatggacatcacagctcatatcaggtacaatttcctacggactaatgaatgatacgggcaacttccagcttctggatgagaattcacaggtgttgtgggacagtttcagtaatccaactgataccttggtgcctactcaaatcatggaggtaaaaggcacgctttcatctcgccagaaagaggccaacttctcacgaggaaggtttcaatttcgcttgcttccagatggtaatgctgtgcttaatcctataaatttgcctaccaattatacttatgatgctcactacatcagtgccacttatgattcgaccaacacaacaaactctggtttccaagtgatttttgataattcaggcttgtacatattgaagaggagcggtgagaaagtttatattacaaatccaaaagatgcgctctcaactgattcctattattatagagcaaccatcaattttgatggaactttcaccatatcaaattaccctaaaaatccagcttcaaatccaagctggacagttatgaagacattgccagacaacatttgcatgaatttgctaggaaacacgggtggtagtggggtctgtggattcaatagtatctgcactctcaaagctgaccaaagaccaaagtgcagttgcccagaaggttattctcctcttgattcaagggatgagtatggcagctgcaaaccaaatttggaactcggttgtggatcaagtggacaaagcttgcaaggagatctgtacttcatgaaggaaatggcaaatactgattggcctgtatcagattatgaattgtataaaccttacaattcagaagactgcaagacttcttgcttgcaagattgcttatgtgctgtttctatttttagagatgatagctgctacaagaagaagctgcctctctcaaacggaagacgggatagagcagtaggggcatctgctttcattaagttgatgaaaaatggtgtttcattaagtcctccaaatccattcattgaagagaagaaatataaaaaagatcaagatactttgataactgtgatatcagtccttttgggaggttctgtctttttcaatctggtcagtgctgtatgggttggtttctacttctactacaacaaaaaaagttctaccaataaaactgctacagaaagcaatttgtgcagtttcacctttgcagagctagtgcaagcaacagataacttcaaagaggaattgggaagggggtcttgtggcattgtctataaaggaacaacaaatttggctactattgcagtcaagaaactagacaaggtgctcaaagactgcgataaggaattcaaaacagaagtgaatgtgataggccaaactcatcacaaaagcttggttcgcctgcttggatattgtgatgaggaacaacaccggattctggtgtatgagttcctgagcaatggaactttagcaaacttcctctttggagatttcaaaccgaattggaaccaaagagtccagattgcctttgggattgcaagagggctggtctacttgcatgaggaatgctgcacccaaatcatccattgtgacataaagccacaaaatatactacttgatgaacaatacaatgcaagaatttcagattttgggttgtcaaagctactaaagattaatgaaagccacacagaaactggcattcgaggaacaaaagggtatgttgcgccagactggttcaggagtgcaccaatcactaccaaagttgatgtctacagttttggtgtactgcttctggagatcatttgctgcaggagaaatgtagatggtgaggttggcaatgaagagaaggccattttaactgattgggcttatgactgttatagggctggaagaattgatatactgcttgaaaatgatgacgaggctatcgatgacacaaataggcttgaaaggtttgtgatggtagctatttggtgccttcaagaggatccctctctcaggccaccaatgaagaaggtgatgttgatgctggaaggaatagctccagtcacaattccaccaagtcccagcccttatacctctgtgtctgttagttgtggttga

SEQ ID NO: 90251 - DNA, 306 bp, Glycine max
  Peptide Sequence Number=SeqID_207029
atggtccttaggtcttgtattgcaagagccggtgtttgtgtagaagatgaaaagggaacagcaagagggatgccgagctttgattcacaattgcccaattccaatgcatgctatacagagggaagcgcaattgattctttttgtgtgtttgactttgatcaatcagttggatatcgcatagaggattgtgttgccttgaggggaaactcagtttttgactcactaaaagtaagtagccaaacaatttctcggggtcctgttgaagttgattcctttgataagcttggaaaattaggtgattggtag

SEQ ID NO: 90252 - DNA, 1123 bp, Glycine max
  Peptide Sequence Number=SeqID_207030
atggtggcggaaatgggaatggggatgtcaatgagagcgggaagctcaggttacttggagatgcatcccgaacgcaaaatcacctttttccagaacccctacatcgttggtatcactttcgccgctggcctcggtggtcttctattcggctacgatactggcgttgtgtccggcgctcttctttacataaaagaggatttcgagctggtgaggaatagcagcttcattcaggaagtaattgttgggatggcgttgatcggtgctattttcggtgctgcaattggtggcgtaatcaatgatcatctgggacgcaagaccgccactatcattgcggacatatgctttggcgcaggctcagtaataatgggtttggcaggcaacccttacgtgatcatattcggtcgttttctggtgggtctgggtgttgggtcggcctctgttaccgctcctgtctacattgcagaagtatctccatctgaaatcagaggaggacttgtcagcgctaacacacttatgatcactgctggccagtttctgtccttcatcgtcaactatggcctcaccagagttcccgggacatggcgttggatgcttggtctctctggcttcccagctgtccttcagtttgtcctcatttcctttctccccgagtcccctagatggctctacatgaagaaccggcgtgaggaagctattcttgttctctctaagatctactcctctccccgcttggaggacgagattaaaattctagatgatcttcttctgcaggagcctgagagcaaggcctcggtcaagtatactgatgttttcaccaacaaagaaatcagagttgctttcacttttggggctggacttcaggctctgcagcagtttgctggtatcagcatcattatgtactacagtcccaccatcattcagatggccggtttcaaatcaaaccaatcagctctcttcctttccctcattgtttctggcatgaatgccgctggcacaatccttggcatctacctcatcgacctcgccggccgcaaaaagctcgctcttggtagcttgtctggcgtgcttgtgtccttgatcattctctccacatcctgctatcttatgggtcatggcaacacgg

SEQ ID NO: 90253 - DNA, 603 bp, Glycine max
  Peptide Sequence Number=SeqID_207031
atggaaccaaaggcaatccaagaagtggaactaaactcaggccacaagatgcctacattgggttttggcacaggaactgtgcccttaccaccccatcatgtgctcatccctgcattcattgaagccatcaaatctggctacaggcattttgacactgctgcttattatggttccgaggaacctcttggccaagcaattgcactagcactagaccaaggtcttattaaaagtcgtaatgagctttttgtcaccaccaaattatggtgcactgatgctcatcctggccttgtgctcccagcactcgagagttcattacagaggttgggccttgagtatgtggatctttacctaattcattttccagtgaggctaaggcagggagttaaagggaccaagtacagcaaaggagagattcttcctttggacatgaaagggacatgggaagacatggaacgatgctccaagttgggcttggccaagtccattggtgtgagtaattttggggtgaaaaagctttcagaaattctacaaaatgcacgtgttcctcctgctcttgtccagtctcgtaaatgtccttttgagaaagaggcaactgggctttag

SEQ ID NO: 90254 - DNA, 1356 bp, Glycine max
  Peptide Sequence Number=SeqID_207032
atggtgggtttggagaagaaggatggtctcacctggagttcatgtcagctaggagcattaaagttgacaaagcatgaagaaacaattgtcagcatggcagtgactggtgcaattgttggggcagcagcaggtggttggattaatgacgtttatgggagaaagaaggcaaccctcattgcagatgttatctttactctgggagcaattgtaatggctgctgccccagatccttatattctcataattggccgtgttttggttggtttgggtgtgggtatagcttctgttactgctcctgtgtatattgcagaatcatcaccatcagaaataaggggagcattagtaggcataaatgtgcttatgataactggtggacaatttctttcctatctcataaatcttgctttcacacaggttcctgggacgtggcggtggatgttgggagtttcaggtgtgcctgcagtagttcagtttttccttatgctcttactgcctgaatcccccagatggctctttataaagaataggaaagaggaagccattactgtgctagctaagatctatgactttgctcgtttagaggatgaagttaatctacttactactcagtcagagaaagactgccaaagaagggatggcattagatattgggatgtttttaaatcaaaagaaattagacttgcattccttgctggagccggattgcaggcttttcagcaattcataggcataaacacagtgatgtactacagcccaacaattgtccaaatggctggctttcaatctaatgagttggctcttctcctttctctcatagttgccggcatgaatgctgccggatcggttcttggcatttaccttattgaccatgcaggacggagaaaattggccctatatagcttagggggggtaatagcatctctgatcatcttggccttgtcattttttaaccaatcatctgaaagtggtttgtatggatggcttgcaattcttggtttggccctgtacattgctttcttctccccagggatgggacctgtgccttggacagttaactcagaagtataccctgaagaataccgaggaatatgtggaggcatgtctgctactgtgaattgggtctcaaatctcattgtggtacagtcatttctgtcggttgctgcagctgtaggcactggccctactttcttaattattgctattatagccgtgcttgcgtttatgtttgtggttgtctatgttcctgaaaccaagggattgacatttgatgaagtggagctgttatggaaggagagagcttggggcaagaaccctgatgctcaaagccttcttgttcggactgaaaatcattcctag

SEQ ID NO: 90255 - DNA, 1494 bp, Glycine max
  Peptide Sequence Number=SeqID_207033
atgacgatgaccactatacaatcgacgccaggaagctcagggtatttggatttgtttcctgaccgcaaaatgtcattttttaagaacccttatattctcggactaactgcagttgctggcattggtggcatgctttttggctacgacacaggtgtgatatcaggagcccttctatatattaaagatgattttgaaggggttagacaaagtaatttacttcaggaaacaatagtgagcatggcaattgcaggtgcaatagttggagcagcaggaggaggatggatgaatgatgcttatggaagaaagaaggcgactctgattgcagatgtgatatttattatgggagcaattgggatggcagctgcaccagacccttatcttctgattctgggacgttttctcgttggtatgggtgtcggggttgcctctgttacctctcctgtctacattgcagaagcatctccatccgaaatcaggggatcattagtcagcactaatgttctcatgatcactgctggccagttcctttcctacatcgttaaccttgcttttactcgtgtccccggcacctggcgatggatgctcggtgtctctgccgtccccgccattgttcagtttcttctcatgcttttcctccccgaatccccaaggtggctcttcatcaagaataggaaaaatgaagctgttcatgtgctctctaacatctatgactttgctcgcttagaggatgaagttgattttctaaccactcagtctgaccaagagcgccaacgaagaaactctatcaaattcggggatgtttttaaatctaaagaaatcaaacttgcattacttgttggagctggcctgcaggctttccagcagttcacaggaataaacacagtgatgtactacagccctaccattgtccaaatggctggcttcaactctaatgagttggctcttctgctgtccctcgtagttgctggcatgaatgctgttggaaccattcttggcatttacctaattgaccatgctggccgcaaaatgttagccctttctagcttaggaggagtatttgcatctttggtcgtcttgtctgtctcatttttgaaccaatcatcatcaaatgaattatatggatggcttgcagtgttgggtttagtcctatacattgcttttttctctcctggaatggggcctgtgccatggactgtgaactcagagatatatcctgaggaatatagaggaatttgtgggggcatgtcagctactgtgtgttgggtttcaaatctgatcgtgtctcagagctttctttccattgctgaagctatagggataggttccactttcttgattcttgctgctatttcagtgcttgcctttctatttgtgcttttatatgttccagagaccaaaggattgaccttcgatgaagtagaactcatatggaaggagagagcttggggcaacaacactgactcacgaaaccttcttgcagaaaatcaaccttag

SEQ ID NO: 90256 - DNA, 2412 bp, Glycine max
  Peptide Sequence Number=SeqID_207034
atggctgatgtttcagattctcaagaacagcctgttcttgattccgctgaactggaaatgaagaagaagcgactgttggtggagctggaatctgcgctgggcggtgagaaatcggtgacggcgcaggcgtcttcttcttcttcttcctccttaggcttgggtattgaggttatcgacgaaacggcgttgcttgactccgttgcgaagaagaacggaggttcaagaagaaccaagaacaacaacaatggtcacaatcacaagaagtcgaagccctcaaataagattgggaacaaaaagtactctcgtaaggagttggagtctctgagattcgtgaacatggcccgacaacgcaagttctggaaagcaattcacgctgcctttcaaaccaccgtggccatggagtatgatgctttagcctcctcacccctgccgcataacaaaccaatcctcagtgcagtgttttgtgaaattagggatagtgaaaaagtgactcctgttgacccttcttgtagtcataatcttgtgggtgaggatgggtgctcaattgtaaaagagtgcagtgaagaagatgatggtagtgatgatgactatgctagcatccaaaggcctgcctttatggttgatggagaacctaattttgattctggtccaccagaagatggatgggaatatcttaggcgtgtcaggtgggaggcacatcaaattccaaaagtgaaggtagcaaaacttgatagaggtaaacttaacaaggaacaaagtgcttacatgccccagattcctgatattgccaagtgtccagagcatctgctgccactgaaagagtgggaggatgcatttcttgccgagttttctgcactgagaacgaatttctcatgccttgatggttctagtgccatacattctggaaatcttcatgttcattcctcacaaatagttgggaacaattgtggagaattttctagtgttatgagcagagatgtgttacttaataatcatttgagaattggtaatgcaaatgatcaacctacgaacttgactgctgaagataaggatagaacactgtcttcagagaatccagaagcgaaaacttcagctgatcaaagaagcagcagcagctccccgactccccctttgctttccgtaatcttagcaatggactctgtagcccgggtatcaagtttgttgaaacgaattaggttgctagaggctgcagacactatgacaaggaatgattgcatgtggctttttgctctctgtgcaacagttgatgctccactagatgctgacacttgtgctgctctcaggagtctgctaaggaagtgtgctagcatccgtgccggaaaggctgaattggatgaggagttccctccgccatccccatgccgtcgccattgccgtctcaccgtcgtctgctcctccttccgccgccgcagtcgaagccgcagacgtcacaacaaagtatctcttcccaccaccacctccacctcttcatttgaaccgaagctcgaagccgttatcgacctcactcccctaaccgctttccaatctgaacttcgacggttcctatcttccggcaaagacgcttaccgagatttgcaaaccttggtcactctcgaccacaaccggaggcttgtcgtttcgtgtcgcccttccaccttgcatttcctcggaacttcggcggctttgaccttcctcgccttttctgttttcacggttttggctcaattgatttctaggttttcgtcttggcgtcgtaacgcgtctagccataagcctgttgtggtgcggagggaccgaagtctcggcggaaaagaggtggttgttgcgtggggtcagagaagtgacacgaatccgttatcagcgccggttcgggactccgtgaagcgctctgcgaagaataaggtggttccgttccaaaggaaattgcccaaatggtggccaactgtaatcaattccagcgcttctgtttttgacgccaatgaacaagaggaatacaagagggaggcttatagagtggttcgagtgtctattgaaccaacaaatattcgggacaccttgtatcgggcatctgttaactttgttttaaatgtatgcagcagggcaccaactcactctacttcaattgatattaatggtgaggatgctccacaattccttactggatttgctgaaaatatcggccttgaaaatgttcgtgctgcaacaattgtgtctgcagctgttgctgctcgtactcgctcctgtcttctacaggcttgggctctggaaatgcaaggcaaacaggttgatgctatggtggaactgtcaaaaatatgccttcttctacgaatatttcctcctgaggagtcttcggaggatgacgtggatgcctcatgtaaagctggttcttacttcttaaccattaaaaaataa

SEQ ID NO: 90257 - DNA, 252 bp, Glycine max
  Peptide Sequence Number=SeqID_207035
atggcttccgacggcgcggagggggaactagcggtgcggtggcagtgtcgtccggccacggtggacgacaacgacgaagtggccaaaaccgttgttctggcggtggaaagagttcatcggagaggagggtggagatggcgagaaaagaactacgaaacgccatcgccgccggaaatcgcttccgtcagcagcgaacagtggtcggaggttaaaaggtggtcagaggggaagaggcgggggaatttggtgtga

SEQ ID NO: 90258 - DNA, 147 bp, Glycine max
  Peptide Sequence Number=SeqID_207036
atgagaggagagaagaatgacgaaacgctgattatggagtcgctgcggtttatttatgcgaaagcgaaagtgaagctgggtaaccgagtgaacgagacgggccacgtgtcttcgagagcctgcgtttatgctacgctgtgtttctga

SEQ ID NO: 90259 - DNA, 1101 bp, Glycine max
  Peptide Sequence Number=SeqID_207037
atggggtttgcctcacagctgaagattgctgctagaggccatggccattcacttcaaggccaggcacaagtacatggaggcctagtcattaacatggagtcactgcagggtcctgaaataaaagtttacaatggagaattgccttatgtggatgtctcaggaggtgagttatggataaatattctgcatgaaactcttaaacatgggttggcaccaaagtcatggacagattaccttcatctcactgttgggggcactctttcaaatgctggtataagtgggcaagccttcaaacatggacctcagatcaataacatctttcagcttgaagtgatcacaggaaaaggagaggtggttacctgctcagggaaccgaaatgctgaccttttttatggtgttcttggagggcttggtcaatttggcatcattacaagggctagaatttctcttgaaccagcacctatgatgatggcaaaatacttcaaccctgatgaagctgaagccatgaatcagagtgttgatcagctactgtcaaagctgagttacattccgtccacactcttcctatcagaagtttcttacgtggaattcttagacagagtgcatgtttctgagaataagctaagagcacaaggcttgtgggaagttccccatccttggctgaaccttctgatcccaaggagtgagattcatgactttgctgaagaagtatttggcaatattcttaaagacacaagcaatggacccatactcatttaccccgtcaaccaaacaaggtggaacagtagaccatcgttggttactccagaggaagatgttttttacctggtagcactcctatcctcagcactcccaaattctacaggtgcagatagtttagaacacattctagcccaaaacaacaagatcatagatttctacacgggtgcccaactgagagtgaagcaataccttccccattacagcacacaggaagagtggcaagtccattttgggtcacgatgggaggcattcgtggaaagaaaaagggcatatgacccactagcacttctagcccctggccacagaatctttcaaaaggcagtgtcttcttcatgttag

SEQ ID NO: 90260 - DNA, 671 bp, Glycine max
  Peptide Sequence Number=SeqID_207038
atggaagagtcttcatccattgaggaatcggtggcaagcgtggtcgaagaagcgaaggaggttcaagacgccgtttccgctcacatctctaaggcttccagcgacgaggaacctctccggcaacgtgtccgtcgcgtcgattcccgaatccattcgctccgttcctctctcgattctcttgtctccaccaaacaaatccctccctccttagccgataagttggatgaagatttgcagagagcgagatgcatcatcgttgacggtgactcctcttcgcttctccctggccatgcacaaggaagctttctgaggatgtttctgggtcctatcaatgttcgtgcctccaggaaggacgttcagctcaaggtcaaagaggaatacaacagttacagggagttgctgcaaagagcacaacatgccagtgaattgctcaaaaatggtgaagctcaaatcagcagggaaagcgcaagcttaatcggggtaggggatagaactgccctgctattcctgctttttccggcaacactgcttattctaagatcttgggtttggtctggatgcttgccaacttttcctgttcagatgtaccaggcctggctgctattcctttacaccggtttggcattgcgagagaacatattgagagtcaatggaagtgatattcgtccctg

SEQ ID NO: 90261 - DNA, 168 bp, Glycine max
  Peptide Sequence Number=SeqID_207039
atgaatgagatcattaagcttctacaaggatgggaaggtctaccaaacccagagggcagggaaatattgcagacgattccagttcctacaagtaacaagctccatgctaaagtcactagaaaggttcagtttgcattctggattctggaatacatcaaagatgcatga

SEQ ID NO: 90262 - DNA, 396 bp, Glycine max
  Peptide Sequence Number=SeqID_207040
atggctctagctttctggacctatgcaagtcctcatggtacaagcatactggttatatttgatggacgccatgctttgagaaagcgacttgaagagcttggttatgaacttagtgacgaccaagttcagactttattttggcgttttaaagcagtggctgagcaaaaaaagagggttactgatgctgacctcagagcattggtatcagatgaagtttttcaagcagagcctgtctggaaacttggtgatttgcaggtgacttgtggaactcttggcctttctacagcaactgtcaaacttttgagtagtgatggtagcacacatgttgcttgttctgttggtacaggaccagtggattcggcatacaaggctgtggatctgattgtgaaggtttga

SEQ ID NO: 90263 - DNA, 2172 bp, Glycine max
  Peptide Sequence Number=SeqID_207041
atggccgaatcatttatcttcagcatcgtggagtcactcattgaaaagcttgcttctcgggctttccaagaagcttctgaggcgctggacgtatacgatcatctacgagagtttgaaaacactctctcattagtcaaggcagtgctgctagatgctgagaaaaagcaggagcatgaccatgtgcttcgggaatggctgaggcagctcaaaagtgtcttctatgatgcccaatatgtgttggatgaatttgagtgccaaacactgcgaaagcaagtgctcaaagctcatggtaccatcaaagacgaggtaagccacttcttctcaagttctaatccacttgtttttcgttccaagatggctcagaaaatcaaagatgtcagcaagaggctagacaaggttgcagctgataggcacaagtttggtctccgaacaattgatgttgacacacgtgttgtgcataggagagacacgagtcgcatgacacactcccgtgtgagtgactcagatgtgatcggaagggaacatgataaagaaaagatcatagagcttttgatgcagcagaatcccaatgatgacgataagagtctctctgttatccccattgtggggattggaggcttgggaaaaactacacttgcacagtttgtgtttaatgataagaggatagatgagtgtttctcattgaagatgtgggtgtatgtttctgatgactttgacattaaccaactcattattaaaatcatcaattctgttaatgttgctgatgctcctcttccccaacagaatttaaacatggtcgatctggagcaattacaaaatcaattgagaaacaaacttgccggtcaaaaattcttacttgtcttggatgacgtatggaatgatgaccgtgttaaatgggttgagttgaggaatttaatacaagaatcaaatgggcctttaaagaaggattatcaatttcttagtgaggaggtagctatacattggggggcacttggtctccttgcatcacctagaaagaatgagacaccggaaaatgttgtgaaacagtatctggatgaattactgtcaagatctttccttcaagattttgtcaattttggcactatttatcgatttaaaatgcacgatttggtgcatgatcttgctctgtttgttgcaaaagatgagtgcctagttataaattcccacattcaaaatattcctgtgaatattcggcatctgtcttttgctgaatacaattttattggaaattcattcacctcaaaatcggtagctgtgagaaccataatgtttcgaaatggtgcacaaggagccaacgttgaagctttgctaaatacttgtgtgtcaaagttcaaattattgcgagttttggatttaagggattcgacatgcaagactttgccacgttccattggtaagttgaaacacttgagatatttcagcattgagaataatcgcaacatcaagagactcaccaattctatttgcaagctccaaaatttgcaattgttgaatgtttcgggatgcaaggagctggaagcattgcccaaaggattaagaaaattgattagtcttcggcatttggagataactacaaagcaacctgttttgccttacagtgagattaccaacttgatcaagcttgcacatctgtatattgcatcaagccataatatggagcctatctttggaggggtgaagttacctactcttaaaacattgaatgttgctgactgtcatagtctgaagtctttgccactggatgttacaaattttcctgaattagaaactctgattgttctactttgtgttaatctggacttggatctgtggaaggaccaccatgaagaacaaaaccccaagttgaagttaaaagttgttggatttgggtatttaccacagctggtggccttacctcaatggcttcaagaaactgccgactccttacagaccttgtttattagaaactgcgacaactgcgacaatcttgaaatgcttccggagtggctgtcaactctgactaatctgaaagtacttattttatcagattgtccaaagcttatatctctcctggataacatccatcacctcaccgcacttgaaaggttgagaattgtcggttgtcctgaactatgcaaaaaatgtcagccccatgtcggtgagttttggtaa

SEQ ID NO: 90264 - DNA, 303 bp, Glycine max
  Peptide Sequence Number=SeqID_207042
atgaaaagcatcgagcacaggttgaagaaggagggtcatggtgctttgatagaagattggtggagtgactgtaaggaagaagatacgaatgaaattgatctagatgatttaccctatgggacagggatgaaagcatctcccatgagagcaaacaaggtaactggaatgaggaatgaggtaaagattgggagctttggaaggaggttattgaaaagacacaaggagcactcaaattcggttaaagggaaagggacagagctgagaatatcagaaaaaggaaaagtaactctgccagtgttttag

SEQ ID NO: 90265 - DNA, 297 bp, Glycine max
  Peptide Sequence Number=SeqID_207043
atgtcgccattgcagcggaggttcctgattcctcgttttcgcaactcagtgattctctcaagggcgtgtgcagtttcgatgatttcaagcagcgaatgggggtttatctcagcctcccagcatgtaaagagatcttccatcaaattaaccgtgtcaccaagggatgttgtgcagcggagcacgtggaggcggacggaggacaggtggcgcttggtggatagcgctatggcgacggtagaaacgacggtggtggcaacaacggtgggggttggagaagctgcggcgagagagagatag

SEQ ID NO: 90266 - DNA, 444 bp, Glycine max
  Peptide Sequence Number=SeqID_207044
ccttattggtgaaagggttgaaaacatgtccctatccccagaaattaccgacgtcgacggcaccgactttctcaaagcccaacttctccgaatgccaccaaattataataaggttgttgctgtcggtaatggtggcgctaattcaaagcccccatggttagatcatcatcatcatgaaggcaaaaccctactttgtgatcatgataacattattaatactttcaagaacctaattatatgtgaccacgacgtcgaaccaacagacgaagatgatgatgatggtggcatccacacctgcccaaacgtgtttgagaccgaaagtgatcagagaaagaagatactgatggccataatccgaaggagacatctctctgctgcagcgggaattggaaacaacaaaagcaaagtctttgaaaaagaaaaactactgagtctgctgttgag

SEQ ID NO: 90267 - DNA, 955 bp, Glycine max
  Peptide Sequence Number=SeqID_207045
cattgcggagtcactcattgcaaagcttgcttctcgggctttccaagaagcttctgaggcgctggacgtatacaatcatctacgagagtttgaaaaaactctctcattagtcaaggaggccgtgctgctagatgcagagcaaaagcagctcaaaagtgtcttctatgataccgaagatgtgttcgatgaatttgagtgccaaacactgggaaagcaagtgctcaaagttcatggtaccatcaaagacgagatggctcagaaaatcaaagatgtcagcaagaggcttgacaaggttgcagctgataggcataagttcggtctcggaataattgatgttgacacacgtgttgtgcataggagagacatgagtcgcatgacacactcccgtgtgagtgattcagatgtgataggaagggaacatgataaagaaaagatcatagagcttttgatgcagcagaatcccaacgatgacgataaaagtctctctgttatccccattgtggggatgggaggcttgggaaaaactacacttgcaaagtttgtgtttaatgataagaggatagatgagtgtttttcattgaagatgtgggtgtgtgtttctgatgactttgacattaaccaactcattgttaaaatcatcaattctgctaatgatgctaatgcttctcttcgccaacagaatttaaacatggtcgatctggagcaattacaaaatcaactgagaaacatacttgccggtcaaaaattcttacttgtcttggatgacagccttcctccggtgaattcattgtctctttttgtcaaatgggcatttaaagaaggtgaagaggaaaaacatcctcatttggtaaatatcgggaaagaaattgtgaaaaaatgcagaggggttccattggctgtgagaacattggggagtttactattttcaaagtatgaggcaaatgagtgggaatat

SEQ ID NO: 90268 - DNA, 852 bp, Glycine max
  Peptide Sequence Number=SeqID_207046
atggatgaccctgtcttcctgcacagtattctactgttagcccaatacgagaggtttggaagggatagaatgcttatatctggcagcagtaggcatcaggggaaaacatcttttgtggagcatcgaactttttttcatctttatcatagcttccaccgattgtggatatttctattcatgatgtttcagggtctaaccatccttgcattcaatgatggaaagtttaatgccaagactttgcgagaaattcttagtcttggacctacatttgttgtgatgaaactttttgagatgattttacatttccagatgtttgtgcatgactgcagaaaagcactccaggaagagagtaaaagtaatggaaactcggttgtcttcagattgtatgtgattgtcatagggatttatgctggtgtccaatttttcattagtttcctcatgcggataccggcatgtcatcgtctaacaaatcaatgtggtcgttggcctttagttcactttgtgaagtggctgcgccaggaacggcattatgttggacggggaatgtatgaaaggagttcagatttcataaagtatatgctgttttggcttgttattttgagtggaaaatttgcatttgcttactttcttcagatcaggcctctggtgaaaccaacaaaggctattataatagcggataacataaattactcttggcatgattttgtctctaaaaataatcataatgctttgacagttgttagcgtgtgggctcctgtggttgctgtaagtatagtttcattgtttgtttacctccttcccccttcttcaaatatgttaatcataaaaggaggatatataggacctgggtag

SEQ ID NO: 90269 - DNA, 629 bp, Glycine max
  Peptide Sequence Number=SeqID_207047
atgatcctcaggggagccactaaatatgagaatgtcgttgaaaaaggcgatgatgaaatgtcggagccttgtaacaagtccaattttgagaagcaacgtgcaccatcgagttcatccaagaggtcatcaattgtgggaatcgagaatcgatccttgatggtgagggcgttcaaagctcacatcgatgatgagaacgggctggtgttgggttgtatcagtcccttttgcagcatgcattccacctacaattcaatctgtgcttctgataataggggtgatgtgtctgtaggaaccacagtaacatggaaacacgacatttctagtgagaatgggaccgagggattgcaaccattggacgcccagaataacattggcaccgacgataggcaagacatagaggtccaccgtgaaggatgttgtctggaggtcaatggtgatcgcctcacaaagccaatgacactccaattgttggtcgttacccaccataaccgagagaggagtagtggtgcgataagggaggtcgagttgggtgacgaggtactgctaaatgaaattatgggtgctctctccgtccaccaggaggagcaccgcctggccgaaaatggcagccaccaacctgagagtctcgg

SEQ ID NO: 90270 - DNA, 1149 bp, Glycine max
  Peptide Sequence Number=SeqID_207048
atggtcaaaggtaccaccatagagcccttccagtggtcaactcaagcccatatggctttcaatacactgaagcaagctttatcaatgacgtcagtcttagccttaccagacttcaagctcccattcaccgttgagacggatgcatctagagttggcatgggtgtcctcctctcacaacagggacaccccatttccttcttcagtaaacccttcagcccgaaactcatgcgtgcctcgacctatgtatgggagctagctgcgataaccacagcggtgaagaaatggcagcaataccttcttaagcaccacttcaccattgttaccgatcatcgcagccttaaggagttgttgaaccaagtggcgaatgccctgtcgcgcttaccagaacatgactccactgtgttaatggtcctctttgtcccatgcttaatgttcatgaaagaactttgctgtcaactggataatcattctgattaccaacgccaccttcaagagcttccaccttactcatggagtatcatgcgacatccacagggggacacaccagggttactaagactctggcaagaatcatggaaaatttcgtctagccaaggcttcaagaagatgttgcacaatttgtggcccactgtgtcgagtgccaggcattcacctgggaatgcttccttcgaatcattatgccctaatgacaacatccctgtttttggactttgtcatgaagcttcatgggcttcctcggagcttggtctccgaccgcgatccactatttgtcagtcgcttctggcaagagctttttcgggcaagtggcaagcaactccgaatgacattcacaagaaactcctgaaagctcaagaagctatgaaacgacaagccgacaaaaaacgccgagaagtgcaataccaagtggatgattgggttctagtgaagctccgccctcatcgtcaaacttcagcaaaaggggatgaagcaatcgcgggcaaattagctaagaggtattatgggccgttccagcaatactcgactaccgccgaacttcacccagtgcaccatgggaggtacttgtgcaatggaaagggttatctccagatgaaacatcttgggaagattggtcccagttgtgcagtgattttcaccttgaggacaaggtga

SEQ ID NO: 90271 - DNA, 912 bp, Glycine max
  Peptide Sequence Number=SeqID_207049
atgctgctggaaataggagtgatagggttcggaagcattgcatttcagttggtcgggatgctagaaaacttcaatgaacggatgccttcaaaaataatagttaaattggaagccattcagagaagatttctttcgggaggaggatcagagcataggaagattgcgtgggtcaattggaagacagtatgtcaaccaaaagacaaaggtggcctcggaattaaagacatcaagatattcaattcagctttgatggcgaaatggcgttgggacctctttcacaagcaggaggagctatgggcaaaagtaatcaactcaaagtatggtggatggagggcattggaggaaggcataagaggaaatcatcagcagcagcaaaacctagtaatcaaacgggaaaccgcttggaaggtgggtggaggtgaaaagtttagattctgggaggatccttggactgataatggtatgccactaatggagaaattcccaaggttgtaccacatatcaagccaacaaaacgcaaacattatgcaaatggggagcatcaacaacaatggatgggaatcgaagctcacttggaggagggatctatttgactccaaagtagaaatggcggacacttttattggggaaatttcacagcagcaagttcagcctcatagggaagatacctggatatggaagcacgatcaaagcgggagctactcaacaaaaagtgggtatgacctaataaggagaaagctaacgggggcaaaccatgactctgatttcgtggacctatggaagctacaaattccaagtaaagcggctatgtttgcatggaggctaatcatggatagactatcaacaaggatgaatcttagaagacggcaggtgatggtaaatgactcgatgtgcccactatgtggactttag

SEQ ID NO: 90272 - DNA, 353 bp, Glycine max
  Peptide Sequence Number=SeqID_207050
ctcgtgtacaaatgaaggttcgtgttgcggaagcggagccatttggcagcgtcgatagtgacgtagaagggaaggaggaaggggtggccgagctccgtgtccttgaccttggcgatgaacacccggtggatggcggcccagcggcggctggggaaggacgcctggggcttgctgttatcggggagggcgtggcggcggagttggcatgggtgtgtgtgcgaggagtgccttcgcagaggaagaagatggaggctagcttggctatggcttcttctatgcgttccattctggttttggatcgagttgattcagccatggtggcagtgctcaatgaaagcaccaagttgttatga

SEQ ID NO: 90273 - DNA, 828 bp, Glycine max
  Peptide Sequence Number=SeqID_207051
atgaccctccccaccaatctcaacttcttctatgtgttcctcccaatgctcattctctattcctcttccttccttgcatcagcttctgattctaaagctgaagatgaaaaatttacctacgctataggaagtagcacaggaccagagaattggtggcatgtcaaccaaaaatggaaaacatgtggggatggaaaactacaatctcccattgatctgcttgaccaaagggttcaagagcttcctcaattgggtaaacttaagaaagcttacaaatcagctcctgctgtcctaaagaatagtggtcatgacatcgtgctggaatggaaaggagatgcaggccatcttaacataaatgaaacttactacaatctgattcaatgtcattggcatacaccttcagagcacacgttgaatggaacaaagtttgacttggaactgcatgcagtccataaatcctctaagggagagtttgctgttattggaatattgtataaaattggttctccagatccctttttttcaaagctgctcaatgacataaaatcaagtgtggacaaggatatagatgtaggagtaatcaacccaagagagatcaagtttaaaagcagaccgtactacagatatgttggttctcttacaactccaccatgcactgaaggtgttgtttggacaattgtgaagaaggtcaggacagtctcaagcgagcaattaagtgccttgaaaggagctgttcatcatggatatgaggaaaatgcaaggccaacgcaggaacttggtggaagacaagtttggttatatggacctatggagaatgaaaagcctacttaa

SEQ ID NO: 90274 - DNA, 357 bp, Glycine max
  Peptide Sequence Number=SeqID_207052
atgattgtacatctgaagcgagtcatggactcagattctgcattgacagaggatctggttgcgtacaacatcatcccgttagatgcttcctcttcaacaaatgctattgtttatttccctgaggtgcaagcagcagtttcagctttgaagtatttcaatggcttgccggagttgcctaggggctatttccttcaacctacaaggaatgctaacatgttcgattttttgcagtgtacctttggatttcagattatccatgttagagcaatccaccagcatttccatcttgtagtggtccctagggttttgcggcagtgctgttgccaggttgacctaggagaacgactcccaccatag

SEQ ID NO: 90275 - DNA, 501 bp, Glycine max
  Peptide Sequence Number=SeqID_207053
atgtctcgagctgaggagctttgggagcggttagtccgtgctgcattgaggagggaaaggactggtgatgatgcatacgggcagcctgttggtggaattgctggaaatgtaccatccgccctagctaaaaatagggatatcgatgaaattttgagagttgctgatgaaattgaagatgatgatcccaatatctctagaatattatgtgagcatgcatattcattatctcaaaatttggatcctaacagtgaaggccgaggtgttttacaattcaagactggtttgatgtctgtcatcaagggtaaaacctctacggtagttattgatatctcaccagtcatcatttatgaagagattagtatgcgcattttgatgctcaaatcaatggcaaattctagtagctggtcagggtggctcccccttatttatagtttgggtgtggttgggtcacggcttggtggacataaggcagctcctgtgctcagatcctattgcacctaa

SEQ ID NO: 90276 - DNA, 549 bp, Glycine max
  Peptide Sequence Number=SeqID_207054
atggagaagcaaaggttacggtggtttgagggtgagaaggaaggggaaaagacaaaacccaagccatattcttttatgacgaacaggaagaaagtggcgaacgaggaggaagaccatacaatgatggaggggatgcatgtgagggactctgttggggagtatgcgcacatttttgaaaccctcattgcccaaaccaggggctttaccggaagagcaattgttggggtactttctttgtgggctaaaaccagagttaagcaaaagctggctaaaagagaagctggaaccatagatagaagtcaggacatagctcggttacaagagttctacaagagttatagagagaagcataatgtggataaattacgtgaggaagaaatgaagttacgggaatctggtgctttcagccgggatcttggcgagttggagcgcaagactgtgaagaggaaaagggtttttgctaccttaaaggttttgggaacagtacttgagcagctgagtgaagaaattcctgatgaggttgggttcttaccttctgggcactcttaa

SEQ ID NO: 90277 - DNA, 2688 bp, Glycine max
  Peptide Sequence Number=SeqID_207055
atggatcacaggccgaaatccaaggactcactctcttactccactctcttcaatctcgagcctttgatgaactttcaacttccaaaacaagatgatgattttgattattacgggaatagtagtcaggatgagagcagagacagcgaaggtggggggattacaaatcacggtaatgggaatgtgcatgaaaaggaagtgaatttgttcaagaagaggagatggtctctaaacagtgacaacgaggagaagaccagtttttacggggcacacatgacggaggagcgatatcgatcgatgctgggagagcatattcagaaatacaagaggaggtttaagggtaccttgagtagtcccgcccaaaatcaggctgctgctccacttgtgaaaagcaacacgggactaaaagctcgcaagtcagggaatgagcacaggggaggaggattacatgtggcggagagtacatcggaatggatgaatgattccagttctcagaaacctggaaactaccgcgatgcagatttctcaccacaatatggcactgataggattatgtatgaacctgcatctttggatattggggatggaatcatttacaagattcctccggtctatgataagttggctggagctctgaacctcccaagcttctcggatatccatgttgaggatttttacttaaagggtactttggatttgggctccttagctgaaatgatggctgctgataaaagatttgggaacagaaaccgagcaggcatgggagaagcaataccacaatttgaatcactgcaggcacgactgaaggttttggagaaaggtgacacctatgagctttgtctctttggactgcttcagatcattgaaagaagcctacctaagaagcaaaaggtgaagaaagaccctgctttgatcgagaaggaggaaatggaaagatgtggaaaaatttgggcaaatattgtcagaatgaaagttagtagatcccttaaatggacaaggactgtcggtatgcgcacccggaaactagctagagacatgttactgttctggaaacgaatagacaaggagatgacagaagtgaggaagagggaggaaaaagaagctgctgaagctttgaggcgtgaacaggagcttcgagaggcaaagaggcagcagcaaaggcttaattttcttatacaacaaactgagctgtacagccactttatgcagaacaagtcgaacttactatcttcagaaactttacccaaggaagatgaagatgcagatgatcaagatgcactggttgactcttcagatgtgatgcccgatgaggaggtagatcctgaagaggctgaattgaagaaggaagctttgaaggctgcacaagaagcagtttctaagcagagaatgttgacaagtgcttttgacactgaatgcttgaggctgcgccaagctggtgaaactgattcacttccaccagatgttgctggagcgagtaatattgatttgcaaaccccctccaccatgccagtggcatccactgttcggacacctgaattatttaaaggggttcttaaagaatatcagctaaaaggtcttcagtggcttgttaattgttatgagcagggtttaaatggtattctagctgatgagatggggcttggaaagaccattcaggccatggcttttttggcccatttagctgaggtagctattcaaccacatgttttggaaaaaaatatatggggaccttttctggttgttgcacctgcttctgtattaaataattggaatgaggaacttgagcgcttctgccctgaactgaaaagacttccatattggggtgggctttcagagaggacagtacttaggaaaagtattaacccaaaggatctttatcgtagggaagctaaatttcacattctcatcacaagctaccagctattagtatctgatgagaagtattttcgtcgcgtgaaatggcagtatatggttttagatgaagcccaggctatcaaaagtgcaaccagtataagatggaagacactcctcagttttaattgtcggaatcgcctactgctgactggtacacccattcagaataatatggctgagttatgggctcttcttcacttcatcatgccaactttatttgacagccatgagcagtttaacgagtggttttctaaaggaattgagaaccatgcagaacatgggggtactttaaatgagcaccaacttaatcgattgcattcaattctaaagcctttcatgctgcggcgtgttaaaaaggatgtgatttctgagcttactacaaaaactgaggttactgtgcattgtaagctgagttctcggcagcaggctttctatcaagcaattaagaacaagatatctcttgctgagttgtttgatagtaatcgtgggcagctcaatgagaagagaattctgaatttaatgaacattgttattcaactaaggaaggtttgcaaccatccagagttgttcgaaaggagtgagggaagcacatacctttactttggagagattccaaattcccttccacctcctccatttggggagatggaggatgtatattattctggtggtcacaaccccatatcatatgagtttttatcgtctgaaaatgggtccatagtaaacagccgttataaagaggatttttcaatggtattagacagtaacactggttga

SEQ ID NO: 90278 - DNA, 1572 bp, Glycine max
  Peptide Sequence Number=SeqID_207056
atgaacgaccaatcgcagatgatgatgaatttgaaccagatgagccagcctcagatgatgaatcaggtgcagattataggtcagtcgcagcctcagatgctctcgcacaatcagggaatgaatcagcaagcgcagcagcctcagatgaagacatcgcagattatgatgaaccagtctcagcctcagcctccgatgatgaatcgtggatacaacaaggtttggtctcagcaacctcctctggaccctaacatgaagtttcagaaccctatgaaaccgaattaccggagcaactggaaggggaagaaggtcactgacaaacgcaaggaccctaggagaatggaaaaacccaatccaagtggaatcgctactcttagtatttccaacagcggtgtcgttggttaccagcccccaacgttgcacgagttgcaatcgcaaaatcgcttaaaagcgcgtaagttttatcctaagaagaagtttaataatagattcgctccttatgcccctaggaatacgacgtcgtttattattcgtgccaagaagtccggtggcatagcatcgcttgtgtcgccttgccctgtgacccctgcagtgcttcccacgcctatattgtcgccgtcgagggaggtgttaggggatatggcgaaggaggagtggggtgttgatggatatgggtcgatgaagggtttgattagacttcgatcgcccgggaatgaggctgatgttcatgattatgaggatgaggaggacggtgggtccagtgagagtgatgtggaggaacatgtggaggtggagaggaggctggatcatgatttgagccggtttgagatgatatacccgaactatggcgttgagtataataatgtgctcgagaatagggttgatgatcaggattcccatatagctcaattggaagaggagaatttgactttgaaggagcgccttttcctgatggagagagaattgggcgatctgcgaaggaggttgctgtttcttgagaggcagaaccaggctgtggaggatgtcaacgaggaagttgtggagaatgggtctgataatgagagtgagggtggatcagatgttccagttataggaattgagaacaatgttgagatggttgactcgctgccggaaagtgggagagatggaaatgttgaggctgatgccaagttggataatggtggagtattggaggctgaaggtgtagatgatgtttttatggaagggtctgttccaaatgaggctattgtgaagaaggatgagatcagaggtaatgaaatggggggtgactgtgtgtttgatgaagtgaaggagaaggatgagcagcaggatgaagtagtgtcacgacagtgtttgacagataaattttttgcaaaagataatgaggttatggataacaaagagagtgatgattttgaaatgctgaacagaaatgaagaatcaacaagtcaaggagcaacagatgaaaacacaaatgacttagtcttaaatgagaaggatgaaagcaagaatcaagtagttgggacaagctcagagactacttccggagatgataatttgtctgtcccatgttag

SEQ ID NO: 90279 - DNA, 261 bp, Glycine max
  Peptide Sequence Number=SeqID_207057
atgcaatcgattcgcagttccgataacctccttcgtcatatgctctaccggaacaccgatacacgattcatgtttgaaattgtgagaatgaaacggaagagggagagaaaatttgtcgggaaaaatgacaagatagcaatgggaatggggggttggggtttgatgactgagcaaactcgggagcagattaaccgggaaagggaaagtagcggcaggcaagaacagccttacactgtacaagatgaaaacggaagtatataa

SEQ ID NO: 90280 - DNA, 1833 bp, Glycine max
  Peptide Sequence Number=SeqID_207058
atggcagcagttgatcctcactcgttcacggactcaaggcaagcaggcacaaggcacgtagccctgagtctctacctggacttgccctcatccaccatccacgcctccgcactcttcagtctccaaacttcccacagcggccccttctatctggacacccgctccctcaccattcactccgtcatccaccccaaaacccagacccctatccccttctctctctctgaccctgaccccatcaaaggctccctcctctccttcactctctccgaccactcctccttcctcatctcttactccacctccccttcctcctccgcactccaatggctcctccctccccaatcctcccaccccttcgtctacacccagtgccaatccattcatgcacgctccgtcttcccctgccaagacacccccgccctcagaatacaatactccgccctcctcaacgttccttctcagttatccgccgtcatggctgcccgccacgtggagcgtcgctcgcccaaacacgacgacgccgttcatgtcgttttgccggacggggaatcgtggtgtgctcaagggaggattgtggaggagttcgtcatggaacagtccgtgccgccttacctcttcgcttttgctgttggggagcttgggaatcgggaggtgggtcccaggacaagggtctacgccgagaacgcggccgctgtgttggattccgccgcggccgagtttgccgggacggaggatatgataagggaaggggagaagctgtttgggccatacgaatgggagaggtttgatttgcttgttttgccgccgagttttccttacgggggaatggagaatcccaggatggtgttcttgacgcccactgttattaagggggatgccaccggtgcacaggttgtggctcacgagcttgctcacagttggactgggaatttgatcactaacaagaccaatgaacatttctggttgaatgagggattcactacttatgcggagaggaggattgtggaggctgtccaaggagaacaaagagccgcgttgaatattggaatcggttggaggggtttgaatgaggacgttgagaggttcaaggacaacttggagtttacaaagctcaaaaataatcaggaaggaattgacccagataatgtctattctcaggttccctatgagaaaggttttcagttcttatggcgcattgagcgacaggttgggagacctgcatttgatgagtttctgaagaaatatattgctaccttcaagttcaaatccattgataccgaaacattccttgacttccttaaagccaacatccctggcatagagaaccagattgacctattgctgtggactgaaggtaccggcattcctcctgatgcttatgaacctgaatccactgcttataaaacgattgtatcactggcaaatgagttcacaaatgggaggatgccaagggaggatgaagttgctggttggcaaggtcaggagtgggagctctacttggacaacttgccaaaatccattgaagcttctcaggtcatagacttggattcacgctacaagctatctgagtcaaaagattacgaggtaaaggtgtcatttctccaaagggctatttcatgtggatgcaaaacttactataatgaggtagagaaaaccttaaaaggagttgggaggatgaagtatcttcgtccactttatactgctcttgtgaaaggcagtgggaaggaagatggtaaagtatttgccaaaagaatattttcagaggctcgtgagtgttaccatccaattgctcagggtgttgttgaggccatatttgccaagcatctctag

SEQ ID NO: 90281 - DNA, 261 bp, Glycine max
  Peptide Sequence Number=SeqID_207059
atggaaaaccctaatctcccatccccaattcgccaaggagcaccccagcaccaactacaacattctgttcctgcaatgtcatgttgtggaacccttccatcagaaagattgcccctcggtgttggacctgctagggatattacttcctatggttttggctatgacctacctcaatcacaagtacaagttgctacttgcttaatttattctttcccatcttccattacacgaagttcacaagtaggttccaaggcgatttaa

SEQ ID NO: 90282 - DNA, 228 bp, Glycine max
  Peptide Sequence Number=SeqID_207060
atgacactggaaaggatcctgctgatgaaacaatcacgaaaaactggctccggagtgtatggcgttacaatggatgatgcagccataattggtggcccattcggatatcccttagaactgaaaaacaacttcatattggagcttctatacagtgacgagaagctcagagttagccggggaaacaacagtattcttttcgtacatgttcgtaccgatgcattgaggtga

SEQ ID NO: 90283 - DNA, 2484 bp, Glycine max
  Peptide Sequence Number=SeqID_207061
atgaagtctaacaaaaccgtaaatcctctcatcaccttcgaacacaagagggatgcctatgggtttactgtgcggcctcagcacctgcaaagataccgtgaatatgctaacatttacaaggaggaagaggaggaaaggtcagataggtggaactcatttcttgatagacaggctgagtcttctgaattggccacagacggattagttgtgggggagggtgagaaggttttgggtgatgaagctgcagggcaagaagctgatactagctcggagaagggtgttgatggacatgaagcaagcaaccaggtgcctggtggttctgacagtgcagcagaaaatggtagtcaaaaggaggaggtgccaccagctgaggagacaaaagttcacagagtccagttatggacagatataagatcatctcttcgaactattgaggatatgatgagtgttcgtgtaaagaagaaaactgggtcagtaaaagatgaacagattattgaagctgcaaaatcaccatcacattctgatgatgtgaaatcaccaaaaggagcagcatttgaggaagactcagaggaggagttctatgatgttgagaggtcagatcctagtccggatatgcctgttgttgatggcacaaatgcctcagcaaatggtattactgctgatgctgcaccaccagaggcttcatttccttggaaagaagagttggaagttctggttcgtggtggagtaccaatggcattgaggggagagctttggcaagcttttgttggtgtaaaagcaaggcgggtggagaagtattatcaggatctgctagcctcagaaaatgattctgaaattaaaactgatcagcaaagcatggagtcaactgacagtaatgggaaaacaggtgcagattttggatgtatgccagaaaaatggaaaggagtcaaaggacagattgagaaggatctgcctcgaacatttcctggtcatcctgctctggacgaggatggtagaaatgctttgagacgattacttactgcatatgctcgacataacccctcagttggttactgccaggtagttttggactttggagcaatgtttctccaggccatgaatttttttgctggcttattgctacttttgatgcctgaagaaaatgccttttggaccttaatgggcattttagatgattattttgatggctattattcagaggaaatgatagagtctcaggtggatcaacttgtttttgaggagttggtgagggagagccaatcatctggattatctgggagtgcaggtggcatgggttactggaccatggttcctgtccatttttgtgaacatgcttccttgggaaagtggtcagttcttcgagtgtgggatgtgcttctttttgaaggaaaccgagtcatgctctttagaactgcagttgctttaatggagctatatggtcctgcgttggtaacaacaaaggatgctggagatgcagttactttacttcagtcgttggctggctccacatttgatagcagtcagcttgtactgacagcttgcatgggttaccaaaatataaatgaaactcgtttgcagcagttgaggaataaacatcggccagctgtaatagcttccattgaagaaagatcaaaagggcttaaagcttggaaggattctcagggactagcatcaaagctagctgatatgcaagtgcttggcaatttatctcgtacagaatctggttccactaatgcagatgaaattctgattagtctgactggagagggtgagatagatgctgttccagatcttcaagagcaggttgtctgtttgaaggttgaactttgtagactactagaggagaaaagatcagccattcttagagcggaggagctggaaacagcattaatggaaatggtcaagcaggataataggcggcaactgagtgccaaggtagagcaactagatgaagaggttgctcagcttcgacaggcacttgctgataaacaagaacaagaaactgctatgcttcaggtcttgatgcgggtggagcaagagcaaaaggtgactgaggatgctcgtaggtttgctgagcaagatgcagccgcacaaagatatgctgcgcaagtccttcaggaaaagtatgaagaagcaactgctgcacttgctgaaatggagaagagggcagttatggcagaatctatgctggaggctacattgcagtaccaatctggccaagttaaagtgctacaatctccacgatcttcacagtcagattctccggtatcgagaaacaatcaagagccggatatccctgctaggaggataagtttgctttctcgtccatttggacttggatggcgagatcgaaacaaggggaaacccactaatgaagagccagctgagggaaatcccagcgttgaggaacaaaatacgatcagtgaacaagacgtcaatggccttaaagtacaggatgagagtagaaaagaagtcagtgcctag

SEQ ID NO: 90284 - DNA, 216 bp, Glycine max
  Peptide Sequence Number=SeqID_207062
atgaatggattggcactgggtgtagacgaaggggtgggaggattggggagggaggagccattggagtgcggaggaggaaggggaggtggagtaagagatgaggaaggaggagtggtcggagagagtgaaggagaggagggagcctttgatgggatagaaggggccgctgtgggaagtttggagactgaagagtgcggaggcgtggatggtggatga

SEQ ID NO: 90285 - DNA, 986 bp, Glycine max
  Peptide Sequence Number=SeqID_207063
atggcgtcaacatcttgcgttggtaacacttcattatctatgaaagattcagcttcgagctattctgcatatcctcttcctctagcaaaatatgaggaggttgtggacaatccccagctcttcatgtttaccttggagaaacttcacgctgctatgggtaccaagttcatgattcccattgttggaggaagagaactagatttgcatcgcctctttgttgaagtgagttctcgaggagggattgcgaagtactatgtttcattgctctaccattatgaacaaatctacttctttaaagctcgtgaatgggatcctattgctcctgatgtttcgcagaaccaatcgaccctgccagttcctcctccaaaaatgcagtttcagcagcctttgtcagaaactcaaccagctgtctttcaactgtcaaatgttaatgctgctaaattgcctgaagcaatggcagcatcttcggcaggttctccagtcattggggtcattgatgggaaatttgaaagtgggtatctagttactgtcacaattggttcggaaaaactcaaaggtgtgctttatcaagctccacaaaaccctgtattgacagcatcccatcatagtgcctcagctaataacaacaatgcttctgcttcattgggtgtccatcgtcgacgacgcaggaagaaatcagaaataaaaaggagagatcctgctcatccaaaacctaacagaagtgggtacaatttcttctttgctgagcagcatgcaagactaaagctacttcaccatggaaaggacagagagattagtaggatgattggtgaactctggaacaagttaaaagaatcagaaaagacggtttatcaagagaaggccatgaaggataaagagaggtacagagtagaaatggaggattatcgggagaaactgaagatgggcccagttatcagtgatgctgtgccgcttcaacaacgacttcctgaaccagatactgacat

SEQ ID NO: 90286 - DNA, 144 bp, Glycine max
  Peptide Sequence Number=SeqID_207064
atgactccggatttcccagctcccacactcgcaactcttggcccaaggcaacagaatcctcacaaaagaagctgcacgaaagagcttgttcccacccaagctcaatgccaacagttgcagcaattgaagcatggaaagacatag

SEQ ID NO: 90287 - DNA, 216 bp, Glycine max
  Peptide Sequence Number=SeqID_207065
atgcctatttttgtaccaaaggcatccgctgtgaatggaatgatggataaacctttgtgcagaaattgtttgggaagtggtgctgtgctttattgtttcgatattattcctgatgccatatgctgtaaccttatcaatgaaaatggaaagctcttaacaggaagcgagctaaagatgtttacgaatttactgagtgtccaaattgttatggtatga

SEQ ID NO: 90288 - DNA, 285 bp, Glycine max
  Peptide Sequence Number=SeqID_207066
atgacttttggtcctctttcgatgatgaaccccaaaaggaaagaggtggccatttgttggacccctcctccaatatcatttgtcaaaattaatgtaaatggatcctataaatcctcaacagggagggctgtttgtggtggcatagtgtgtgatcatatggacaatatcgttactacctttcatcataaattgggcatctgcaacttgctttgggcggagctctgggctctaagactaggcattcaagtggccaaggatcttgggttgaaggatatcagtttttag

SEQ ID NO: 90289 - DNA, 1302 bp, Glycine max
  Peptide Sequence Number=SeqID_207067
atggtggattccccatcggtttcagggaaccgtttactgacaagaacagactccatgcgcttcttttcttcaagaggagtcaagagttttgcttccggtttcacgttggcttctatcttgcttatgctcttcctcattctaaatccttctagctaccaatcatctccaaggctcagaaatgccttccaatcttcacgtggtggatatcatttctctaacgtctttgctcacatattccccaactcttcctcttctccaccctctcatgatcaaacttctaagaatgatgatgcaatagatcttaggttagggactagtgctccttctccttctcaaatttccagaaaggaaggctctggactcacagcaaaggaggaacatagaatacaggcaccaccacaagagccttctctcactgcatggtcaccattaccaattcctattacatggtcaccatcaccgactgcttcttctccaaatgagaagcacagtgagcaagattggatggaaatgtggaaggattgtgatatgtatgaagggtcatgggtcagagatgattcataccctctttacattgctggctcttgtccctatattgatgagcctttcaactgtttccgcaatggtaagagtgaaaatatgtatgagaagtaccgctggcagcccaagaattgcaacgtgccaaggtattttctgatgagttcgatcaccctatcaatgtataggaagcaatgtaagggagaaattctttggtacccacagaaatttaagggttttgataaggctattgaaaaactctctcctttaatgtgtccaaactcattcaactattggtctaaaacatttataccagaactcttttctaagtttctcagtgagatgagtaatgtgcgcaggtttaaagctaatgaaatgttggagatgctaagagggaaacgtttagtttttgttggtgattccctcaataggaatatgtgggaatctctggtttgtgttcttagaaattcagtgaaagataagagcagattgtttgaagcctctggcagagaagaatttcgaactgagggttcgtactcatttatcttccaagattacaattgctcggttgagttctttcgttcagtgtttcttgttcaagagtgggagattccagaccagaagggatcaacgaaagaaacacttcgtcttgatttgcttgagagatcttgtgataagtacaaagatgcagatgttcttatcttcaacacaggtcactggtggactcatgagaaaagaatagaagggtattgcttcttcttttaa

SEQ ID NO: 90290 - DNA, 930 bp, Glycine max
  Peptide Sequence Number=SeqID_207068
atgtctcagcagcaaaaccaaaacctacctgcggtttcgcaatctctgctacaacaaacggtttctggagctgatgttaaacccttctcaataagacagtatgtaattgcttctcgtcacataaatatccttcataactggccatttcatgagaagcacttgcaattgtgtcttaaccatggtctcaaggaggtgttgccaccatttggacgccaaacttcacctgctgaatcactccaaggttgttccaacttgatgcaatcactagatgataatgataataaagaagctgatttttgcaaagctgaagtgccacatctcattgatgatgaccacccacaaagtactaacaatgagtgtgtctacaaagtcaccaaccacacttcagcacatgaagaggcaagtcactcaaatcagcttaactgcagcatttctgacaatttatctcaaccagcagcaaacacatgtaccctcccaagttcaactcatgctagtaagagtttgccatcatccaaggcagtgaaagataaacgcaaaaggcgtaaatggagatgtaagaaacgctcaatggtggatattttagctgtggcacggcacactacattagaggagatccataggatgaacaagttttattatgctgaaactgtgattaaaggatgtcagcaaacggtgcctcatgaaaatatttccaggtctgaggtagtgggtttggattcatgtagaaaagctgggagtgaagatcatggtgtagctaatgttgatatgacaccaaaggggccattgcttcttaagttcaagctcaatggatgtaatgaaattagtgacaaatatgccgatttggttacaattaaagttgcaaacaccccaaaaattatgatcaaaatcacgctcgtggattgttttttaaaattttttgcgcattcttag

SEQ ID NO: 90291 - DNA, 420 bp, Glycine max
  Peptide Sequence Number=SeqID_207069
atggaaaatcctgatactcatgtttctgcactgtcaacagggggtttgacttctggatggttttgtcttgagtccgctgcacttacacttgcaataagcgctgcagcattttcattctatagaaaccgtaccaaagaaaaggcaaggagaatgttccatgccagtcttctttacctccctgtgtttatgtctgggcttttgattcaccgtcgttctgaaaacgaacaattcttagaagacaaagcaaagggttttgtgaaatctgcatcctctacggagtcttcagagttggatgatgataacggcgatcaaaatatcaaggccaggcgtccctatcggactgaagcgcgtcctcccgtatcgtatgcctctgttgcaccttttccctttttgcctgctccatcatataacttcccttga

SEQ ID NO: 90292 - DNA, 1332 bp, Glycine max
  Peptide Sequence Number=SeqID_207070
atggttatacctaacgtttctgcaatgcaccgcgtgggtagtgcaagtaatggaaacaattcaactcgccctcgtaaggagaagagattaacctacgtgttgaatgattctgatgacataaagcattgtgcaggcataaattgtctggctctacttacgtctgcggcatctgatgggtctgattatctcttcaccggcagccgtgatggcaggttaaaacgatgggcactaggtgtggatagagcaacatgcttggctacttttgaatctcatgtcgattgggttaatgatgctgttcttgttggtgatagtacacttgtttcttgttcttcagatacaacccttaagacatggaatgccttgtcctttggaacctgcactaggactctccggcaacactctgactatgttacttgcctcgcagcagcagaaaaaaataacaatattgttgcctctggtggccttggtggggaggtttttatatgggatatcgaggctgccctcgctccagtctctaagtgtaatgatgatacagttgatgaatcttcaaatggtatcaatggttctggcaacttactaccattgacatccttgcgtactattaactcaagcgacaatatgtccatgcacaccactcaaactcagggatacattccaattgctgccaaaggccataaagattctgtttatgcactggctatgaatgaaagtggaacaattcttgtctctggtggcacagaaaaggttgtgcgtgtctgggacacaagatcaggatcaaagactctaaagctaagagggcatacagataacatcagggctctgcttctggattctagtggcagatattgtttatcaggatcttcagactctatgataaggctttgggatataggtcagcagagatgtgtgcattcttatgcagttcatacagattctgtttgggcactcgccagcaccccagcatttagtcatgtttatagtggcgggagagacttttcattatacttgacagatttgcaaactagagagagtagtttgctttgcacaggcgagcaccctattcttcaattggctttgcatgatgatagcatatgggttgcaacaacagactcttcagttcatagatggccagctgaaggatgcaaccctcaaaagattttcctgagaggcaattcttttttagctggaaacttatccttttcaagagcaagagtgtcactagaaggatctactcctgttcctgtatataaagaacctaccttaactatcttgggtacacctgcaatagtacagcatgaagtcttgaataataagaggcatgtgctgacgaag

SEQ ID NO: 90293 - DNA, 228 bp, Glycine max
  Peptide Sequence Number=SeqID_207071
atggctgagagggcatctagaaggggagaaaggaatggttggagaggagaaataaagggttcgtttaggaggggttgggaaaggaaggggggttcaggaaggaaaaaggagaaggagaaggggcgcaagttagggaattccaagaagggaaagaggaaagaaggatgggtgaaaaattttgaacttggggataaaagaataatttcaagggagaataagaaccaatag

SEQ ID NO: 90294 - DNA, 342 bp, Glycine max
  Peptide Sequence Number=SeqID_207072
atgaaccacatatcagatattaaactgaaaaacaggttcagggaacattttctacacaatggatctgtgtatattccagagatgaccatgggggaaaacttgatttctcctaacgttgtcacaaggtgtaggagccgagagctggtgaagcatgcaaaatacaacattgaacttaatcagaaaggggctgcgcgaacgcaagcccccactaccacaaattatgatgtaggctctcccacttggggagaccttaggtgggcacccctccaaagtgcaatggaggtcaccaacctaggccatggacattcacgatcgtccattgaccccacccagattgcctaa

SEQ ID NO: 90295 - DNA, 804 bp, Glycine max
  Peptide Sequence Number=SeqID_207073
atgccttctcttcgcatcctaaacaaaatttgttattcgataaaccaaaattgcaagtacaagtaccgaacaatctcctccacggcacagttgcagggttcatggatggagaaggtcaaaaacgtcatcacgggccaaaagagcacgccccagtcccagggagacgcttcccaagtcacctccgattcattcactttgctccgttttgcggacgaaatgaagaatgcaaagagaataggcgcgtttaaggagttcatggctgggcgaagcagcgaagccactttttcctccgccttcgacaaatacgaagccataattcgatctctcggtgctttggaccccactggagagaatctcccgacagctcagaaacaagaagcggcaaaacattgtaattgcacgattgctgatgtggaggatgcacttgccaagtttacttgggccaaggaagcacagaagaagatacagaagctaaaagaagaaggaaaaccaatgcccaaaagctttgctgaagtccaaaagctagttggttcaactccattggatcttgcaaggtctaatttggcccaagctggactaattagcaggaacgcactttgtccatgtggtgctgcggaaatgactgaaggaattcagagattaaatgttaaactgcaaggaagcctgatctattatggtggttccatacctacgcatatgcacatagctgaattgatctgcagtcgtaccttgttttattcagttcagatcaagttggcctatgcactagactgcaagcatgcccctaagctgattttaggatga

SEQ ID NO: 90296 - DNA, 348 bp, Glycine max
  Peptide Sequence Number=SeqID_207074
atgggtgttcaagaaggcctatggcctaggtttggtgacctccattgcactttggagggggttagtctccgaccattgaagatgagtgacgttgatgatttcttgttatgggccggtgatgatcaacaagcgttgactgtcattcgagatctgtgcatgcctcatccatggactcgttccatatgcgttgacgatgtaaccattgggtttgtgtctgtgtctcctggaacaggtgatgacaggtgcagggctgagattgactatgtcatagttgccaagtactggggccaagggatttccaccaaagcagtgaagattgctgtcacaagtcttcaaggatgtgcctga

SEQ ID NO: 90297 - DNA, 1620 bp, Glycine max
  Peptide Sequence Number=SeqID_207075
atgagcaccatcatgatcctaataccctttatactagcttcattatttcccttttttcaagctcagcctctatcatcagccttcgccaaccaaggtcaatggaatctcctgcaaccaagcattggcatatccccaatgcacatgcaacttctccataacgacaagatcatcatgttcgaccgaaccgattttggtcattcatacctccctctttctaatggccgttgccgcatggatcccaacgagattgccctaaaagttgattgttccgctcactcagtactatacgatgtagccacaaacacttttcgacccttaatgatacaaacagacacgtggtgttcctcgggctcggttctccccaacggtacattggtccaaaccggtggctacaacgacggtgaacgtagcattcgcatgttcaccccatgcttcggtgaaacctgcgattgggtcgaattcccaggtttgttgtcacaaagaagatggtatgcaacgaaccaaatactcccagatgctcgtgtcattgttgttggaggtagaagacaattcaactatgaattcttacctaaaacacctagtcctaacagttctccctcatctattccacttaattttctccaacaaactagcgatagaagtgaaaataatttatacccttttgtgcaccttttacccgacggaaacctattcatcttcgccaacacgaaatccgtgttattcgactacaaacaaaacagtgtgatcagagagtttcctccaatcccaggtggcgatcctcgtaactaccctagctccggatcttcggttcttctcccactagacgaaaacctagattccctcgaacctgaagtggtggtgtgcggcggagctccacgtggctcgttcgagaatgccgcacgtgggaacttcgtgcaagcccttggcacgtgcgggaggattaaagtcactgactctaaccctaattgggtgatgcagaacatgccgatgccgagagcaatgggagacatgcttcttctccccaacggcgacgttgttataattaacggcgcaggagcagggaccgccgggtgggaacacggccatgacccggtgttgtcgccggtgatattccggccatcggagacggtgaatcagtttagtgtgatggcaccggcgtcaagacctaggttgtatcactcttcagcggtgttgttgagagatggaagagttttagttggtggtagcaacccacacgttttttacaatttcactggggttgagtaccccactgatcttagcttggaagcgttttctccgccgtatttagcgccggatttcgctccggtgcgaccagtaattagggttttttgttatgtcacattcacagtgcctaattatgcttcggtgagtgaggtttcgattaggatcgtggcaccgtcgtttactactcactcttttggacagaatcagaggatggtggtgttgaagttgagtgcagttacatatctggccggggaggcatattacgccaccgtgatggggccttccacggcggagatagcaccgccggggtactaccttttgtttgtggtgcacaagggtgtgccaagttggggttcgtgggtgcaagtgatgtaa

SEQ ID NO: 90298 - DNA, 510 bp, Glycine max
  Peptide Sequence Number=SeqID_207076
atggccttggtgacgggttttctagcctcacatgtcggtgctgtaaggcaccaccggtttgaagttggaattggagttcgggcggtgtcgtcatctgaatctgaaacagtggcagctgtgaacggatcttcttcgcggaatggttccttgctactgaaggaggaaaagaaggtgcctttcttgcgagttgaagagaagaagaataagaggggagaagaagaagaagaaggtttggcagcactttgggatgatgggtatggaagaaggagtgtggaagattactttgctgcagctaaggagatgtgcaaatccgatggaggcccacctcgatggttttgcccacttgaatgtgggcctcctttcaaggattctcccactctcctgtttttacctgggatggatggcacaggattgggtctcactttgcaccatcaagcccttgggaaggcttttgaagttcgttgcttgcatattccagttcatgatcgaacaccatttgaaggtctttga

SEQ ID NO: 90299 - DNA, 2656 bp, Glycine max
  Peptide Sequence Number=SeqID_207077
catgcaacttgtagaagtcattgacgagtttgaccagtctttgacacgtggcactggtcttaccagtgccactggcgatttgagctacacgggactcgccaactctcgcgtcatacggctccgttctcagctaatcaatgagcaaatcgccatcaaactggcgagtcccgtggagctcaaatcgccagtgacattggcgagaccaatgtcacgtgtcaaaggccggccaaactcgccaatagcttttgcgagtctgccatggcttttaggtgtgcgtttggctattgatttcgtagctctgcgttttgatttgaatcgcattgagtcttcggtgcgtttgatatgcgattatgctttgactggtggttcggacagtatggaaataatgagtttgaacttcgcctggattcggagcttcttggtaaatgtgaaaaacacttctagagttgtagattttagtatcagtgtttggcatattgagaagagagctcccgggttataccgttatgcggttatgcctaatgcttttctgtatgtggtttctgtgggagtagaagtgtttggattttcggcaatgcaccgcgtgggtagcgcgagtaacggaaacaattcaactcgctctcgcaaggagaagagaataacctacgtgttgaatgattctgacgacacaaagcattgtgcaggcataaattgtctggctctacttacatctgctgcatctgatgggtctgattatctcttcactgggagccgtgatggcaggttaaaacgatgggcactagctgtggatagagcaacatgctcggctacctttgaatctcatgttgattgggttaatgatgctgttgttgtaggtgatagtacacttgtttcttgttcttcagatacaacccttaagacatggaatgccttgtcctttggaacctgtactaggacactccgacaacactctgactatgttacttgccttgcagcagcaggaaaaaatagcaatattgttgcctctggtggccttggcggggaggtttttatatgggatatcgaggctgccctcactccagtctctaagtgcaatgatgctacagttgatgaatcttcaaatggtatcaatggttctggcaacgtactaccattgacaagcttgcgtcctattaactcgagcaacaatatgtccatgcacactactcaaactcagggatacattccaattgctgccaaaggccataaagattctgtttatgcattggctatgaatgaaagtggaacaattcttgtctccggtggcacagaaaaggttgtgcgtgtctgggatgcaaggtcaggatcaaagactctaaagcttagaggacatacagataacatcagggctctgcttctggattctagtggcagatattgtttatcaggatcttcagactctatgataaggctttgggatataggtcagcagagatgtgtgcattcttatgcagttcatacagattctgtttgggcacttgccagcaccccaacatttagtcatgtttatagtggagggagagacttttcagtgagcgagcaccctattcttcagttggctttgcatgatgatagcatatggattgcatcaacagactcttcagttcatagatggccagctgaaggatacgacccacaaaagattttccagagaggcaattcttttttagctggaaacttgtccttttcaagagcaagagtgtcaatagaaggatctacccctgttcctgtatataaagaacctatcttaactatcttgggtacacctgcaatagtacaacatgaagttttgaataataagagacatgtgctgacgaaggatgcatctggttcagtgaagctgtgggagattacgaaaggcgttgtgattgaagattacggaaaggttttatttgaggagaaaaaggaagagctatttgagatggttagcattcctgcatggttcacagtggataccaggcttggaagcttgtcagtccatttggacactccccaatgtttctctgcggagatgtattcggcagatcttaacgttgtaggcaagcctgaagatgataagattaatttggctcgagaaacccttaaagggctactggctcattggttgagaaaacgaaagcaaagaatgggatccccagctccagctaatggggagttattatctggaaaggatatttcttctaggagtcttgcccattctagaattgaggttgatggtagttctgagaatgatgctatggtttatcctccgtttgaattctcagttacttcccctccttccattattactgagggcactcatggaggctcttcagtccagatcctcacacaagggaagctaagtgccccacgtatattaagagttcacaaagttattaattatgtaatagagaagatggtgcttgacaaacctttggatagtttaagtggtgatggtagttttgcccctggacttactggatcacagtcacagcttcaagcagttggggatggatcttttcgatctggatttaagccttggcaaaagcttagaccttctattgaaatattgtgcaacaaccaggcaagtagtctgttgtctacttgtcttatatgcaatcttatgacagtgcatatagcatggttttctagatgctga

SEQ ID NO: 90300 - DNA, 258 bp, Glycine max
  Peptide Sequence Number=SeqID_207078
atgtgcgggggaggtttgggttgtgcggatggagaaggtgaaggagcaacgaagggatggagaccgcggtggtgggaacagtgtgacggagaagaagtgccgtttggtgtggcaagttgcagatctgagcctcttgcacggaggagacaaagttttggaggcgccgagtataggcttatgggtttgacagagcaaacaaacacaaaggtttctataattgggcttgagagacaaggatattctggacatgttgcttag

SEQ ID NO: 90301 - DNA, 261 bp, Glycine max
  Peptide Sequence Number=SeqID_207079
atggtggcactgtcgatgtcgcaggacacggtcgtggttgagttgaggccgagggacgatgatgagagcgtggtggacttgggaatgaaggttgttaagcgaagagagcctctcagggcggtcacaatggccaaggctgttgcctccgatcagcagagcgacggcattggtattttgatacgcttgttgcgctccgatttgccatcctcgacgccgccaaatgttggagatgtcgtccttgccggttccggccaccactag

SEQ ID NO: 90302 - DNA, 435 bp, Glycine max
  Peptide Sequence Number=SeqID_207080
atgtctcctccacctctagaacctcacaatcactcacaaactcatctcaagctctcaggacggcttcctcttcaagctaggttctctgcaggtcttcacacaacaaaatctctcaaactctctagaacttggacctttctctctctagaaaaccctagacatgcgaagcttcaagaaaaggccaaagttgaggttttgcttaatagacaaccaaaatcagtcaaatacttgaaaaggaaatttgattatgtgaagaaatcaatttccaaagagggtttggaagggatttggaggaagatgattgagttggtggatacatcactgaatttcaatctttatggtggaagaatggctgagattccttcaacaacatctcctttccctcatcgagctgggaacctatggaagatccaatacctagcgaaaacttcataa

SEQ ID NO: 90303 - DNA, 831 bp, Glycine max
  Peptide Sequence Number=SeqID_207081
atggcttccaacctcgctgcgaatatggccacttgctctcatctcctcaaagaagcagcatctgctggagccaaattgctttgctttcctgaggccttctcttacgtgggcactatggatggggacagcgttcttgttgctgaaccattggatggacctattatgaaccactactgctctttggccaggtttgacgtagatgttcctggtggaagggtatacaaagaaagtagttttacagaatcagtcctccctcagcgtaactctctttctagaaaatctgagggaaaaggggagggggagtgtttgaaagagaagataagcacacttggatatgatatgcaccatgaaggatggggctttcatgtgaatttcttctgttttggggatgttttcaggctggatattgttgcagtagacagtcctattggacgtttgggcctcagtgtttgctatgatttgagatttccagagatgtaccaattgctacgtttccaacatgaagcacaggtactactggtgcctgcagcattcacaacagtaactggtgaagcacattgggagattcttcttcgtgcccgtgtaattgagactcaatgctatgtcattgctgctgcgcaagctggcaaacataacgataaaagagaaagctatggcaacacattaattatcgatccatgggggacaattgtaggacgattaccagatcgtttgtctacaggcattgtagtagctgatattgatttatcatttgttgattcagttagagagaaaatgccaattgctaagcaaagaaagccaattgacttctggaaagctgcatctctatag

SEQ ID NO: 90304 - DNA, 225 bp, Glycine max
  Peptide Sequence Number=SeqID_207082
atgactccttttgtctccaagaatcctagacgggctttctttaattatagggaccttgacttaggaagtattaactgcaatgctaaagggagagtttatggagtgaagtatttcaaggataacttcaataggttggttcaaataaagaccaaggttgatcctgataatttctttatcacagcacaaagcatacctatggtaccatatcagaaattattagagtaa

SEQ ID NO: 90305 - DNA, 2868 bp, Glycine max
  Peptide Sequence Number=SeqID_207083
atgaagaaattcttctttttcaaatcttctgcatctagcagtggaagtaacaacgatgcagctccaccaaaatcaacaaataagcaagcggcctgggatagtttttcagacattggaatgaataataatcaggcttacggtaaaaccaagtctgaggattatttccagagccccaagggcttcttctcaaaatctcgaaagcatgtttctgataaccagagttcttctgctggtccggatcttagaaggagcaggtcattgtcatcatctacttaccagttcagagattcaaccaggtctccttcaagtagcattgtcagtgatccatatcaacaagttgagcgttcatctcgttctcaggctcctaactatgagaaacaaaagcgagacaagccaacacaagttgcagtgccttctgtccaaaatttgcacagatacgagagacccgggtctcctagttcttcaagatctcatcatgagtcctcagggaactcttccacttgttccagcaacatttcaagtaagattgtggatcgttacattgatggagagcagcatccagaggaaattagacccaggaacaattcacaaagaaataatagcagacaagggaattatggtgtgaagcttcctccaaaagttcagcttacagcaccaaattcaccaactcacggagtcaaagataaaccaaggactcattcatttagagaagctaaagctacccgtcttggtttctcatcccgagattggacagaaaatgggtttggaccagagtctccgaggagtcttgcaaagaatgtgattgagagactttctcagtcttgtgatctcgctaagccatgttcaaagaatgctaatgtggataatccaatcaccattgaagatatctattctagatctgtgaatggacactatgactctgattttgatgctgctcagccaaaaaatgatttgttggatgaaccctacagaatgacaaatggctatcatggcatggatggcaattttgagggtttaagctgtgatgaagctgaagaggatgcggatgcagaactaatgagaagatcgaaggaggctgaggagagggttattcttctctcaaagaaactggaacgagatagcttttttcctgatggtggttatgatgtgtcagcactgattcagacaatcagacatctactagaggagaaaataagcttggctctggaagtttcaacccatctaaggtctcaaattgcagaaagagtctctgccagggaagaacttagacgtgtaaagacagaactggagtttcgtactcagagactagaaaaagaaaagaatgagatgcagtcagcattggagaaggaattggacaggaggtcaagtgactggtcatttaagcttgagaagtaccagttagaagagcaaaggcttcgtgaacgagttagagagcttgcagagcagaatgtatcacttcaaagggaagtctcctcttttagtgagagggaaatggaaagcaaaagtgtgatggcatttactgaccaacaactcaagggattgaccgataagacagagataatgaaaaatgagattattgatttgcagcaaaatctcttggaactacaagagaaatacaagatagcagaagaaaatagggactgtatccttagaaattttgaagagaaggagaaggagtgcaaggagttacacaagtccctaaccagattattaagaacttgcagtgagcaagagaagtcaataaccggattacaagatgggtttagcgaggagcttcgtaggaaccatcccattgagagtgttgacaatcacattgaaaaaatgcgaatggagcaaatgagattaacaggagtagaactagccttgagaaaggagttggagtcttgcaggtttgaggcagattctcttcgccatgagaatataatactcttaaaccggttaaaaggtgacgggaaagaaagtgttgctgctacttatagactagataaagaactatgtgcccgcatatactgccttcagaatcaaggcctaacaatgctaaatgaaagcacatacttgtgttcaaagttactggaattcgttaaagggaaaggaagccgtcttcatcaaaatgttcagccggatcgagaagtgattggaaatggtttagatgggcaatttattgttgaatctgaaactaaaattcagggactcaaaagtggcaccgagggtttaactaggagtttgcagatgatgtcttctttgttgaaagataagtcaaatccattgacttgtaaatttcaatcagagtgtatcgacgctggtaaattagctacactgaatgatcaatcatctgaggatattttaagaactgaacttaaagcagaatgtttggtgacaagtttattaagagagaagctgtactctaaagagctccaagttgagcagatggaagctgaacttgcttcagcagtaagaggaaatgacatacttagatctgaggtgcaaaatgcattagataatctttcaagtgtaacccacaagttgaaggaccttgaacttcagatgttgaagaaagatgagagtagaaactgccttcaaaatgatctgcaagagtctaacagggaattgactatcatgaggggaaaactgcccaaagtgacagaggagagagactatatgtgggagcaagtgaaacaatacagtgagcagaatatgctgttgaatgcagaggtcaatgtattgaagaagaagatagagacacttgaagaaaacaacctcgagaaggaaggtcaaatatccatattgcaagactcccttgccaaaagatcctatgatgatctccttgggagtcctgcgcatgaatttttcagtacaaaattactatga

SEQ ID NO: 90306 - DNA, 702 bp, Glycine max
  Peptide Sequence Number=SeqID_207084
atgtctcagcagcaaaacctatcttccgtttcacaatctctgctacaacaaacaatttctggagctaatgttaaacccttctcaataagacagtgtgttcttgcttctcgtcacacaaatatccttcaaagctggccatttcatgagaagcacttgcaactgtgtcttaaccaaggtctcaaggaggtgttgccgccatttggacgccaagcttcacctgctgaatcagtccaaggttgttccaacttgatgcaatcactagatgataatgttaaagaagctgatttttgcaaagctgaagtgccacatctctatgatgaccaccctcaaaatattaaaaatgagtgcgactacaaagtcaccaagcaaccttcatcacatgaagagggaaatcagcacaagtgcagcatttcaagtacaagtaatgttcataagagcagtccaccattgccaccatccaaggcagtgaaagataaacgcagaaggtgtagagggagacgcaagaaacgctccattgtggatattttagccatggcgcggcacagtactttagaggagatccatgggatgaacaagttttattatgctgcaactgtgattgaaggatgtcagcaaacgggagcttatgaaaatatttccaagtctgagctagcgggtgaggattcatgtagaaacgctggaagtgaagatctcgtggtgtag

SEQ ID NO: 90307 - DNA, 189 bp, Glycine max
  Peptide Sequence Number=SeqID_207085
atggccattgcaacggtctgtatgttccatgctgggaaggttgaaaagactcctcatccactaaaggatgctattcttgtttcttatgagatcattcacaagaaggatcctgatgctgcacagaggataaaacagaagcctaaggtagtggcgatgtcatacgcaaaaaggaagagactccaagaatga

SEQ ID NO: 90308 - DNA, 282 bp, Glycine max
  Peptide Sequence Number=SeqID_207086
atgaggaatgaggatagaaggaaaagttttttttctgggcagaaattggtcctgtatgctacattctttggtgtatggagaagatatggtttgacagtagaggattttaatcttgcacatcgcattgttcagcccatttttaggactcaaacaaccatgtactatatggattccctaaatccgacagttgttgatcatatacatttggccaacttggaggaaaagttgtttgttgctggcagatctaatggaaagccatacaaagctatcagagaagtataa

SEQ ID NO: 90309 - DNA, 1230 bp, Glycine max
  Peptide Sequence Number=SeqID_207087
atgggatgtctttttgtgcgtctatatgcttctgtatatccttctcaattcttgtgggtattttctcttgcagagggaagtgaagtagaaggaagtgcaggaggaacaagagttgcttcaaaggctccttctgcaaatgaggagcaagcctcaaagcaaatatcatctcaagccccccagcacaaatctgtagacacaactgcgataccacaaagaggaactaagaaccaaagcaacgatgggagtgtagaaatgggcagtgacatcactgatcacaacttggatattagggagtcacataatttagaacagttgactcatcaagataacaagagacaagtgtcaaatagatctaaatctagtactcaacgtgaccaagacagaattgttgggactaagcagggtgcagaggtaggaaggagagatgaatctgcattaaacaattctggcagcaatgttggccgaaatctggagcgtcaggaagttccactaggtcattcacccaatgaagcaataaagattgacaaggataagttaaaggcactggcagctatgggagagaagagaaaggaacaacgaggcgaaatggcattaaagaaacatgtaatggatgaggattatctcattgagagggagctggaaaatggaattgaattagcagtcgaggatgacaaaataacatattggatttggatcaacctcatccagttcaatggaagaaggggtagggctacaatgtcaaagagcagaggttcaatgttgaatgtcaaagaaaggaccaagcagaaaggtgaacaaacatgcgctagggttcaaagaaaggagcaagcagaaagcaccactgtctgtcattcttccactattggagaaggagatgttgcgattgttaatccaacctacacccaatggacattacaagatcattatgcatttgtgacactccttgggtcctataattctgatgcccaaatcgttatgacttatgcaaaatcttctaccattgcatggaatcgattgaacaagcaatatgtcaattgttcccgcactcgtgttatgtctctcaaggaacgtcttgccacaattactaaaggcacgtctagtgtgagtgtatacttgcactccatcaaagtaataactgatgagcttgctcttattggtcatcccattgatgatctcgatcttgttattgttgccctcaatggtcttgggcaattatctcgtgaattctaa

SEQ ID NO: 90310 - DNA, 174 bp, Glycine max
  Peptide Sequence Number=SeqID_207088
atggaacgagaggaaaagagaataatgatccagagggaatggaggaaggaattagggcttcctgtgaccctgaatgccattgactccgactcaaggttcctttctgctttttcgatggttccaccatttgaggagtttttcgggatttcaatcggttcaaatgaaagagattga

SEQ ID NO: 90311 - DNA, 669 bp, Glycine max
  Peptide Sequence Number=SeqID_207089
atgacgaggatgcaggacacatgctgtaaccacaacacctgtagctgctgcaatagcagacaaagtgaccggcgaaggctacttttgcgtgggctaactcaatcattgcctgaaattttgcccctattatacactttactagaaaggcactttacagctgcaatgaatgaagctggtaggaaacagatggatattgccaaacagcatgctgccactgtaacagctactctaaatgctgtgaatgcatatgctgagtgggctccattgtcagattttgctaagtctggcatcattcatggttgtggtgtactactatctgcaccggattttcgtcttcatgcttcggagtttttcaaacttgtctctccaaggaagaggcctattgatgcatctgcttctgaatttgaccaagctatgagcagcatctttcaaatattgatgaatgtatctagagaatttttgtatagatctggttcaggtcctgggtccatggatgagggcgaatatgaatttgctgaatttatatgtgaaagtatggtgtcgctgggttcttataacttgcaaagtattgctggtgatagcaccatacttccactttaccttgaacagggtgatgctgctcctctcttctccattttgttaggtcaggccatggctggagtggcgtga

SEQ ID NO: 90312 - DNA, 330 bp, Glycine max
  Peptide Sequence Number=SeqID_207090
atggggaggggatggagagttcgtgagcaaaaagggagagggacgaggagtgagcggcagcaagtgaatcagggacggagaagagccggtgaggcagagtttttcgtccaatgtccaacggagacgcaccatcatggaggcagagctgttgctccactgctgcatccaaagtctgaacttgcatcacttctttcctttcagactaaagaggagaataacaataggagctacttctcacatatctatgatttttgttatattggtgcatatgggagctattaccccaatgtaaacagctgtaaactaactgcatatggcactttatcatga

SEQ ID NO: 90313 - DNA, 984 bp, Glycine max
  Peptide Sequence Number=SeqID_207091
atgtcggcagtcatcctgctatcttgctatagcggttttgggatcggctgctccatgccattatctgggataactatgcactatgttgctatgcatgaaatgctgggatttttccaacatttcaagtttggtattcattttcaatccatgcacttctggctggtgctaatgagggatttgatgtcaaagccaaaaaattccacacattcagctgctgacagttcagctgtgagtagcacaggttctggagaagttgaaaatgctaagaaaaagactctaagctttgtgagtgatgatttttgtggtgcaattttagatacatctttccctcgcatgctcaagagagagaaaattctgcatgagactgccatttctttaggggcattagagttgtggagtgacgattttgagggcaagggaactttcagccagtatcgttctagactgttggagttgattaggtttgtttccttttacaaacccctgatagctgctactaaagtttctgaaaaaattgatacaatcatcaaaggtctcttgctttcatcagcaccaactcaggacttagctgtgatggaaagcatgcagttggctttagagaatgttgtaaatgcagcttttgatggatcaaatgactttaccaaggcaaatgctgaagttcagttagcattatgtagaacgtttgaaggtttacttcaacaatttatttccttaaaatggacggagcctgcacttgttgaagtacttgttcactatttggatgctatgggcccctttttgaagtatttcccagatgcagttggcagtgttatcaataaattatttgaacttttaacatctattccccttgtaatcaaggttcccgcaacaactccttttcatgatatgtcaatgcataatgcacggcatgcaaggctgcagacctgtacatcatttattcggatagcaaaaactgctgacaaaagcatcttgcctcatatgaag

SEQ ID NO: 90314 - DNA, 954 bp, Glycine max
  Peptide Sequence Number=SeqID_207092
atgcatctccaaggtttggcctatggtgctatactgttagtaggtattgctgatacaatgggatgtttgcaaagggagggtcgtttgcttcagggagagcataatcttttaggtgaagcttttcttgttatggcttcttctgctgggatccaacagcaacaagatgttttaaggtggttactagaacctttgagcattcagtggacacaatcggagtggcaggataaatatttgtcaggtccacacggtttggttcagttgtgctcagatgcgcctgttatgtggtcaatttttcatacattgacattctttgagagggcacttaagaggagtggattgaagaaagccaattggaattcagaaaacagctcaacaccaaactcaactcctttaaatccaatggcctctcacatatcatggatggtgactcctctcttgaaactactgcgctgtatacattccctttggtctccatctgtaagtcaagctttacctggtgaggtcagagctgcaatggtcatgggtgatgttgagaggttcagtcttcttggagaagggaactctaaattaccaaagggtgtcacagatggatctaaggttgacatgaataaagaaggatatgctgaacccaatgaatcagatatacgaaactggtttaaaggcatcagagacagtggatataatgtattgggtttgtcaacaaccgttggggattcttttttcaaatatttggatgtgcactctgttgctgttgcactaatggagaatatacagtcaatggagttcaggcatataaggcagcttgttcattccactttgattcctttggttaaaaattgtcctttggatatgtgggagatttggctggaaaagcttctacacccattgtttgtccatgctcagcaggcacttagctgttcatggtctagtcttctacaagatggtagagcaaag

SEQ ID NO: 90315 - DNA, 1385 bp, Glycine max
  Peptide Sequence Number=SeqID_207093
actatgctgcaaggattgataatttccgaagctacgacactgtcagcaaggatataattcatcgatggacatatccactggtgccagatgtaatgaattttggcgacacagctactaaacttgaacgacaaggaatataccgtgcttcgggtatggatgaaaattttgtagtgtatattgggaatgctgaaatatcacaatcacagtctgctgttattggccctttcactgtcataggatctggcaccaaaattgggcataacactaaaattttaaattctgttattggtgaaggatgtaaaattgggtcaaatgttatcatagagggatgctatatatgggataacatcagcatagaagatggctgtaaactccagcatgcaattgtatgtgatggggtgattataaagtcaggggctgttctggaacctggtgttattttgtcttttaaggtcgtagttgggcctgagtttgttgttcctccatattcaaatgtatctctgttacagcagccgattgaggaagacagtgacgaggagcttgaatatgctgatagtactagtgtcataggcagccaagtggataaatcagatgtagagattgcttccaaagtattggagacacattttagtcctgcctcggagttgggtatgggtggggctggtcatgtgtggtcaacatgtgaaggaagccatgaagaagagtggaggcattcggtggcgcctattcctaaagataaagttatggaggcaattaaaactatgaaagatgatctggagaatgatgatagttttcttccaccttctggagaactgaaacctaattctaattattcagatgatgatgatcatgaagattctagagatgactcttactactttgagaaagaggttgaagcaacctttctcagggctgtgcatgaaaacatacaagaaagccatttgatcttagaaatcaattctttgaagttgtcatacaataagctagctgctgattgtgctggagctgtattttctgccatgatgaagtatgctttagacaccccccatagttcagctgatgttttgcttcaaaatgttcaggctgtatttacaaaatggaaaaaggctcttacatcctatctgactgacatagatgagcagatcgaagtaatacttaaatttgaagaaatatgtgaggaatctgctaaggaatttgctccattgttcacaaggattttgcactacttgtacaatgaagatgttgtagaagaagatgctattttgagttgggaagccgagttaaaagatgctgacgaggcagataaagtttttgttaagcaggcccaaaagttaattcaatggctaaaagaggcacctgaagaagacgatgatgacgaggaatag

SEQ ID NO: 90316 - DNA, 1629 bp, Glycine max
  Peptide Sequence Number=SeqID_207094
atgggtggtgaattaagttacgtgctttcaaaaatggaaatgctaacttcagatcatgcctccgttgtgtccatgaacattttcgtggctctgctttgtgcttgcattgtcattggccatcttcttgaggagaatcggtggctgaatgagtctatcactgcccttttgataggtatttgcactggggtagtcattttgttgttgagtcgcggtaaaagctcgcatcttctagttttcagtgaagatcttttctttatataccttctgccacctatcatatttaatgccgggtttcaggttaaaaagaaacagttttttgttaacttcattaccattaccctgtttggagctgttggtacattaataagttgtagcatcataacttttggtgtcacgcaaatttttaagagaatgggtgttggtaaatcactggatatgggggattatctagcaattggtgcaatatttgctgcaacagattctgtctgcacattgcaggtgctaaaccaggatgagacacctttactgtacagtcttgtatttggcgagggtgttgtgaatgatgctacatctgtggtgcttttcaatgcaatcaaaagttttgacctcaacaaaattgaccacagaattggtttgcatttttttggcaacttcttgtatctgtttaccacaagcaccttgcttggggtcttggctggtctacttagcgcttacattattaaaacgctgtatattggcaggcactctacagatcgtgaggttgctcttatgatgctaatggcatacctttcctacattctggctgaattatggtatctgagtggcattctcactgtattcttctgtgggattgttatgtctcattatacttggcataatgtgactgagagctcgagaataactaccaaacatgcttttgcaactctctcatttgttcttgaaacctttatcttcctttatgttggtatggatgccttggacattgaaaagtggaggcctaaaacatctgttgctgtgagttcagttttattgggtctagtgcttgctggaagagcagcctttgtttttcccctatccttcttatccaacctcactaaaaagacgcaaagtgaaaaaataagtttcagggagcaggtgataatttggtgggctggtcttatgagaggtgctgtttcaatggcacttgcctacaatcagttcaccttgtccggtcacactgaactgcgaaccaatgccatcatgatcaccagcaccattactgttgtgcttgtcagcacaatggtgtttggtttgatgactaagccactcataaggtttttgctgcctattaacccccctcctaaacgcaaaaacagcatgtcagatataggttcatttaataattcccccaaatcaatcactatgccctttcttggaggctcccaagattctgaaaacgaatttgatggcagtgaaaatcaacgtccaagcagtattcgtgccttactaacaactccaacacataccgttcatcaactatggcgtaattttgataattcatttatgcgtccagtttttggtggtaggggatttgttcctgtagttcctacctcaacaaccgctcgcaccattaatcaacaatggcattaa

SEQ ID NO: 90317 - DNA, 1263 bp, Glycine max
  Peptide Sequence Number=SeqID_207095
atggatttgaaacttgctcaagaaactgtagtcatggcaacaccacttgtttatacacttgtttcactgcctttcatatttcatttctccttaaccactgccaccatcacaacctcaactattaacctagtgattaagctcatacaccatgaatcatcattatctccctacaattcaaaagacaccatttgggatcattactctcataaaattctgaagcaaacttttagtaatgattatatctccaatcttgttcctagccccagatatgttgtgttcttgatgaatttctccataggtgaaccacctattccacaacttgctgtcatggacactggcagcagccttacatgggttatgtgtcatccttgttcatcttgttcacagcaatctgttccaatatttgacccttcaaaatcttccacatattctaacttgtcatgcagtgaatgtaacaaatgtgatgtggtgaatggtgagtgtccatacagtgttgaatatgttgggagtggctcatcacaagggatctatgctagggaacaattaacactagagaccatagatgaaagcataatcaaagttcctagtttgatatttggatgtggtcgtaagtttagtatatcatccaatggatacccctaccaaggaatcaatggggtgtttggacttggtagtggaaggttttctttgctacctagctttgcaaatatgcaaggtgactcaactactttgaatgtgatcaatggtttgtattatgttaatctagaagctataagtataggagggagaaagcttgatattgatccaacattgtttgaaagatcaataacagataataacagtggagtgataattgactctggagccgaccacacatggcttacaaaatatggatttgaagtgctaagctttgaagttgagaatcttcttgaaggggttttggttttggcccaacaagataagcacaatccttatactttgtgctatagtggtgtggtaagccaggacctaagtggctttccgttggtgacatttcattttgctgagggtgctgttttggacttggatgtaacaagtatgtttattcagaccacagagaatgaattttgcatggctatgcttccagggaactattttggagatgactatgaaagcttttcttctattggaatgttggctcaacagaattataatgttggctatgacttaaataggatgcgtgtgtactttcagaggattgactgtgaacttcttgatgggtga

SEQ ID NO: 90318 - DNA, 672 bp, Glycine max
  Peptide Sequence Number=SeqID_207096
atgaagaatgttggtcctgttggcccattatcgaagttcgggtgttctgttccagcaagcagaagcagaagcagaactcaggtagcgtgcggttgttgggggaaaaatagaaagcgatggcgaatcagggtgctaagaaacgcaaggaagagaacgctcgtcacatggcgaggctccgccaaatcatcatcgcctgcaacaatgttggtgttccattcgagcttcacctggaagcactggattgggttgattgtgacttctttggcatatgttattccctatcaacagctcgcgaagatggcaacccctgcttacgctgaagatggtgaacttttagatggtggatttgatatgtctactggtggagtttgtgggtatttacatgatgttatctacataacatgctttgtgcaagtcatgtccatcgtctctggaaagttctggtacacatatcttgtgataccggcttttggagcatacaagtcctttggtttcattaaaggatttttgccagggggttcagaggtacggtcacctttgttgattaatgtttactttaagaccacatatagaaccatggaatcatttgaagatgaaaagacccggaagaagagggaaaagatggagaagaaggcatcgagacccaagtttgccaagacaagaactagatag

SEQ ID NO: 90319 - DNA, 1024 bp, Glycine max
  Peptide Sequence Number=SeqID_207097
atgggtcaagaacctccacaatctgtgagaggcatgccgagtgttcgatcatctgcctcttcaaatgctctagctgagcaacctccacctcgaacacccactctaacgaataacgcagagcaacaaccgccttctgctcgtttaacgccaggaaaccgaaccctggaattgtctccttccgctcgcactattataattacacggtcgcctcaacccagcagtgccaacaatgatcagcctccctctgctcgctcaacctcgggccgtcccagtggactttctaaggtggttcccatggtgccacctagtgtacctattacactcagaccggtctcctctgttggtgttcctccctctgagcctcttcttgatattagaaaagacagaaggcatgctgctgctactgtaagggaaaatgccaatcagcagcagcgtcctaccagtgagcttgaggacgagcttcgacttgcagaagagaagtgtgaagaagctgaatcaagagttaggcaactagaacaacaggctgctctgagaaatgcatcaaagaatcatggaggttttcaaacagcgcttcaggcggatgctgagactgcaagggaggagaccgcgtctgctttcgaaaaactacggcttatgactcaacgaatgatactcaccccggaagaaatggaagaggttgttttaaagaggtgttggctagctcggtattggggtttatgcgttcgacatggtattcatgctgatattgctgaagcaaaatacaaatactggtctatgttcgccccgaatccgattgaagttgtattagcagcagcaaagaaagctaaagaggaaaaagacctcgatgtagaggatacagagggtcaacttgacctgaaggaactttctggagagggaaatattgaaaacatgctttttgttgagcaaggtttgcggcaattggcttcactaaaggtagaagaagcattggcggttgcattggctcaacataggcgaccaaatatgttgaaagctggtttttcag

SEQ ID NO: 90320 - DNA, 435 bp, Glycine max
  Peptide Sequence Number=SeqID_207098
atggaagcattcagggctgcatccacgtcacagctcccagcgtctaacatggatcgccggagaatatacgataggcagaacagctcttcagggacgccgtcgtcgccgtcttcgccggtgaatatgatatcgcccctgcaccgccacgcgcgtgcgggttcgaccggctccgccatgaccaacgtccggagagctcagaacaacgccaccaaagccgccgcgcagagactcgcacaggttatgtcgcataccgacgacgatgacgaagacgaggacgacgttcctctcgactattccgcaatcgccggcggcggaggcattggcctcggcggcggaagaccaatgccagctcgctctcccatggcagttcggagcgttcaggatgctgcatctgcaaggtctcggtcaccattggtaatttcgtttctcagctag

SEQ ID NO: 90321 - DNA, 375 bp, Glycine max
  Peptide Sequence Number=SeqID_207099
atgggtagtaaccaggtgtggaaacattctgttatggtttgtgctgcaatcacaacacaccaatatgtatctgctgagcagattgtgaatggcatgcatcaggcaaaggcagaaggagctgatatagtggagcttaggcttgactgcatcaccaatttccactctcaccatgacctcaaaatcattctccaaaataagccactacccgtgcttattgttaaccgaccaaaatgggaaggtggtttgtacgagggcgatgagaacaagcggttggaagcattacagcttgctgtggaattgagtgctgatttcatagacgttgagctgaagttattcaggcagcttcttgtcttccaaccttggtggaacatatga

SEQ ID NO: 90322 - DNA, 939 bp, Glycine max
  Peptide Sequence Number=SeqID_207100
atggttcgggaagtatcagagagttgcattgatagcttattgacggagatggtggcgtgctattgcaaccgattctacgcaaacaagcctgaactcgccgcacgccggatcgaggccattggatatcaggtcggtcaccagctctctgaaaggtataccatggatcggcctcggttcacggatcatctggaggccatcaagttcatctgcaaggatttctggtctgagctctttaagaagcagattgacaacttgaagacaaaccataggggtacatttgtattgcaagataataaatttcgctggcttgcacggatgtcaattgatccatccactgaaaatgttagtccagttgaagatattacttcacctacagctgaaagcaaggcagcacaagcaatgagcatgcatctttacttcccatgtgggatcattagaggagctctttccaacttgggaattccttgtgcagtttctgcggatatatcaaaccttcctgcatgcgcagattctatggagtacgataacatcgaattattggactgtggaaagacggagaattccaatcattgtaatattgttgctctttttgtgtggctggcaactttgttctctcttccacgcaaatccacggtgaccactaaagggatcttgagaacattgtgttcttcctctgatccacgtgtgaggcaagtgattcatgtgaatctccaactgttcgcggaactcggggcgcacgacggcgaggaactctctccgacgccttccaagtccatttgccacggcgctgcgttggttctccaagcccgcgacgaggccctcatgggcgtgtgcgatgcgtggcactggttatggtgtttgaggaggtgcggtggtaacatggttgatgattgttgggttatggtgtttgaggaggtgctcacaaatgacgaaaaatga

SEQ ID NO: 90323 - DNA, 939 bp, Glycine max
  Peptide Sequence Number=SeqID_207101
atggttccacagtcagtgataacgcaagtctccgattcaagtggcgtgaatgcgatatcaaacgtttcttctggccacggattctacgattggttgttcgaatgtcacgggttctggcacaatgccactctcaacatcccctcgttcctcttcgtcttctacttggcacttcaagccaggcacagcttactcaaactctcccttgcgcgctcctatataatcatttcatataacctttgcctctggctcattactctgctcaatctcgcttggtgctttctccagcaccatctttatgctttggaattagtacctagaatacctactttagtccttacagattcacttttgatagttttaataggcatgggagtgcacgtctgggagaaagttgacatggaacctgttatccttgttcactacttccggaatgctgtttttggaagcggcttagatgcaatgaaacgaacttttggtatctcaacgctcgttgttggcttggatatactgttgaaggcaatatatctatttgtatttgggattccattattcgtcgacagcaatgaacatactcatgggaagtggaacttgtgggttgtccacaagctgttgctcactgctgtttatggcttcataatgtttatataccattccggatggaaagaaacgttgcctgcaaaaattgccttttacaagtatgttgcaattatgttcatttttaatgcgattgcgacacttgcttgtggccttgctggaactggtgctgcgtttgctttctggctgtatcgtgtcacggttgtcttctaccatgcattttatcttccttttttgtatacaacattcctagcagacttttttcaggaggaaaatttccatttggaaaatgtgtattattccgagatgaaagatgcaggtttctttgacacggactgggagtga

SEQ ID NO: 90324 - DNA, 315 bp, Glycine max
  Peptide Sequence Number=SeqID_207102
atggtggatttatgtgggatttgtggatgtggagagtcgacttgcaccatcgcccgatcgccacctagaaccacatatgaaggagtggtacctggagatatgtcgtgggggtcaagagaccttggggatgtcaggtggggtgctattgcccaaaaccaagcttggccaatcccgacccaacccgggcatagtcagtcagtgagaacctgtgacgtacctaaacaggcaagctcctggcagtcaaccgataaaagaacaaagaccacaaagaaaggaggcttgtgtggtggctgtccagctatggatcttgagtga

SEQ ID NO: 90325 - DNA, 306 bp, Glycine max
  Peptide Sequence Number=SeqID_207103
atggtgcagctatggtttgggattagggtgaaagaacccggtggaccattcggtcctgccaacaaatcttatctggagccccatgaattgattgtcattcatgcatcctccaccatcgagtccggagccccacgaatttattgcccagcgctgttcgtgcgtcctccaccatcaagtccggagccctatgaactgattgtcattcatgcatcctccaccatcgagtccgaggccccacgaattgattgcctagggctgttcgtgcatcctccaccaacgaatcttatccggagtcccatgaaatga

SEQ ID NO: 90326 - DNA, 481 bp, Glycine max
  Peptide Sequence Number=SeqID_207104
atgtcatcggactcaccgtctctggatgacaaaggtgcagatgatggcgttagtctcggcgtgctatcgtgctctggattgatggtgcatggtagacgatgtaagtctccgtgtgtcaacgggctcactttcctctggttgacaaaaggtccggataaccataagttgacgaaaggtgtagaagacgacgttagtctctgcgtgctatcgtgctctggctctgatggagagcaaaagaatgtttatatggataaccatatgggtatttctgcctaccccttaacttcacgggtgcggataaccataaggtacccccgcatgtcatcggactcgtcgtctctggatgacaaaggtgcagatgatgacgtgcagaagacgacgttagtctctgcgtgctatcatgctctgggtctgatggatagcaaaagaatgtttatacggataaccactcgggtatttccgcctgcccctaactgcacgg

SEQ ID NO: 90327 - DNA, 1093 bp, Glycine max
  Peptide Sequence Number=SeqID_207105
atggagaaagtaagagtacgttttgctccaagtcctacaggacctttgcatttgggaggtgtaagaaccgcattatatgattatcttttcgctaaaaatcaaggtggcgagtttgtattgagaattgaagatacagatacagcaagatatgtagaaggtgctgaagaatatattgaagaagctttagaatggtgtggaatcattccagatgaaagtcctaaaaaaggaggaaaatacgctccttatcgtcaatctgaaagaagagaaatttacgacaggtataccgagcagatcttaaaaacggattatgcatatgtggcttttgacactcctgaagaactggatgctatccgtgcagaatacgaaactaaaggagatgttttttcttatgataacaaaacaagaaatcgcctgagaaacagccttgcattatccgaagaagaagtacaaaaacttttggatgaaaaaacaccttacgtggtgagatttaaaatgcctgtcgacagaattttaaatcttgaggatattatccgtggtaaatcatctgtaaataccaatactttagatgataaagttttggttaaaaatgatggaatgcccacttatcactttgccaatgtaatcgacgaccatgagatgaaaataactcatgttattcgtggagaagaatggttaccttctttgggcttacatactttattatatgaagcaatgcaatgggaagctccacaatttgctcatctttcacttattttaaaaccagaaggaaaaggcaaacttagcaaaagagatggtgataaattcggatttcctgtatttccgttagatttcaaagatcccgaaaccggaaatatctccaaaggttacagagaaaacggatatcttccggatgcatttattaatatggtcgctctcttaggatggtcccctgctgatgataaggaaattcttccattgaaagaaatgataaaagaatttgatcttcataaagttcataaagcaggtgcgagattcagtaaagagaaagcggagtggttcaaccatcaatatattcagttaaagtctgataaagaacttcttgacattttaaaaa

SEQ ID NO: 90328 - DNA, 681 bp, Glycine max
  Peptide Sequence Number=SeqID_207106
gaaaagcttggaccatctagacctcagggtaaaagtcttggccggacatacgtggtggttgcttgcggtgggcgcatcctcttggggaaggggcgttgctggcggagggcctgcttcctgggggcgtctgcgtggcgcccgcgggttcggggcgggcgcctggggcgccgggtggttatttcatcggggccttgtcctgggagacgtccatgatcatgcgggcggccaggtagaggcgggggacgatggaggggatctggatgtattcggcgtcgttggagtgggcgccgaagccgctcaggcccatgccttcgatgacggggccgcgggccttgagggcggcgaaggcggcgtcggtgccgccgccgctggcgcggtcgatgactttcatgggaaggccgagttcctggtagatggcgacgccgtggttggcgagggcgcgcgaggcgggggtggcttccagcggcgggcggcgcacttcaaatttgacgctgaccttggcctcgggcagcagtttcttctggatgcgttcctgcaaggtgcgttccagggcgtcgaagtcggcgaccttgagggcgcgggcgtcgggctgggaggtgccctgaccggggatgacgttgcggttggcccggcctgggccacggtccagttcagtttcaggccttcctcgggcttggagag

SEQ ID NO: 90329 - DNA, 566 bp, Glycine max
  Peptide Sequence Number=SeqID_207107
ggggattcgcctggggagcggttgcattagtccacatgtacgagcatctgaacgacgcgtcacaggcctctacacgtgctggatatacgagcactttcctacagtgcatacatccgtcgttcatgatgcttatgatgaggagagcccacgggcctgcaggtggcttacggggagtcaaaggctttgacttgatatcgtcgtacactggtcagctcagatggggtcagattgtggtatacattcgacctgagcaggttcttcgacagtttggctaccttcagacggtccctctgccaccggtttgtgattctttgacgggtgatgatatagatgaccggtggctgcatttttcagaccatttggtgccttcaggggagctctgtgtagttcctggacaggtggcgccagactacatggagtggttttttcggatattgcacccattcgtcatgtggaccgaggagactgctacgccgagacatccgcctccccctcatcatgaggagttcgtcgagccacccatccccgaggtttcagtcgcgaccgatctccctacgcatttagtg

SEQ ID NO: 90330 - DNA, 405 bp, Glycine max
  Peptide Sequence Number=SeqID_207108
ggccctggggtttccggcgttgatcacgggcctctgccagtcattcggggttcccgtcacccctagtaaattgatccgaccgccgatcacccgggccttcatcgagaagtactgcacgcctaggcaggtgcagggtgatgcacatcaggccgcagccaaccactgtgggcaagtgcagatacatgagtgtgtctaccggttcagcctcagtcagcaggggcagggttccgctccttttgcatgccctactccagagctgtttggggttgaggtcacatggcccggagactggcccgaggcccaggcaggggaggagcctgcaggatcccccagtgaggcagaggaggcccgtatggatgaagatatgattgacttgctcggtttcttgggaggaagcggagccac

SEQ ID NO: 90331 - DNA, 156 bp, Glycine max
  Peptide Sequence Number=SeqID_207109
atgattcaaacaaacattcaagctttgagttcggattctaggcaccatgaattgatcttgatggatgcaaagagttttgatatgattggagctattgatgataacaaagaaacattcaagcttggagttcggattgtggaccgatggtttgactag

SEQ ID NO: 90332 - DNA, 294 bp, Glycine max
  Peptide Sequence Number=SeqID_207110
atggggagaagagaagaggaatttcgttcagccctccttgtaattcaagaatcacttgaaattagtgaaaaaaattggttccgtgaagaaaatccgagccgaggcgcttccgtaaggtttccaaaacatttccgtggggattttcgcgaagattttcagccgttcttcaacgttcttcattcgttcttcatcgttcttcggtcttcaacggaactacgtaggtctgatttccttatcgcaattaaggaatacgtaggagcaagggaaacaacctcgtcgactgcaaaaagataa

SEQ ID NO: 90333 - DNA, 1003 bp, Glycine max
  Peptide Sequence Number=SeqID_207111
atggcagttgaagacagagaaaagacatctttcatcacgccttggggcaccttttgttacagggtaatgccttttgggttgataaatgcaggtgccacttaccaaagaggcatgaccactctctttcatgacatgatgcacaaagaaatagaagtgtacgtggatgatatgattgttaagtcaggcactgaagaagaacatgtcgagtacttgctgaagatgtttcaacggctgagaaatcagaaaggtattggagtagatcctgacaaggtcaaggctattagagaaatgccggttccacaaacagagaaacaagtgagaggttttcttgggcgtctaaattacatttctcgtttcatctcgcacatgacagccacgtgcggacctatattcaagttgcttcgaaaagatcaaggggttgtttggaccgaagattgtcaaaaggcttttgatagtatcaagaattatctgctagaacctccaattcttatacctccagttgaaggaaggcctctgattatgtacttgactgtgttagaagattctatgggctgtgtgctcggacaacaggatgagaccagaaagaaagaacatgccatctactacttgagcaagaagtttacagattgtgagtccaggtactccctacttgagaaaacttgttgtgcactagcctgggctgccaaacgtcttcgtcactacatgattaaccacaccacctggctaatatccaaaatggacccgatcaagtatatctttgagaaacccgctctgacaggaagaattgctcgttggcagatgttgttatccgagtatgatatcgaataccgcacccggaaagcaattaagggaagtgttcttgctgatcatttggctcaccaaccaattgaggactatcaacccatcaagtttgactttcctgatgaagagattatgcacttgaagatgaaggattgtgatgaaccattgcttggagaaggtccagaccccgagtctagatggg

SEQ ID NO: 90334 - DNA, 318 bp, Glycine max
  Peptide Sequence Number=SeqID_207112
atgcccggcttggatccccgtattgtggagcactgtttgcctttgaagcccgaatgctcaccggtcaagcagaaactgagaagaactcgccctgacatggctctcaagatcaaagaggaagtacaaaagcagatcgatgcaggtttccttgtcacatcagagtatcctcaatggttagccaacatagtgcctgttccaaagagggacggcaaggtcaggatgtgcgttgactaccgggatttgaacaaggctagtccgaaagatgactttcctctacctcacatcgatgtattggttgacagcgctgaagaggcatga

SEQ ID NO: 90335 - DNA, 250 bp, Glycine max
  Peptide Sequence Number=SeqID_207113
ggccctggggtttccagctctggttacgggcctctatcagtcctacagggtgcccggatcgcgcccacaaaaaacccagtggacccggaaaagtccaacagggccctggggtttccagctctgattacggccctctgtcagttctacggaatgcctggcgaaacaccacaacagcctaaggatggctgggagcgggcaacaaacgcaccgccaccacctctagagttcatctcaactcatccacaaaaag

SEQ ID NO: 90336 - DNA, 417 bp, Glycine max
  misc_feature (400)..(400): n is a, c, g, or t
  Peptide Sequence Number=SeqID_207114
atggctgggtatttcacttttgcttccggagttcaaatgccaaaccttttgaatgaaaccgcaggccttctggcatttgtgcgcactgtggaagcaggttccttcagtgcagcagcccggctgctcaaaacatccccttcagttatttccagaagtgtcggacgacttgaaagactcatcgaagcgcgactctttctaaggtcgacgcgtgctctcgtactgactgcagacggacatttgctattcgagcgcctgtctcccctgcttcgcgaactcgatattgccgatgatgaaatcaatgcacgcaaggagatatcaggtcgtgtccgcttctccatgtctagtgaacttgccccgctgttccttgacaccatattgtccggctttgctgcgcgttacnccgggaattcatcttga

SEQ ID NO: 90337 - DNA, 352 bp, Glycine max
  Peptide Sequence Number=SeqID_207115
atgggtcttctcaaagacaaggtggccgttatcacaggcggcaacagtggcatcggtaaagcaactgcaaaactattcgtggagaatggagcacaggtcgtcataactgctcgccgacaggacgctctaaacgcagcactgaaagacatcggcggaaatgctattggcatttgcggcgatgtctccgatctttcccaccataaacaggtggcagatgagatctccgatcgcttcggcactttcgatatctattttgcaaatgccggtgtcatcgaccttaaagcgtctgaggcagtgactgaagatatttatgatcgacatttcaacatcaatacaaaaggcgtcttcttcg

SEQ ID NO: 90338 - DNA, 207 bp, Glycine max
  Peptide Sequence Number=SeqID_207116
atgtttggcgaaggaatcaattgggaaaataacaaagaccacatttcccagtcaagaggatccgcacttgacggtggaggacacatgaacagcgctagacaatcaattcatggggctccgaataaaaggcgagaatggagaattgcactaggcaatcactacgcatggctccaaactcgttggtggtggaatcaatcgggaaaataa

SEQ ID NO: 90339 - DNA, 462 bp, Glycine max
  Peptide Sequence Number=SeqID_207117
atggctccaaaaaagctttccaccaaaaggtctaggagagccgccgtggcggaagtgtccagtgccgcccccgagtttgatagccaccgtttccggagcgttgagcactggcagcacttcgaggccatcaaaggatggtcgttgcacagagagaggcgcgtccaactcagggaggatgaatatacagattttcaggaagagatagctcgcaggcattggacatcgctagtgactcccatggccaagttagaccctgaggtagtcctggagttttatgctaatgcttggcccacaaaaggagggagtgcgagacatgcgttcatggcagatgctctcagccagttcctgggtgacccgctagttttggaggaaggccagcagtgcgagttcagtcagaggagaaacaaggccgatgagttcgacgaggaggccattgcccaactgttatgcacaccggggtag

SEQ ID NO: 90340 - DNA, 408 bp, Glycine max
  Peptide Sequence Number=SeqID_207118
atggtgcacactcctaatgagaatgtcaatgactccactcccatactcattaagagccaacaacctcaatctgatcatgcacctatccctcaacctatgggggcgacacatgaaataccccaccacaatctagccaactttgagccttgtctcgaatacgtcactcaagggcaagcaaacatgtgcaaaaaggagcacgaatcttttaaaggatacgcccaaaggtggagggatatggcagctcaagtagtgcccccaatgatggagaaagagatgataacaatgatagtagacaccttaccagtgttctactatgaaaagatggtggattacacaccttcaagctttgcggatttcgtttttgccggcgaaaggatcgaagttagtatgaaaagaggcaaattttga

SEQ ID NO: 90341 - DNA, 302 bp, Glycine max
  Peptide Sequence Number=SeqID_207119
taggaaggtcagctgtttctctggctggtgaattaggaggggcagccgcttcatctgatgatgcatcgaagatgataatcagaggtggagatgggggaactacttcacgctcaagagaagacagtggattcaccactggagattatgggtcagcaggctctggatcaacctgcacaagtgtgggctcaggcggagcagcctcgttgggtctcaccaatggaattactaacggaggagctggagtggatgatgaagggatgtcatccgttctagctctttttctcgatgccatctataactaa

SEQ ID NO: 90342 - DNA, 162 bp, Glycine max
  Peptide Sequence Number=SeqID_207120
atgtacctcgcggagaaagcattgagctttgagcacccacgactatttcagcaccctagtagcaacagttgtaggggttctgtgggttcgagcgaggacaatgtgggtgttgagggagcggtttccggcagctttcaggcgggaggagaaagagaagagtga

SEQ ID NO: 90343 - DNA, 584 bp, Glycine max
  Peptide Sequence Number=SeqID_207121
atgagggccattaaggggatcggtgatatctattgccgacatggcgaagctatgcttagtgcccaatgtgtcatccctcccaaattcaaggtgccggacttcgacaagtacaaggggaccacctggcccaagaactacttaaagatgtattatcgaatgatgggggcatactcaagagatgagaagctcttgatgcactttttacaagagatattggtcggggtggcaatcacttggcagtatcaatacaacactgacatggctcccaatagaacccaattgcaaaacatgtgtaagaaagagcatgaatctttcaaggagtatgcccagaggttattgtcataccctaatttcgtccggggaccattgtttgatggcatgcaacctttgcttgaccgctttgagaagtcaaaagaaagcattgttgcacgatccgtgaagttccgtaacatgccggaaatcaaaaggaaacattgttacacaatccgtgaggggggtgcaaatagcaaccaggcccacttgggccttccaggaagttcctcaagaaggcatcctggaggaagcaacctagctcgcctgggcga

SEQ ID NO: 90344 - DNA, 368 bp, Glycine max
  Peptide Sequence Number=SeqID_207122
atctcgacgacggtgaaccgaccgtgattcgccgtccggagagtgaattcaccgcgctgtatcgtgaacttgcgggccgggttgccgcccagctttactggcaggatgcatcaacacgtactggccctgttcgctctctcccagcgcttcgcgctgccagccgtgctgctgataaaactgcagcgccgcttcgttctgtagcagacatttcagcgcgccagtggagcaaagcctgcgcggtggccggcgatctccgccaccagtaccgtttcaccgggaataatcgcgtcgaaatcttccagctgccagtcgtcgccggccagccatgtccagttatgacggcgcgccgcgagatacagtgtgcgtaa

SEQ ID NO: 90345 - DNA, 585 bp, Glycine max
  Peptide Sequence Number=SeqID_207123
atggcgatcattattccattgctgttgctgacgcacctgccctacgcgcgctatttcgccggcagcgcgctgcttaatcagctgctgcagcccgccgtggtggcgctggcgctgccgctgtatgagcagatgcaccagattcgcgcgcgctggaaaaccatcattagcgtctgttttatcggtagcattaccgccatggtgtccggcacggcgatcgcgctgtggatgggggcgacgccggaaatcgcagccaccatcctgccgaagtcagtgaccacgcccatcgccatggcagtgtcgggctcgctacacggtattccggccatcagcgccatttgcgtgttgattgctggcgtgctgggcgcggtgtttggtcacatgctgctgaatctgtttaaagtgcgcagcaagtcatcacgcgggctggcgattggcaacgcgtctcatgcgctcggcaccgcgcgcgccgcggagattgactatcaggaaggcgccttcagttcactggcgctggtaatctgcggcatcatcacctcgttactggcgcctttcatttttcctttgctgatgcgcttactggggtaa

SEQ ID NO: 90346 - DNA, 831 bp, Glycine max
  Peptide Sequence Number=SeqID_207124
atgcccgaggccgagctcaagcagtcggagttcttccgcaatttcctggagccggtggatgtgtttcacatcctgggggtggacatcaacaccaacgacggcgcccagtgccgcctgcgtatcagccgcgggcgtgacgatgcgcccttcgtcgaatcggaaaaacacctgctggcgcggttcatcccgcacctggaacgttcgatcaagctgcacatgcagctcaaccgcatcgagactgaacgcaacctgtatgccggcgccgtggaccagatggccgtgggcacgatcatcctcgacgacaccggcaagcgcccgggatacccaggagtttcgtcgcctggtgcgccaggccatgctctcgcagaagggcaacctggcgtcggtggtcgaggccatgcgcgtcaagcgcccctccgggcgtgccgacctgggcatcatcgtgcgttcagtaccgctgtcggcctggagcgagggcaaacaatgcccgaccgtggtcattttcatcagcgacccggagcagcaatcctcggcgccccaggagatcgtccgcgccctgttcgacttcaccccggccgaaacccagttggcgatgctgctggccaacggcctgaccctcgacgaagcctccgaggagctgggcatcagccgcaatacctcgcgtgcgcatctgcgctcgaccttctccaagaccggcgtcacacgccagaccatgctcgtgcggttgatcctgcgcagcgtcgccaccttgggctgaagccccgccctacccgcctgcctggccatcgtccgctcggacgatggcaggcactggctggcagcgcacagtag

SEQ ID NO: 90347 - DNA, 225 bp, Glycine max
  Peptide Sequence Number=SeqID_207125
atgtcggctgaaaaatatcagtcggggcaatttcacaaccgatgtcgtgatgaggacataaccaagggcaaggaccatgaagcacttgaaggtaatccttgtggcgtctaccctgacttatcttccttcaccggaagtggcgtcatccaaacctccgtagcctgtatcaaacgatccactcctactcaggttcacatcatttggtatcagagcttcggctcttga

SEQ ID NO: 90348 - DNA, 588 bp, Glycine max
  Peptide Sequence Number=SeqID_207126
atggtggaaccatcaaagaagcaaaaaggttcttcgagtagaagccaacgacactccgaggctcaggatactccaattccttcctccatttcctcatcctcattgttctcatcagaagaacaacgtacacggtactcaaacctcttttcctctcattctatcattgaccctaagttcatagatatggatttcttttctgatgagagtttcaaatgcattcaagcatttcataactcaaatctcattccctttatgtctttaaaattgcctgtatattatgaattggtaaaagccttttattctaaccttgaaattcaagaaagaactttgatttatgaggtctatgggataaaaatggtcattgaccaatccctattctatgatttgacccaattgtctagtgacagtctaccatttgaaggtgcactggatgatgattggaagtttgatttgtctgtgcatgatgcccgccggttggtctgcaccaaccaagtggatatgactggaaggctgcttgccggttcattggctcttgataaaagtattgttatcaagactgtaaaatgttatcaaaagaaacttacataa

SEQ ID NO: 90349 - DNA, 288 bp, Glycine max
  Peptide Sequence Number=SeqID_207127
atgggtgatcaagccacaagcatgcataatataagcacagatagaaacaatgaacacataaaaacaacttcaaatatatacttttcctctattctttgttctgcactaggctcacgtagtctattcagacctccccttcattctccgcaattcaggcttaaaaagggctttttgtccgtgaaggtgcgcttagcacgacgcataagagacaatcttctcgctgaacaagctgatgacgcgttaagcgctaagcggctgatgtctagcttagcggttgagtctcactaa

SEQ ID NO: 90350 - DNA, 438 bp, Glycine max
  Peptide Sequence Number=SeqID_207128
atggcggcgctactaatccatgatcgtgtggagatggagtgcctagagggagcttgggagaccctcgaaggcaatgcgaggtgccgatttcgaggcacgattcgattcacgactacttcattggtgcatccagatgaacccgcgcgcacgcttcagcgcactgtggagtggatattacccacgcctacaccataccgtctagtggagccagtccaagtgatcgaggtgacgtcatccgaggaagaccttgaggaggatcctgaggagctacctcctgagcctgctgtggatgctcttgacttcctagagggtgatgaggacccactccctgaggtggattctcccgaggacgtcatgtcggcatctgaggagagatggccctggagagatggcgatcagtggaggctcttcatcatagtagacagctcattggattag

SEQ ID NO: 90351 - DNA, 129 bp, Glycine max
  Peptide Sequence Number=SeqID_207129
atggatgcctcgtgtcttgctggaacaggtgtgaaaccaaccaaacacagagagcggatctgccaagaccgctaccaccggactttccttgctatggtggtaggcaaggaaagcgtcgattgctgctag

SEQ ID NO: 90352 - DNA, 189 bp, Glycine max
  Peptide Sequence Number=SeqID_207130
atgcctgggtcttccgcgagcctccttgcttcatccgcgaggtggctgttcttcttttgcgaactgcctctttgtcccttgtgtgagtgcttcttcttcttctgttcttccgcgagcttccattatgttcttcatcgagtttgtaggtatgtagttgatccgcttaaggatttaggtcatccgcagtag

SEQ ID NO: 90353 - DNA, 888 bp, Glycine max
  Peptide Sequence Number=SeqID_207131
atggttagaacgagaggtttaggtcgtgcattaattaggggtataggcagaggccggggtggacaggatgagcatcatgcagatgatgctccctggcggtgtaggcctaccgcatctatctgtaggcaatgggtacatgtttctgttgctgaggacgttgctgatatgactgttcctcagatgactgaggatgttcctctgatgactacggacatacctacaactcgagtagagggcttagctagtgatgttgctataggatcagttgctgatgatgctgagggattcccaggtgggccgcgggacccatcaatgctgactttgtttgccgagcatgttgcacacaacatatggagtggagaggaacatcctgaattgaagctggtctcccacgaaaggaaggtagagaaatttgggaggtcagcgcctgagattgcagggttagtcgctaccacaagattaactcctttgatcgggtgttcagtagtcaccggcgatcctggagttatatccgctttcgtggagaggtggcatagggagactagcaccttcgatcttccgttaggagaggttacaatcacactggatgatgtggtgtcactcctccatctgccgatcacaggcgccttccagagcttcgagcctctacttatggacgaggcggtcgtcttgttggtggagttgcttgaggtcttgggtgaggaggctaaagctgagactgcacgagtgcatggggcatatgtacgcctgtcgtggctaggggatatctatttgaggagatgcgaggccggacggtggattgtagcagctcgtgcttatctcctccacttggttggttgcagtctttttgctatcaagagtgcaacacatgttaatgtagtgcattaa

SEQ ID NO: 90354 - DNA, 2769 bp, Glycine max
  Peptide Sequence Number=SeqID_207132
atggcctccgatgatatctcatttgaggacctcaagaaggagaatattgatcttgaaaatattcccgttgaagaggtctttgagaagctaaagtgtaccagagagggtctgacatcagcagaaggagagaagaggctccagatttttggccccaacaaattagaagagaaaaaggatagcaagctccgaaagttcttaggttttatgtggaatccattatcatgggttatggaatgtgcagctatcatggccattgtattggccaatggagggggcaagccaccggattggcaagatttcaccggcattgtggtattgcttatcattaactcaacaatcagtttcattgaggaaaacaacgcaggcaatgcagcagccgctttgatggctggtcttgcacccaaaaccaaggcaacacacatttgttcagtgttgagggatggaaaatggagtgaggaagaggcagcaattttggtcccaggagatgtgatcagcatcaaattgggagttattgtccctgctgatgcccgtctcttggaaggagatcctctcaaaattgaccaatctgccctcactggtgagtccttgccagtcacaaggaaccctggtcaacaagtcttctctggttccacctgcaaacaaggtgaaattgaggctgttgtcattgccactggtgtccacaccttctttggtaaggctgcacaccttgtagacagcaccaacaatgttggtcacttccaaaaggtgttgacatccattggtaacttttgtatctgctcaattgctgtgggcatgttgattgagctcgttgtcatgtaccctatccagaagaggtcttacagagatggtattgacaacttgttggtgcttctcattggaggaatcccaattgccatgccaactgtcttgtctgttaccatggctattgggtctcaccgcttgtcccaacaaggagccatcacgaagaggatgacagccatagaagaaatggcagggatggatattctctgcagtgacaaaactggaactctcacccttaacaagcttactgtggacaagagcttgattgagagtaataaccatatggcaaatgctcatgttaatgtttatggagttcaaaatggaatgttttcattaaaaattgacattaatgtgttccccactggcatggacaaggacacccttgtcttatatgcagccagggcttcaaggactgaaaaccaagatgccattgatgcatcaattgttggaatgctagatgaccgtaaggaggcaagagcaggaatcaccgaggtgcatttcttgccttttaatcctgtggacaagcgcactgctattacgttcattgacaacaatggtgactggcacagaagcagcaaaggtgctcctgaggaaatcattgaactttgtggcctcaagggagagactctgaaaaaggcccacaaggttattgatgagtttgctaaccgtggtctgcgttccttaggtgtttctcgccagactgtttctgaaaggaccaaggagagtgcaggagatgcatgggaattcttgggtctcctacccctctttgaccctccaaggcatgatagttctgagactattcgtcgtgctcttgaacttggtgtcaatgttaaaatgatcactggtgaccaacttgccattggcaaagaaaccggtcgcagacttggaatgggcaccaatatgtacccttcatcctccctccttggtgaatccaaggataatgcccttgcaacaatgtcaattgatgaactcattgagaaggctgatggatttgctggagtcttccccggtatggacattacatctatttatgctcaacattgttactcagagcataagtatgagattgtgaagaggttgcaggatagaaatcacattgttggaatgaccggagatggtgtgaacgatgcaccagcattgaagaaagcagacattggcattgcagtggatgatgcaaccgacgcagcaaggagtgcctctgacattgtcttgacggagcccggactcagtgtgattgtgagtgctgtgttgacaagcagggctatcttccagaggatgaagaactacacaatttatgctgtttctatcacaatccgtatcgtgtttggcttcatgctcgttgctctgatctggaagttcgacttctctcccttcatggttctcatcatagcaatcttgaacgatggaaccatcatgaccatctcaaaggacagggtcaagccatctcctttgcctgactcatggaagcttaaggaaatctttgccactggaattgttcttggagcatacatggccatcataaccgcagtcttcttttatgttgttcatgacactagttttttctctaatcacctcacgaaagtgtgctttctctccctctttcagaacatttttggtgtcagcccaattgcagaaagcgaggagcagctgaactctgctctctaccttcaagtgagcatcattagtcaggcactcatctttgtgaccaggtcacggagctggtcatactttgaacgccctggcataatgctctgtgtagccttcatttgtgcgcagctggttgccactgtcattgctgtgtatgcacattgggactttgcaagaatcaatggagttggatggagatgggctggtgtaatctggatctacagcattattacttatattcctcttgacatcctcaagtttttaatccgcatgggactcacaggcagtgccggggacaacatgcaccaaaacaaggtttag

SEQ ID NO: 90355 - DNA, 135 bp, Glycine max
  Peptide Sequence Number=SeqID_207133
atgagtatgtgcccaaagcatgcagaggtagcgatgacagttggtggggagtttccccaaggaggagctgagtggcttattgaggaaagtagtaagaaggattctagggaggatcccaatgatgatatgagagat

SEQ ID NO: 90356 - DNA, 555 bp, Glycine max
  Peptide Sequence Number=SeqID_207134
atgtctagaaggtggggaccacaggttacaactttgaaagttctaaagaatctcgacatgatgtcccttgaaaaacttgttcgaaacttaaagaaagcaaagaaagttccatcatccaaggaatcctcatctagatcatcgtccaaaaacgcatctaaagcactgagtctagacaactcttctgatgaagaatttgatgaggatgatgagttggctttaatatcaagaaagattcaaaagatgtggaagaacaagagtgggtccagatggaggaactcctccaataaggtattcaaagataagaaagacagagaaaacagcactataatatgctacaagtgtaaaaatcctagatgcttcaagtcagagtgcccaaaaatgaagaattctaaggacaaatacaagcattacatgtctaaggacaagaaaagtctcatgagcacttgggaggacctggacaacaccacttctaatgaagaaggagaaaaggaagccaatctatgtctaatgaccaaaaaacttcttaaggatcaaaatcagaacaagaggaggtag

SEQ ID NO: 90357 - DNA, 918 bp, Glycine max
  Peptide Sequence Number=SeqID_207135
atggtactgtggtttgtggcagtttctactagaagaacaacaacatcacagattccaaactaccccaatcttccatatcagttgctgtgtcaagttcaaaatgtcacacttcatggttcaattctaggtgttgaggtcagcatttctagaaaatcatattctactcaactggttgtcatggaagatgagaatgggaaccaaaattccgcgccacctcaaaacggagggtttctcatcccgaatatatttactttaactataccgaaggttgatggaggtaatgagttgagtggtaagggcattggtgcaagtgttggtgttgcacaatatgggaaagacttgataaagcttaaacaaattctaagcacgttatacgagagctccaagttcaagccttcacttgtcgaacctgggggattttatgaaaaatattgtgtttctaagttgatttctctttcagatagtgatgagcatcttgaaaggaagattctagatcctgagcgcttgagcagggtggaatcaattttcagcaatctttcagaaaccattaaaatatatggtccttggtcttctgcatgggtaggagaagctggaggggcatacaacagtggtggcaatcatgtttctaacagatttctaaacaacttctggtacttagatcaacttggaatagcatcctgctacagcactaaagtctatagcaggcagactttaattggagggaactatggccttctcaataccaccacctttgctcccaatcctgactactacagtgcagttttgtggcatcggttaatgggaaagaagattcttgcggtctcaagtgatgttcatattaaagacttttacatacagttagaaaatgtgcatgcagaggcaaaaggaggggagacatggaggccatggcttctctaa

SEQ ID NO: 90358 - DNA, 372 bp, Glycine max
  Peptide Sequence Number=SeqID_207136
atggggcaagtagtccccttatacttatcaaagtccaagaccttaaacttcagaggaatgatgacatcaggcactagtcacaactccgcctccttcaatggccctcagcctttcctctatatgatcaaattttcccctttctaccatagcaaggctcttcccaccataaaaatgcaagggttatggttgtgggtgaaactgagggccctccaaagtgtctggcaggggtacacgaccaactacttgcctatcagtggcatatccgaggaatgtgtgcaacattgggggtgtatagttgggtggcaagccatatggtgggaaggaatgcttgttctgaatttgcacaaaataggggccgcccgtacttcctaa

SEQ ID NO: 90359 - DNA, 240 bp, Glycine max
  Peptide Sequence Number=SeqID_207137
atgcgtgctagagctagagtaatgagtgaaatagaggaggtgcaagagcagataaaggctgacatggaggccatgaaagaccaaatggcccccatgatggaggccatgttgagcatgaagaagataatggaggtcaatgcggctgcagatgccactaccggcgttgccactgaggtagacccgactcacccatcaagcctcaatcaagtaaatcctccagtcttgtatatagtagggtag

SEQ ID NO: 90360 - DNA, 3023 bp, Glycine max
  Peptide Sequence Number=SeqID_207138
ctcgtgatgatgctggaaacagtgctggaaatagtttatctgagagcaacaatctgaaagcaatggtgacagctggttcgaaaggaagtaacatcaacatatctcaaatgactgcttgtgtggggcaacagaacgttgaggggaagcgaattccatacggattcgtagaccggacattgcctcacttcacaaaagatgatcatgggcctgaaagtcgtggctttgtggagaactcatatctacgtggactgacccctcaagagttctttttccatgccatgggtggtagggaaggtcttattgatactgccgtgaagacctccgaaaccgggtacattcagaggcgactcgtgaaggctatggaggacatcatgcttaaatatgatgggacagttagaaactctttgggagacgtcatacaatttctctacggagaagatggtatggacgctatttggattgaaacacagaagctggatacccttaaaatgaagaaaacagaatttgatagggtgtttaggtatgaatttgacgaggaaaactggaagcctaattacatgcttcaagagcctgtagaagacttgaaaaccatcagagagtttcgtaatgtgtttgaggcagaagttcaaaagcttgaagctgatagacatcaactcgcaatagagatagcctctaatggtgacaattctctgccactgcctgttaacctcaagaggcttatctggaatgctcagaagacatttaaggttgacttccgaaggccttctgatatgcatccaatggaaattgtggaagccatcgataagctccaggagcggcttaaggttgttcccggcgaggacgccttgagtcaagaagctcaaaagaatgctactctcctcttcaatattctgctccgcagcactttcgccagtaaaagggtcttggaggaatacaggctttctcgcgagtcatttgagtgggtagtcggagaaatagaatcaaggttcttgcagtcgcttgtggtccccggagaaatgattggtgtcgtggctgcacaatcaattggtgaacctgctactcagatgactctcaacactttccactttgccggtgtcagcgcaaagaacgttactcttggtgttcctaggttaagggaactcattaatgtcgccaagagtattaaaacgccttctctctctgtgtacttgaaacctgatgctggtaagactaaagagagagccaagactgtgcagtgtgctttagaatataccactctcaggagtgtcactcaagctacagaggtgtggtatgatccagacccgatgagtacaataattgaagaggatgtggattttgtcatgtcctactatgaaatgcccgatgaagaagttgctcttgaaaaaatctcaccttggttgcttcgcgtggagctgaatcgtgaaatgatggtggataagaagttgagtatggctgacattgcacagaagattaaccttgaatttgatgatgatttgagttgtatatttaacgatgacaatgctgaaaaacttatacttcgtatccgtataatgaatgatgatgcaccaaagggtgaggttcaggatgaatccgctgaagatgatgttttcttgaagaaaatagaaaccaacatgctgactgaaatgactctacgaggaatcccagacataaacaagtctaatggggaatggatgcttgataccgaaggtgtgaacctgctagctgtgatgtgccatgaagatgttgacgcgacaaggacaacaagcaaccacttgattgaggttattgaagttcttggtattgaggcagttaggcgatctctactggatgaattgagaattgtaatttcgtttgacggttcttatgtaaattacaggcatttggctattctatgtgaaacaatgacgtatagggggcatttaatggcaataacacgtcacggcatcaacaggaatgatacagggccaatgatgagatgctcatttgaagagacagttgatattctgcttgatgctgcagcatatgcagagactgatagcttgaggggagtcacagaaaacataatcttagggcagctcgcccccattgggacaggccaatgtgccttgtatcttaatgatggcatgctgaagaatgccattgagctacaactgcctagttatacagatggtcttgatttcggtatcatgtctggagcaactccatatcatgaaggcaccatgatgtctcccagttatctgttgagccccaatttacgcctgtctcctagttcggatgcacagttttcgccttatgttggcggcatggcgttttctccttcttcatctcctggttatagtccatcatcccccggctatagtccatcttcgcccgggtacagccccacgtcgcccggttacagtcccacttcccccggttacagtcccacctctccaacttatagccctagctctcccggatatagtccaacaagtccagcttattcgcctacatctcccagctacagccccacctcacctgcatacagcccaacttctcctgcatacagctccacttcacctgcatacagtcctacttctccatcatacagccccacttcacctgcatatagtcctacttctccatcatatagcctgacatctccttcctacagtccaacttcaccctcttacagccccacgtctccctcatatagtcctacctctcctgcatacagccccacatctccctcatatagcccaacatctccatcttatagtcctacttcccccagttacaatccacaatcagcaaaatatagtccttcgttagcttattctccaagcagtccaagattgtctcccacatctccaaactatagcccgacgtctccctcgtattcaccaacatctccttcttattctccatcaagcccaacatacagtcccagcagtcccagtgcgggttactcaccaagtcaacccggttactcaccgtcgtcaaccagccaggacactccacaaactagtgacaaggatgaatga

SEQ ID NO: 90361 - DNA, 594 bp, Glycine max
  Peptide Sequence Number=SeqID_207139
atggcaaaccaattctcagttatcagcccttcctattgtgctccttatgctctcaatctacaaattaatacagagaaaggtgtcacttacgacataaacggtaaccctgtcttttatgtaaaagatgctttattcactcttcacgatcgtcgtgtcttgtatgataatcaaggaaactccatcgtaactctatacaagaagaatatgacgttgcatgggcgatgccaagttttcaagggtaaaagcaacgattcctctgaattgctcttttcggtgaagagatcgtcaatgatccagtatagtgtgatgaaattagatgtcttcctcgctaacaacagaaatgaaaatgtttgtgattttagagtcaacttttgtagagataaaagctcatgcattgtttatgcttctgaatctcctacaattgttgccacgatgcagattaatggcggcctcaatgttttggtctatccctacgtggactatgcattcattgtggcactacttatgattgttaacgagatgaaagattattatgatgaactgatggatgtggccttaggagtgacatttgccgcattgggtaatataaattaa

SEQ ID NO: 90362 - DNA, 1488 bp, Glycine max
  Peptide Sequence Number=SeqID_207140
atggatgttcgattccctttctccccagctgaggtcgccaaagttgccacggttcagtttggaattatcagtcccgacgagatcaggcaaatgtctgtggtgcaaatcgagcacggtgagacaaccgagagagggaagccgaagatcggaggattgagcgaccctcggctcggaactattgacagaaagctcaagtgtgacacttgtacgggcagtatggctgagtgccctggccattttggccacttggagcttgccaagccaatgttccatattgggtttttgaagactgtattagctataatgcgttgtgtttgcttcaactgctccaaaattctagctaatgaggatgatcacaagttcaagctagctttaagaatcaggaatcccaaaaataggctgagaaagattctggatgcctgcaaaaacaaaagcaagtgcgaagggggagatgatattgacattcatggtaaagataccggggagccggttaaaaagagtcgcggtggctgcggtgctcagcagccgaagattactattgaggggatgaaaataaatgcagagtataaagctcagaggaagaaaagtgatgaccaagaacagcttcccgaacccgtggaaaggaaacagactctttctgcagaaagggttcttagtgttctgaaaaggataagcgacgaggactgtcagttgttgggcttgaatcctcagtacgctcgtcctgactggatgattttacaagttcttccaattcctcctcaacctgttaggccttctgtaatgatggacacatcctccaggagtgaggcaagtgatgatttaactcaccaactggccatgatcatcaggcacaatgagaatctgaagagacaggagaagaatggatctcctgcacatattatttccgagtttgtgcagttattgcagttccacgtagcaacatattttgataatgagttacctggattgccaagggctactcagagatctggaaggccaatcaaatcaatatgtagcaggctcaaggcaaaagaaggccggattagaggtaacttgatgggtaaaagagttgatttttctgctcgaacagtcattacacctgatccaactatcaacattgatcaattgggagtaccatggagtattgcgttgaatctaacataccctgagactgtgactccatataacattgaaaggttgaaggaacttgttgagtatggaccccatcctccacctggaaaaactggtgccaagtatatcattcgtgatgacggacaaagacttgatctcagatatttaaagaaaagctgtgatcaccatttggagcttgggtaccaggcactgtttcttaacaatgataatattgtcgagcgccatttgaatgatggagactttgttctcttcaatcgtcagcctagtcttcataaaatgtctatattgggaaacagaatcaaaatcatgcctgattctactttcgggcttatctag

SEQ ID NO: 90363 - DNA, 1449 bp, Glycine max
  Peptide Sequence Number=SeqID_207141
atggtaaggcaccctttatccaagagagctaacaaataccttagaaaattcaagaaatggccacactccccttacaagacctcatggcaccacaacttcggtgaagaacaagccatgaaaaatctcaaacaagcaaccctagaaatggattcttcccaacacccccaaagacccaaccttccgtgcccttttctcctctccactctccttgattccttcaaagcctatagcattgacccaactccaaaagcttacttctttgtcctcaaaaccctaaccagcacctcccagttgcaggacattcctcctgtcctctaccaccttgaacacttggagaagtttgaaacaccagagtccatccttgtgtaccttattaggttctatggtctttctgacagggtccaagatgctgttgatttgttcttcagaatccccaggttcaggaagagggactgtctcgagatggtccccgagatcttgctgaagagccagcacatgaatattcgtgttgaggaatcgactttccgggttttgatccgggcgttgtgtagaattaagagggtgggttatgctattaagatgctgaattttatggtagaagatgggtatggtttggatgagaagatatgctctttggtaatatcagcattgtgtgagcaaaaggatttgaccagtgctgaggctttggttgtttggagggatatgaggaaactaggattttgtcctggtgtcatggattatacaaacatgattaggttcttggtgaaggaagggaggggtatggatgctttggacattctgaaccagcaaaaacaagatggaattaaacttgatgttgtttcctatactatggtcttgagtgggattgtagcagaaggggagtatgtgatgttagatgaactatttgatgaaatgcttgtaattggactcattcctgatgcttatacttataatgtgtacataaatggtttgtgtaagcagaataatgtagccgaggcgcttcagattgttgcttctatggaggagttaggatgcaaaccgaatgtggttacttacaatactttattgggtgccttgtctgtagcaggggattttgttaaggcaagggagctaatgaaggagatggggtggaagggtgttggactcaacttgcatacatacaggatcgtgcttgatggtttggttggaaaaggtgagattggtgaatcatgtcttttgttggaggaaatgttggagaagtgtttatttcctagatcttcaacatttgataacatcatatttcagatgtgccaaaaggacttgtttactgaggcgatggaattgaccaagaaagtggttgcaaaaagttttcttcctggggccagtacttgggaagcactgcttcttaactcaggatctaaacttgggtattcaaaagccacattttctggcttgttgggaccaatttaa

SEQ ID NO: 90364 - DNA, 1521 bp, Glycine max
  Peptide Sequence Number=SeqID_207142
atgaccaatatagtagccattatcagtttttctctcatcttgattgtggtactgatgaaaatagtgaggaatcataagaaaacaaaaccaactccaaatgtacctccagggccatggaagctacctgttataggaaatgtacaccaaattattacatccgcaccacatagaaaattgagagacctagccaaaatctatggacctttgatgcatctccaacttggagaagtcaccacaattattgtttcctcacccgagtgtgctaaagagataatgaaaactcatgatgtgatctttgcatcaaggcctcgtggtgtagttacaaacatattgtcttatgaatccacaggtgttgcttctgcaccttttggaaattattggagagtgctacgaaagatgtgcaccatagagcttttgtcccaaaaacgtgtcgattcattccagccaataagagaagaagaactcactactctcatcaaaatgtttgattctcaaaaagggtcacccatcaacctcactcaagtagtactttcatcaatatattctatcatttcaagagctgcttttggcaagaaatgcaaaggccaagaagaattcatatcattggtgaaagaaggactcacaatattgggtgatttttttccttctagtagatggcttctacttgtcaccgatttgaggcctcagcttgatagattgcatgcacaagttgatcagattctagaaaacatcatcattgaacataaagaggcaaagtcaaaagtaagagaaggccaagatgaagaaaaggaagatttggtagacattctcctaaaacttcaggatggtgacgatagtaacaaggattttttcttaactaatgacaatatcaaggctacaatcttggaaatctttagtgctgggggtgagccatcagcaattaccatagattgggcaatgtctgagatggcaagggatccaagagtgatgaagaaagcacaagatgaagtgagaatggtattcaatatgaagggaagggttgatgaaacatgcatcaatgaactcaaatatttgaaatcagttgtgaaagaaaccctaagattacaccctccaggtcctcttttacttccaagagaatcaacacaagaatgtaagattcatgggtatgacatacccatcaaaagcaaggtaatagttaatgcctgggcaattggaagagatccaaactattggaatgaaccagagaggttttatccagaaagattcattgatagctctattgactataaagggaataattttgagtacattccatttggtgctggaagaagaatatgccctggcagcacatttggtttggtaaatgttgagatggcacttgcattgttcttgtatcactttgattggaagctccccaatggaatacaaaatgaagacttggacatgactgaggaatttaaagtgactattagaagaaaaaatgacctgtgcttgattcctgtatctcctccttgttctgtggttgcaatgtatagctcataa

SEQ ID NO: 90365 - DNA, 759 bp, Glycine max
  Peptide Sequence Number=SeqID_207143
atgggcgatcacatagcgaagggacaagaactggccaagagagcggagaacaagctccatgcttgttgccccttgttcgggtccaacttggaagacgctgccgaattgttccacaaatccgccacttccttcaaactcgccaaatcattgcagttggatagcaagtatgatgctgcaaatgcttatgtggatgctgcacattgctacaagaaaacttccacatcaggagctatttcctgcttaaataaagctgtgactatcttcactgagattggtaggcacatcatggctgctaagtattcaaaggaaattggcgagttatatgagcttgatcaagacatagaacatgctagatcttattatgagagggctgctgaactttttgaaattggggatgcagcaacttctgtgatccagtgcaaagttaaagttgcacaattttgtgcccagcttcaacaatatcagaaggcaattaagatttatgaagatattgcccggcaatcactggatagtaacttgttgaaatatggagttagagggcatcttcttaattctggcctttgccagcttgtccaaggggattttgttgcaattaccaactctttggagcgctatcaggacttggatctgacattctccagaacccgtgaatacaaatttttggctgatttgtctgcttcaattgatgagggagatgttgaaaagtttactagagtagtgaaggagtttaatagcataaccccattggtatacttctga

SEQ ID NO: 90366 - DNA, 1560 bp, Glycine max
  Peptide Sequence Number=SeqID_207144
atggccacgtcatcactttctggcaacttcagccttctccgccacagcgagactcaatcccgctcgctgctgttgctcggtggcagctctgtcaagctcttcaggtcgaagcacgaggccagcacgtgccatggcgcacgcgtcgctgccgccgtgccacgtgcttcggcgcctgaggtggcggtggttgagaaggggagggagaaagtgagggtgctgaagctgggcctcatatgtggcggtccttctgctgagcgtgggatttccctcaattctgctagatcagttcttgatcacttgcagggggatgatttacacgtgagttgctattatattgattgcaatctcaatgcatttgcaatttcttcagctcaggtatattccaacacccctgctgattttgattttaaacttgaaagccttgcccaaagtttccagactttgtctgatttagcaaagcatctagcaacagctgtggacatagtatttccagttatacatggtcaatttggagaagatggtggcattcaggaattgctggaaaagtataatgttccatttgttggcacaggatcaaaggagtgctgccaagcatttgacaagcataaagcatcattggagctcaggaagcatggattcataacagtacccagtttcttagttcaggggtatgaaacagacaaatcagaactatcagaatggtttaaaaagcaccagctggacccagacttagggaaagttgtggtaaaaccaacaagaggtgggtcaagcattggtgttggagttgcatatggtgtgaatgattctcttgtaaaagccaatgaaattatgtctgagggaatcgacaagaaagtgctaatagaaatatttcttgaaggaggaaatgagttcacagccattgtccttgatgtaggatctgatttagatagttttcctgttgtactacttccaactgaggtggagcttcaattccgtggtgcaaatgatgtgaaagagaatgatgcaatatttaattaccgtaggaagtaccttccaacccaacaggttgcttatcacactccaccacggtttcctttggatgtaattgaaaatattcgcaaaggagcatctctgttatttcaacggctttgcctgcaagattttgcacgaattgatggatggtttttgccaaattcaagttccaaattatcaccattttcccaaagtgagtttggaagaacagaatctggtgccataatattcactgacattaacatgataagtggtatggaacagaccagttttctatttcagcaagcttctaaggttggtttttctcatacaaacatccttagaagcattattcaccatgcttgcttgcgatttccaaatcttgcatcagttagtggtatatcaggtcagcttccaagcaggtcaaaatccttacaacgtaacaagtctttttctcgccgtgaaggaactcgaaaagtgtttgtcatttttggaggtaacacatcagaacggcaagtatctcttatgagtggtacgaatgtctggctcaatttgctagccttccatgat

SEQ ID NO: 90367 - DNA, 459 bp, Glycine max
  Peptide Sequence Number=SeqID_207145
atggaggatcatcaaaaggtggagatgcaaaacaaggcaagagttgaagtgctctacaaggcactattagggcaaggaacaatggacaatgtggccaaattgctagcaagtgaccttgagtggtggttccatggccctcctcattgccaccacatgatgaaggtgctcacaggggaaacagatcacaccaagggcttccggtttgagccgaggcgagtcacagccgtcggagactgcacgatcgctgagggctgggagggcaaggcgtattgggtgcacgtttggaccctaaaaaatggcctcataactcagtttagagagtacttcaacacatggcttgtggtgagggatttgaggcctccaaggtgggaagatagcaaagatagcatgacattgtggcaaagccagcctcgtgatctctatcaccggtcactgccagggcttgtgttaactatttag

SEQ ID NO: 90368 - DNA, 255 bp, Glycine max
  Peptide Sequence Number=SeqID_207146
atggctgcttctagggagaaaagaagagcatctctggaagaaacgttgcaacaacttcgcgatgtcacaaactccactgctgtaattgatatgaagcttgtgcttctgttgaacaaagcctcaattattgtagacgcctcaaaatacatagaggagttgaaacaaaaagtggagggactgaactcagagctggaaatcgcggaatcatcaacaaccactcaaattgatgaactacctatggtgctttattattaa

SEQ ID NO: 90369 - DNA, 207 bp, Glycine max
  Peptide Sequence Number=SeqID_207147
atgaattttgcgccctttatcattcaagagcagcaagctgagtggataaacgtgcatagatcaattatgcgccctttatcattcaggaacaacaagttgggtggtaagcgcgcagagacagattctacgccctttatcattcaggagcagcaagtcgaatggttctgctggcagggaggttcactggccgaatggtgtttcggttga

SEQ ID NO: 90370 - DNA, 606 bp, Glycine max
  Peptide Sequence Number=SeqID_207148
atgaaagcacaaagatggaggactttgagtcctgtgaaagataaagtgaggattttgagtcatgtgaaagataaagtgggaaatttgagtcttgtgaaagataaagtgaggattttgagtcttatgaaagataaagtgaggactttgagtcttgtgaaagataaagtgaggactttgattcctatgaaagataaagtgagaactttgagtcctgtgaaagataaagtgaggactttgagtcctgtgaaagataaagtgaggattttgagtcctatgaaagataaagtgagggctttgagtcttgtgaaagataaagtgaggactttgattcctatgaaagataaagtgaggactttgagtcctgtgaaagataaagtgaggactttgagtcttgtgaaagataaagtgatgattttgagtcctgtgaaagctaaaagcgaggactttgagtcctatgaaagggttttcccctttctatttaaaagctttgattattttgcacaacaaggaaacataaggctttgggatcaatcatgtgccccattgaaggatggtcatagactgacgccaagggtttgtcgatcccatggaaactcaatggcatag

SEQ ID NO: 90371 - DNA, 273 bp, Glycine max
  Peptide Sequence Number=SeqID_207149
atggcattatgggtcatggcagctagcgcacgcgagctattgcttcaacctgaagtaacctttcttgcccaggcaagctgctctagcccaatcctcttggagccttttgttcatggctctagtgactggtcccttcctagggaggattgcatcaaaaggggaaacaacttaccattgttacattttgatctggttggcccaactagaacaaactcagttagtggtaaaaggtatggtctggtcactgtggatgattactctagatggacctag

SEQ ID NO: 90372 - DNA, 1269 bp, Glycine max
  Peptide Sequence Number=SeqID_207150
atgaagagcctcaatttgtggccgaaccctaatggaaggattttgcctcgcatttcaacatgtccaacactcaaccttgtctattctgttcctccttctccttcttcagttcgatgccatagctctccaactcaattgccgctcaggtgcgcagtgctcggtgctggattcgctggcctctcagttgtttggcatttgttgaagcaaagtcctaaggagttgcaaatgagaattgatatatatgatgaagtgggtattgggggtggtgcttctggagtatctgggggtcttcttcacccttattcccctaaagttaagcttctctgggagggtgctcagtgttggaaagagagcatgaagcttttgagagttgctgaagaagctagtgtctccaaagactgcagaactggagaatctgctgaagatatgaaagcttttgtagctcacaaaagagtagaaacacttaatgacgaagaggctcaaagtcttttacctggtgtatgtttaccattcaacactgctttctatatgcctgaagctctaaatatcaattcccaacactatcttcaggcacttttccaaggttgcaaaaatttggtgaaagaatcctccactcttgagtctggacacaaacaacttagtttacacaaaagatctgttcatagactttccgattttgaaggggaatatgacgcagtcatcatatgcctaggtgccaaggtgaacatgcttcctgagatctcggggaggcttcctttaaggacttgtaggggtgtaattgcacacctggaattgcctgatgatatgatcggttatcccgagagtgggccgtcaatattatcagatgcatggatttctgttcagggtcctcgtagtctgaaagtgggctcaacttgggagtggaaatccattaattcattgccaaatgtctcaactgacgaagctacgaaagctcttctggagcttttgccaaaggcatctaccatttatcctggaataaaggattgggttttcactggagcaagagctggtctgagggcaatgcctccactcaccacccttggatcacttccacttttgggttgtataaatgatgtaataggcagaaaccatacttgtaggtattggttatttggagggttaggttcaagaggattgttataccatgcttggctaggtaatttgatggcacaagctgtgctttcctgtaatgaagaagtcattccatctgagttgacatcttggaaagccactgaacccaaaatttag

SEQ ID NO: 90373 - DNA, 168 bp, Glycine max
  Peptide Sequence Number=SeqID_207151
atgactaacgtcgtcacctgcacccttcctggagatgtcagcatcttccggccgatactacgaaaatatctcatttgctatttgttttacttttgtcatccagagacattcaagtccaacgacgcacgagattcttctctgctagacggggacgatcgagttcgataa

SEQ ID NO: 90374 - DNA, 177 bp, Glycine max
  Peptide Sequence Number=SeqID_207152
atggagaaacatcaagtgttgtcccctatttcatcttcatcatctacttctccatctgactttaaacttggtgatcacaattctaatgctcatgtcaaaaaggcaggagtcatgttgatatactggatgatgggtaccggtggagatcgaattcctgcagcccgggggatccactag

SEQ ID NO: 90375 - DNA, 135 bp, Glycine max
  Peptide Sequence Number=SeqID_207153
atggaggccaagaacaatgaagccttgcagggttcaacatggcctgcagaatggagcttacaagctggaggagctgctgcaaaagtcatccctcggacttggagttctactcacttaaagttctactacaactag

SEQ ID NO: 90376 - DNA, 429 bp, Glycine max
  Peptide Sequence Number=SeqID_207154
atggctgaagatattgtcgtcttcgaaatgcaaatgaagtctcagtcaaaagacattgagtcttcgacaaagggtgcagatgatcatattggtctctacgtgtcatcgaacttgccgtcttattacaaaggtgcggataaccatgaggtgtctctgcacgctatcgtacttgccatctctggatatcaaagggaccagatgaccatattggtctctgcgtgtcatcagacttgccgtctctggatgatgaaggtgcggataaccatgaggtgtctccgcgcgctatcggacttgtcgtctccggatagcaaaggtaagactaaagtagtctcggtcgatagacatcgagtcttcgacaggggtgtagaagcaaagcttcatgatgaatcaagattgattcaaagatgttttgatgataacaaaagataa

SEQ ID NO: 90377 - DNA, 1233 bp, Glycine max
  Peptide Sequence Number=SeqID_207155
atgtcttcaatcattgcataccttgaaaaggcgacaatgaccttcatttgcatttcgaagacgacaatgtcttcagtcattgcatgtcttcaaaaggcatcattccatgatcttcatttgcatttcgaagacgacaatgtcttcagtcattgcatgctttcaaaaggcgacaatgaccttcatttgcatttcgaagacgaaaatgtcttcattcattgcatgccttcaataggcgacaatgccatcatttacgctttcgaagacgttttactgcttggacttccactagtggtcggtcaggggagggggctgagtttaaggggttcaacattttttgctgtcgcaacctacccttcggcgggagggcgacgcgagactcgtgggatgcgtgttccacgaaaggaatacgcgcggagtcgccaccaacgtttatttgaggaaaatgtcggaaaaaccggaaaagacgcgatctacgaacttttaagtgaaaggttcgggagttgtatttacgcacggggaagcaaaataggggaggtgcttgccgcccagctcgcccaggcgagccaggttgcttcctccagaagcaacagccttctggaggaatattctggagggcccaacaccttacaaggaccaaagaaaggtcgcatgtcatcaagcaaaggtccccggatgaaattagggtatgacatttgcattgagttttcacttgaaattagtgaggagaagaagaaagaaggagagaatccaagccgaggtgcttccgtaacgcatccgagacgttttcatgatcgattccgtggacgttcttcgccgttcttcgtcattcttcaatcttcaaccggttgcgatagtggggtcccaaacctcacacattggcttagaggtgcctctgacaggaggtgcactagcaaaacaaaggactccaacactcaaggctctatgtacccggccttgattgcaaacattgatcttgccgatgataatgtgaccttgaaggagatggttattgagttggaggaggatgtgaagggcctcgacacccgggttgtgaacaacaagacttcgacacgacaacatgctaaagaaactgagaggttgaaggctactttagttgaggtcactggtcctctctctatcgatgtgccattgactgaggtggtagataatgaggatgatgataacggggatgaagaggaggtgcaacatgggaatgatgagttgatctcttag

SEQ ID NO: 90378 - DNA, 389 bp, Glycine max
  Peptide Sequence Number=SeqID_207156
ggttgacccttgggtacacgccctcaccttcaaaggactacatcactttcagaggactacacgtcctcactttcagaggactacacaccctcaccttcagaggactagacgtcctcactgtcagaggactagacgtcctcgccatcaaaggggtacacgcccacgcctttagaggactgtacgtcctcgtctttagaaggctgcaggacctcaccttcagagggctacacgccctcgccttcagaggaatgcacgccctcgccttcaaagggcgacacgtcctcaacttcagagggctgcacgccttcgcctttagagggctatgcatcctcattttcagtgtgctccatatccacacattaagagaatttagggtcctttgcccttag

SEQ ID NO: 90379 - DNA, 564 bp, Glycine max
  Peptide Sequence Number=SeqID_207157
tccatgaaagaagagatgggttcagaggaaaccaattttccaagcaaaccttggataagggattctcatcatgttcattctgatgcggcaagggaaacaacatctcatgcttggccacaacatatgtcaccaccaacaccaccaccatgtgttaaaggtaacaacaacatttccaacaatgaaattgatgtgtccatgtcttcaggtgcacaatattgttactacatgttggaggccatgcctcagccagggcctacatggtccacaacaggaccttgtgtattggctgagccaacaccaacaccaacactaacaccatcagcactcattgaagattcttcttatacttgctggctgggataccttgaaggctttgatgggaatttgaccactgagaaattggatcccccatttgtggaaaatgttgtgatggaaaatgctaagggggtttttggctatgaatctacccttgtggaggctatagatcttagttattgttgtccagatgattggttggtgattccaacaatggagcaggatttggaagacatagttatgccatag

SEQ ID NO: 90380 - DNA, 165 bp, Glycine max
  Peptide Sequence Number=SeqID_207158
atggacacaatttccacgcttccaaagagtagaggtgtgtgcactgataagaagacaggaagagtatatgtaatggggttgttgttcacatttcacagtgttggtgtgcatgatcaattcggattttcaggaaagtggcagaaaggtgtggaaaattggccataa

SEQ ID NO: 90381 - DNA, 264 bp, Glycine max
  Peptide Sequence Number=SeqID_207159
atggagactatatatggtggtctttggatgaagttgaaatggggtggcattttccggatattatatttggataaaagcaacaagggcatggagatccggaggagaagatcaaaagaaactactggcatggtgtcttggccttacaagatcagccatggaattgatgaagatagaaaaaagagtagagtagctataatagatgaacaaggaatgggattaattcttctggcacaggttttatatgcatatatgttgtacatgtaa

SEQ ID NO: 90382 - DNA, 309 bp, Glycine max
  Peptide Sequence Number=SeqID_207160
atggcagagcccttgatcaaaatgtgttgcatcttgcttgatgtgagagttgtaagtgacgttgaggttcacgggctaagttctaattacgtaacagaacaagttctttctaaactcatttggggtggaattgcaatcaaaatccttcgcggaaaattccatgaccacatcctacaaaagctactttgtctcttttcctcacatgctaaatccagccagcaacacctacacatagaaacaaccaaagtgcatcaaaaggaagacaataggatcatttgtacaaagacatcaagacagctacagctataa

SEQ ID NO: 90383 - DNA, 180 bp, Glycine max
  Peptide Sequence Number=SeqID_207161
atggcccacaatactcgacctccatcatggcagtgttgtcattgtgcagtgacgttgctaacattgctaatttgtactgtactagacccgtgtggaaactggagcaccagatgtgcctgctataggaaatcttcatctaactccactgtactgtgtgagaatgagtatgatcataattga

SEQ ID NO: 90384 - DNA, 258 bp, Glycine max
  Peptide Sequence Number=SeqID_207162
atgaaagatgcagaatataataatgagggtgcagaatacaatagtccattgagtattctagtaattggggatgtgagaggaataggcatgatgcttggagttgaacttgtcagtgatcgcgaacttaaaacaccagcacaaaatgaaacactgcatgtgatggaccaaatgaaagaattaggagtgttgattggaaagggtggctattatggaaatgtattcagaattacaccaaagaagatgcaggttgctctttag

SEQ ID NO: 90385 - DNA, 1272 bp, Glycine max
  Peptide Sequence Number=SeqID_207163
atgttgttgttgttgctgccactcatgaggcttttccctttccttttcctcctccttgttctcttgttcaattatggcttttctgagtctggtgttggtgctggctaccaactcatggtggcagttcctgtggagtatgaagtgaattttaaagggagggcttttcttgtggagaccaatcagactgcaccaaatttcagagtggcattgagcattgaggccatcaatgggaaatactcatgctcattggaagttttccttggggatgtgaaggtgtgggattctggccattactccaggttttacataactgagaaatgcttgctagaacttaccatggatggagatttaaggctgaaaggtccaaaagaaagagtgggatggaagactgggacttctggacaaggtgtgaagagattggagatacagaggacaggcaatctggtgcttgtagatgcactgaacaatataaagtggcagagtttcaatttcgcgacgaatgtgatgcttaggggtcagcaacttgatgtggcaactcgcttgacatcttcccaaagcaactcaagtttgttctacttctcttttgaaatcgaggacaagaaggttgcattgtacttgaactatggtaagttgaggtattcttactgggggtttcagcctaccatgaacagaagtattacatatattaagctgagttcaagagggttgttgttgtttgatgtcaaatacaagaaaatagcacaaattccatcggaggggattcatccactaagatttctagcactgaataatgaaacaggaaaccttggcctttatcactattcacccgagaaaggaaagtttgaggcctcttttcaagctcttaacagcacatgtgatcttccaatttcttgtaggccttatgggatatgcacattctccaattcttgttcatgtattcagcttttggcaaatgaaaacaaaggtggtgctgattgcagtggaggaatcacaggagggttttgcaatggtaaagaggcggaaatgctagaaatagataatataagtagtgtgcttaaaaatgttactagggtggactgtaaatgtgctgctgctttgtattttgggaatgcaagcacagatgaggcagaatgttatatttacagactagtgctgggtctcaaacagggtttggatattggttggttaaaaggagaagtcatagcttacattctcgagccggcaatacatgagcagtttaggaaaaagcctggaccaggagaatcatcatag

SEQ ID NO: 90386 - DNA, 741 bp, Glycine max
  Peptide Sequence Number=SeqID_207164
atgtttcaactttttctaaaggcactcattgccataaaaaaagggactcaattaataaagtacagtcgaaaaaccaagccaaaagtttgcccattcagactttctctggtagtctttagaagatatttacagccagaaaaagattacctatcgttttcacttgtttatagtaacgaggagcgaacacttgatttgatatgcaaggacaaagatgaggcagaggtatggtttacaggccttaagacattaatttctactggaaagcttaggcgcattggaagtgaattatttgatgatggtgttgattttactccaaaaggtcgtccttttggtgcagcactagagtttggcatatgcatcactcgtaataacaaggtcgcttttgattttgcttctcatgagccttcattgaatttggtaaccagcacagatgtggggttagagagtgctaataacatgcaaccaagaacaagtattggagatggttttcgtgtcagcgtgtcgagtacaccaagtgtttcgagcacaggatcgggaccagatgacatagaatcactaggagatgtttatatatggggagaggtttgggcagatggtgtttcacttgatggattttccactcaggccccttccacaacagatgtgttgattcctaagccattggagtcaagtgttgttcttgatgttcaacagattgcatctggtgtgaggcacattgctttggtaacaaggcaaggggag

SEQ ID NO: 90387 - DNA, 660 bp, Glycine max
  Peptide Sequence Number=SeqID_207165
atgcaagctaccaggatttacacaagtcctactatcctaaagaagcaaatgtcgccacttggagacgaggccgctgtcggaggggccggcggggacggcggcctcgaaggcgtcgtggcggagctcgcacaggacgacggtgtggggcaggtaggccatgctggtggcggcattcccggcgtagttgccgctgctaatgatggcgatggcggcttcagagtcgcggcggtgcgcgaaatcggcgtcgtcgttgctgctgctgttgttgttaagagcggcgacggcggcggcagcagaggaggaagaggaggcggtggtggaatcgtcgaggtggttgtgagaggtgggaacgacgagaactgtggattgggaaaagcgagaggccatcaaatctcccaatgccatccaaatcggaaaccctcctcagtggcgatcgtacatggaataataataggaaaggttttgaggaaagaaggaaccctaggttttcgcagtgtgagggatatgaagatgaagattaaggtgaaggtgaaggtgatgatgatggcgatggtgatggttatggtgttggcgttgatgatggtagggatggggatggtgatgatgatgatgatgaagggggcgcatagaacagtggcggcaggcactgtctctccttga

SEQ ID NO: 90388 - DNA, 1743 bp, Glycine max
  Peptide Sequence Number=SeqID_207166
atgactgttgctctcactacatctggtcacatttttactatgggaagcaatgaaaatggtcaactaggaaaccatttggctgatggaaaagtacctatcctagtacaagacaagttggtgggtgaatttgttgaggtaatatcatgtggatctcatcatgttgctgccttgtcatcaagaagtgaattgtatacttgggggaaaggtgccaatggaagattgggacatggagacatagaggatagaaaatcaccaacaatagtagaatccttaaaagataggcatgtaaagaatatttcttgtggctcaaactttacatcttgcatatgcattcataaatgggtctctggagttgaccaatctgtttgcacgggttgtagacaaccatttggattcactagaaagaggcacaattgctacaattgtggattagtgcattgccatggttgtagttcaagaaaggtattgaaagcatcattggctccaacaccaggaaaacctcatcgcgtgtgtgactcttgttataacaagcttaaagctgttgaggcatgtgctagttctaatcttcataggaaaatgaccacaacacctcgtaattccttagataccagggaaagatttggtcaaggagatgtaaagtcttcaagactaattttgcctcctatcacagaaccaatgaaatttcatcagataatgatggctaataagatgggaagcaaacatgattattcttccatgtctccagcatcccaagttccatcacttttacaattgaatgatattgcatttggtaactcaataagttcaactcaaaatgttttgaggtctgctatagctcttagtccaccaccaactccacctctcaattcaagaccaacatctccttattcaagaagggcaagccctccacgttctagaactccgggattttctagaagtcttattgatagtttgaggaagacaaatgaacttttgaatcaagaagtttcaaaaatgcaaaaccaaattcgaagtgtaaggctaaaaaatgacatggaaattcagaagctccaaaaaaatgtcatggaagctacctcctttgctgcagaggaatcttctaagcataaagccatgaaagaaatttttgagtctactgtggatcagatgaaggaaatgattgagaagttgcctccagacgttttagatagtggaaatttgaaagtcgtgcttactcgagctgagaattttctaaaagaaaattcagaatttgaaacaccatcaagtgcgaagtctcaacaacaacatgcacttaatacacctaacttaaatactagctcttctaaattgcaagaacatagaatagaagaaaataatgaaactgtagatgaaggaaatgttattcaagaaagcaataactcatctttatcaaacaacgaggcatcaatgccttcacaaaatgattcaaaatcccaagactcttcaagaccaggcaaagaaggagaaacagaagtcattgaatttgaacctggggtacatgtgacactaatagtaaagcctggtggtgtcagatttttcaaacaagttaaattcagtaagcgaagattccgtgaacatcaagcaaaagagtggtggagcaaaaataaagatagagtgcataggaaatatattgctccacaaactacaaattccgaaggtaccggatcatctaacactctaccaccaccaccacctacgaaagaaaatattgagacagtgtcttcctaa

SEQ ID NO: 90389 - DNA, 1761 bp, Glycine max
  Peptide Sequence Number=SeqID_207167
atggcaccgcaaaaggcattggagtcaattggaaaaactttgagcagtcagtatgaaagatggcaaccaaaggtgggagtgtttaggcaggcccgctataaatgtcaacttgatccgacagtggatgaggtgaagaagctttgtactacttgtcgtaaatatgcaaagtcggaaagagttttattccattacaatgggcatggtgtgccaaaaccaactgctaatggtgaaatttgggtcttcaataagagttatacacagtatattcccttacctatcaatgaacttgattcctggctgaagaccccatcaatttatgtttttgattgctctgcggctgggatgattgtgaattccttcattgagcttcatgagtggagtgcttccaactcctctgtgtcccaaagggattgcattctgcttgcagcatgtgaagcacatgagactttgcctcagagtgcagaattcccagctgatgtatttacatcttgccttacaacacctataaagatggcattgcgatggttttgtactcgttcattacttcgtgaatcacttgattattcacttatagacaagatccctggccgtccaaatgaccgaaagacacttctgggtgaattgaattggatctttacagccgtaactgatacgattgcctggaatgttcttcctcatgatctttttcagagactgttcagacaggatttgcttgttgcaagtctgtttcgaaattttctacttgctgagcgaatcatgcgatctgcaaattgttctcctgtctctcacccaatgttacctccgacccatcagcatcatatgtgggatgcatgggacatggctgctgagctctgcctctctcaacttccgtctttagttgaggatcctaatgctgaatttcagcctagtacatttttcactgagcagttgacagcatttgaggtatggcttgaccatggttctgaacataagaaaccaccagaacagttgcctatagttcttcaggttttacttagtcaatgccatcggtttcgggctttagtactccttggaaggttccttgatatggggccatgggcagtagatctggcattatctgttggaatatttccatatgttctaaagctgttacaaacaacaacacccgaactacgccagatccttgtattcatatggacaaagattcttgcacttgacaagtcatgtcaggttgatctagtgaaggatggcggtcatatctattttattaagtttcttgatagcatggaagcatatccagagcaacgtgcaatggctgcttttgttttggctgtgattgtggatggtcatagacgaggccaagaagcttgtattgaagctggtttaattcatgtctgcttaaagcaccttcagagttcatgtcctaatgattcacaaactgaaccccttttccttcagtggctttgcctgtgtctggggaaattgtgggaagacttttcagaggcacaaacaatcggtttgcaggaagatgccactactatatttgctcctctactgtctgaaccccagccagaggttagggcatctgctgtttttgcactaggcacccttcttgatgtggggtttgattcatgtagaagtgttggtggagatgaagaatgtgatgatgatgataagtttagggctgaagttagtatagttaagagtatgttagatgttgcttcagatgggagtccattggtgagggcagaggtagcagtgggtaggttattaagcatctaa

SEQ ID NO: 90390 - DNA, 483 bp, Glycine max
  Peptide Sequence Number=SeqID_207168
atgattcctcaagccaacactgcggcatcttattcatctgcaccaagggttaggcccgtgcaacacaataactcattcccctccagaggtagcggtggagctcctgcaagtgcaactggacaaaagctgtttgttccatcttacaggttatttgaagatttgaatgttttcggaaacacggatgcaagggtaaagatgaccaacagtggctcatcatccagcttgtcagggtcaatgggacctggtatggataacttttaccatagacgggcagagaagttgaataaatttcaaactcattcggtcatattcctgggcaatctcgagaaaatatcacgagatacacaggaggcctttaacatcgtacaaaggacaaccccttgtgctaggaaaagttttcatagatcaaaatccggactacttatcctattccggaataggatcctccagaaaggccattctggaatagggtgccaaggatga

SEQ ID NO: 90391 - DNA, 204 bp, Glycine max
  Peptide Sequence Number=SeqID_207169
atgtttgatcccttttgcttgtcttggcaatacatgcaaactaggtcccaaaggcttaagttattagaagaacctgagatagaaagacttgctcgtagactaagaaaaggacatcgagaaaaagcaatgactgaggtagaaaatgctacacagacccttatggattatcttaaccttcacttgagggaaaccaacaacatttaa

SEQ ID NO: 90392 - DNA, 1029 bp, Glycine max
  Peptide Sequence Number=SeqID_207170
atgcagcagcgcggtaagaaagccggcgttaaagctgtcgccggcaccgattgtgtcgaccaccgcgaccgcgcgaccagcctgttgcaggctgtgctgacgttgccagcagcccgcgccctgcgcaccgcatttcaccacgcagccgccgcgcccgctgagccgttgcgccagcaggtgcgcgccggtgtgcagatcatctgtgccactcagtccgagcgtttcgacttcattgagcagcagccagtcgcactgcggcagccagcgggcgatctgcgcgcgtacctcatcgctccagccctgcggcggccagccggtatcgacggcggtgataaacccgcgctgctgcagttcggccagcaactgcggatagtcgtcatacagttgcaggcagagaaacgtgccgcacaacagcacgatatcgccgctgctggcttgcgccgggagctggctcagcacgtcctgcgcgctgagccgcacaatgtgaccgagattactgaggaacgatcgctcgtgatcggagtgcgtgacgccaacggtgagcgaggtttcgcaggcgtagcgcgtccagtgcgccgcgctgtgcggaaaatggctcgccagccatgcgctgaggccgtcatcgccctgattagcgacggcgcgatggcgcacctgcatcgcttccagcgccagcgcgcagttgcctgccgaaccgcccggacgcagctcactgtgctgcagcatcacttcggtgccgcgctgcggccagctgtccagcgtacccatgatgacatcgacattgatattgcccaccacgtagagcgtggcgcgggcttccttattgctcatcatcctttgctcccgccactggcaaggccgctgaccagcgttttttgcagccagatagcgataaagagaggaggaaccgacgccagaataccgacggcggcaatcagcccatcgtcggtggcgcggcctgcggtaaagccggcaatggtgaccggcagggtttgtgcggcgatgttactggtgaacagcagggcgtag

SEQ ID NO: 90393 - DNA, 696 bp, Glycine max
  Peptide Sequence Number=SeqID_207171
atggagaagtggaagcaactttatcttgcaattaagagggagctagatgaacccactcaaagaacatatgatggggatggtctatactggaaagcagaggaaaatgacatccaaatggaaaagcagaagaaggagttgcaagaaaaggaagaaaccatcaaggttttaaaaactcaattactttcaatggagaaagaaaagtacaaaaggagagggagtttgacttgcaatagattgtctcacagggatgataaggttgattgtctcatagtaaaatgggatgatgaactagtcaacattcccacatatggagaggctaaatggagggctaatggtgaggaaagacaagtggttatggagagaacgaatgagacaaacagtgtcacagtcaccatttcaggcttggttgagttggatattcattttttccaattggacagaacttgcaccaaggttcacaattaccagttgccaacagattattctttttctcatttggagacacagttgtggtttgagaaaagtattgataattttgaaggagttttgggtcaaacttataggccagggtatgttagccctgtcaagagaggggttcctatgccaatcatgggtggggaacatcaaataaaaattatatggcccaaattaaaatgtttgagccactctgattattttgatatttacagcatgtga

SEQ ID NO: 90394 - DNA, 423 bp, Glycine max
  Peptide Sequence Number=SeqID_207172
caatatggtataactacagcaagcaattacccttatgaagcaaaagatggaacttgtgatgcatcaatggtgaatgaacctgcagtgtcaattgatggccatgagaatgtccccgtgaacaatgaggccgcattgctcaaagctgttgcccatcaacctggagtatttacgggaaactgtggcactgctctggatcatgcggtagcaattgtgggctatggaacaactcaagatgaaaccaaatattggatagtgaagaactcatggggatccgaatggggagaaaagggttacattagaatgaaaaggagcatatctgtcaacaaaggtctttgtggcatagcaattgaagcttcgtatccaatcaaaaagtcctctagcaaaccaagggaacattcatcatatcctaaagacgagctttaa

SEQ ID NO: 90395 - DNA, 408 bp, Glycine max
  Peptide Sequence Number=SeqID_207173
atgggatcgagtcaagtgcctttgcttaaaaagaggttctatcaagtcaaggtcaatagcctaggaatcgccagtctaaaagagttagggcagttgatgggtcagctccagcgacaagcattttgcaaagcttacggtaaagtctgggacctagccatggcagaagtctccacagaggccattgcctccctcgcccagtattatgaccagccattaagatgcttcacttttggggacttccaactatcacccatggtggaagaatttgaagagatcctaggatgccctctaggagggaggaaaccatacctcttctcaggaattagaccacaaaaagcaagtcgaaaatggggtggttggagtaccgagaagatgtttggaggcaaaagcaagaatcttggcaggtag

SEQ ID NO: 90396 - DNA, 378 bp, Glycine max
  Peptide Sequence Number=SeqID_207174
aatccacaactatatgacatatatgctgagacattgaccaccgtgtgcaatttcggagagatcttcgtgcttgatgtacaatgggaagtctggattaaacaccccaaacatggtagcattccagttgtcgcaacatgcccttttgcaggcgaacgagggcgaggctcacgggtgcgctttccaaaggaggaaagatgcgcggagtcgccaccaatgtttatttgtggaaaacttcggaaaaaccgaaggaaaccggtcaaaatgaaaattctaagttcgggagttgtatttacgtttgaggaaggtattagcacctctcacgtttgtcccaaaggacaacaacctatttttaagaattgtggaattgcgttaccttaa

SEQ ID NO: 90397 - DNA, 384 bp, Glycine max
  Peptide Sequence Number=SeqID_207175
atgatgtgccatgtccattattcttccctagacaatataagagcagatggtttgaaaaatttgttggtgataaataacacgaagaccaccattcaactttataagaaagatgcattagtctcttttgaagatgaggagtggcagagggtactatccaatatagagcctgaaaccgccagccccattggcaagtttgccccggatgcgaaacgtggcgcggtctcgccactctcattgacgatttggcctgcaacaggagtagccagtttgactggcgatttgcacaggctgtccagagctactggcgagatcaaggacatagccagtgctactggcgagatcaaagatatagccagtggtgctagcgagatcatgcagctttaa

SEQ ID NO: 90398 - DNA, 540 bp, Glycine max
  Peptide Sequence Number=SeqID_207176
atggaggaagctgctcaatccggaagcactaacctcgtgattgatcctccatctcccatcagacgacacgtgaagtggaagatggtcagcaccaagaaaactgggcaaatgatgtctgaggcatcaaaggaaattgctgacaagattgcctcacagggttccttcgtcgcccatggacgtcaggatgtactgactgttgccattgggcgaccagaacaccctgttcgtgtgtgtgctactggagttggtatgcaatcacaaggactcgcactgcctcctaagcctgcggttggtccttcagctgctcgtgttagcacaaaggaaagttgtgttgatcccttaaggaacgatatagacacgggtgactcagagaaatgcgggttgtacatcaaagaaaatcctccccgcctggatgccctaggaaaactttatgagggttcaacaaccgttcacaacatccctttgcgccatgataaagtcaaggttggtgttgaagaagttagagatgcagatgctctcattcctatacccactgaagag

SEQ ID NO: 90399 - DNA, 351 bp, Glycine max
  Peptide Sequence Number=SeqID_207177
atggaagctgccaattgtttgtcttatgaaagccaatttggatgcctttgtgaagaagaatatagggacttcggtgaagtcgttgctgcagcatctttgataggagctgcaggctcaatagtaggactagaatcagcattgataggagaactagagttggaatttgaatctgttgtgggatcaacagaagaagaatgcacagttcagttttacaagacagagattcagattagagggagatacagttttgggattttaaattctgcgaaaccggctgaagtatgctctgacataccatcaactcattgctattctgatgcagcgacatgttcttgtcgatggcaacgttag

SEQ ID NO: 90400 - DNA, 246 bp, Glycine max
  Peptide Sequence Number=SeqID_207178
atgagagttttggagagtgcttctccggttgaatctctcactcatctgcatgctggaagagggatgacaagggcaatccagtgcatgaggcacttgcctagtggggtttggggagggtggatgtatgcaaccttaatatatgaacgtgagtgggaaaagagggatgtagagtggaaaatggctggaaggttcagagtacttcattggaagtttaatatgaatgtgcttgctggttcatctctttga

SEQ ID NO: 90401 - DNA, 3783 bp, Glycine max
  Peptide Sequence Number=SeqID_207179
atggaggtaggaggggcagaagcgtggccgaaagcctgtggagtggagagatgcaacagttcactttccatgagaccggcaagtgcaagaaccataaaactcttgcgttgttgttcaacatcagttgctgcatcactagtaaacatggggtttcaaaatcagcaattaaatgatcaagcttaccaagataggtctacacatccaagttttccaaccttaaccgaaatcagttgcctgtcacagtttcacaccagtacaatggtaaaggtcacagaagcaccaaaatctacggataatgctttggaggccacgtggaatcaactaaaaaatggttgtagagggttgttggagagaggagaagacggcggtgcagatcgactaggcacgccggagaaaggagtcatggtggtgggggaaatgagatgcacagtggttgcaggtcatggcaccagtaaatgggaacaacatgccgaagtcaggaaaagagaggagaaagaagctgctgaagctttgaggcgtgaacaagagcttcgagaagctaagaggcagcagcaaaggcttaattttctcatacaacaaactgagctgtacagccactttatgcagaacaagtcaagtgtacactcttcagatgctttaccctcggtagatgaaaacacaaatgatcaagatgtactgtttgactcttcagacgctgggcataatgaggaggaagatccggaagaggctgaattaaagaaggaagctttgaaggctgctcaagaagcagtctctaaacagagaatgttgactaatgcttttgacagtgcatgcttgaggttccgccaggtggatgaagccgattcacttacacggcaattagcaggaggaagtaacattgatttgcaaaccccatcaaccatgccagtggtatccacagttcagacaccagaattatttaaaggttgtctaaaagaatatcagctgaaaggtcttcagtggctagttaattgttatgagcagggtttaaatggcatacttgctgatgagatgggacttggaaagaccatacaggctatggcatttttagcccatttggctgaggagaaaaacatatggggaccttttctggttgttgcacctgcttctgtattgaataattggaatgaggaacttgaacgcttctgccctgagattaaaagacttccatattggggaggactttcagagcgagcagtgcttaggaaaagtattaacccaaaggatctttatcgtagggaggctaaattccacattcttatcacaagctatcagctattagtaactgatgagaagtattttcgccgtgtgaaatggcagtacatggttttagatgaagcccaggcaatcaaaagttcaaacagtataaggtggaagacacttctcagctttaattgtcggaatcgcctactgctgactggtacacctgttcagaataatatggcagagttgtgggctcttctgcactttatcatgccaactttatttgacagccatgagcagtttaatgagtggttctcgaaaggccatttaactaaagtcttacagtcttttatgattaatctcatgccagaattgagaaccatgcagaacatggggcattcaatactaaaacctttcatgctgcgacgtgttaaaaaggatgtaatttctgagctgactaataaaactgaggttatggtgcattgcaagttgagttctcggcagcaagctttctatcaagctattaagaacaagatatctcttgctgggttgtttgatagtaatcgtgggcagctcaatgacaagaaagttatgagtttaatgaatattgttattcaactaaggaaggtttgcaaccatccagagttgtttgaaaggaacgaagggagcacgtacttttactttggagaaattccaaattcccttccacctcctccattcggggagttagagaatatatactatcctggtgggcataacccgatatcatatgagataccaaaacttgtctataaagagattatacaaagttcggctgttggtcatggtatctgcagggaatcttttcagaaatattttaatatttttagacctgaaaatgttcatcgatctatcttctcagaagatattattgttaaaagtggaaactttggttttacccatctgatggatttgtctccccaagaggtggcatttatggccactggttcttttatggagcgactgttattttcaatgatgagatgggaacggaagttccttgatgaagttttagactttcttatagagaccacaatcggtgatcctgaatgttaccttgagaaaggtaaagtgagagctgtttcacgaatgttattgttgccatcaagatatgagaccaagtttcttcagaaaaagtttgcaactggacccaccaatgctccttttgaggccttgatggtctcacatcaggataggctttcatcaaatgcaaggcttcttcactcagcatacacatatatcccaccaactagagctcccccaatttgtgctcactgctcagacagaaacttctcctataaaatgattgaagaattacatgatccttgggttaagaggttgtttgtgggatttgcgcgtacatctgaatgtaatgggcctagaaagcctgataatccttctcatttaattgaagagatcgattctgaattacccatttcacagcctgcacttcagttcacgtatggtatttttggctcttcaccgcctgtgcggaattttgatccagcaaagttgctcactgactctaagaagcttcaaacactggatatattattgaagcgcttacgagcagaaaatcatcgtgttctcttatttgctcagatgactaagatgctgaatattttggaggactatatgaactatagaaaatatagatattttagacttgatgggtcatccactattcaggatcgcagagacatggttagagacttccagcacaggagtgatatttttgtgttcttactgagtacaagagctggtggattgggtatcaacttgacagctgctgacacagtcatattttacgagagtgattggaatccaacattggatctacaggcgatggatagagctcatcgtttgggtcagacaaaagatgttagttcatctctaacctttgggggtgaagaagatgagaatttaggagggccaagagaaagaaggggtggcaataatatgatactaatgcatataatgagcacattctgggcttttgggggggcaactgccccccttggaatcaacctagttccgtctctgaatgtcacttctcaaacaaatggtttatatagaacttccttccttggatatagctctgtggttactgtttaccgtcttatatgtaaagagacagttgaagagaagattcttcatagagcaagtcagaaaagtactgtacagaaccttgtcatgactggtggttctgttggtggtgatcttttagctcccgaggatgttgtatctttgcttcttgatgatgttcaattgcaacagaagttaaaggaaattcctctccaggtaaagagtaagcaaaagaaaaaacctaacaaggctatacggataaatgaggaaggtgatgcatctttggaggatctaacaaactgtctagaccagggaactgcaaatcatgatacttccatggatccggagggaccaaagtccagtaataaaaagcagaagttgtctagtttcttgtatataatggaggatcttttgcatgaggaattgtcatctggctga

SEQ ID NO: 90402 - DNA, 537 bp, Glycine max
  Peptide Sequence Number=SeqID_207180
atggatttggagtttgattttgaggtcaacaatggattgtatgattgcattaggaggttggtttcacaacctgatgtgctacagaagattctaactaggttgcatctttacaagactagtgttggtatcttcagttgtgattttgcaattaaacaaactaaaattgcttctcctaattcattctcaaaaagatataggactgagcataaaaatttgcatgatttggtgtttgtcaaatacaaccaacaactcaaacaaagagataatgctagagatggaattcatccaatttctctcaaggatattgacatgtgctggatacaattgggatggcttaaatggagaaaagcatcagggtttatttgtgatcgtaaagtgcctaccaagctcaaaggaaagctttattgtacagctatatgcccagctatattatatggtagtgaatgttgggctttaaagggacaacatgagagaaaagtcgagggtagcaaaaatgagaatgttaagatggatgtgtggccatacaagaaaagatag

SEQ ID NO: 90403 - DNA, 777 bp, Glycine max
  Peptide Sequence Number=SeqID_207181
atgacacccacccagcgcacattagtattcacccgtgcttcgcacaccggctgcgtctatgatctttctcttctctctcaccgcgacctttcttatccttcgcaccctttctttagggctaaggcttcttctcctctctccctaacctcttcttattcttcttcgctctttcggaaaattaggcgcatggatcgcaaatccaaacgcaaccactcgttctcctactccactctcttcaacctcgagcctttgaagaactttaaacttccacgtgaagatgatgatgattttgattattatgggaataatagtcaggaagatgagagcagagatagccaaggtgaaagggaaaattactgtaatggaaatgtgcacgcaagggagcagaattcgtcgagtaagagggtgtggtctgagaacagtgatactgatgatgagaataagggaagatattatgggacacacatgacacaggaacgatatcaatcaatgcttggagaccatgttcagaaatacaaaaggaggcgtaaggatgccatgtctaacactgatcaaaatcaggttgttgttcctcttgtcaaaagtaacaatggcttaaaaattcaaaagtcagggaatgattgtaggggagcatcacatgctgaagaaagggcatcggaatggcttcaggatcagaaacaaggaaacttcagtcgtgcagatttcaagcagcaatatggcactgataggtttgccttccttttctgttgcattgatagtgttggaggtttccaatga

SEQ ID NO: 90404 - DNA, 198 bp, Glycine max
  Peptide Sequence Number=SeqID_207182
atgttttttatgattggtcccctctcatccctgagtctgccccctgcttccctcatgaagtggaaggagatttatttcccaaaggaagaagaggcggtgatccagatacaaagccaattagggagcagtgataatgaccaagacaattggctagtggggaatggactcactaaagagtccttcaatgctaaagcttaa

SEQ ID NO: 90405 - DNA, 447 bp, Glycine max
  Peptide Sequence Number=SeqID_207183
atgtcgtctctagatggcaaaggtgcggatgatcatgagttgtctccgtgtgctatcgaactcgatagtctctggatagaaagggtggtggatgaccatgagttgtctccgtgtgctatcgaactcgattgtctctggataacaaagcgcacttgcagcttaacaacaaagggatcttctttcttggcagacccttccgttccttcttccgagggtaagggtagcaattcctatcctaggtcaaggtttatggccgatgagctaaggttttggctcaacaagcttgtagagggccaaccggacatgatgtatgtcagggatgctaggccaccgtggcctcgaactgctcgggagtgggccaagggaaagggtcgtggtcctgactttgctggtgcaggttgtaacgatagaacatctcgttcagccgccccttccctctgtgattag

SEQ ID NO: 90406 - DNA, 873 bp, Glycine max
  Peptide Sequence Number=SeqID_207184
atgggatcattcatgatcatgaaaggaagttttatcgattgcttcaacagtagttgtagtgatacagatatcttgcatgctgaaatccttggtcgtcatgggattcacatttgtaattggaataatatcaccgtcgtggaatgcttttcgatattatttaattccactgtctatctccctcacacacattttctttgtatctctttctcttctgagaacggcatccgcgcgccacgccttctagctccgaagcaacagtgccgtccaagtatttgcataggggagatcggcaaccaagttgacaccgcacatggtcatgagtcacacatgtgccgccagagcatgcttaaacacaacttcaatctagacgaaactgaactggagttgcacaaggctagaccacgtggtcagatcaaagaaggggctgatgggagagaaaatggtgttgctgcgcaaaatgatagtcagtcaccggtagcggcgagtttcccttgtgtcccttctgactccaatttctccttctcttttttacttgcatttgatgaaggctttattgttaatgggcttgtcttggttgcgacggctacaaagggggcgatggtgtgcttgaagtggagattcgctgaggcagaaaatgaataccatcgagccaagaaccaagaactagtgaatctgcaagaggaatcatcaatcagacaggagcaagctcgacaagtagaaggaagagcacacgaagcaaagctagcagaagatgttaacatgcgaatattggttgatcggggattaagagccattctaaccgatcaaaataagttggttgtagcagtttgtggagtgactgctctggcagcagggaggggtctacactgcaag

SEQ ID NO: 90407 - DNA, 933 bp, Glycine max
  Peptide Sequence Number=SeqID_207185
atgaaggccgatatagaggccatgaaggaacaaatgacaatgatgatggaagcaatgatgagcatgaggaagatgatgaaggataacactactacagttgttgctgcgagtactgctactaggataggactcaacgttctcacctttatttttcataggactcaatgtcctctatctttatgctttcatatgactcaacatcctcgccttcatgttttcataggactcaacgtcctcgcctttatctttcataagactcaacatcctcacctttatctttccataggactcaacatcgtcgcctttattttccataggactcaacgtcctcgcctttatgtttccataggactcaactggcatcagagcttaggttttgaattgagagaaacacttggtgaggggagtgaaacacttagtgaggatagtgaaacactagtgaggttgctaggttcccaagatgctttggagaaaggttatacacaaattgaaaatgaggattcttttccacaaaacaagaagttaactttgttgaagatgaagaagacggatcaagaagcacttaccttcatctgtcaaggtttagatgaaggtatgtctgagatggtgtccaatgcttctacctccaaagaagcatgggagattttaaggacatcccttgaaagtgttgacaaggtgaaaaagttgcgtctacaaactctttgtggaaagtttgaatccttgtgcatgaaggaattcaagtcaattttggattttggaaatagggtggtaatggttgtgaaccaaatgaagtgttatagggagaatacgaaagatgtttgttttgtagagaatgttcttcattctctaattgcaaaatctgattttgtggtttgtgcaattgaagagtcaaaggacatcgaatcaatgactgcggaccaattattgggttaa

SEQ ID NO: 90408 - DNA, 261 bp, Glycine max
  Peptide Sequence Number=SeqID_207186
atgaccgagaacgagaacgagaacgcaatagtgagtagagttgtgagtgagagcgagaacaagagcgcaagagtcagagatgaggggtcactgtgcagctacaaagagtgtgtgagtgagagtgagagtgagaatgagagcacgagagtgagagataaggggtgtcgtcgtgccgctgcaaagagtgtgtgtttgatgattgacaagttggaagaggacctagaaaaaatgaaatcttcgacaacactgattgcaaactga

SEQ ID NO: 90409 - DNA, 1527 bp, Glycine max
  Peptide Sequence Number=SeqID_207187
atgctcattttcttcttcactcttctagtgtccttctcagggtttctccttctctttttggacacacaaccagaacaacaacgtagtcataattataaccatgcacctctttcgcacccaatcattggatgcctcgtctctttctaccaaaaccgccaccgtctactggattggtacaccgaacacttagccaattccccgacacagaccatcgtcgtgcgccgcctcggagcacgacgcacggtggtgacggcgaaccctcgcaacgtggagtatattttaaagaccaatttcggtaacttccccaaaggcaaacccttcaccgaaatcctcggcgaccttctcggctgcggcatattcaacgtcgacggcgagctgtggcacacccagcgcaagttagcgagccacgagttcagcacgcgctccctcaaagacttcatcgtgaagacacttcaagaagagactcaacaaaggcttcttccattgctggagcatgcagcacgtgagagccacgtgatcgacttgcaggacgtgctgaggaggctcacgttcgatactgtgtgcagggtgtcgctgggatacgaccccagctgtttagatctcgcgaagcccctgccgcctcttctgacggcgttcgacaccgcgtcggaggtcagcgccgctcgtggcgcggcgccggtgtttctggtgtggaagatgaagagaatcctcaacgttggctcagagaaatcattgaaggaagcagtgaagctagtgcacgagtccgtggtgaagattataaaagcgaagaaagataaaattgcattcaatgaaagaaattgcggcatggatttgcttgataggttgttgaaagcaggacacgaggaaatcgtggtgagagatatggttataagcatgataatggcggggagggacaccacttccgcagcaatgacgtggctgttttggttgttatcaaagcatagagagcaagaagcatcgttagttaaagagttttcttgcggagaaaacgaaaataagtgtttggattatgagtgtttgaaagaaatgaaattgttgaaggcatgtttgtgtgagtccatgaggttatacccgccagtggcatgggactcgaagcatgcgggtggtgctgacgtgttaccagatgggacccacgtggggaaaggggatagggtgacctattttccgtatgggatggggagaatggaggctctgtgggggaaggattgttgtgagtttaagccagaaagatggtttgatgaggagagtgtgaagaaaggggttctgaagtgtgtgaatccttataagtttccggtgtttcaggctgggccgagagtgtgtattgggagggaaatggctttcattcagatggagtatgtggtggcttctattctcaaccgctttgtgatttcgcctgtttctgatgactatcctcgttttgttcctcttctgacggctcatatggctggagggttcaaagtgagggtccactacagaaatggaactcaaagaatcaagctagagtga

SEQ ID NO: 90410 - DNA, 423 bp, Glycine max
  Peptide Sequence Number=SeqID_207188
atgcaaaccgccagtcccattggcgagtttgccctggctacgacacgtggcgtttgtagtggtctcgtcactgtcattgacgatttggccatgcaaaggggtctagccagtttgactagcgatttggccatgctagggcgcagtagacttgtagggctaggcacgagcaacaggttgcaggcttgcagcgcttttcaaactgggaatcaccaacaccactggcgacttgtgcttggatgtatcaatggtatcttcttcgttatgttcatcaaatatacaaagccatcaaatctgtctcataaaaatgacgatctcgaactcattcaccgttggatcgtagtgaaatttaaaaagcatgtttgcaacccatttccaaacattctcaccgttgggaatttcgatatcacgtctgagctaagataa

SEQ ID NO: 90411 - DNA, 1203 bp, Glycine max
  Peptide Sequence Number=SeqID_207189
atgcttaaaagtcaagattaccttagagaagctatgaaagaaaggattgagggattgttctccaccaaatccttgaggtggattatgaggatttcgcttcaattaaaatgttcctcttggtgtggtggtttggcggcaagcaacgatggctcttggtggccaccagtggtcatgggtggtggaggaggaggtgttagggcttgggtgggcgtttggagagaagacgagcgaaaaatcatacacatgactaaaccatcgaactcccctccttctgagtcagcaccttcgtcgtcttctccgaagaagactagaaaagcaacacagatcagatccttggataccagacccattagaatggagagatcagtggtttatatggatcctaacactgggaaagttgatgaagcatccaaccaaaggacgaagaagaaaatccttaagacgataggagagcgatggaggaagtttaagtcagatttgacatccaaattgactctagaacaaggcaaggaggaggacgatattggcaaagaaaagtggcaacaattttgtcagagtcgtagagaaccttcatggaaagatgttagaaagaatgcccaggtcatccagaaactcaacactgcccctcacgtgttgtctcatggggaaacaattgttgatcctccatctcccattagacgacacatgaagtggaagatgactcacaccaaaaaatctagagagatgacatctgaagtagcacacgaaattgcaaataggattgatgtgctgactgttgccattgggcgaccaaagtactatgatcgtgtccgtgttgttggagtaggtgtcacgatcaaacaatactttggaccaggttcaaaaagctcctgcacttctacatccatcactcccaaagagctagagcaattgacacaaaaaatcagggaccagttggagcagtcgatcactaaaaaggtgactcgacaactaatgttgtccttcaaccagatgcaatcgcatatgcaatcccatggactcgtactgcctcctgagtctgaggttggtccttccgttgcccgtgtcagcacaaagggaagtgggtcgacaaccatctacaatgtcccgttgggcaatgatcaagtgaaggttagtgttgaggaagttcaagatgctaatgcttgcgtccctgtacccactcaagaggttcagctagtggggtag

SEQ ID NO: 90412 - DNA, 465 bp, Glycine max
  Peptide Sequence Number=SeqID_207190
atgagcgaaacaatgaataaaggaaacgagttcgaagctaaaccacaaaatgaatgttccagacccttaaacccttccgctgcatggctatttataggaaaaggccatttggtgcaggggaagctcgcccaagcaagctggttgcttaaagttgaaggtgtcaactcacccaggagagtggcttgcttagggctgaagaaatttcatggctcagcttttgtttctggaactaataaacaaccagcgaaaccctacgcgaccccttggccttgcactgtaaccgatgtcaaacaacaacagctagaggttgtattcctacaaggcaacacttctaaacaaagaggcatcaatgcccaatcatatgccctctttgcactcagcgcgatgcacaggctcaatgggcaaagcaggctttgcgttaggaagtatggagaggtcttgatcttgaaggcgctcttagcatga

SEQ ID NO: 90413 - DNA, 201 bp, Glycine max
  Peptide Sequence Number=SeqID_207191
atggagatggtgattaataatgagacaaacctccacggaaagcgttggagggaggcacttcgggaggctgctggcatttcgggggtagatgacccagcctgggttggtgacccagaagatgatggtgaactcttttttggagatggctttggtagagccagtttgaatccttttcttgtacttcttcctcccctcagggag

SEQ ID NO: 90414 - DNA, 945 bp, Glycine max
  Peptide Sequence Number=SeqID_207192
atggtcggacgctttactcattgtcatgtccttcacttgaacgtgtctttccctagtgttcagaaaacaatcctccaacgggtggggaccttcaaaagacactctgatgctcaagccgggattgaaagggtactagattgtggccgagagggtattaggtcaagccgagtcaaatacctaaggtttcctcctaccaaagagggttgggattatttgggtattcagcctatcaaatactcaagttctttctttatcaagggagtactaggtcgtggccgaagggatcctaagttgcatcgaggggaagacacacgagcttctttcacttcgcatctctatgcatctcttcagaatattagaatcattgttttcaaggatgacaagtcacttccaaagggagatcacatttcatactcactattggtgaattggagaaataatggagtgtcacagaaccatagggcaggtggtagctatgaagcatggggacgagtgttaggtggtgttccccatttccgtggcctacacgtgcgtccccatggtccaaaatttatcggctttctgtttttcactctctctctcctcgttgggctattcgccacaatagccattgtcgccacacaccgaatctccttcgcattggtcgacaccggcaagggcaaccaccatgccgagtcagcgaagttgagacacccaaatcctagtggacttgtcattgggaacacaaacctcgtagacccacttgttgttcctctgccacactcctctgtacataggaatggccatcaccaggcaaaccaccaggcaaatcctcatggacttgttgttggtggtgatgcatttgattcaatggaggatgtgagatttttagagtttgtagaactctcactcgatgagccaaaattggagaatgagttgatcaccgagaatgttgacaatgcttga

SEQ ID NO: 90415 - DNA, 558 bp, Glycine max
  Peptide Sequence Number=SeqID_207193
atggaaagaaaaactagaaagaaaaaaaaaggaaagcagagggtaaaaataaatcaagatgaaagggaacaaataagggaagaagaaagaaggaaaatactaaaagagttaagaaaagaaaaacatgtcacctatagtagtcatgactcttgtaagagcctaagtgaagaattttgtgactattatgaaggaaggcataggtcatatcttagacctcactcctataagagagagaaggaaaaaaagcctcaagaggctaacattaacctcccatacttccatggaaaggacaatgtaaaggcttacttagattgggaaataagggtagagcaacaacttaaaagaaagtctacttcaaaatcttacggctctcactcttatccaaagaaagaccaaggtctagacatcttatgggcagcaccttctaagcccaaagatgataagtggaagacaatagaaaaacaaccccctaaggctattttaggagaaaggatgaagaataagaaggttgaagcaattggtgtctcgctaagcgaggcatatgcgcttagcgagtaa

SEQ ID NO: 90416 - DNA, 255 bp, Glycine max
  Peptide Sequence Number=SeqID_207194
atggttacttcactttcattggttaactcatacccaagacttgttgttgcaccacacatgtttgtgaatgcctacaagaatgttcttgctgttgtggttgagacaaattattctttgcctaaggcagataaggtcaaggtgtatttgaaggaaacttctagacaatcacaatttaatggtccgatgttgccaatcccaaaattgatgctcaaagggaagaagctccgcgcaagggcaagggcaagaccgatttag

SEQ ID NO: 90417 - DNA, 539 bp, Glycine max
  Peptide Sequence Number=SeqID_207195
atgcccaccgacacaacgaaaatcatcacactcctctcattgatcacaagctacgccctttctaagcctcattccccgcttaaactcctatattgcaccgacacccgtggaagcaatgccttccaagggtacatcctttgtggtacaagtatagagtacatctacttgggtttgactgagaacaagagagggtacatctcttgtggatcggttctaatggagggtacatccactaggttgttcaaagagaacaagggagggtacattccttgtggatctttgcttgtcactcgatccaacaacaccgtccatgagatggagaagatgctcactgagctccatcttctccatgattatcagctctaccacctcggccccaccttcgagatcctcgccctcggcctttcatctaggaagaatctttgtgctaactcacgggttctcaccaccgagaattacgactccacagatgttgactatcggaagctgacctcctcatgggtctgggcggtggctgcggagaatcccaacatgtcaag

SEQ ID NO: 90418 - DNA, 289 bp, Glycine max
  Peptide Sequence Number=SeqID_207196
atggcccttggtgtcgaggagaaggtggagaaagggtatcgggaagaggagaacaagaagacaacgatcattgacgtcgacgtcactgaagaggatggccctgacattgaacatctcagtgtggttcccacagtagcgttgccccactatctgcaaaccaccaaacaaacccttttcatcaaaacatttatgttttatctgaacgggttggagctcctgctcatgttggtttgggctgtggcgaatccaacccaactgcaaccaagcaattgttggtgtgagaaggagg

SEQ ID NO: 90419 - DNA, 429 bp, Glycine max
  Peptide Sequence Number=SeqID_207197
atggtgagggagcatttggtcttccaacataaatccctaacgaaagggaagagaatttggtgcagacgcagcaaacatagatatacaacaacacaaataactacttctccgaagcagggtcctggaatacttgaatgtgaagaacagaacaaggggctgcttccaagagttgtagaaggactttttgattccataaattctttggatatagaaaagacatattcggttaaattgtcaatggttgaaatctacatggaaaaagtaagggatctatttgatttatcaaaagataatatacaaattaaggagattaaatcacgaggaataattctacctggcgttacagagtttttgattgaaattcacataacagcaatgcatggggtttctaatcttattagtcgtaaacataccagcttgcctaaataa

SEQ ID NO: 90420 - DNA, 465 bp, Glycine max
  Peptide Sequence Number=SeqID_207198
atgaatggtagtgaagaagatgatgtaaccataactttgtttcaaactagtgcattcagtgtaactgtgtttgttgtctcagcaaaatctatgcaatgttcttatgatccaaaaggaaacagtgtccccattattctcttgctaatgcaggaccatttatactcacagggaagtttaaagttgaatagaggcattgtaccagatgacattgatgtccactatttagcaaggttgatcaaagcctggttccaagagctacctttaggagtgctagatggacttttccttgagcaagttcttcagtgcaacacagaaaaagaatttgttgagcttgtgaagcagctaaagccagccgagtctgctttacccagttgggctattgatctcatggttgatgttatagaagaggaggaatttaacaaaatgaatgctagaatattgcaatggtttttgctccatacatga

SEQ ID NO: 90421 - DNA, 240 bp, Glycine max
  Peptide Sequence Number=SeqID_207199
atgatgaccgtcaccgattggctagcgacaacgatgatgaccagagtatatcaacaaagagagggaaatagcagcaagtgtgagcaccatgaaagaaatagtcaacgtcaaaggggaagggaaatttcttggactcccccttccatgggatgggtgaaagcggatacagatggcttgattagagacaatggttgccatgattcttgtgcgagtgtcattagagatgtgcatgggagatga

SEQ ID NO: 90422 - DNA, 369 bp, Glycine max
  Peptide Sequence Number=SeqID_207200
ccacaagaacagtttcacacagcttttcaaagaatagaaataggcctagtaatctccatctttgccatgtttgtgtttggcacattggagtttctaaggctaagggaagtcaagaattacaactactataatctcaagcacatgcttatgtcaattttttggcaagtgcctcagtacttcatcataggatttgctgaggtgttcacatttgttggaaaattgaagtttttctatgagcaagctcctacatgcaatgagagtctttgttcttctttgtctctcacaacagtagcacttagaagttatttgagtattatgcttgtgaatgttgtgacggatgtgagcactagacatggtggaagtggctag

SEQ ID NO: 90423 - DNA, 232 bp, Glycine max
  Peptide Sequence Number=SeqID_207201
atggctgatgaagaccagctaagggttacccttgaggattattctagtagctcagtgtcgcaattctttacaagagaagccaagaagtggctacattcattcaaaggtaatagtctgaagatgtgggaggaagttgttgagaaatttctgaagaaatacttctccgagtcaaagactgcagaagggaaagctgctatttcatcatttcaccagtttcctaatgaatccttga

SEQ ID NO: 90424 - DNA, 630 bp, Glycine max
  Peptide Sequence Number=SeqID_207202
atgacagagaggtacgcctggggagtaactgctctggttcatatgtacgaccagctgaacgatgcatctatgagccacagtcgacagcttggcgattacatcacactaccgcagtgctggatttacgagcacttttcctcggtcgcggagtccaccgctgatcaggactacgacgaggcttccccgatcccttatggggagcatcgggaggtccgggacttccacgtcagatcatgctattccggtctcttgcgctgggggcctgttgttgtttattaccgaccggagagggtcgtgtggcagtttggctacacacagaccattcttgctcctcctgtcgattcatgggtctcgtatgatgatatacacgacaggtggatgcactacgaggatcatatcgttccagcaggtgaggtgtgcgttgtgtcaggccagtgttccaatgactacatggactggttcttcggcatctcccatcctctcatgacaccaggccacgcatcaaattctctgcttcatggtcacgccctgcagccccgagtcgtccctcaggccccgcagacggatatccctcacgtgccagagccaggagcatcgtcgacatctgcggaggagcctagacatgcagtg

SEQ ID NO: 90425 - DNA, 246 bp, Glycine max
  Peptide Sequence Number=SeqID_207203
atgggctcaaaaatctaccctaaggttcatgagaaccctaaggccttctttatcaactctagcccaatcctcttggagcctcttgctcatggctctggtaactggtcctttcctagggaggattgcatcaccaaggttctaagtagcttaaggttgtgtctcaacatggtcttttcattgtgcgtgcccgattttgatatttggggcaaaacaaattcatgtgtcagggtgtcggtttcgggttaa

SEQ ID NO: 90426 - DNA, 120 bp, Glycine max
  Peptide Sequence Number=SeqID_207204
atgtgcaggaaacataagaggatttcttcaaagtctttagaagaagctcgcaacacctttggaactgatgaggatcttctgttgtggtgcagctatcataatcttcacttaggactttaa

SEQ ID NO: 90427 - DNA, 1202 bp, Glycine max
  misc_feature (1190)..(1190): n is a, c, g, or t
  Peptide Sequence Number=SeqID_207205
taccatcaccttcagaggactgcacgtcctcaccttcagaggattgcacgtcctcaccttcagaggactgcacgtcctcaccttcagaggactacacgtcctcaccgccattagggggcagcacgccctcaccttcaaaggactacatgtcctcgccatcagaggattacaagtcctcgccatcagagggttgcacgccttcagaggacaacacgtcctcgcctttagaagactacacgtcctcgcctttagagagctacacgtcctcacctccattagggggctgcacgccctcaccttcaaaggactacatgtcctcgccatcagaggattacaagtcctcgccatcagagggttgcacgccttcagaggactacacgtcctcgcctttagaagactacacgtcctcgccttcagagggatacacgccctcaccatcagaggactacacgtcctcgccttaagagggctacacgccttttccttcagaggactacatgtcctcgccttcagaggacttcacgtcctcaccttcagagggctacacgccctcgccttcagaggacttcacgtcttcacctttagagggctacacgccctcgccttcgtagggctgcatgtcctcaccttcagagtactacatgtcctcgccatcagaggattacaagtcctcgccatcagagggctgcacgccttcagaggactacatgtcctcgcctttagagggcgacacgccctctcctttagaggtctgcatgccctcacctttagaggactacatgtccacgccttcgtagggctacacgccctcaccgtcagaggactacacgtcctcaccttcagaggactatacatcctcaccttcagaggactacatgtcctcgccttcagaggactacacgtcctcgccttcagagggctacacacccttgcctttataggactacacgtcctcgccatcagaggactacacgtcctcacctttagaggactacacgtcctctccatcagagggcttcatgtcctcaccttcagaggactacacgtcctcaccttcaaaggactacacgttctcaccttcaaaggactacacgtcctcaccttcaaaggactacacgccctcgcctttgtagggctacacgccttcaccttccgaggactagacgtcctcaccgtcggagggctacacngcctcgccttta

SEQ ID NO: 90428 - DNA, 372 bp, Glycine max
  Peptide Sequence Number=SeqID_207206
atgacgaaggaagtgatccacggtcacaactcacagtgcctcggctccacttctccttcttcttctatgtttttctctcagctttcagcgagctgtagctcgcccaggcaagtttatgacttagtgctaaaggcactaatttgccctggcgagttagatgctagcctgggttccctattgttgattgatgatgccactaataagagaacttttggccattatgctagagttctagttgatctggactttgctagagttcttggggaccaagcaatagaacacaaggatattccttctattgttgacaaaaatggtgttgttgagaacatggtgaagggttcagttcctgttcaatcagaaaacacatattag

SEQ ID NO: 90429 - DNA, 549 bp, Glycine max
  Peptide Sequence Number=SeqID_207207
atgcattttcctcctatggaagatgcacccgtgagcctcgcctcgctcgcccacaaaagggtagataatataagttcattcacgagtgtgccgccgatgctagggtactcaaagcgaggagtgtgcgctaccattgcaaccccattacagtgcaccgccatgaccctgttacgatgcaccagcatctttctcatggagcctgtccccttttttccttggggatttctcaataagccatcaatatcaagtcaccaagagcatacctttgtccaagccctcaatcatgtgtgtaacatccctctcaaccaacttcccatgctgtgtttgaagggagagcccatcttagtcaccattttggaagacaagtacggaggtagtctcgaagggtgcaagaaccatttaaatggacgtatcattttacctaaaggggccaaaccgatttccttgacagatttgcgattgagattatcaaaactatggcagtctctgaagcaatggaatctcactccgattggcaagggattcttcgaatgtgccttttcatcttag

SEQ ID NO: 90430 - DNA, 354 bp, Glycine max
  Peptide Sequence Number=SeqID_207208
atggaacaccgcatttgtggtggtctcagcagtgatgctcgcttgcaccatcaaggagaaccccaacacgccgatttgttggtggatctgcgactacgcgctacagtgcctcatccatatggccttcgtgtggctgagtaccacaggaggaacgacgctcccaacaatagcgacgaggacaatgttggaacctccgagagttcctcttccttaggattttgtttcaaatggcttttggggttgcaagctgagaaatttgagatgagtagccaaaagggtcatcatgaacatgaagaagagatgggtaccggtaaagtggttgtgattgcagtaaaagcttctagagatatttga

SEQ ID NO: 90431 - DNA, 609 bp, Glycine max
  Peptide Sequence Number=SeqID_207209
atgataggaatacgtctctcttccataaagttgccaactaccacaagaccatggagcgaatgtccattctcaaggatggaaattgtattctctaatcgcaacaagcaattcaaaatcatgtcatttagtactatgattctctatttgcctcagactgtttgttttactaatgatcttattgccaagcacattcctaatatggtctttgatgaagataaccttatgatttctaacctgcattcttttgatgaagttaagatgatagtcttttccttgagtgggaataacacccttggtcctaataggattaaccaatacatgcctattgctatgacaaactttcaattcaagataatctccaaaattctcgtagacaaacttgctactatttctcccaagattatttcaacccaccgtagggggtttattagagaaggggtgtttgtcagggggaccccctctctccctttttcttctgtttggcagaggaagtcctcagttgtggtttatgcatggcccaaatcactcctcaaggaggttgaatgttgggtccataatttccttttgagttgggacattgctattaggaagttggtcaccgtgaagtga

SEQ ID NO: 90432 - DNA, 317 bp, Glycine max
  Peptide Sequence Number=SeqID_207210
atggcatgcaaccttcgcttgaccgcttcgaggaacttgacacccatcgttaagcaatctgtgaagtttcacgacatgtcgggagtcgaaaggaaacattattgtgcaatccgtaaagttccctggattgcttctggaagcaatacagctcgcctgggcgagctaggcggcaacctcctccccctttttcctataaaaaggcaaaatggggctgttctaagggtccctgatccccctggctatgcatttcagctcaaatccgcgaaggttttcctccgttcttcaccgttcttcatctgttcttcattcttcaacgg

SEQ ID NO: 90433 - DNA, 258 bp, Glycine max
  Peptide Sequence Number=SeqID_207211
atgcccattgcggtctatataagtgtgggttggccagtcctttgtgaaggcaacacacaaggacatcagaagtacgacaaattaagacagggcctaagagaaagtgttgtagataggatacagagagaaagagaaatggattctcattgggttcgaatggtgcttctcattgcttgcattcttccagctttggttgaatgcagagtgaggcactacaaatttcataatgatgtcgtgacaactgcgagagtagcttag

SEQ ID NO: 90434 - DNA, 876 bp, Glycine max
  Peptide Sequence Number=SeqID_207212
atgaacaggggaattgaagttctttctccagcctcatacctccgaagttccaattggctgttccaagaaagcttggggaccaggtggactccacaggagaacaagctctttgagaatgctttggctgtgtttgacaaggacactccggaccggtggctgaaggtggcggccttgattcccggcaagacggtcggcgatgtgatcaaacagtatagggaacttgaagaagatgtgagtgtcattgaatcagggtttattccacttccagggtacactgctgctgattcctttacattggagtgggtcaacaatcaaggatttgatgggctcaggcagttttatggtgttactggcaaaaggggtgcttccactagaccatctgagcaggagaggaagaaaggtgtgccatggactaaagaggagcacaggcaatttctgatgggtctgaagaagtatggtaaaggagactggagaaacatctctcgcaattttgtgaccacaagaacaccaactcaggttgcaagtcatgctcagaagtatttcatcaggcaactaagtggaggaaaggacaagaagagatccagtatccatgacatcacaatggtgaatctcccagaagcaaaatctccttcatcagagagtaacaacagaccctattcaccagatcactcagtgaaggatgaacatgattggaaattgccatgtgaaactgtgcctatgcttttcaattccacaaatggaaacatgttcatgacaccactttgtgggatttcttcatatggatctaaaccacttcaggagcagtatttcctcagtggatgccagtttggaccttatgatacaattatgcaaatgccgtccatgcaaaatcaatga

SEQ ID NO: 90435 - DNA, 264 bp, Glycine max
  Peptide Sequence Number=SeqID_207213
atgacgatttcgatcttgcaatgtgatgagagatctgtgacgcgaatttcttcatggttactatttaagggagtttgggacttgttgcggcagcaacggaaggacaatgatgtggtggcaatggtgatggtgttaagaaagacagtggaggtgttaaggaggaagacaaaggtgtttgcggtgacaatgaggggttcgttggcgtcggaagtgtcatcagcgatgacaaaggtcagagatcacgagtgttgtccaacttactga

SEQ ID NO: 90436 - DNA, 210 bp, Glycine max
  Peptide Sequence Number=SeqID_207214
atggaaaatggagagtacgctgaaggagaaaaggatggagtgaagtgcggaggagtacaaagaaggggaacaggaatgtcaaaggcactgagttgtgattggtggatagggtgcttgtgggcgctgagaccacacgatggatacaacaaggcgtggactggtttgggcaaattggtaatctacatggaggccatgaacattgacgtttga

SEQ ID NO: 90437 - DNA, 1116 bp, Glycine max
  Peptide Sequence Number=SeqID_207215
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattccccaaacaacccgactcgccgacagcgcctcgtggtgcgacaggggtccgggcacgacggggctctcaccctctctggcgcccccttccaggggacttgggcccggtccgccactgaggacgcttctccagactacaattcggacgccgagggcgaccgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaa

SEQ ID NO: 90438 - DNA, 1683 bp, Glycine max
  Peptide Sequence Number=SeqID_207216
gccttgaaacgaaaactccagatgtgtttgttgccacatgtgtcataaagagagtcaaggagaagccatctgagattgacagagggtgtaatttgagttctccatcttctggttttcgtgatgtcccaaaatgtccatccaatacaaaattagtctctgtatctagtacaaagcgccctgtatcttcctggaggcaaacccggtcccatcaaagtcgagtaggtcctgatccccatgatgattttcttgatacttctcttgagaatatcagagaaaatttaaataaggatttgaacaaggaagaccaaccatgcctgattcagaaagacattagtgcggacagctcagatgacgaaacacacgatatgaatgccaaaagcagtcctcagaagaagcaaaagcaatcttctgttacagtggccaacacaagaagtttcaagtacgttgaaccagttaggaagaaagctgagcgtgaaaatttaaaaggagttgaatgcaaacaatgcaggaagttctatgatgctgttcttcctaatgctgatggcaaggatgctgacagtaagcagagcttccgctgtgaacaccttgatggtgtttctaggcatcgatataggtatgttcctcccatgactcctgaaggattttggaatattgggtttgaatctgaaatcatcaatggctgccttcgcttcttccacgtcccctatggggaccgcatcgaagccgccactgcggaactcacctccgatcaaaccatgtccaccaaactggatgaaattcttcagaggttgacccttcttgaaatccactatcagttttccaatgtgctccaaccttctttgaccccttcatctgagcaaaccgctgccggcgcggttcctcagttgaataccaaagacggagccgcggagtttgaaccgagcttcgtttgcttagacaaaaaggtgcagagcctcatggaagagtcgctgaactcagtttctaatcaagggagggttgtggaaaatcaaaccatggaggcggaagttcatggtgaagatggttccaaatttgcactgggaagcaatgagaagtcagtgtttggacgaggttgcagattcggcaactacgactgcacagtgtctcgtcaccacgtgcccttcgaactcgaccattcagactcagaggatgctaatgctgtttcatttgaagtcctgaaggagacacccttttgggtgtatgacagagaagcgcttgggctcttcaaaaagttcaacaaaggtctggggcatttccttggtattgacacatttgaccctggaggctacttaaagggcttgaaaagaagaaaggaaataattgattaccaatatgcctgggggtatattatgggcaacgagaggttggatgcaaattacgtggttccccaatggatgccacaatttatgtgcaaaagtgaagctcgaactttgattgttttggatgaggtgtggacactctccgtggtggatcagcttatgtgtagaataccaggttgcaagtttcttgtagtgtcaaggccaaaattccaaatggtgctgagttatgaagtggaattgctgattgaagaggatgccctgtctttgttctgtcaccatgcttttggactgaaatcaattcctttagctgctaatgagaatttggtcaagcgggttgtgactgaat

SEQ ID NO: 90439 - DNA, 216 bp, Glycine max
  Peptide Sequence Number=SeqID_207217
atggcaggagctggtgacggtggtgagccctatggacgaatagaaggacaagagcaccaaatgaatcagaatgttgggagaccttatggtgggatcagaaggggcaataatggaccgaggcaaaatagaatggaatggcagaacagaattgagggagtaaaactcagtatacctcctttcaaaggcgagagtgacccaaatgcctaccttgactag

SEQ ID NO: 90440 - DNA, 262 bp, Glycine max
  Peptide Sequence Number=SeqID_207218
atgaattgtcaacaaaatgcacatgaagaaataactcatggtcctgtctatactccttcatattctcctcctgatatcactccttcaccttctactgcttatgctccttcagcaacaccaaatgaatccatagcagcacctaaagtagaagaaacaactaataatttggaggggacaacaaaaacagaaacaagtagacttaaaattgagatttggaagcattttaaaaagatcaaagctaatggagaagacaaggcccaat

SEQ ID NO: 90441 - DNA, 426 bp, Glycine max
  Peptide Sequence Number=SeqID_207219
atgcaaagaagatctattgcaggtgatttgatttccattgatttagaggaaagtagagctgatcagaaggtggaaggatttaaacaacagctggctgatgaaccaacgttggaatcggttgatgatttagttcaacttgtagaaattgttgaggaagcagaagagaaggtcattgagactgagaagaagaagggtaagagtgaggctaacatagaaaagaagaaagaggctcctcctattgaatgcaaggagaaactggaaattaccttgccttttggagaagcacttcagcaaatgcccttctatgccaaatttttgaaggatatgttaaccaagaagaacttgtacatccatagtgacataattgttgtggaaggtaactatagtgctattattcaacgcattcttccacctgttagtcgatga

SEQ ID NO: 90442 - DNA, 148 bp, Glycine max
  Peptide Sequence Number=SeqID_207220
atggtggtggtggtagtacttgtggcgacaacaatagtgggaatagtggtgattgtggcgataacaatgacaatgagtggtgacaatgatgatggtggtaattgttatggcgacgatggtagtagtagtggtgacgatagtagtaatg

SEQ ID NO: 90443 - DNA, 300 bp, Glycine max
  Peptide Sequence Number=SeqID_207221
ggtaccatcaaggtggctcacaaaagactcaagtcccaaaactcacaaaataactcttcaatcccggacttggtgcagaactcgtgcagccttcatgattatatagccgtgtacgattctgggctgcaagttcttgatgctggaggagatctatcttcttctgaaaaatctgcacaattccagtattctcgagcaggatgtcaggacattgtatccgacatcgtggatccttcaacttcaattcatcacttgacactttatcttgccttgtgcattgtgcatcccgatcttattccttga

SEQ ID NO: 90444 - DNA, 418 bp, Glycine max
  Peptide Sequence Number=SeqID_207222
gcgtcaggatgtactgactatggtcattgggcgatcagaacaccctgattgtgtctgtgctgctggagctggtgtcacaatcaaacaacactttggactggctccaaggacctcccacatgtcttcgtccatggctcccgaagagttggagcaactgacgcaaaaaatcagggaccagctagaggagtcaatcataggaaaaggacttgcactgcctcttaagctggaggttggtccttcagttgctcgtgtcagcacaaaggagaattgtggttatccctcaggaaatgacccagacacgaatgagtcaaagaaatacagattgtacgggtcaaccaccattcacaacatccttttgggcaatgatgaagtcaaggttggtgttgaggaagttcgagatgcagatgcttgcattcct

SEQ ID NO: 90445 - DNA, 987 bp, Glycine max
  Peptide Sequence Number=SeqID_207223
atggatgagaccgtgaaagcccattgccagtttgacttacacacgcccaaaccggatgactcgctaaaacagtacgcgctgtcgctggataaagctgacgcaccgcccgaagatatggatctcggccagcagtttgcccagacgaaggtgctgcaccgtgagatgacgcagctcctgcaacaggtggcgcagcagccgcagcaggcgggtgtcacgctgatgctgttcagccttgcctatggcgtgctgcatgcgctggggccgggccacggcaaagtggtgatcagcacctttctcgctacccacccggcgcagctgaaaaccagcatgaagctgacgctgctggcggcgctgttgcagggcgcggtggcgattgctctggtgacgctgatgctggtggcgctgcaaacctcgtcgcgccagctgcatctcaccagttactggctggagaaaggtagctatttgctggtgatggcgctcggcgtctgggtgggctggcgcgcgctgcaggggttacgccgcgcgttccgtccggcgaccgggctccagattcgcgcggtacggccacatcatcagcatcatgctgactgcggctgcggtcatgcccacctgccgagcgcgcaacagctggccggtgcggtgagcggcagaacccaggcgctggtagtgctgtcgatggggctgcggccctgttccggtgccatcatgatgctgttgtttgccaaagtgattggcgtatatggctggggcgtggcctcggcgctgaccatggcgctgggcaccgcgctcaccgtgtcgctgctgggtttgctggtgcagcgctcacgcgtgctggcggtgcgtctcggcagggtcagcagcagaggggcagcgcaatggttgttgccggccgtgatgctggctggcagcctgctgttgctgctggccggctttattttatggcacagtgctacgcccggcttcggtggcggtctgcgtcctttttaa

SEQ ID NO: 90446 - DNA, 393 bp, Glycine max
  Peptide Sequence Number=SeqID_207224
atgactgctgcccatgtcctcaatagatgtcccaccaagaggttgaactcaatggttccaaaagaagcatggtctggcagtaaacctttagtcaaacacttcaaaatctttggttcattgtgttacagacatgctacagaccaaaagagaaaggcgcttaatgataaaagtgaaccaatgatctttgtaggctataactctacaggcacatacaagctgtacaatcccaagactaaagaagttctcttcagcagagatgtctattttgatgaatcgaaatcatggagtgaaccacaggccataactgaaacaattccaagattgcagcttgattgggaagaaattgactcaagaaaagaagccacacagggtacattgaatactgagcaatag

SEQ ID NO: 90447 - DNA, 339 bp, Glycine max
  Peptide Sequence Number=SeqID_207225
atgtcccatactaatggattcgggtccacaacgatgggttcaaatgtaagatcggttcaggatcatgggatccttttctatcagataggaagggctgtttcacaaaatgtacttctaagtaattgctccatagatcctatatctatctatatgaagaagaaatcatgtgacgggggggattcttatttgtacaaatggtacttcgaacttggaacgagtatgaagaaattaacgatacttctttaccttttgagttgttctgccggatcggtcgctcaagaccaatggtctctacccggacctgatgaaaaaatgggatcacatcttatgactcgttga

SEQ ID NO: 90448 - DNA, 636 bp, Glycine max
  Peptide Sequence Number=SeqID_207226
atgcatcaggactggtcgtcggaacaaatcgccggttggctgaaacgctgttatccggataatcaggaaatgcatgtgttacacgaaacgatttataaaacgctttttatacaaacccggggagcattaaaaaaagaactacagcaatgcctcagaagcggaagagttgtgcgtagatccagaacgtcatcgcttaaagggaaaggattagggtcaatcccggattcgataccgatcagagaaaggccacctgaagccgcagacagagccataccaggtcactgggaaggcgatctgatccagggctcgaaaaactcctatatcgtcactctcgtagaacgccattcccgctttgttatgctggctaaaatcagagacaacaagaccataacggttatatctgcactcatcaaacaagcccgagtattacccgttgagctttataaaacactaacatgggatcgggggtctgaaatgaccagccacaaccggtttactgtagccacagacatccaggtttatttctgtgatcctcaatctccctggcaacgcggctcaatgaaaatacgaacagattgctcagacagtattttccaaaaggaactgacttatcggttcacagccagcaaagactaa

SEQ ID NO: 90449 - DNA, 1240 bp, Glycine max
  Peptide Sequence Number=SeqID_207227
atggaggattgggggaattttctccaccaaatccttgaggaggattctgaggattccactccaattaaagtgttcctcttggtgttagggtttgagtggcgttttggagaagagcacgacaattcaggcttagcacaactccctctgcactatgcctcacttagcgggccaaaactcgctcagcgcaattccctctctgggtgttacactttcagaggactcaaagtcctccccttcagaggactcaaagtcctcgccttcataggactcaaagtcctcacctttttaggactcaaagtcctcgccttcagaggactcaaagtcctcgccttcagagtactcaaagtcttcgccttcagaggactcaaagtcctcgccttcgtaggactcagagtcctctgtcatttatgctttttagagactgttgtagtctcctttcatcaaccagaggaaaggaagcctgttgacacgaagagacatatatggtcatctgctccctttgtcgaagacttactatctttcgaccgaaactactttagtctccccttcgtcaaccagaggcaagcgagaccgttgacacgcagagacaaatatggtcatctgctccctttgtcgaagactcaatgtcttttgaccgtgactagtttagtctcccttttctatccagagacaatcgaatccgatggcacacctcaatgtcttttgatcgaggctattgaagtctcccttgccaaccagagacaatcaggtctgatggcatgcggagaccatcatggtcctcatctatatttcaaagatgacaatgtcttcagtcattgcatgccttcaaaaggcaacaatgtcctcatctacatttcgaagatgacaatgtcttcagtcattgcatgccttcaaaaggcgacaatgtgcttatcaacatttcgaagacgacaatgtcttccgtcattgcatgccttcaaaggcaacaatgaccatcatttgcatttcgaagaaaacaatgtcttcagtcactgtatgccttcaaaggcgacaaaagggtacatctacttgggtttgactgagaacaagagagggtacatctcttgtggatcagttctagtggagggtacatccactaggttgttcaaagagaacaagggagggtacatcccttgtggatctttgcttgtaaaaggatttttacaggttgaaaagaaatctcaaggaccacaggtcgcttggggactggatgtaggcacgg

SEQ ID NO: 90450 - DNA, 318 bp, Glycine max
  Peptide Sequence Number=SeqID_207228
atggcgaagaacgaaggaaaatcttcacggaattgctcacggaaacgtctcggaagcattgcggaagcacctcgacttggattttcttcacgaaaatacattttttcacccaaaacagttgaaatgcatagcataggggatggggtggtcgacaaaagcggggcttttgctcctacgtatcctgcggggcgagaaagtcgccagcgcacaggattttgcttgtggggcttctatggaggctggatctttgagcttcaatggggtcctttaatggtgattttccaccatggagatgcagcgaaagacaaaggaaaggag

SEQ ID NO: 90451 - DNA, 121 bp, Glycine max
  Peptide Sequence Number=SeqID_207229
atgtatcagataggaatcaacaccatgccaaagaattcatggccctttggcaggagaatgcacagctacaagagggtaatcgattttggtgacctagaaatgaacactcgttggagcaaag

SEQ ID NO: 90452 - DNA, 210 bp, Glycine max
  Peptide Sequence Number=SeqID_207230
atggcgctaagcatgccttcgagcttattgtatgcatgcttgtggtttgatcacccattggtgtgtgctgttaagaactttagcattgacaaatgtactgtttccttggaacttgaaagagcagggctagataactgtagtgctagacatagtgtgcagggttctagttcttattatgttgtgcttataatgttgtttaaatcaggctaa

SEQ ID NO: 90453 - DNA, 379 bp, Glycine max
  Peptide Sequence Number=SeqID_207231
ttggaccttgggttgggtcgatcggtccgcctccggtgtgcaccggtcggctcgtcccttctgccggcgatgcgctcctgtccttaactggccgggtcgtgcctccggtgctgattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 90454 - DNA, 162 bp, Glycine max
  Peptide Sequence Number=SeqID_207232
atgaaggcaaccattaggtccttccaagaacagactcgggaaggttccagattagtataccaagtgatggctgccccagtgattcttggggcaagtagttcccttgtacttatcgaaatccaacaccttgaacttcagagggataacgatgttgggcactag

SEQ ID NO: 90455 - DNA, 423 bp, Glycine max
  Peptide Sequence Number=SeqID_207233
atggctaccttggggctggagattttggttgaatctgcctcaagtgttattttgaagatgatattatcatttgaccttgcttttgctttgattccgctcctaaagttcagtagcagcaaagtgactagcagcacaagcattgaagagccttatttaccaacaacgacgggtgctcgagccaccatcgttgaaacctcaaagaacaatgacgatgtcctcaccaccgacgttgacatactgccaaacaacgtcggtggtgagcccgccaccgatgttgacaggaaacaaaacaaatacgggtgttatgcgtacccgacgttgatatggacaacaacaacgacgagtcttgctaacccgacgttgaaatggaccaaaacaacgacgggttgtataaaatgtgcgtcgttgaatccttttttataa

SEQ ID NO: 90456 - DNA, 294 bp, Glycine max
  Peptide Sequence Number=SeqID_207234
atgatatatcatacaaaatttgatgaattcaagactgagttggaaagaaggaattggcacaaagagctgaccaattttctagatgggagcatcgatgttgctatagtgaaggagttttatgctagtttgtatgaccctgaagataaatctcctaagcaagtaagggttacgggtcacttgataaagtttgatgaggatgccctcaacactttcctcaagacgcctgtgattattgaggagggggagagcctatctgcctactctaggttttgtagactgaggccagatccatag

SEQ ID NO: 90457 - DNA, 812 bp, Glycine max
  Peptide Sequence Number=SeqID_207235
atgattcacaacttgctccaccacccgaagttggtgccattccaccaacttttgaagttcaaaatgatgcaccacttgtaaatgaaaggctaaaaaaggcctatgttgctcttcaagcatggaaagaggctatttactctgaccctttgaacacaactggtaattgggttggtgaagatgtctgctcctacaatggtgtgttttgtgctcccgccattgatgatcccacattgaatgtggttgctggtgttgatctcaacaatgcggacattgctggtcacctcccagaagagttaggcaacttgtcagatattgcacttttccacattaactccaatagattttgtggaattgtgccagagaccttggaaaatctcacacttcttcatgagtttgacattagcaacaatcactttgttggtggttttccatctgtggttctcaaatggccaaacttgaagtacttggatatcagatacaatgactttgaaggacccttacctccagagctatttgagaaggatcttgatgcaatatttttgaacaataatcgtttcacgtctatcatcccagacactctaggaaaatccaaggtctcagttgtgacctttgctaacaacaaattcacgggttgtattccaaagtctattgtgaacatgaaaaacatgaatgagattgtgttcatgggcaatgaccttggaggttgcttgccacaagagattggattgttggaaagcataactgttttagatgctagtcataatggttttgtagggactcttcctaacttgtcaggactgaagaatgttgag

SEQ ID NO: 90458 - DNA, 648 bp, Glycine max
  Peptide Sequence Number=SeqID_207236
atggaggagaggctacgcgtcattaaaggaggaggaaattatgcctttgctgacatggcaaaattgtgcttagtacccgacatggttatttctccaaagttcaaggtgccagactttgataagtacaagggaacctcttgcccaaagaatcatcttaaaatgtattgtaggaagatgagggcatatgcgaaagatgaaaagttgttgatgcatttcttccaagagagtcttgttggggcaactattacctggtatactaacttggaaccttcccaagtctattcttggaaggacctaatgattgctttcattaggcagtatcaatataactctgatattactccagatataatgcaactacagaatatgtgcaagaaagacaatgaatctttcaaagaatacactcaaaggtggagagatctggaaactcaagtaacgccctcgatgatggagagagaaatgatagtggacacattgccaatgttttactatgagaagatggtaggttacgtgccttcaagttttgcagatttagtgtttgctggcgagaggattgaagtgggtttgagaagagggaaatttgattatgctgctactgcgagttctagtaatagaagagctgggatgagtagagggaataagtgttag

SEQ ID NO: 90459 - DNA, 252 bp, Glycine max
  Peptide Sequence Number=SeqID_207237
atgaagctttgcttccacatatacgtcctcaccttcagaggactacacgtcctcacctttagaggactatacgttctcaccttcagtggattgcacaccctcaccttcaaagggcgacacgtcctcaacttcagagtgctgcacgtcctcgcctttagagggctacgcgtcctcactttcagtgggctccatatccacgccttaaggggtcgcgcccataagacacccagtggacccggagaagtccaatag

SEQ ID NO: 90460 - DNA, 434 bp, Glycine max
  Peptide Sequence Number=SeqID_207238
tccgcatttaccaagtttcacgacaaaggttgcatgcatctgcatccctaaagatcatgttaactgcatagatttcctacatctaatgtccaaatcttgtggatttgggatgaccagccctctcgatgagtcgatctcttgctttctcataagggtggcaccttgggtactagttaccctcaccgttagaggactacacgtcctcgccttgagaggactacgggtcctcaccatcagagggctgcacgccctcacctccagaggactatacgtcctcgccttgagagggctacacgccctcaccttgggactacgcgtcctcaccatcagagggctgcacgccctcacctccagaggactacatgtcctcaccttgagagggctacacgccctcaccttgggtactagttaccctcaccgtcagtggactacac

SEQ ID NO: 90461 - DNA, 365 bp, Glycine max
  Peptide Sequence Number=SeqID_207239
catggaatgcggtggaaagaaaagataaggagcttagaggaagcaacaacggtgttatcagggactaccatacatggttgaaggctcggacggaagaagctgaagtccctgaagagagcgaagaagtgcaatccttgaaagcaaaacttgaaagagcgagaggggtcaaggaaaagttcaagatgacagccaccagggtcaggaaagagtgtgacgagttgagggatgtcaacatggccatggccgaagggactcaagctttgaagggccgaaagggacgagtcaaggatggaaagtatgatattagaggacaagttgaaggcttgtcaaaggtcgaagaggagtttaaccgaacaactgagtag

SEQ ID NO: 90462 - DNA, 1047 bp, Glycine max
  Peptide Sequence Number=SeqID_207240
atggacgtgctcgcctggagtcgccatttccgctgtttccccggccaaggggagctgaacctggctcagttcatgactcaactttccgcgcatggctatcgcggcgcctggtcgctggagatatttaacgatggtttccgcgcctcaccggtgcttcccacagctcaggacggtttccgatcgttgttgtggctggaggaacaaacctatgactggttggccaaacagcctctgctgcccaacgccatggcctcgctcatggaacgttccttattccattcgcagccgcatccgcccttgctggcgctggagtttatcgaatttgccgtctcgcacaacgacgggctggcgatgggccaatggctgacgcagttgggattggttcacgccggcgaacaccgctccaaaagcgtcgccctctatcgcaacggcaaagtgaatgtcattctgaatgcccaaccggaaagtcaggccagcggctattatcacttgcacggcatttctctttgcgccgtggcgtggcgggttcgcggcgtagcgcgtttactgcaacgggcgcaagactacggatacgccctatggcaaggagaaaccggccccaacgagcggcaaattcccgccctgtgcgcaccggacggcagcctgatttatctggtcgaggcggacgaagatcccaagaacgatatttatcacaccgattttcatctgactcatcgcagcgcgccgccgcctgcactgcagagcatcgatcacctcgcgatagcgctgacggacgaatcttgcggcaactggatcatgttcctgcgcagcgtgccgggttttgtgcaggacaacgagtgggaattgcccgatccgttgggtttggtgcgcagccgcgtgttgcgcagccccaacgacgctatccggctgccgctgaatatgtcggtgagccgggaaacccaaatcgcccaggcattaaccacctatcagggcgcgggattacagcatgtcgcctttggctgtgaggatttgttcagcgtcgtgaagcggctcagcagcgtggattaa

SEQ ID NO: 90463 - DNA, 861 bp, Glycine max
  Peptide Sequence Number=SeqID_207241
atggattgggaccagctcttggctgggataggaggtagaacaatcagttggttcccccgatggaaggaaggaaaggagggagtccttttctcatgtggagggtacccaaacattctgttgataggaacgaggggttgtattaactacaatcccgcgctcgctataagacaactagggtaccccatgaggggagcaccgatggaagaaagcatgtctcctttcattgtgagagatttcagcacgcaaaatttcaaggctatacaaaggatccataaagcgtgggaaaccccattaagaaaagataaagaacttaggggcattcataatggcattattggtggttatcatgaatggctgaaagttcatacacgaggtttagattggctcgccaagctaaaggttgttagcgaagagagtttcgaagcaccggaagaggacgaagaagtccaagctctcaaaaacgagttaggaaaggcgagacttgccaaggagaagttcaagttagccactacagacatccggaaagagtgtgctggattacgagaagagaatgcaactgccacaagagcccttgaacaagagaccaagagggctcgtagggaagagcacggccggaacaaattccgaggggctctgtgggggtccaaaagaagtttgtttcagcggttatgcaagacagagaccaacatgttagctatcatcaccaagtaccaagaggaactaagtctagccacggcccacgagcatagagtggcggacgagtatgcccaagtgtacgcggaaaaggaggctagaggaagggccaaagcagtggcgaacacctactctgccccgaggagatccacgaacttctcagctatt

SEQ ID NO: 90464 - DNA, 481 bp, Glycine max
  Peptide Sequence Number=SeqID_207242
atggattctgtaggaataagatcggctaacccttatttggcgactcctggagcaacggtcttccaaaaagtagaacaggtattagaagttcgttcgattgattcaatatcgatgaacctagaaaagagagttgatacttggaatgggcgtataacaaaaattcttggcattccttggggattcttgattggtgctgagctaacgatagcgcaaagtcatggaatgtctaatgtttttttgcccggtgaactaattggattgttgcgagccgaacgagcagggcgttccttagaagaggcgatttgctatcgagttctattattggggataacaaaaacatctctgaatactcaaagtttcatatctgaagcaagttttcaagaaactgctagagttttatcaaaagccgctctccgggggcgcatagattggttgaaaggtctgaaagagaacgttgttttagggggaatgatacctgttg

SEQ ID NO: 90465 - DNA, 390 bp, Glycine max
  Peptide Sequence Number=SeqID_207243
atgagggtcgatgcactacgtcaaaaaggcttatctccattgcagaagtgcacaactgctattcatatattggcttatggatcacctgctgacaatgtggatgaatacgtccgaattggtgaaacaattgcagtggaatgcttggaacgatttgtatcaggcatctacaccatatttgggaatgaatacttgaggagaccaaataacgaagacaccgaacgactactacaaatgggagcggcacgcggatttccaggtatgttaggttccattgattgtatgcaatgggaatggaaaaattgtccagttgcttggaaaggtcaattttgtcgaggtgatcatcgcaacccaataatcattcttgaagccatgacatcacaagacttgtag

SEQ ID NO: 90466 - DNA, 893 bp, Glycine max
  Peptide Sequence Number=SeqID_207244
tcggtgccgaacaggtcggcgatgacggagtggtcgatgaccatctcggccggcgagagcgggttgatcttgttcgcgtcgccaccgagagcggtgaccgcctcgcgcatggtggcgaggtcgacgatgcacgggacaccggtgaagtcctgcatgaccacgcgcgccggcgtgaactggatctcggtgttcggctctgccgcggcatcccacgaacccagagcttcgatctgcgccttcgtcacgttcgcgccgtcctcggtgcgcagcaggttctccaggaggaccttgagactgaaggggagcttgtcgaaaccgggcaccgtgtcgatgcggaagatctcgtagtcggtgctgccgaccgtcagggtgctcttggcaccgaagctgttcaccgtggacacgaatccgtctccttctattcggatgggagcgacaggcgcctccatcttggtcgtcggcgagcccctgcggctagcaaggcggacctaaccagtctgctccgcacagctcaccggcgaaagcctgcgatttatcttgatgtcaagataaatctatcacgtctccgacgtattctcgtgcgcgggctctcgggggtgcagcgcccgcacgacgagccaggtgacggcgatcaagggtgcgaacaacggcagccccatgatgagcttgagcgttccgagcgccgtgacgtcgccggcgagatacagcggcagctgcacggccagacgggcgaagaacagcgcggaccaggcgatcccgagccagaagtaggcgcggcgcttgcggcggtcgttgcgccaggtcgtgccctcccccatcaggaagccgacggcgaggccgatcagcgaccagccgatgagtgccgacacgaggatcaccgagccgtagaccgc

SEQ ID NO: 90467 - DNA, 225 bp, Glycine max
  Peptide Sequence Number=SeqID_207245
atggtggcccgagtgatgttggggaatggttacgagcccgaaatgggtttaggcaaggacaacggcggtagaaccaacctgataagtgccagaggaaaacgtgggaagtttggaaaatccaagccgaggcgcttccgtaacattttcatgggtaattacgcgaagaatttcaaccgttcttcgacattcatcgttcgttcttcgtttttcttcggtcttcaaccg

SEQ ID NO: 90468 - DNA, 333 bp, Glycine max
  Peptide Sequence Number=SeqID_207246
atgaggatcaaaaggtcttttaaggttgtaatggggccaaggacaagcctttcagaaacaacatttcattcagcatgtccaacatttaaccaatatacaatgtacatcaagtatggcccaaaatacatcatgaagcatagtcaacaaaacaagttatccaatgaaacaaaaaccccccacacttattcccaaaacaattctaaagctccaaaattccttaaggatatggaagcatcaacaagaatcaagccaagactattgtgcaagcaatcaatggggcaaaacacaccaaatgattatgatgatggatggctcaaattctcacaaaggtaa

SEQ ID NO: 90469 - DNA, 1368 bp, Glycine max
  Peptide Sequence Number=SeqID_207247
atggatcttgatcatttgaaaattcctatcgacgatgatccaagctggaaagagagatgcaacaagaggatggaggaactgaagaacacacaattctcaagtcaagatgcagcttcacaacaggaactgctgcataaggaacttgtgggagagaaaattgttctaattcctgagttgtataaagctgttgaggaaggaaatgtgaacaagtttcttgatgtgttggagcaagaatgtaaacaaaggaaattgaatttgtctgttatctttgaacaagtcactgagacaggagattcattgcttcatgtggcagcagataaggggaaagaaaagattgtagagttgatttgttgtcactttcctgagcttcttattaggagaaatgtaagaggtggcactccacttcatgttgctgtgaggtccaagaactctactatggtcaacctcattctctcccaatatgcatcaatgaagtcaacacatgatgtgatgaaagacaaagagataacaagagagaaagatgaacttggggatactcctttgcatgaggctgtcaataatggagatctaagtgtgcttcaagtcattttacatagagataaggatatggtccatgaattgaacaagtctaggtgttcaccactgtttttggcagctgcgagtggcaatgtggcaatcgtgaatcttctattggatattccattctctgcagatcagaagcttccactgtgctttggaaactctccactccatgcagctatactgaaacggaatcctgctgaagatggaagtacttctcttcattatgcagcttacattggttatgttgaaggatttcgtactctattgaaaaattcattcagcttggaagggaataagaagggacatcttcctattcaccttgcttgcaaaaggggtcatcttgaggtggttaaagaattccttcaaaacgaatggcctattaatcctcgtgttcttaataaaaaaggccagaatattcttcacgttgctgcgaagaatggaagaacggctttcactgtgccaggaggtgtatacagttccgatgacacaaaccctaaaaatagagggatggcagttttagctcataaacgattcttttgggtattcaccaccttcaacatgacagctatgtatagctctgtacttgcatgtggacttatgttgatggcattgatttttgatcataaattggcaacacgaacaactatccttgcaatgagttgtttgattcttgcctttgtaacggtgccggtggcgtttatggcggctgtgcgtctagttgtggccaacaactctgcactttcccttcttataactgtcattggagccacatacacttttctcatc

SEQ ID NO: 90470 - DNA, 252 bp, Glycine max
  Peptide Sequence Number=SeqID_207248
atgtcgctgaactcctccgctgtcggtgacccgacggctttctcggcctccaaagggttacgcgtctgggtctcgtactcgaatgtttggccaaaagatccgatgttgaaggtggatctcaatgtgggtatgtacgttaaggatttggtgtatgtggggttttctgggcctacccaacatagcattaaggttcacagtgttgagtggtgcatggctaaggaggcggcgaggtcgacgacgattacacagtag

SEQ ID NO: 90471 - DNA, 288 bp, Glycine max
  Peptide Sequence Number=SeqID_207249
atggctgctagtgacattggcattttgagagaccgagcccacattcctaccaagaagagcttattggagctaacctcacaggacgctatgttggcacaaaacaagttgctatccaagcaactagaaacaataacagaaacactcagatgtacaatttttggtggagctcatgaatctggatgttgcatcccttatgaagagcacattgcacgtgaagttaattatatggggaataagcccagaggcaatttcaatacaagtggatttccaggatttcagaacaattag

SEQ ID NO: 90472 - DNA, 408 bp, Glycine max
  Peptide Sequence Number=SeqID_207250
atgagaagagaaagaagggaaaaaaatccaagccgaggtgcttccgtaacgcttccaagacgttttcgtaagcgatcccggggaagttcttcatcgttcttcgttcgttcttcatcattcttcgatcttcaactggttttaggagagcattgtcttgatggaaattgtttggttcaaatttgggagaagggggtggtttttattaaatcattaaatgattatatcagcatcatgcagcctaaagaaaactgtagaaaatggcacaactatgcttctaatctgcttcaaaaagaaaagatgaaaattaagaagaatttgagggcaggaaaagaaaggtttaagaaaggaagatttggaagtgtttctgaagagctcgctcaacgagccagattagctaagcgaggctaa

SEQ ID NO: 90473 - DNA, 318 bp, Glycine max
  Peptide Sequence Number=SeqID_207251
atggcagaattgtgcctagtgtctggcatcgtcatccctctgaagttcaaggtgcccaacttcgataagtacaaggggactacctgccccaagaatcacctaaaggagtactgcaggaaaatgggagcatatgcgaaagatgaaaaattattgatgcatttcttccaagaaagtcttactggggcagccgtcacctggcagtatcagtacaattctgatatggcttcggatagaatgcaactacagaacatgtgcaaaaagagcatgaatccttcaaaggatacgcccaaaggtggagggatatggcaactcaagtag

SEQ ID NO: 90474 - DNA, 114 bp, Glycine max
  Peptide Sequence Number=SeqID_207252
atggaagaggacaatgttaagcagccattgttggagaggaagtactacgagatcagcccaagttgtaaagtggatcaagccaaagagttgagtgagggacaagctaacttctaa

SEQ ID NO: 90475 - DNA, 360 bp, Glycine max
  Peptide Sequence Number=SeqID_207253
atgtcgaactcggatagcaacacctgtcaccgcgtgattcatcctgtgagggctggcttatcaaatatgtacttgaccgggtccatcttggataccaaccaggtggtatggctcataatagacgacctattccctttttccggaatcgtcatgctaccccaacatgcaccccatcaactcatccaacaccatcatatagaggaagagaggcctcccagtcaccggtggcatcagtaccgaggggttcatgaggcattgcttgatcttcccaaatgccttttgacaattgtcattccagggaacgacctgatccttgcacaaaagcttgaagaacggctcgcaggtggccgtgagctatga

SEQ ID NO: 90476 - DNA, 375 bp, Glycine max
  Peptide Sequence Number=SeqID_207254
atgacgggagacgaatcaaaattcacacatatctctcccaagaaaagcggacatataacttatggtgacaacaacaaaggtagaattcttggagttggaaaaataggtgcaaatgcttcaacctccattgaaaatgttctacttgttgaaggtcttaaacatagtctgcttagtgtgagtcaattatgtgacaaaggctatctgtgtttagctctactgagctttaaaagattggctaagattttgttaaaacatgaacacttagacaatgaaggaaagctggagttgctgcacatgatgttcaacgttatgtcaaggaataagatcgggctgcacaatgcacaaggcaagataaaatgtctagtgaagaattga

SEQ ID NO: 90477 - DNA, 759 bp, Glycine max
  Peptide Sequence Number=SeqID_207255
atgggtactttcagctttacatcgaaccataaagaaacgctcgaaatccgtatgggcagcaatctcgacattgtgcaaaatcgcacgttgaccctgagcggcggggacaactcgattagcacgttgatgctgagcggctatatgtacacaggcgataaaccgctggtgcttaatctgaccgtcgccgcagattttagcgataacctgaagaccatcatcggcagcgaatttaccgatgaacgccgttattactccgacatgaagctgtacctcgtcgcagaaaaaggcggcaccggcggcggcgctttctacaacacgctaaacacgctggccaataaagacgatttcgcccatgtcattgccgaacttgccggcgaccagctaacggtcgaccgcaccggattgaccgtctataaagccgacgttaagggcaacacgacgctggatagcgccggtgcgttacattttaccgatagcaaaatagacaatatggtcacgctcaataccggctatgccaacagcgtcatctccgtgggagaaaccgataacccatgggttttctccaagacaggagacaagaccgcaaccttgtacggcagcgccactacccaagctgagttacaaaatgcgttcagtggtctgaatgcgacggacaatgcccaagcgctgttctcgcaggttctggcgaagatgaccaacggcgccagcgccaacaacctggcggaagtcggattgctaaagttggacaaatcgctctat

SEQ ID NO: 90478 - DNA, 528 bp, Glycine max
  Peptide Sequence Number=SeqID_207256
atggctactccacctgcctcgcctcctcctcctcttccttctccttctcctcctcctacagtagcatcagtgtctccgtccacccagaagcggacacgcaaagcgacatgtctacgatccttggccactagaccacctagggaagagagaccaatggtcaacgtcgatcctgtgaccggcaaggccgacggtccccacaagaagaaattaagaacatatttgggggttgtcgctcgtgataaggtcgacgtcacatacgagacctggaaggaaacggaatttgaaatcctcgaagcatctgatagcaggacaaagaagaaaattcttcagactgttagtgaaaggtggtggcagtttaaattggacttgaataggaaatggacccttgcagccgaacaagacggtgtggacgacactgtctatgaaaaatacgacattagcaaggagaaattggcccagttttgtcagacacacagagacccttcttgggaggatgtgcggaaaaagacacaggtcatccagaagtaa

SEQ ID NO: 90479 - DNA, 198 bp, Glycine max
  Peptide Sequence Number=SeqID_207257
atggatgcctctacatcgacaaccagatctcttcttgatgatgcgttgggtgactatgatggtgttgtcagtgattacattgaactttgccagcaacaccgttgttctagccaccaattgggccctcaatctgaatctcttgccttggacgtgtgtggtggttgttgtacagccacaaattgtgatttgatcttttaa

SEQ ID NO: 90480 - DNA, 781 bp, Glycine max
  Peptide Sequence Number=SeqID_207258
ggataatgggcctattttcgtgaaagataataaaggacacctcctgatcgaagattggggatttaatggttggggagaaaagtttgattttgaaaattgtgatgaaattccacaacgtatcggaaaagacatcggagcaaaggttatagatctgaatgaagaaatggtaaatgagggaggtgcaatagaaactgatggaaatggggttttaatggcatgtaaaagttctgtgatcagccagaaaaaaggttcggtaaggacaaaagggataacacagcaggaggctgaggaaatgtttaaaacctattatggagtatcaaaggtgatttggttggatggcattacaggactggatgttactgatatgcacattgatggatttattaagtttatagacaaggataccatgattactatggatgacgaggatcttgcagaaattgggctgtcggatcaagatatcaatacattgtatactgccacaaacgtgaagggaaaagaatataaaaaagtttatgtgcctgctacaaaaaacaaggtgaaaacagcttatggtaaacaactggatgaaaagggctcgtatgtaaactattacgtggccaataaaattgttctcgttccaaattatggtgaccccaatgataaagtagcaaacaaaattattcaggatcagtatcctactagaaaagtgattggaattgatgttagaaacctatatgaaaatggtgggatggtacattgtgtaacccaacaacaacctgccggagaattggctaaataa

SEQ ID NO: 90481 - DNA, 217 bp, Glycine max
  Peptide Sequence Number=SeqID_207259
cagttgggctaagtgcatatccactgctaagcgtagcttcagcgtgcttagcgcaaaagagaatctggcagagcatcagcatcaaagtcgttcgctaagcgcaacaggattgcgtacagaacggccagggcacagaattccagagaagccacatgcctatttggggaaaagagcccgggaagcagaaaagaggagcagcttgtgcattgaagcctag

SEQ ID NO: 90482 - DNA, 507 bp, Glycine max
  Peptide Sequence Number=SeqID_207260
atgctggcgctgccgatgtttcacgcggtgggtgtggacgtgcagatgcgaagcatggaccgttcgctttgggaggtgcgcgtgcgtcagggcatcgactatgacgccactgcacaccgcttcggcggcaatgccgggatcgctgctattctcgatccgcgctatttcattcccaacacgaccgaggcgctctacgccaagggctggcaattgtggtaccgcgatcctgcttccaagggtgcggtcgagccgcctcagccggtcaaggacgcattgtcacgctatgaccgcgtgctgggctcgccggacccggatgtgcagcgcaagctgatggccgaaatactggagatcgcggccgaccagttttacgtcttcggcgtttgcctgcccagcgacagttacggcgtggtgaagaacaacatgcagaacgttcccaaatccatgccgaattcgtggggatatcccacacccgggcccgccaaccccgaaacctttttcaaggcctga

SEQ ID NO: 90483 - DNA, 727 bp, Glycine max
  Peptide Sequence Number=SeqID_207261
atgttgcatcgaccaaacgccatttccggagctgccgttcgttctccggactggtttaaatccgccactcgctggacccaattgacctttgcggaggacgacccggcgaaatatgaccccgagttctggatcgacgtcttcaagcgcaccaagtcgaatgcagtctgcctttccgctggcggctatatcgcctattacccaagcgaaatccccctgcattacgtgtccagcttcattggcgataccgatccgtttggcacgatcgtggaaggcgcgcgcaaattgggaatgcacgtcatggcgcgcgtcgacccacatgcgatccacgaggatgcagcactggcccatcccgaatgggtggccatcaatcaggacggaagtccgcgtgagcactgggcatttcccggtatctacgtcaccgatgcgctgggaagttataaccgcgacttcacaaccgacgtcattcgcgaagtcgtaaccaaatatgacgtcgatgccgtgttcgccaaccgctggcagggccatggcgtgtcctacagcgacgacaatcgcatacgattcaggcaggaaactggttttgatttgccgatgagaccggatgcgacggatccggcatggcaggcgtgggcggcgtggcgcagacgcatacttaccgagctcgtggtctattgggacgagacggtcaaatccatccgtccccatgccagcttcattccaaatatgagcg

SEQ ID NO: 90484 - DNA, 309 bp, Glycine max
  Peptide Sequence Number=SeqID_207262
atggcacatcattggactaatgttactaaggatgttctctacctaataatgttcatgtgttctatgttgtctcctggactactaaaccccgatgtctcgcgcatgcaaaggcacactagaattaagtgtagaagcaagcttcatgatgatgaagcaagcttcatgatgatgaaccaagcaattttgatgatgccaaaagcccaagtgattgattcaagattgattcaagacttcaagatcaagcatcaaaaatccaatccaagattcaagagaagaaatcaagaagcaacaagtcaagacttcatatag

SEQ ID NO: 90485 - DNA, 149 bp, Glycine max
  Peptide Sequence Number=SeqID_207263
tcttctcgctcaaccttgaggatgcaaccagtgtgcttagcgagttaacactcgctcagcacttctgtacagctcatccttcttccagagtcttctatgcgcttagccaacggatgtcgcgcttagcggatggctccctcagcgcgtga

SEQ ID NO: 90486 - DNA, 984 bp, Glycine max
  Peptide Sequence Number=SeqID_207264
gaacgtcctgatttgaagttagtgtcacatgggaggaaggtgacactgattgggaggccagtgcctgagattgaaggcctggtggctgccacaggattaagtccactgatagattgttcagttattactggcgatcctggacttatatccgcatttgtggagagtttccacgctctttctacggaggaggccagagccgagacaacactcacacgtggagcatatgtacgattaggatgggttcgtgacatttatgagaccagatgtcaggctcggcggtggattgtcgcaactcgcgcttatctgttgcaccttgttggttgcactctttttgctaataagagtgcaacatatgtgcatgtggtccaccttgacgctttccgggacctcactcatagtggtggttacgcttggggggttgccgcgctggttcatatgtatgaccagttagatgaggcttgtaggaccaccaacccacagcttgcggggtacttgacgctacttcagtgctggatctatgagcacttccctagtgtgcaccagtgcgtgactgacgatacataccaggaaacgtccccacgtgctttccggtggttgacgtcgaaggcgcacatgaagggcatcacaggagcaccgtacagggcacattgtgatgggtcagctctgatggggtcctatgatcgtcacagttcgaccggagagggtggtacgccagttcggttacatccagagcatccctccgccgcatttcctgggcaggtatctgcagattacatggagtggtttttccgcatatctcaccctttcatgacaccgacccaggcaggtgaccagcagagggatgcaccagctgcagaccctgaggactacatacagccgcccagcccccaggttccagtggcatttgacccccctccacatgatgattacgagggatatgaggcgattgcacagaggttggagcgtgtgctcaaccttaggata

SEQ ID NO: 90487 - DNA, 628 bp, Glycine max
  Peptide Sequence Number=SeqID_207265
aggactgcgcgtcctcgccttcagagaacttcacgtcctcgccttcacaggactgcaggtcctcgccttcagacgactacacgccctcacctttagaggactgcacgtcctcgccatcagagggccgcacgccctcaccatcagaggactacacgtcctcgccatcagagggctgcacgccctcaccttcagaggacttcacgtcctctccatcagaggggtacatgccctcaccttcagaagactacacgtcctcgccatcagagggccgcacgccctcaccttcataggactacacgttctcgccatcagagggttgcacgccctcaccttcataggactacacgtcctcaccatcaaagggctgcacgccgtcaccttcaaaggactacacgtcctcgcctttaaagggctacacgccctcatcttcggagggctacacgccctcgactttagaggacaacacgtcctcgcctttagaggactacacgtcctcgcctttagaggactacacgtcctcgtctttagaggactacatgtccttgccatcaaagggttatacgccctcgccatcagaggactacatgtcctcgccatcatagggtcgcacgccctcacctttagatga

SEQ ID NO: 90488 - DNA, 117 bp, Glycine max
  misc_feature (19)..(19): n is a, c, g, or t
  Peptide Sequence Number=SeqID_207266
tccctaactttacctccgnttatgcaaataagtccttgctgttaaaatctaatttcctccgttggtcaaatgtctatttggcaaacctcagtccacgtaagcatcccaatgtggcag

SEQ ID NO: 90489 - DNA, 381 bp, Glycine max
  Peptide Sequence Number=SeqID_207267
atggcatccttcagccaccttcaatcgcagatgcaatctcagggagttgcagtgcctcctgagcctgtggttggtcctagtccctccggtcctcgagtgagcacaaaggggagttgtgttgatccctcaggaaacgatcctgagaccggtgactctgacaggtgcggcttgtacatagaagcagatcctgcacgcctggttgccatcgggagagtttatgagggatccactgttgttcataacacccttttgttgcctggccaagtaaaggtgagtgtggaggaggttagagatgcagatgctccagttcctgtacccactgatgaggtttccttagtggggcaggcacttcacaccttccttgcttggccgacacatctg

SEQ ID NO: 90490 - DNA, 372 bp, Glycine max
  Peptide Sequence Number=SeqID_207268
atggttgaagtgttatcaggacctgaacggcctcgccgtcgtacaccgcaggaaaaaattgccattattcagcagactatggagcccggcatgaccgtgtctcatgttgcgcgccttcatggcatcaatgctaaccagatcttcaaatggcgcaggcagtatgaagacggctctctgaccgccgtagcatcaggcgaagaggtcgttcccgcatctgaacttgctgctgccaataagcaaatccgcgagcttcagcgtcttctgggtaaaaagacgatggaagctgaaatactcaaagaggctgtggagttcggtcgggcaaaaaatggattgcgcatgcacccttgttgcccggggacgacgaataactga

SEQ ID NO: 90491 - DNA, 387 bp, Glycine max
  Peptide Sequence Number=SeqID_207269
atgggggataagcttcatcgtcgagagggaaacagcccggatcaccagctaaggcccctaaatgaccgctcagtgataaaggagctcactgatcgagccgctcttgcgccgaagatgaacggggctaagcgatctgccgaagctgtgggatgtaaaaaagaatcggtaggggagcgttcccccttagagggaaggacccgcgcgagcagtgctggacgaagcggaagcgagaatgtcggcttgagtaacgcaaacgttggtgagaatccaatgcctcgaaaacccaagggttcctccgcaaggccgaagggcgtagtcgatggacaacaggtgaatattcctgtactaccctttgttggtcccgagggacggaggaggctaggttag

SEQ ID NO: 90492 - DNA, 226 bp, Glycine max
  Peptide Sequence Number=SeqID_207270
atggttatctcagcagccacttcaaataacaacaacatccatcagttgcaatctttcaactctcagaacaacaattaccacctttgcgacgtgtccttctcttcgtacttgaacaacaaagaagagatcctggcagaatcaggccatggctatgttagcagtagaaaggatcctcttggagtaaagaaggaagatgatggagaattggagtatttgaagctgaaaa

SEQ ID NO: 90493 - DNA, 542 bp, Glycine max
  Peptide Sequence Number=SeqID_207271
ggttgtcagactttgacgatcttcgcggccttcacgacggggttctctctcgcgatggcctctctccccgcggccttgtagtcgtaggagcagtcgtggcggtcggagtagcggtgctctgcgcagaaaaggtccccgcagcggcaccggaatcccgtgagtcccacgcgccgccggcagccggagcagcggttcacggcgctggcgggggtggttgcatcgaagaatctagaaggttcggaaatcgaggtggtggtggtggtggtggtggtggtggtagtgacgatgatggtaatggtggtgattgtggttgtggtaatgtgacaataatgaaaatagtggtggtagttgcgacgatgacaatgacaatgagtggtgacagtgacgatggttatagttgttatggcgatgaagtaatggtggtgacaaccatagtggttgttatggcgggcacggtgatggtattgacgacaatggtggtaactatgcctatgatgaagatggtggtagagactgaaacatccctgattgttgacttcttg

SEQ ID NO: 90494 - DNA, 243 bp, Glycine max
  Peptide Sequence Number=SeqID_207272
atgtttggtttgcatgtttggtttagggctggtggtacttttgatgttctgttctgtgttatggcacgttctctagacaagataaagagcatcgatggctcaaaagaaactcttaaactcagtgtgaggatcagttatctatggtttattggcatgcctaacaaatctgagcaagctgaaatggtgtttgtggcctccgatctttattacttattactcattgttcagttcattgtgttgtaa

SEQ ID NO: 90495 - DNA, 195 bp, Glycine max
  Peptide Sequence Number=SeqID_207273
cgccaggccatccattcagagggctccagaatcgaaggtggaggacacatggccagcgctaggccaagaaatcaaggggctccggataaaaatggagaatggagaattggcgaaatagcgctaggcaatcaattcgcgggactccagactcgaagactcgaaggtggaggacacatgaacagcgctaggcaatga

SEQ ID NO: 90496 - DNA, 531 bp, Glycine max
  Peptide Sequence Number=SeqID_207274
gccttgcagcggcagcgcccgcaaggtttcactggtgctggaaatgatagccagcgagcgccagccacgcctgcagcgcgtgcagctctggctggccaaggaccaccaggccgaaggtgcacgcctgcgggaactgctggactgggatacgcgctggccgtgggccgcgtatggcggcctggtacgggaggctgccgatgcaggcacgccgttgttcggcggcaacctgtcgcgtaccgaggtcaacgcgctgctggcctcgaccgagggcgtgcggttccctgtggccgctgcccgccagcgcctgtcggccgtggtgctggcccagcatgcagacgcagcaccgatgctggaagggatgctggccgtgcaacaggcccgcgatacgcgcatggcgcgggtgctgctcgatgcgcccgcgccagcgctgctggtagcaggtcgctggcatgtactgcgcagtaccggggtaccgggctacctgtcacaggatacgcctgcgctggtgatcgcattggcttcaccgggtga

SEQ ID NO: 90497 - DNA, 690 bp, Glycine max
  Peptide Sequence Number=SeqID_207275
atgcagaggcctccacctgaagattttctgttgaaggagaccaagccccaccttggaggcggaaaggtttccggtgatagacttaccagcacctatgatctcgttgagcaaatgcagtacctttatgtgagggtcgtgaaggcgaaggacttgcccgcgaaagatatcactgggagttgtgatccttatgttgaagtcaagcttgggaactacaagggaaccaccaggaatttcgccaagaacacacatcctgagtggaaccaggttttcgccttctcgaaggaccggcttcaggcctcgatgctggaggttaatgtgatagataaagatgttctgaaggatgacctcatcggccgggtgtggtttgacctgaatgagatcccgaaaagggtacctccggatagccctctggctcctcagtggtatagattggaggataggaagagcgacaaagcgaagggggagctgatgctggctgtttggatgggtacacaggctgatgaggcttttcccgaagcttggcactcggatgctgcgatggttagtgggagtgatgctcttgcgaacattagatcgaaagtttatctgtctcccaagctttggtatttgagggttaatgtgatagaggcacaggacctgatgccaactgataagggtagataccctgagaacagtttgaggagccgctga

SEQ ID NO: 90498 - DNA, 210 bp, Glycine max
  Peptide Sequence Number=SeqID_207276
atgggatcgagtcagacgccttggcttaaaaagaggttctatcaggtcaagatcaagagcctaggagtcaccagtctgaaagagttaggacaattgataggtcaactccagcgacaagcctttcgcaaagcctatggtaagatctgggacctaactatggcggaggtctccatagaggccattgcctccctcgctcaatattatgactag

SEQ ID NO: 90499 - DNA, 615 bp, Glycine max
  Peptide Sequence Number=SeqID_207277
atggaggaatcatcaacaacatgcgtgttgtgcgagaagagggcaatgatgctctgcgactcggaccaggctaagctatgctgggaatgcgacgagaaagtccacagcgccaatttcttggtcgcgaaacattctagggttcttttatgtcgtttgtgtcactccccgactccgtggaaggcttcggggatgaaactcacgcccactgtgtcgttttgtaaccgctgcgttgcggaacggaacgcgaggtggaaccgattggtgaataatgaaaatgaacatcaacaacagcaacaacaacaacaacagagtgattttgtggtggatgatggtagggaatatggttctgatcatgtttttgatgatgacgatggtgattatagtgatgatagtggtgaagaagaagaagaggacgaggatgatgaagaggagaatgagaatcaagtggttccaatgtcttctggttctgccacgtcaccacctaaggttgcctgtttagcgttgaagcgattgagaaacaactctttttctgtcgattcttcacatatctcctttagatctgtgtcttctttccacgtactaggtaagcttgtggtgcaactatgcaaattgtaa

SEQ ID NO: 90500 - DNA, 771 bp, Glycine max
  Peptide Sequence Number=SeqID_207278
atgagaattaaggctccaaaagaaggttcatgtgaccctattgcaccccttgacctgcctcatgctatgcatgcatttaatcgtgtctcttcaacagataaactaaacttgaaaggttaccacacttaccgcgggggattttggaactactttagcatgggaatggatgctcaagtatcttatgcatttcattctgagaggaagttacatccagaaaagtttaaaaatcagttatacaatcagagtacctatctgaagcttggatgtacacaaggatggttctttggttctctgtttcaatctgcttcgcggaatattgctcaattggcaaaggttaagataatgaaaaaaggtcattgggaagatctccacatacctcgcagatatgaaaatttctattatggtatacaacaacaacaacaacaacaatgccttatcccactaggtgggtcggctacatggatcaacttccgccataatgttctatcaagtaccatacttcgattcaaaccattaatttcgatattatgtataaagtcaatagtttgcctcaacttgcccagcttttctggtggactcaatccctggggaacaccaaataggaggaaatcaatttatagggacctgactctcccctacgtggatgatggcctatttgaggtagttggttttagagatgcttggcatggtcttgttttgctggcaccaaagggacacgggactcgtttggcacaggtaggacatgtcggttttgtgatcatacaacagtag

SEQ ID NO: 90501 - DNA, 315 bp, Glycine max
  Peptide Sequence Number=SeqID_207279
atgtttgggttaaactgccctaatgagtttgatgaatggcataatgaccattgccccagccctagctgtcgcgcagtccctagctcgttttcgtccaaacctaggttcctcatccctaccattgttatctttcgttcgccttctccatccttttgtttgactggtatcccaggtccgtcgtctccctcatttgctttcagtggtatcgaaggtccatcgtctctccgcattgttgtttttgttgttatcaaggtcaaaaacagaaggctttggcatgcccagaagagcattggtgctgcctgggtcccccgttga

SEQ ID NO: 90502 - DNA, 150 bp, Glycine max
  Peptide Sequence Number=SeqID_207280
atggtccatgatagcatcctgatgtccaaggtgcaaatagcagataaaggtgcagaacaaacacagcaatatgaaggtgaggtgccaatagcaagtgataccaagagaaaggtctcgaggcccaaaaaaagacaaattcagttattgtag

SEQ ID NO: 90503 - DNA, 474 bp, Glycine max
  Peptide Sequence Number=SeqID_207281
atggcggaaccatcgaagaagcgaaaagggattgtgacttcatccgcagtcactagaacaagaagccacggaacatccaaggcacagacatctcaaatttctcccaccatatcatctcctacgttgttttcctcggaagaacaacatatccagtacaattctcttttctcttctcattccattattgaccctaagttcgtagacttagctttctttgatgatgaagtgtttgattgctttcaagcatttcaaaattatggtttaattcagtttatctccatgaaacttcctttttaccctgtgtcgcaacatgccattttgcaggcgagcgaggcgagactcacgggtgcgcttttcaaaggaggaaagatgcgcggagtcgccaccaacgtttatttgtggaaaacgtcggaaaaaccgaaggaaaccggtcacaacgaaaattctaagttcgggagttgtatttacgcttga

SEQ ID NO: 90504 - DNA, 266 bp, Glycine max
  Peptide Sequence Number=SeqID_207282
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccacgttag

SEQ ID NO: 90505 - DNA, 438 bp, Glycine max
  Peptide Sequence Number=SeqID_207283
atgcacccactctttgtgtttctcttgcataaaaactttggtttcctaggtgtcgcaacctacccttcggcgggagggcgatgcgtgactcgcgggatgcgtgttccacgaaaggaatacgcgcagagttgccaccaacgtttatttgagaaaaacgtcggaaaaaccggaaaagacgcaatctacgaacttttaagtgaaagactcgggagttgtatttacgcgcggggaagggtgtttccctttgctcctacgtattccccaattgtgatgaggaaatcagacctacgtagttctttcttatgcgtgaatcaagtgattcttttttacttgaaaggtgatcattttaaggcgttggaccttaaaaatgatccattttacttggtaagaaacagaaatgataaactttcaaaatcctatttttgtggacgagcttga

SEQ ID NO: 90506 - DNA, 1200 bp, Glycine max
  Peptide Sequence Number=SeqID_207284
atgcctgacccctctaatgttcctacttccttagaagatgccattctcaaacttgcggctcagcaattgtccatgggtgagaccttacaaacggtcacattccagctaaatgaaatacttcatcgtctacctcccgcacttcccaacatcggttcggcatcatctactcatgcttcatcctcttcacctgcacaacatcacaaaatcaaaattgatgttcctcggtttgatgggagtgacccttctgggtggatctttaagatcacccagtatttcgagtaccatgctacccccgaggtgatgaacaaaatcatcgagcaatgcttaagggcttttgttcatcggagaccgcgagtgtgggggaagctcctcttatgggtggaatggtcccataacacctcttggaacgctgccacgggatccacgccttacgaaattactttcggacggaagccattcaatttccctgattatatcacaggaacatcaaaattagatgcagtagaggatatgctcaaggacagggatgagacattccaatgtatcaggaagaaacttcttaaggcccaggctaatatgaagaagttcacggatatgaagaggagggagatgtcttatcagcccggagattgggtcttactcaaactcaggcctcgacgacaatcgtcagtgaaggagaatcctagtgtgcaaggaaaattagctaagaggttctatggtccctttaaagtgattgagcgtgtagggccagttgcttatcggttacagctgccggaaaacgcgcgtgctcaccctgtttttcattgttcgatgttgaagcaattacggggaacaccggagtctgaaattttggtccagttgccggaccaattccttcaagatcaacctctcatctctccgctgtctatcctggattataggaggtccaccccagcagacccatggcagttgctggtgcaatggaaatggttgactcctgatgatacttcctgggaagattgggacacattacagcaggactatcaccttgaggacaaggtgattctgcaagggcccccgagtgatagcatcgtgatgtccaaggtgcaaatagcagataaaggtgcagaacaaacagagcaatatgaaggtgaggtgcgaatagcaagtgataccaagagaaaggtctcgaggcccaagtacctgaaagactatgtttga

SEQ ID NO: 90507 - DNA, 170 bp, Glycine max
  Peptide Sequence Number=SeqID_207285
atgtggagagacgatggaccttcgataccattgaaagcaaatgagggagacgatggacctgggataccagtcaaacaaaaggatggagaaggcgaacgaaagataacaatggtagggatgaggaacctaggtttggacgaaaacgagctagggactgcgcgacagctagg

SEQ ID NO: 90508 - DNA, 129 bp, Glycine max
  Peptide Sequence Number=SeqID_207286
atggcagggtgtagggacgacgaggcgggtcgttacaaggggcgtggcgtaggcgaggagggaggtgaattgggagagctcgggcatggtggagaggagggcaatgaggttgttaatgtttggaaatag

SEQ ID NO: 90509 - DNA, 255 bp, Glycine max
  Peptide Sequence Number=SeqID_207287
atggagataaaattttgtgagaaatatacgtggcagttgaagagttattgctattttggctttcgtatcaccatacacttaatcttggctacaaaaactcaactattgagcatcttcggccttcgggcaattgaagaggcatggagttttattttattttataaccgaagaggcatcgagttgatcagggaaattgtggaagacgcaaaaggtggattaggtggtaagggttgtgttgaatcaaaccaaacttga

SEQ ID NO: 90510 - DNA, 321 bp, Glycine max
  Peptide Sequence Number=SeqID_207288
atggaggagttgattaacaaaacacaactctcttccaaaataatcccaacgtcatcacgtcagctcgacggctcctcgacagagtctcacttcctgcaccctactactgtcattctgctcccacgaacaagacacattcaacaattattcatcatccatccatggatccaatcaagactgctcagaatgatgcatgcacctgacctcaactctcagatgcaatgcggtacgtaccgtatccaataccaaggaaatagccctaagcgtgtctacacgacacctcactcaggaaaccatgcagtatttgtcgaggccacctag

SEQ ID NO: 90511 - DNA, 150 bp, Glycine max
  Peptide Sequence Number=SeqID_207289
atgacgaagagcgcacggaagggagtgccgcggcgagtccagaggagaacgtcgcgggcgaagtttttggaagcttcgggaaggagaggagcttcagagtccagaggagtttttggaagctttagatggatttcagacactttcaggtag

SEQ ID NO: 90512 - DNA, 147 bp, Glycine max
  Peptide Sequence Number=SeqID_207290
atgaggctttcccttattggagaatttggaggtgaagaagtcgggaatataggaggctcaagtgaggggacacgtttagagcgtgtttggagatacaatgcttttgaatttgatgtcaaacttccatccatcaaagaacaactttaa

SEQ ID NO: 90513 - DNA, 315 bp, Glycine max
  Peptide Sequence Number=SeqID_207291
atggttggagcattctcgcaaaacatcgtgaccctaactggtctccctatgatcttacttagtgagagtgacctgacaaacccattgtgtgatgtgtcttgttatgtactcctaagcgccccagggtggtttttcactgacatgagggtgtcacacctgtcgttagatcaagttgaaaaaccaggttactattggaatgggagaccaatatcttccacaaaatgcagaaatctatgcaaagttggaagagctcaaaaagatgatcagcgaggccagctatgtgcacacaagctattcattgcaagatacagatga

SEQ ID NO: 90514 - DNA, 2931 bp, Glycine max
  Peptide Sequence Number=SeqID_207292
atggtgttatcggcttcgccatgttccttggcgagaagctcgctagaggagatgctcgattcccttcgtcggagagatgaggaggaggagaggaaaaaggactcgccgccggcgttgcccgcgaggccggcctcgcgggcacggcttcctccggcgcggcggtcgctgccgaacaacttcaaggttagcggcagcgagctcgccgtcgcgccagagcatggagctgggactaacggggagaatgatttggggcagaaaaggagaagaaatggttttgggagcaagagggtgaataaggatgtggagtctccttacgtggaactttcttccagtgattcatctgggatgatttgggaattggagggtgatgatagcgtttcttatttcatcaaaaagaagcttcgtgtttggtctaggcaaccaagaggtcagtgggaactaggaacgatacagtcaacttcaggagaggaagcatccatttcactctcaaatggaaatgttatgaaagtggtcagatcagagattctgccagctaatcctgatgttttggagggtgcggatgatcttaataaactttgttatttgaacgagccatcggttcttcacaatctgaagttaagatattctcaaggaatgatttatagtaaagcagggccaattttaattgcactcaatcctttcaaagatcttcaaacatatggaaatgattctgtctcagcttataggcagagaattattgatagtcctcatgtttatgctgtggcagatacggcttataacaaggtgataagagatgaagtaaatcagtccattatcataagtggcgagagtggatctgggaaaacagaaacagctaaaattgcattgcagtacttagctgctcttggtggtggtggaagttgtgcgatagaaaatgaatttcttcagataaatcgtatactagaagcttttgggaatgcaaaaacatctaggaataacaactctagcagatttggaaagttgattgaagttcatttcagctccatgggtaaaatatgtggggctaaaattcaaacctttggcttattttcatggctttgtgtttgtcatatgccaacccatatgctaactggaacagtaatgttagaaaagtctagagttgttcaactggccaatggtgagagatcatatcacatattttatcaactttgtactggatcttcatctggtcttaaagagagactgaatcttagagcagtcagtgaatataaatatctagttcagagtgactgcacgttaattgatggtgtcaatgatgctaacaactttcatcagctgatgaaagcgctggatactgttcaaatttgtaaagaagatcaagagatgatctttaagatgctcgctgcaatactatggctgggaaatatatcattccaagtagacagtgaaaatcacattgaggttgttgatgatgaagctgtaaccagtactgcccagctgatgggttgcagttcccaggaattaatgacagcattatgtacccttaaaactcaatttgacgaggatactattgccaaaaatttgacattgaggcaggcaactgaaagaagagatgcaattgcaaaattcatctatgcaagcttgtttgactggcttgtagaacaagttaacaagtcacttgaagtgggtaaaccacatactgggaaatccataagtatccttgatatttatgggtttcagactttccagaaaaacagctttgaacagttttatataaattatgccaatgagaggattcaacaacattttaatcggcatctatttaaacttgagcaggaggactatgaattggatggtgttgattggactaaggtagattttgaggataatgaagggtgcttggatctttttgagaagaaacctcacggtctattctctttattggatgaggagtcaaatttagccaaggcttctgatttaacatttgccaacaaacttaggcaccacctgggtgctaatccttgcttcaaaggagaaagaggcagagctttccgtgttcgtcattatgcaggggaggttctgtatgatacaaatgactttctggaaaaaaatagagacacgttgtcttctgattccattcaattcctgtcatcctgtaactgtgaactgctgcaattgctttccaaaatgtttaaccagtctcaaaagcagagtgttgcaacaaagttcaaggttcaattgttcaagttgatgcagaagttggagagcaccacacctcactttattcgctgcataaagccaaatagtaaggatcttcctggaatttttgatgaaggccttgtcctacaacagctcaggtgttgtgaagttctagaagttgttagactttcaagggctggatatcctattcgaatgggccatcaagagttttccagaaggtatgggtttctgctttctgaggccaacatatcgcaagatccattgagcatctcggttgctgttttgcaaaaattttatatcccttatgaaatgtaccatgttggctacaccaaattgtatcttcgagcagggcagattgatgcactggagaataagagaaaacaggttttgcagggaatacttgagattcaaaaatgcttccgtggtcatcaagctcgtggttatttctgtgaacttaagaatggaatgacaacattacaatcatttattcgtggagaaaatacaagaaggagatatggtgttatggtgaagtcttcaataacaatttattctagaaaactggaggagatccatgcaatcatactattacaatctgtaattcgaggttggctggtaagaagggatgctagtcatgtaaataggtctaagagatatcctgaaaatgctaaacctaggcgaaagtcctttatgaagataataccagaagtaaagttgtattacgttaaaatgtaa

SEQ ID NO: 90515 - DNA, 240 bp, Glycine max
  Peptide Sequence Number=SeqID_207293
atggacattctttctatcatgttgccattattggatgaccaagatacttcccaaaaatcgaaattcttgatcaatggaggaacaatatcaccatttttgttcaataagataccaaagtggatgattgactcattccatactagaaagaatgacaggaaatcttttgataacacatattcctatttctcaatgatatcccacgatccagacaattggctgaatcccgtgaaacgtccataa

SEQ ID NO: 90516 - DNA, 190 bp, Glycine max
  Peptide Sequence Number=SeqID_207294
atggtggacggagactcttccgttttgagcagcgtcaccactttgtctgcacatggcaccagggatctccacaaggttgttgaggagattcaggatgagtttgtgatgacgtcaaatttcgggaaagaggttgtgttgttgcttgaggtttgcaaacggccttatagatatagggttgctgcacttagag

SEQ ID NO: 90517 - DNA, 129 bp, Glycine max
  Peptide Sequence Number=SeqID_207295
atgagtgaaggcggaagcacagggggaattccaatgaaggatttttggatcttgaggggtcgaagatttggtcgggttcagatactgaggcgcgtcgcttccttgtgcgagactcgagaaatcatttaa

SEQ ID NO: 90518 - DNA, 240 bp, Glycine max
  Peptide Sequence Number=SeqID_207296
atggacaaggaagaggcaactaaggctctgataccaaatgttagactaaaatgtttaacctatgatgttacaaactacaaaatgaaacacagttttgggaatgatggtggtgcagccaccggagagttgctagaagaggtggaagcagtcgccgaaggtggtcaaggcattaccaaaagtgacgcggaggaggtgaagatgttgccgaaggcatcaaagaagaggaagagtaaaatttga

SEQ ID NO: 90519 - DNA, 274 bp, Glycine max
  Peptide Sequence Number=SeqID_207297
atgacacagtcagacattcacagagatgaacatcagataccaactaacaccacacaggatgatcaatttgtcggcgatgacaactcagattccaccgataatgatgtaaatatgacacaggaaaacattaatatagaatactcatcaaatgacccaacaatagatgatcttgatgattatgatgaacaaacttttctatctgcctcatctgcataccaaaatacaggtggtacttaccttgatatcggagatcctatatgggaatgcccacatt

SEQ ID NO: 90520 - DNA, 303 bp, Glycine max
  Peptide Sequence Number=SeqID_207298
atggctgagcacaaaggaataaaggagttatgtgaaaagcaacttcaacatggaaggcacaaccccattcccctcagttcattcaaatgtcttgacccagctttctttcattcagggaaagtctttatcatccacaagtatagccattctggccacctatggtacttgcaccgccgctccatctacgggacacgctgcctggactcaccgccaggaagactttcaatacaagggattcccaaggccgagatccatcaccgccatcttactcgtctgagtcagtcaccaagtcgaaccatctag

SEQ ID NO: 90521 - DNA, 219 bp, Glycine max
  Peptide Sequence Number=SeqID_207299
atgaagaagggtaagtctcacattgttcggcgtgttgctataccttataaaggcaaatatgttgcttccacatctagtactaaggatgagaaaaaggataatgatggcaaacttaactatggcaagaagaagaagtatggacataaactaagtgatttttattttctcaagaagaaaaatcaaaaggaaggaactcaagagccagatgaagttaagtga

SEQ ID NO: 90522 - DNA, 330 bp, Glycine max
  Peptide Sequence Number=SeqID_207300
atgtcgtttcactctccactggggttcccaatttctctcctccttcccaccgaaaacatggccaccgaaaccctagaagacaccaagccttccctacaagacaaggatcatgcaaaatcagagattcccaagaatgacgcatcctcggacgatgtcgctacaaaatccaaggacacaaatgttgctgacaaagatagagcatttgacaatcaggaagtagaagtggaagatgctgctgaggagaagaaagaaaatattgacaaagacaaagaggaagaagacgatgtcaaagacaaagaagaaaaatgtcttagaaaatcgactctctaa

SEQ ID NO: 90523 - DNA, 291 bp, Glycine max
  Peptide Sequence Number=SeqID_207301
atggagaagagggtattgtctgaggcatcaaacaagagtttcttctcattgggaagtggtgattactataggtttagttttggttgtggactttggacacgacaaagaactagggaaaagaatgtacccctcgaatctctccaacaattggtatctgagccaatggttcaagttggtgatcgactcagacgagtatgcaagtaccgtaggtggccaaaatggctatacttgtggatgataaagactttccctagagggggaggctaccatgtggaagagactcacacttga

SEQ ID NO: 90524 - DNA, 294 bp, Glycine max
  Peptide Sequence Number=SeqID_207302
atgtttaggaagaatgagaattggcattcaggtggaaccacgtgctcattgagtgacagcctgataggtcgccataggatggaaggtgcttacctgaggggcgcttaccggaggaagcgacacgtggccgctgctgcaggcggtgctgcaggtggtgcagacgccgaaggtcgcgccctgcatgcaggcgctactgctcgcgccctgcacgcaggcgcgtcccgtcgtgccgttcccgaggcggcttgccagcttctcccctgtttgcaggtttcccttcccttgtttggttag

SEQ ID NO: 90525 - DNA, 450 bp, Glycine max
  Peptide Sequence Number=SeqID_207303
atggaggccatgaaagaagagatggccacaatgatggaggccatgatgagcatgaagaagataatggaggtcaatgcgactgcagttgccgctattagcgttgtttctggggtggacccgactcccccatcttacctcaacctaataaatcatccaaccgcggatacaggagacccccattttgtgcaagcccagaacaagcaggttttcccgccatatggtttgcctccaaactatactccacccaatgagaatgtcaataacttcacttctatacccattgagagccaacaacctcaatttgatcatgcacatgtctctcaacccatgggtgagacacatgaaatgcgccaccataatctagccgacttccagccttgcttcggatatgccactgaagggcaagcagttggtggtatacccctgcaaaacactttggaaggcccttag

SEQ ID NO: 90526 - DNA, 231 bp, Glycine max
  Peptide Sequence Number=SeqID_207304
atgaatgataagtttagtaacttaataatatcgtattttccaaatttccaacacattgcagaaagaaatgtcgacaggggaccacagcaggcagggattcctcttatagacatcactgctgtacacacaacagttagccataacagacttagacatgccatgaaccagaaggaatacaattctagtgtaatgtgcctccttggcagaaagcaagatttatggaatacctag

SEQ ID NO: 90527 - DNA, 265 bp, Glycine max
  Peptide Sequence Number=SeqID_207305
gtccaaattacaatgggaacgtgttcgggctaggcgctttgagcaaaaggtttagttgctcaaaatcagctccatctacttctattgctcctgtggaagaccaaatagaggaaatgcgtgagacaattactaaattgaatgttgagcttttggcaaaggcagataaggagaggacacttgaggaaaagatgtttccatcgactactagagcagatggaactgagtaccatgttcatgatgctcaggttgatcatcctcatgacat

SEQ ID NO: 90528 - DNA, 726 bp, Glycine max
  Peptide Sequence Number=SeqID_207306
atggagtctccaaagacgaggccgaagacatgcacaaacaagtttcgtttgttccgatgtttcaaatccgagttccccgacgacgttgtttttccgccgccgccgcctcggaaggcaaaaagcgtcaatcctcctctctcctacattgtcgtgccggagaagcagcgcacggcgctgccgagggcgttgtcttcagctttcgcggcgacgaagggcgccgaagaaaacgcgagtcgccggcaaaaaaagatggacaaagaacataataactctcttcgccgggctctcatggcggctttgaatcacacatcattggccaagaagatgaaaagctgcaagaggaaaaccaaacagggttcttactcaagagaaagctcaatcaacttatcaagaatcacttcctcttcttctagttcacttggattcacatcatcttcaactactacttcatccactttaagcagcactacttcaacaaatgcttcggcgtcatcctctgaatcgtacctatcaagatccatggcaatggatggaactggggtggcgaaaaataagcagattattggagaaaaagggtattttggttcaaacatggctttgagttttcttttgatcactagtattctggttttgatcatgtggggtaagtgttgtgctattgcttacacctcaattgggttcttagtggtgcctaattgtcggaaaaggcctatcaaggagggagct

SEQ ID NO: 90529 - DNA, 525 bp, Glycine max
  Peptide Sequence Number=SeqID_207307
atggtcactcaactctgtgcaacgcgacgtgcccgccgtgtcagcaccgagttcctcaatgcgtcattgagtgcctgccgcgttcaactctcgcattgcacaatcgctatcagtctcgtgctcttgttctcgctctcactcatagctctactcactctcgttctcgttctcattctcggtcataaaaggttaatcttctataaatacttgtttctgtgtttggttttgatggtgatgccttatggtcaagtcagtaggtcctttgctctaagatggaaggatgaactagagcatatttggcctctgctagatagtaatgacaacatgtattctgttacatataaccaagatcgggtgaatccaactctattagctagatggacaaaactcagacatttctatggactcactgcaaatcatcaagtgaccatgacctattttggacagagtgctttcttcctcaccatcttcaaaagcatctccgaaccaaaaacttatcctaaatggcactcattgtaccactaa

SEQ ID NO: 90530 - DNA, 414 bp, Glycine max
  Peptide Sequence Number=SeqID_207308
atgtctactccagcaagaactgccattaaccaagaatcatctgaattttcagtaccacaagtttcggctttgaatccacgaggcgaggagatgcgagggttaattgtagacaatgcttttgattctatgaatttgggacacaacaatgcggatatcattgatttcatagagtcgttacttgaagaagatacttatttcacagggttaggtcacaatgtcaacacgaataataatggtggagtttcaagagtagtgcaacctgcaaatcaagactttattcaaaatcttgaaagggttacaattcaagaaataaggatggagcaatcatcagattttatgtgttccatatgtcgtgaggaattttcagttgggaataatacatgtcctctatgtcgtaggactatctatctatag

SEQ ID NO: 90531 - DNA, 243 bp, Glycine max
  Peptide Sequence Number=SeqID_207309
atggtgcagatgaccacgttagtctccgcgtgctaccgaacccttgagtctgacggtagaaacgagactttttcacggtctcggccagaagatgctgacatctccgagaaaggtgcaaatgacgacgttagtctctgcgtgccaccggaccctttatctctgcgtgctaccgaacccttgggtcatgatagcaaaggtggggtggtcgacaaaagcggggattttggtcctacgtatccttaa

SEQ ID NO: 90532 - DNA, 621 bp, Glycine max
  Peptide Sequence Number=SeqID_207310
atgaatgtggatgttccgcccggcagtaatgaacgccgtgtgttgcaggcgattgaacagcagctggtgccagccatgcagcaattccgccctgaattgatcatggtgtcggccgggctggatgcacatgcgggagatactttaggcgcattacagtattccgatgcgggctatgccgcgcttgcaacagcagccaaacaattggcagcacactacacacaaggacgcatggtgtggatgctggaaggcggttatgtacccgctaataatgccaatgctgtggagaagatcactcgagcattgattgcgcggttttatgtgtatttcttgctggcgtttctgtttgccgttgcgcagaccgggatcgtcacgcatgaaatcagccatatcaaagagctgacacaacattcgcagccagacaaaaaacagggtaatgagccttgtacgctatgtatcagcctggcgcatgccgcgggtgctttaacgcagtcaccgcagtggagttttccaccgcaaacaagttttaccctctcaaccgcagtggtcattgcggttcaaaccagtcgcgttgccatttattctgcacgcgcgccgccattcttatttcagcctgatcagtga

SEQ ID NO: 90533 - DNA, 321 bp, Glycine max
  Peptide Sequence Number=SeqID_207311
atgaggggcaccgtgcatgagcctcaagtgaacataggggccgatcaaaagttctcacccatcgatgtttttaacaaaaaaaaagggacaaaccctggatttcaatggattgattacacttcaaacgactccattgccgtcactccaaatggtcaagtggacccttgggtactagtacctaacacctttagaggactgtatgtcctcgccatcagaggactgcacatcctcgcctacagagggctgcacgccctctcctttagagggctacgcgtcctcattttcagtgtgctccatatccacaccttagaagaatataag

SEQ ID NO: 90534 - DNA, 174 bp, Glycine max
  Peptide Sequence Number=SeqID_207312
atggaagatgcacctgtgagccctcgcgtcgccctcccgcaaaaggatgcacaatgtagtgcacctgaagcaatgtctcctcataatgcttgtcctcttcatattgatttgaaaggtgttcccactgttgcttatttgctcaagtactccatacaggaatactttcaccactaa

SEQ ID NO: 90535 - DNA, 339 bp, Glycine max
  Peptide Sequence Number=SeqID_207313
acttatcaaggtaatccttgtggcgtctacccagacttatcttccttaaccggaagtggcgtctacccagacttatcttccttcattggaagtggcgtctacccagacttatcttccttaaccggaagtggcgtctacccagacttatcttccttcaccggaagtggcgtctaccctgacttatcttccttcaccggaagtggcgtcatccaaaccttcgtaacctgtatcaaacgatccgctcctactcaggttcacatcacatttgaatttctcgagagcttccgttgttcaatttcgagcgtctcgatatattatgcgcctggatcggacctctga

SEQ ID NO: 90536 - DNA, 240 bp, Glycine max
  Peptide Sequence Number=SeqID_207314
atggcctccatcattgcgaccatttgctctttcatagcctccatgtcggccttcaccttctcttgcatctcctctgctttacccattactctagctctagcacaggtgaaactggaagtaacaaggatatcgacagccctaaatgtgtttggcagtagacgaaggagcgataaatgggtttatgatcccaacatggttggctcatggtacctaacacatgcaactaagaatgcatcatga

SEQ ID NO: 90537 - DNA, 478 bp, Glycine max
  Peptide Sequence Number=SeqID_207315
aggactacacgtcctcgccatcagatggctacatgccttaacctgtagaggactacacgtcctcgcctttagaggactacacgtcctcgccatcagagggctacatgtcctcaccttcagagggcagcacaccctcgccttcatagggctacacgccctcacctttagagaactacgagtcctcgcccttagagggctacgcgtcctcaccttcagaggactacatgtcctcgccattagaggaccacatgtcctcacttacagaggactacacgtcctcgccttcagagggctgcatgtcctcaccttcagaggactgcacgtcgtcaccttcagagggctacacgccctcacccttagaggactacacgtcctcgccatcagagggtcgcacgccctcaccttagagggccgcacgccctcacttcagagggctgcactccctcaccttcagaggactacacgtcctcacctttag

SEQ ID NO: 90538 - DNA, 198 bp, Glycine max
  Peptide Sequence Number=SeqID_207316
atgatgcatgcacctgacctcaactctcagatgcaatgcggtacgtaccgtatccaataccaaagaaatagccctaagcgtgtctacacgacacctcacttaggaaaccatgcagtatttgtcgataccacctattcgtgcatcgtaacttcccccctaggtgatcaactttgggggccacaaggagttccttaccag

SEQ ID NO: 90539 - DNA, 371 bp, Glycine max
  Peptide Sequence Number=SeqID_207317
atggccattgaaggaggtgaacattatgcctttgctaacctaaaagagttgttcctagaacccaatatcatcacccctcccaagttcaaggtgctggactttgacaagtacaaggggactacttgccccaagaaccatctaaagatgtattatcggaagatgggggcatgcgcaaaagataaggaattactgatacattccttccaagaaagtcttactgggatcgatgtgggtatgaaaaaaggcaaatttagtcatcctgcttggacgaatgagaaaactggggcaaatgaagagggtgagaaagagggagaaacccatgctgtgactgccattcctatacggccaagtttcccaccaaacccaacaat

SEQ ID NO: 90540 - DNA, 861 bp, Glycine max
  Peptide Sequence Number=SeqID_207318
atgagagggttgcacgccctcacctccagaggactacatgtcctcgcattgagagggctagacgccctcacattgggactacacgtcctcaccatcagagggctgcacgcccttacctccagaggactacatgtcctcgcattgagagggctacacgccctcacattgggactacacgtcctcaccatcagagggctgcacgccattacctctagaggactacatgtcctcgcattgagagggctacacgccctcaccttgggtactagttaccctcaccgtcagaggactacacatcctcaccaccagagggctgcacgccctcacctccagaggactataagtcctcgcattgagagggctacacgccctcacattggtggactacacgtcctcgccgtcaaagggtcatgtactttcacctttgtagggctacacgccctcacattcagaggactacacgtcctcacctttagaggactacacgtcctcgccatcagaggactgcttgtcctcaccttcgtagggctacacgccctcacctttagaggactacacgtcctcgccaacagagggctgcacgccctcaccttgagaggactgcacgccctcacctccaaaggactacacatcctcgccttgagagggctacgtgtcctcattttcagggccagtagtttccttttaacggttcctgggccaccccctgatattgcaggagggccaactgtgcgagcacaaccagagagggaggctattacacagctactatgcataccggggcaagatttcatccgtgccgctgtaaagagacgagtgcggatcatgcgcaccaacatgaccactcttacacagatatag

SEQ ID NO: 90541 - DNA, 330 bp, Glycine max
  Peptide Sequence Number=SeqID_207319
atggagagaatagcaggagtggtcaagatctcagaacaagaattagaccgagtgaagcaaagtgggaatggggtagggggaataccaaggaagtgcttggagaaggcagaaactctggccagccaaggaaagtgggcattattcatcgacgtattagcactgctagcatttgggatagtactatttttgaatatagacgggctggtggatctagcaacaatcgacgtttttcttgcttatcaccacaacaaggaaagcccagtcattgctgttttagcatacgtgtatgatacattcgacttaagatgcgagaagagcgatgcgagatga

SEQ ID NO: 90542 - DNA, 1068 bp, Glycine max
  Peptide Sequence Number=SeqID_207320
ccttctgagctatatgagttttgggctcttccagcccgtcgactggctgggcagaaccgataccgccttatgggccattctggtgataccatctcgcccgatctctacgaggcagcggacattgaaggcgcgagccgctggcagaagttccgcatgataacctggccgctgctgcgcaacacggccgtactcgttatcatcgtcattaccatgcaggcttttgcgctttttgcgcagatcgatgtgatgaccaaaggcgggcctcgcgactctacgcagagcatcgtctatcaggcggttgagcgaggataccgccagcaggacatagccgcgggctccgcaatttctgtcgccggacgccgcaaaagtcccgtttttctcatcggcaattacgcgctcatgctcgccttcgcggcgatcttcatcctgcccctgttgttcatggggttctcatcgctaaaaccgaacgaccagctgttgagcgatgcgacttcgatacgagccttcctgccggtgggagatctttcgctcgaaaactatactgcggctttcgcccgggcgccgattgcaaccttcatattcaattccgttgtggtaactggcgtcaccgtatttctcgccctgctgctcggctcgcttgccgccttcgcttttacgtttttgaactggcgcggcaaggaccttctcttctcgatcattctcgccacgctcattattccgtttgagacgattgccgtaccgctgctgctggaggttaacaatctgccatggatcggcagcggcgggtttacctggggttggctcaattcctggcatgtgcagatcattccatggatcgcggacggattgacgatttttctcttcgtccaatatttcaaggatctgccgaaggaattactggaggcggcacgcatcgacggagccagctggctgcgtatctacgcacaggtggtaatgccgctcagcgggccggtgatcgcaacagctgcgatcttgaagtttctcgtcatgtacagccagcagtatctatggccgcttctcgtcacgcagtccgaggcttaccggccg

SEQ ID NO: 90543 - DNA, 518 bp, Glycine max
  Peptide Sequence Number=SeqID_207321
tgacccccaatgcaaagagtacttcaagggagtccgataagcatagagtgcagtgcaaaagtaaagataaggagcttacgggaaacagcaacaggatcgctagtagctctcataagtggctgagagttcgaccgcaagagttggattggattctaaagttaaaggctgcaagagaggaagagactgaaactccagaggagagtgaggaagtgcaaaccctaaaggcggaacttcaaaaagcccaaatagtcaaagagcagttcaagtcaacggccatcaattacaaggaaaagctaagcctagcagcgactcatgagcaaaggctagaggacgagtacgccaaggtgtcaatcctacaagcggaaagggaagctagggaaagggtgatcgattcattgcacagagaagcgatgatgtggaaaaataggttcgcctttactttgaatgggagtcaagagctcccccgactgctagccaaggccaaggcaatgggggatgtgtactcggcccctgataag

SEQ ID NO: 90544 - DNA, 1197 bp, Glycine max
  Peptide Sequence Number=SeqID_207322
atgcgggaggcggagattgatgcgctggtactgttccagcccgaggcctttcgttatgcggttggtgcgcctgccggtgttgcgaccatgtggggcaaagcgggttccgcaattgcgctggtgcctgccgatgccggggcagggctggccgccgtcgtcagtgatcatgccgcgccgatcatcaggagggcggcacctgatatcgatctgcgctgccatcgcatctggatcgatttggtcgatctttcgggtgtggaaaccatcgcgcaggtggatgatgcctatcgccgcaacaattctggcggggcgcggccagagacattcgatcgtaccgcctgcttcggcctgctctccgatctgctgcgggagcgcggactgtccgcggcgcgcatcggtgccgaccttgaattcatgcccgccgccgattttttcgccctgcgtcaggcgctgcccgaggtgaactgggttgatggttcgacggtgctgaaacgtctgagggcggtgaaatcccaacgcgagatcaaacttctcaggcaggcgccagccgccgccgaggcggggttggtcgagatggcagccgccgtccgaccgggggcggcccttggtcaactctctgccgcctggaaatccggcgcgcaggcatatgccgcaaaatccggtttttcgttgagcgggcattgggacttcatttcggtcggcccggctttgtcggatatgacggcagcggtcgcgccgggtacgctgatcaaggccgatgtgggcacgctggtggacggctattcttcggatggcgcgcggactttttcatgggggccggtttcgcctttggcgggcgatatcttcaaggctcttgaggcggccttcgcccgcgggctggacgcgctccgcccgggcaatacattcggtgcagtgcacgccgccatgctggcctcgatgcgcaaggacggcttcggtgaatattatcgcggccacttcggccactccgttggtggcagcgtgggtatcgaggaatggccgttcttttcccacgacaatccggaactcattcttcccggcatggtcgtcgcgctcgaagcgccgttttatggggaaggcgtgggtgcgttgatgatcgaggaccagttcctcgtcaccgcatctggcgcagagtgcatgaacagcctgccacgcactctacgggatttatctgcggactga

SEQ ID NO: 90545 - DNA, 204 bp, Glycine max
  Peptide Sequence Number=SeqID_207323
atggctccgaaaaagctttccgcgaaaagatctaggagggacgtcgcggctaaagggaccagtgccgcctccgagtttgatagtcaccgtttccggagcgccgtgcaccagcagcgcttcgagcccatcaaaggatggtcgttccaccgagagagacgtgtccagctcaggacgatgagtacaccgattttcaggaggagatag

SEQ ID NO: 90546 - DNA, 262 bp, Glycine max
  Peptide Sequence Number=SeqID_207324
atgactcaaaatataattagagatcattggatgacaataggaactgataataaagctaataatatttttactaagcaaggaagggttaaatctggtgctaaaggaattggaaggtttgcattagataaactaggaagcaaatgcgaaatgaccactatttttaatcctagtcctgaaattcataagccagatactgatataaacggaagtcccacaaattatacaggatataattgggaagttaattgggaggactttgaag

SEQ ID NO: 90547 - DNA, 513 bp, Glycine max
  Peptide Sequence Number=SeqID_207325
atgcctgtgagacccctccagttctgtaattcgaaggaggttctgagaattcaaacccctcgtcacctactagtgagccggaaagctgagggacgcctctcgttcctcttctcccatttgacaaccgtatctcagaataatggggatatatcgttgggaaaaagcagaagaaaaggatttcacgggcagaagaagggaaggaagttcggaaaagcagacgggactattcctttctattacgatctcggcaccaccttccttaccccctacgataaatttaccccttttttgaagaggaaagctcccaggttccgcatcttaaaaaagtgcataaccagattggaagcactgaagttaattcgcaatgggccaactcacccagccatgatgcgcatgacagaagagagcgagcacaaaatggagtttccatcttggatgaggctcacgtccggaaagaatctttttcaagactttctcccctatgttgaactttctctatattacattacctga

SEQ ID NO: 90548 - DNA, 498 bp, Glycine max
  Peptide Sequence Number=SeqID_207326
atgaccctttcatcatcgcagaataagctaaataggtattttatgttcaagacccttgtgatgaaaggtggcaaacggctacaccactcaactctccttcttctcctactgacaagaaaagtcacacggctaatatcattagcgactacaccagttggggtagagagaccgctggtccatgtcgatcctgcgaccgggaaggtcgacggtccccacagaaagaagttaagaacatatttagggattgttgctcgtgataaggtggatgtcacatacgagaattggaagcaagtccctgctgctcagaaggatttgatatgggaggatattcagactgtgggggagtggtggagacaatttaagtctgatttgacatccaaatgggcacttgcagccgacaaggacagtgtcgatgacactgtatgcaaaaagtacgacattagcaagaagaaatggacccaatttgtcagatttgcagagacccttcgtgggaggtaa

SEQ ID NO: 90549 - DNA, 312 bp, Glycine max
  Peptide Sequence Number=SeqID_207327
ggaaacattgatgttgccattgtgaaagagttttatgctaacctctatgacccgaaagataggtcacctaagcaggtgcgggtcagaggtcacttgattaagtttgatgaggacacgctgaatacattcttgaagactcctgtaatcatcaaggagggggagacattactagcttactctagatttgttctctcgaggcttgatcctcaagagttagctgctaagctctacatcccagggaggggatttgagcttaatgctaatggtcagcctctaaagatcctcaggaagaacatgaccacactcgcttag

SEQ ID NO: 90550 - DNA, 225 bp, Glycine max
  Peptide Sequence Number=SeqID_207328
atggagaatggacaattggcgaacaacgctaggcaatcaattcgtggggctccagactcgaaggcaatcaattcgcgaggctccagactcgatggtggaggacgcatgaacagtgctaggcaatcaattcatgggtctctgaataagatggagaatggagaattggcgaacaacgctaggcaatcaattcgcggggctccagactcgatggtggaggacgcatga

SEQ ID NO: 90551 - DNA, 270 bp, Glycine max
  Peptide Sequence Number=SeqID_207329
atgaatttcgaaatctgccaaattgtgcagcaaaaagctgtcaaatttgtgcagcagaattgctcaacatgtgcagaaaatgcttgtgcattgctggttatgggaaagcttggaagggttgatggggacccggtgctgagaggaacgaggataagggctacgttggagtacgtgagctcagttgaaggtgggcaactggggatggtgggttcatgtttgatttgtggatgtgggagagttgatttgcaccatcgcccgatcgccacctag

SEQ ID NO: 90552 - DNA, 422 bp, Glycine max
  misc_feature (5)..(5): n is a, c, g, or t
  misc_feature (42)..(42): n is a, c, g, or t
  misc_feature (59)..(59): n is a, c, g, or t
  Peptide Sequence Number=SeqID_207330
ggggncggagcctatggaaaaacgccagcaacgcggcctttntacggttcctggccttntgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccctcaaatagggcccaagtgtcctgggatgcctttacaaaaccttttccatatgctgcaatctgttaagtcaaataaagttggaggaaggaccactttcagaaccacaggcagtcagatggtgattgctcagtaa

SEQ ID NO: 90553 - DNA, 413 bp, Glycine max
  Peptide Sequence Number=SeqID_207331
tgtcagggttgagccaacagaggaggtggaaggaccgacttgatgaggaggaagtcattgttggagtcctagatttggagggagagagaaagaggggaaggcgaaccacttgtcatcgaggttgtcatggaggtgagaggagggggcaagggcaagaagggttcggagtagaaatagagactgcgaagggtagagaaagagaaggaagagaggttaggatcattggattagagagagagagagaaagggaaagaaaaagtaggatagtgtctgttgaagaacaagttccacaaaatcttgaacctaccaagtgtgatggttgggattggtatgagtgggatcatttgccacaccctttggttgggcctcttgagaaaatggtcaaaggagctttcgacccatttccaatttga

SEQ ID NO: 90554 - DNA, 444 bp, Glycine max
  Peptide Sequence Number=SeqID_207332
atgcttagttgcttacgatgtacaatcactttatctggaagcttcttcacaaactgctctgcagaatatctccaatcagtagcattgaaatatcaaactgtcacttttatactcagttcgttcggaggaagagaaccagaagcccaacactcgcatgtggtcattgggcagcatgttgctctcgctcctgtcttcgtcgcccacgatgaagcagaagtagcggcggtgcagtcattgctaggtgcagaagacgccgcagtggaggaccggcgacagcgaccaatggcaaacgacgagcgagcttgcggcacaattcgaacctcacagcggagtgaaggaggtaaggacgaagcttgctatgtgttcggagtgatagaggagacgacaaacgtttactctgtcatgagaattcagacaaacgcacttagagtacatagcagttag

SEQ ID NO: 90555 - DNA, 519 bp, Glycine max
  Peptide Sequence Number=SeqID_207333
atgaccacatgcgagtgttgggcttcctattccgtaaggttctcgccttgctcgttattttcatttcccacggaaaatgaggcgttttcttcactaagggttccagttcaacaaactggttctcttcctccgaacgaactgagtataaaagtgacagctccgggagtgaatcgtccacgaaatgagtttaagcagtttgtgaagaagcttccagataaagtgattgtacatcgtaagcaactaagcattcccacctcctatcaaaatttagcgtctccttttcatctgcatctgaaaattggcagtgaatgcaattcgtcaaaattgacgtttgatgatgttgatacaatgggagagaggctagctgaagaggtattatctgttgttagacggtggctagaggtgcaaaagatatcctttgtggcgcattctctaggaggctcggtggcaacatatgctattgggagactttatgatggaagcttgcttgtgaaacttctatggaggctggatctttga

SEQ ID NO: 90556 - DNA, 311 bp, Glycine max
  Peptide Sequence Number=SeqID_207334
atggggacaaatcaaatcggaaaaagattctatcaagtcaagattaagggcctagatgtcaccagtcttaaggagttagggcagctgatgggtcagctccaacggcaagcttttcacaaagcttacggtaaaatctgggacctagtcatggtagaagtctccatagaggccattgcctccctcgcccagtattatgatcaaccgttgagatgctttacctttggggacttccagctgtcacccatggtggaagaatttgaagagatcctaggatgtcctctagggggaaggagaccatacctcttctcagg

SEQ ID NO: 90557 - DNA, 578 bp, Glycine max
  Peptide Sequence Number=SeqID_207335
atgttgataaactttacgggctctgtgatccaggaaaggagaatttgtgcctctatggacatccgaataaggcttgggaagtaactctgccatcagaggaagttccaccagagctccctgagccaactcttggaatcaattttgctagggatgatgtgagtcgcagggattggatttctttggttgctgtgcatagtgattcgtggttgctttctgtggccttttaccttggaattcgtcttaaccacaatgaaagaaaacgcttatttggtttaatcaacattcttcccaccatttttcaagttgtgaccgacaataaaccaattaaggacaatcctactatggatagtggaagcaaattttggggaagcactgaggtagcagcagttcgaaatgagcatattgaaatattttgtggaagttgtggtggaaattacaacaaagatgaattttggatcggctgtgatatttgtgagtggtggtaccatggaaagtgtattatgatgacccctacaaaggctgagaccctaaagcactataaatgtgcatcatgcagcttaaggagaggcaggttatag

SEQ ID NO: 90558 - DNA, 321 bp, Glycine max
  Peptide Sequence Number=SeqID_207336
atggataacacagaagctgaagagcaatttgcttcagagatgctgaggccgaaactcaaagaattggaggaggctgttcaacctaagatttcccctgtccaagactatgccagttttactcttcaggttctttctggtccttttctgcaacaaaaggatttttttaaatgtggatatgagtgctttgatagaagcaaaaggcaggaagaagtaaacaattgtgtcaataattgcattgatcttcttactaaagcgaaaaaaactttggataatgagatggaaatgtttgagtttgatctgatgatacaaatcaatcattga

SEQ ID NO: 90559 - DNA, 186 bp, Glycine max
  Peptide Sequence Number=SeqID_207337
atggaagatgatactaatccctcacctgaaaacgtacctatggggatctggtgcttatcaacgactctgtgggtctcttcatcaccaccacaaacattcatcgtcttcgtcgaagcaacaacacctccctgcatgactcctggttcgcttaaacatgggctaggatttaggtggttcaggctttag

SEQ ID NO: 90560 - DNA, 498 bp, Glycine max
  Peptide Sequence Number=SeqID_207338
atggcttcagattccaaaaaggatttccctgctgatgacaaagctggaacagaagagagtaaaacatccaaagatgagacttcatctaaagattctccagcagaacaaagagcgacagctacttttggacctagacctggacctgctgggcatccaggcaacccttttgatctctcagcaatgtctggtctgctcaattcttggtggggccctggttttggagcctgtggttggacaatgatggatccaagtatcaaggaattggctgaacagatagcaaaagatccatcgttcaatcagatggctgagcagcttcagaaaacttttcaaggagctccacaagatgctatccctagcttcgataatcaacaatatttttcaaccatgcaacaggttatgcagaatcctaattttatgaccatggctgagcgcctgggtaatgcattgatgcagaatatagacgctgtaacaggatccgtctatgtctgccatgcttga

SEQ ID NO: 90561 - DNA, 363 bp, Glycine max
  Peptide Sequence Number=SeqID_207339
atggcgatgcgcgacctcgtttctggtgccgcggcatgtggcgactcttcttcttcttcctcaaaccctctcgcttccctcgccaacgcccttattggctcttcgtccaaaactcaggagaggctgaaggagattcccacatccactcctactgaccctgcttcccaattttactccacagctctccccgccaatcagcttcccggctccgaattcgataagcctctattgaatttaaactcccagttgttaggattgctagtttttgttagcaggggattccaacccaccacctctctctccttcccttctcccttcaccactcctattgttatgatacttcttaatgaattatccaagtga

SEQ ID NO: 90562 - DNA, 632 bp, Glycine max
  Peptide Sequence Number=SeqID_207340
atgccctcgccttcagaggactacacgcctaacctttcaggggactacatgtcctccatttctgaggactacatgtcctccacatcagaggactacacgttctcccctttggaggactacatgtccttgccttacgagggctacacggcttcaccttttgaggactacacgccctcaccttcagaggattacacaggattacacaacctcgccttccgagggctagacgccctcgccttcagaggagtacacatcctccccttgagagggctacacgccctcgccttcgtagggttacacacccttaccttcaaaggagtacacatactcaacttcagaggactatacatcgtcgccatcagagggctaaacgtcctcgcctttagagggctacacgtcctccccttcagaggacaacatgacctcccctttagaggactgcacgccctcgccttaacaggactgcatgttctcaccttccgaggactactctacctcgccttccgagggctatacgcccttgccttcagaggagtacacatcctccccttgagagggctacacgccctcgccttcgtaggaggactatacgtcgtcgccatcagagggctacacgtcctcgccttcacagg

SEQ ID NO: 90563 - DNA, 497 bp, Glycine max
  Peptide Sequence Number=SeqID_207341
cgtcagccgctgcaccggctgctgatgcagtgctggcagccgcggctggccttagcgcagggcgtagcgctggaaggcatttcgctctatccggtggtggagtatccggcgtgggccgacgatcggcgctcgcctggcgcgctgtttggtctgggcgatcccaatggcaatcgcaccctgcacgaagcgctggcgctggagttacgcatgacggatcggctggatggcgcacgtccgtcagccaggtcatggtgaaaaggaacactacgccgatcaggcaggcagaaagcagtccaatgatggcgatcagtttgtcatcccgggattccatcgacatctccttgcgggcgtccgttgtcggttgcaggcctcagctcatccataacgtaagcatcaggacgaagattataagggtaaccgaggtcactgcaagtaccacaatggcgaagaaagaggcgtttttcagcgggattgccgcacagagtgtaatggaatag

SEQ ID NO: 90564 - DNA, 363 bp, Glycine max
  Peptide Sequence Number=SeqID_207342
atgaagaaaaccgccggcggcacttacgatggcaaacaggcgattggcgtgccgcgctacacctacgtgctgggcgcggagtatgacatcaagccggtggaggggctgacggccacggcgctgctcaaccacagcggctctcagtatgccaactcggccaacaccctcaagctggacagctataccacgctggatcttggtatgcgttaccgcatgaaggtgaatcagaacgatctggtgtggcgcgtggcggtcgaaaacgtcaccaatgagaagtactggtcaaacgttgatgacaccggcacctatctcgcgcagggcgacccgcgcacgctgaaaatcagcatgagctacgatttctaa

SEQ ID NO: 90565 - DNA, 792 bp, Glycine max
  Peptide Sequence Number=SeqID_207343
atggaaaaagcgtcatcttctaatgaggtaaggacactagttttagttggacgtactggcaatggcaaaagtgcaacgggaaatagtgttcttggaaggagagcattcaagtcaaggacaagttcttctggtgtaacaagtgtgtgtgaattgcaaagaactattatgaaagatggatcgattgttaatgttattgacaccccaggactatttgctggaactgattctgctgggaaggaaatagtcaaatgtattgatatggctaaagatggaattcatgccattcttatggtgttctctgttagaactcgcttttctgaagaggaacaagctacttttcttaccttgcaagcattgtttggacaccaaattgttgactacatgattgtggtcttcacaggaggggatgatctagaagctaatgaagagacacttgatgattatttaggttgcgagtgtccacaacctcttaaggatattctgaccctgtgtggcaatcgtaaagtgctttttgataataagactaaggatgaaaaaaaacgattaggacaagttcaagaacttctcaatgttgtgaacatgattatatcacataatggtggacgaccatttacaaatgagttgtttatagaattgaaggagaaagcaacaatacgagataaccaacaaaaaatggttgactccatgggaggatattcaaaagcagaaacgttggggattaaaatgcaaatgcagcaaaaatatgatgatgagctaaaacgaattactaatatgattttactgaaaatttga

SEQ ID NO: 90566 - DNA, 303 bp, Glycine max
  Peptide Sequence Number=SeqID_207344
atgaaggaggaggaatcaacagcaattccgattgaggacgaagacgatccttcatcaacgcttctggatctcacgagctaccagctccacgaccttgacttggtcgagttgccacccagccttactgcgaatcgcttgtccctgctggacccgcacatagggaacctctcccatctcaagaagctttcccattgtgaaaacctagccgtcgctcccctctctttccccaaaacatcgtctcctctctcgagcgatttcgcggaggttctagacgtgtatgagaggggagatgggctctactag

SEQ ID NO: 90567 - DNA, 810 bp, Glycine max
  Peptide Sequence Number=SeqID_207345
atgggtgggaataattgtagaaaagtattaacgagtgatgttgtggatgtaaaaaaggttaggagattggatcatagttccaaagcttgtagtggaaggggagaccttcaatatgatgagtacttatacacctcagggagaacatctagaggatatgagggttcatgtggggtttatgatcttggagaaggaagtgtagaaggtaaatctatcctagaattcttattagctcatgacttcacaatagccaacacttcaccttttggtgttgttttgtctgcttactgtactgaggaaattaattgtgtttctgctggtgctggctattacaatacagaactgcatgtcatagatgggattccacaacttatctttgttcgctcaagttatactattgagactgttgaagcagaacggatatcagttgatcatgttgctcatcttaagccatctgatggtggttcagctgctacacaattggctgctcaccttactggtacacacagtgccatcaaaatgcttcatagcagaataaaggtgctacaccactatcttcttgcaatgcaaaaaggtgatgttccttgtgagaattcactattaagacaagtgtcaagtctcctgagaagattgcctgctattgaatctgggaaatttcaagatgatttcttgatggagtacaatgacaccgtattgattagttacctggcaatgctgaccaactgttcaagctcaatgaatgagctggtggacaaatttaatatcgcgtacgataggcatagcagaaggggtggacgaactgcttttatgtga

SEQ ID NO: 90568 - DNA, 381 bp, Glycine max
  Peptide Sequence Number=SeqID_207346
atggatttcacagtaaaaggatctctcaaaatcgatatgggagtttccaatttttttctcaacattagaaaatatagtttgggaacttcgctttcaacatggctcatgaatagccttatccatgatttcttaggagttgtggtcgtgctaggcttccacacttcttctgttgcggtgggaaaccaaatcaaggtaatactggtgaacagaaaggtagtacaagctaatcaagctgtttgcgatgcaccagatgttggttcatgtgcaggaccactcgtaagactagaatcagcaatgttctatggtacaaagaaattctacaccaattatacgaaaatcacatgtttatgtatgactggttgggtggctgttaaattttaa

SEQ ID NO: 90569 - DNA, 2673 bp, Glycine max
  Peptide Sequence Number=SeqID_207347
atggagattccatcagaaattcttgtcagtttgaagagtttgaagtctctgtttctcgcacacaacaagttttccggcgaaattccgagtgagcttggaggcctttgtgaaactcttgttgaacttgatctctccgagaacaagctttctggttcgttgcctttgagtttcactcagtgttcttctctgcagagtcttaacctcgcgaggaattttctctctgggaacttgcttgtttccgtggtgagcaagcttgggagtctaaagtatctaaacgcagcgtttaataacatgacgggaccggttccgttgtcgtcgcttgttaacttgaaagaacttcgggttcttgacctaagctcgaaccggttcagcggcaatgttccatcgttattttgtccttcggagttggagaagttgatcctcgctggcaattacctttcagggactgtaccgtcgcagctcggtgagtgtaagaacttgaaaactattgatttcagctttaacagtttgaacggttcgataccgtgggaggtgtggtctttgcctaatttaactgatttgattatgtgggctaataaactcaacggagaaatccccgaggggatttgtgttgagggagggaacttggagactttgattttgaacaataatctaatttcggggtccattccgaagtcgattgcgaattgcaccaacatgatatgggtgtcgttggcgagcaaccggttaactgggcagataccggctgggattgggaatttgaacgcattggcgattcttcagctgggcaataactcgttgagtgggagggttccaccggagataggcgagtgcaggagattgatatggttggatttgaatagtaataacctaactggggatatccctttccagcttgctgatcaggccgggtttgttatcccggggagggtttcggggaagcagtttgcgtttgtgaggaatgagggtgggactagttgcaggggtgctggtgggttggttgagtttgaggatattaggacagagaggcttgaaggttttcccatggtgcattcctgcccgttgacgcggatttactccggtaggaccgtgtatacttttgcttccaatgggagcatgatctaccttgacctttcctacaacttgttgtctgggagcattcctgagaatttgggtgagatggcctatttgcaggtgttgaatttggggcacaataggttgagtgggaacattccagataggtttggtggtttgaaagcaataggggtgcttgatctgtctcataatagtcttaatgggtccatccctggggcgttggagggtctttcttttctcagtgaccttgatgtgtctaataataatctcaatgggtccattccttctggtggtcagttaactacttttccagcttccagatatgagaacaactctggcctttgtggggtgcctttgccggcgtgtggggcttcaaagaatcactcggttgctgttggggattggaagaagcagcagcctgttgtagctggggtcgtcattggtttgctttgcttcctcgtgtttgcacttgggcttgtgttggctttgtaccgagtgaggaaggcgcagaggaaggaggagatgagggaaaagtatatagagagtcttccaacttctgggagcagtagttggaagctttccagctttcctgagcctttgagtatcaatgttgccacctttgagaagcctctgcggaagctgacttttgcgcatcttcttgaggctactaacggtttcagtgctgagagtttgataggttctggggggtttggtgaggtgtacaaagctaagctgaaagatggttgtgttgttgctatcaagaagctcattcatgtgacgggtcagggagatagggagttcatggctgagatggaaacaattgggaagattaagcataggaacctggttcagctgctgggttactgtaaaattggagaggagaggctgcttgtgtatgagtacatgaaatggggaagtcttgaggctgttttacatgagagggcaaaagcaggagtttcaaagcttgattgggcagcaaggaagaagattgccatagggtcagcaagaggtcttgcatttcttcaccatagttgcattcctcacattatacaccgggacatgaagtccagcaatattcttcttgatgaaaattttgaggccagagtttctgattttggcatggcgagattggttaatgcccttgacactcatctcacagtcagcacgcttgccggaacaccgggctatgtacccccagagtactaccagagttttagatgtacagcaaaaggggatgtctatagctatggtgtcatattgctagagcttctatcaggaaagagaccaattgactcttctgagtttggtgatgacagcaatcttgttggatggtctaagaagctttacaaagagaaacgaattaacgaaataattgatcctgatttaattgtgcagacatctagtgaaagtgaactattacaatatttgagaattgcttttgaatgtctggatgagagaccataccggcggccaactatgatacaagtgatggctatgtttaaagagcttcaggttgacacagataatgatatgcttgatagcttctctctcagagacaatgttattgatgaagcttga

SEQ ID NO: 90570 - DNA, 1040 bp, Glycine max
  Peptide Sequence Number=SeqID_207348
cctcactcctacacctactccatttgtcccaagacgctcttctcaacctatcaaacccaatgttctccctgcagactatatctgtagcatcaagacacaaccaaatcaatcatcatcaacatgcttgtatcccctccagtctgttttgtcttattctaacatctctgagtttaagcgtcactatataatgaatttatcttctggggttgaacctcgaagttatcagaaagcgagtttgagtccttgttcggttgaagccatgaaagatgaaattgaggctttaaaactcaacaacaccagggaaattgttgatactctagctggtgttaaacccataggatgcaaatgtttctacaaaattaagagaaaatcaaatggaagtgtggaacggtacaaagcacgattggttgcaaagggtttctctttagtggaaggaattgatttctttgaaacattctctcccgtggtaaaaatggccactatctatttcatcctcgctcttgcttttgcaaataaatgtcagcttcaacaactcgatgtgagtaatgctttcctccacggtgacttgtctgaagaggtttatatgacaattcctcaaggattgcaagaccatggctcttctcagagttgtaaactaaaaaaatctctatatggcctcaagcaagctagccttaaggatttaggagcattgaaatactttctgggtttagaaataaatcactctgctgatggcatatatgtatcacaatgtaaatactgtcttgagttgcttgctgattttggaatgatgggttgcaaaccttgttcaacacctatggacagttcattgcgactgcatcaagatgactctagtgatcttcttgatgatcctttatcctataggcatcttgttggtcgtctagtttacctcaccacaacccgtcctaacattggttctccaagcaaaggtcttcaattcaagagggacactcctatacatttaattggcttcagcgatgctgattgggcgacttatgttgacacccgcagatcaatcacag

SEQ ID NO: 90571 - DNA, 459 bp, Glycine max
  Peptide Sequence Number=SeqID_207349
atggctgggattgatgataatgttgcccttactggtgattggggtcttgctagcccaagtccaaggacctttttttccagaatgttagaagaagatagtgtgacaagatcaatctcagaacattctggaagtggtagaactggggatcccttttcgggacatcgcgagcctagtgagatgaggaaagaaaacatgaaagatagggcacaggatggtgattctggagcccaattgactgacgtgagttttcagaccgagcagaagccgagctctcggggtggtcttgttgaaagaatggctgctagagctgggtttaatgctccgaggttgaatacagaaagcattagatctactgacctttcacttaattccgacattcagtctccttacttgaccatcccacctggtctcagtcctactacacttttagattctccagtgttccttgcaaattcactg

SEQ ID NO: 90572 - DNA, 863 bp, Glycine max
  Peptide Sequence Number=SeqID_207350
atggttaatggcaacatgcggcactcagaattatcatctgatgctccagaaaaatgtaaacacaatggctttgatgatatctacacatcatcctttgctttcaagcctgcaacagattcaggctcctctttttatcatggtgctggaagaaaaataaatccaactacacttcctcaacaatcccttcctggtgttgaggtttcggctcagtctgaaaattcttttcaatgtcaaagtgttgatgctgtcaaagctcaaactgagaacaaaagtggccttcatcttcaggaagactttgttgaatcgcctcctcaaaaagataatggaattaaaatgttctcagccaatcaaagggcttttcatgctgttggcagtggcattgaacattctacaccagttgaagagcaagcagatgaagaaggagatcaaagagtcaatggagattcaatggctggtggtgttggtgcaccatctgaagatggatataactggagaaaatatggccaaaagcaagtgaagggcagcgagtacccacggagttactacaagtgtactcatccgaactgtcaggttaagaagaaagtagaacgatctcatgagggccacataactgagatcatctacaagggaacgcacgaccatgcaaaacctcctccaaatcgccggtcaagtataggttcggttaaccttcatactgacatgcaagtggacaaccctgaacacgttgaaccacacaatggtggtgatggtgacttgggctgggctaatgtacaaaagggaaatatagctggagctgctaattggaagcatgaaaacattgaagccacatcatcagcatctgttggccctgaatactgcaacca

SEQ ID NO: 90573 - DNA, 138 bp, Glycine max
  Peptide Sequence Number=SeqID_207351
atggctgtgcctgaaattagacagattcatagctcaataggaggcggaacaatgtcaacagaaccaggcataaaaagtgcctcattgcatggcatgcagagcagcaagaatctaagtggtttacagtttccaagatag

SEQ ID NO: 90574 - DNA, 285 bp, Glycine max
  Peptide Sequence Number=SeqID_207352
atgaagaataagaaggttgttgtggctggtgtctcactaagcgagacttgtgcgcttagtgagaatcatccgctaagcgaggcactcaacctgcttagcaagttgggagaatctggaggagaatctgtcaagcatctgcgtgctcagcgcggagaaaatgacgctaagcgagccttcgaggatagaaagcccttgaaagctgaagttggcaaaaaaatagggagatgcttgagagcctatgcaatagagagacgtaacagggcaagggagcatcgaaaaccttag

SEQ ID NO: 90575 - DNA, 414 bp, Glycine max
  Peptide Sequence Number=SeqID_207353
atgaagaagatcctaggcctacaagctctaatggagcttacatcactattgatgttgctttgctctaaggatccttccccaaagcaagccagagctagaggccacttggtgaagatagacaccaacatcctcaacacatttctagagactcttgtagtcatagaggagggggagacgttacccacctactctaggtattgcaggttaccatcagaccacagagagattgaggctgctttttgcataccagggagggggttcattttgaatgctgagggccatccgggaagtattctcaggaaggatttgactacattggcccaggtgtggagtgttctctcttgctccaacctggcccctacatctcatacatcagatcttactatggacagagccaggttgatctttggcctg

SEQ ID NO: 90576 - DNA, 327 bp, Glycine max
  Peptide Sequence Number=SeqID_207354
atgtcggccttcaccttctcttgcacctcctctgctttacccattactctagctctagcacaggttcgccgaagcaatgatgtaacacaatccatcttttgccccaacttttgcaagatggttacttccatacttcaacttgactcgatgaaccttttcgtaaaagcacgagcttggttcaaccccataacccagggaatggcaattttgatcgccaatacttcatcaacatttcataaggatgaaagactcgggaatacgcatgctatgcatggaaaatgtaattctgagatggagatgcccgaagaaacatcctttcttagttaa

SEQ ID NO: 90577 - DNA, 830 bp, Glycine max
  Peptide Sequence Number=SeqID_207355
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgcccacgttgtggcccttgctgccaagcagcaggtaaaactgctcattttcccagagctttcgctgaccggttatgagccagagcttgctcgtaagcttggcatcacgcttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 90578 - DNA, 1068 bp, Glycine max
  Peptide Sequence Number=SeqID_207356
atgctgtcaactactgccgctgctcagcttccaagttgctggtacctcattcccagccatcttaacgtccatcatcatgctcaacaaaagagaaaactcaccactctatcacttgccaatgcagatagccgaattcccctcagaaacttctatggcctaagtcttcctcaaacccataattgcagcaaagggaaagaaagcaataacagggctagatacaattccaatttaaatcagaaccacagacatttattatttctacagttcttccctgacagtgacacagaagacagcaataatcaaaatccaagaaccagaaaccactgtcaacatcaagtagatgaacaaagagaattcaaggaaaataaagaggccaggttgcttttctcaaacatgtggtgggtagatgtgaaagcagcacttggccaaagaataaatttggagggcattctatgttcaactatggtgatcttaaaagacccgaaattggcaatgccccatatttctgttcctgatataaggtatgttgattgggctgagctgcgtagaaagggatttaagggtgttgtctttgacaaggataatactattacagcaccttactctttgaagtcctggcctccacttgagtcttcattggagtgttgtaaatcggagtttggtcatgatattgcagtatttagtaactctgcgggacttcatgaatatgaccatgacggttcaaaagctaggatgcttgaaggggcaattggaattaaagtcataagacatagggtgaagaagccagccggtacagctgaagaaattgaaaagcattttggttgtgaagcttcacaattaatcatggttggtgatcggccattcactgacattgtttatggcaatcggaatggatttctaactattttgacagagccattgagtcttgctgaggagccgtttattgttaagcaggtgaggaagctagaaacttcatttgtaagtttctggtctagaagagggttggatccacttagccagaagttattgtcagatccaaagccatgtgtcaaagagccatatcattga

SEQ ID NO: 90579 - DNA, 210 bp, Glycine max
  Peptide Sequence Number=SeqID_207357
atgaccatttatggaagaggagtattagtcttgatgcctggagagcagattccttcattcattgcacttcctgctcctgcaccatgttgccgtgagcccatgtcatggcctattcaagaattaaggtcatatcatttagcagtgtgtaaaattgaagcctctagtgagactatcactgatgagcattcaaggatcataaaagtagcctaa

SEQ ID NO: 90580 - DNA, 519 bp, Glycine max
  Peptide Sequence Number=SeqID_207358
atggaaaaatgtggtcatcgccaagctcttgggaaggaagattggttacaaagtttaagagacacgattgaatcagttgtggggaggaccattgaaaaagtgccttggcttatctatgatcattaccttacacttagggaatggtctccagatcttcactcgactaatgaggccattgaagaagtggcagtgcgggtaagattctctaagcttccgattgaatactatgatgccaaacttcttcaagtgataggagataggattggtaggcctatgcatgttgacagaaacactttaactcaagaaagggggaaacatgctagactttgtgttgaagtggatcttactaaaccactgctagctttgtttgagataaacaatagatgttacaagattgagtatgaacggctccattttttatgtcttacccgttgtcgttttggccattatatggaaggttgcctggataaagttgttaacacttggtatggtaaaggaacaaggaggtgggggtcctaa

SEQ ID NO: 90581 - DNA, 267 bp, Glycine max
  Peptide Sequence Number=SeqID_207359
atgcaagaaaagactagctctataaagtgctttaaatgtcttcgaagaggacacattacttctcaatgcctcaccaagaaagtcatgattatgaggggccaagacatttataatagccaagatgaagctactacttcaccttcctctagtgaaagtgaagaagcaaaaggggaagaatctagtgaagaagtctatcaccaagaagaaggacaacctttaatgggtgagaaggagtgtaaggagatttacacacttcaacaacaatga

SEQ ID NO: 90582 - DNA, 186 bp, Glycine max
  Peptide Sequence Number=SeqID_207360
atgcctagaagtttccagtttgtgagaattagaacagcggatggatcaactccaacgtcaagctttccacaagacatatggaaagagctgggatctggctatgataaagtctctgttgaagccattgcatccctcactcagtattacgatcagtcgctaaggtgcttcatgtttggggacttttag

SEQ ID NO: 90583 - DNA, 296 bp, Glycine max
  Peptide Sequence Number=SeqID_207361
atggccaaggagggtgtggatgaccatgatttgtctccgcgtgccatcggacttgattgtctctggatggtgaaggtgcggatgatggcaaaggaggctgcgaatgaccatgatttgtctccacgtgccatcagacttgattgtctctgtatggcgaaaaggctcaaaaagggtgcggatgaccataatttgtctccgcgtgccatcggacttgattgtctcgggatagcaaaaagggtgcggatgactatttggcttctgacaagtgcaccggatcgcacaagtagtataaaacg

SEQ ID NO: 90584 - DNA, 1203 bp, Glycine max
  Peptide Sequence Number=SeqID_207362
atgaatctatggcaagaaaaggggcagagggttggtaaacgagacatttctgatcattgccccatatggttggaatgttctaatcttaattggggtcctaagccttttcgttttaataactgttggcttgaacatgatgatttcaagtcttttattgttgaggagtggaagaagattcagattactggaagaaaggcatatgtcataaaggagaagctgaaaattattagagagagtttgaaaaagtggaataaggaggtgtttgggtggctagaccttaatatagaaaatatagtggctgagatgaataagttggatagaggcatagaggaggggtgtaatcttaatgaggtggtgaagaagaaagaagcaaaggcattattttggcaacaactaatgatgaaggagagcttgttgaaacagaaatctaggttgcgttggattaaagaaggagattataacacaaaattctttcattcttgtcttcaagataggaggagaaagaatcaaattttatccttacaagtggaggggcgttgtgtggaacaggttggggaagtgaagatggaagtgcgtcgattttttgaggaaggattcaaggaagcttctttttctagaccggtgttgggggggatagagtttcagactttggggtcggaagaaaattctttcttagtggcaccattttcagaggaggagataaaggatgtagtgtggagttgtgatggtaataaatgccctggtccggatggtttcaacttgcgctttataaaaaaatgttgggagtttgtcaaggatgatattgttgaatttttacaagaatttcagatcacaggaagacaaattttagatggtgtcttgatgattaatgaggcagttgatcttgccaaacgtagaaaggatgaatgtttgttgtttaaggtagactttgagaaggcatatgactcggtttcctggagttttttgacttacatgttgaacagaatgggttttgataagaggtggattgggtggatacaggcgtgtgttttttctagttctatgtcagtcttggttaatgggagccccacggatgaattcacagctcataaaggtttaagacaaggagatccactatctccatttttatttctcattgtggcacagggactttctggtttggtacaaaaggcaattcaggttggaaattttgatggttatcag

SEQ ID NO: 90585 - DNA, 294 bp, Glycine max
  Peptide Sequence Number=SeqID_207363
atgggggcagcttggctaatgttgcagagaattatgcttttgcataatcggcttagcgagaggctgcctgctaagcctaacaatttccgcaacaaatgtgtgctaagctcagtatggttacatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 90586 - DNA, 405 bp, Glycine max
  Peptide Sequence Number=SeqID_207364
gagtttgagcctttaatacaaaagcctttttctattgtctacttccactctgctgcatctttgcagatgcagccagacctgggttggatgagaagattgcaacaaatacttggtcggaagcaccagcgcaacctgcatgcaatatatgtccttcacccaactttcggactaaaagcagcagtatttggacttcagatgtttgtggacagtgtggtttggaagaaagtggtatatgctgatcgacttctgcagctcttcagatacatacctcgtgaacagttgaccatcccagattttgtgtttcagttgagtctttatgttttcacacggcatgacttggaagtgaatggagggacgggtctcattgtggatcccagaacaaaatatgtgtacaacagaccatga

SEQ ID NO: 90587 - DNA, 228 bp, Glycine max
  Peptide Sequence Number=SeqID_207365
atgtcgcaacctacccttcggagggggtgtgaaaaggccaaaatagatgggccaaagcgttttgtctccaaggccaccaacatttatttgagcaaaacgttagaaaaaaccaaaaaggggtttacgagttttgaaaatgagggttcaggagttgtttacgcatggggaaggggactgccattgcttctacgtatcctcaggtgcgatgaagaattcaaacctacatag

SEQ ID NO: 90588 - DNA, 1359 bp, Glycine max
  Peptide Sequence Number=SeqID_207366
atgatctcagcttattttatcgtatccctgctgaatgcagctagtatattaaagtatgatttctgtttcaagttagcaattgtttacaaatgcctgaagggtggaacagtgcggcgatttcttgagaagcagaaaaacaacataatagctgttgtcttttgcactgtgagcacaactgatactgagatatataaaaggttgcttcctctgtactttcctcgggataaacatgaggagcaagttgctttgtctaaacttcctgcagatgttggggatgaaaatggtgagacaatctcagatgagcgtaaaatcagaataaagcctttgcccaaaaggatagtttcaagaccacctgaatttccagctgatcatcctgttagtgatgtcggcttggttagcaggaattcatcacatttagattcatttctggatcctgccttcatgtccatgatcaaagaccccgatcaacggcggatggagcagtgggagaaaactgctgaagcacaaagaggctggaattgtgctaaattgattggatatggcgaccttggtggaccctcattgtctgctgccgaagaatattctctacactctagatacctgtctaaagcaaattccttaaatctttctgaaattgcagaaatgaaaattgttataaatactgctcttgtaagagattacagtgcctttgtaatattttctcaatgcaatatacaaatctcttttctcttctctatactttctacatggtatctagagctctctgatccattttcatggcttccgcaaatactgatgcaactttggttaacaccggcgacactggtgcgatctgactccagcaaacaacaccggtgcgactctgtctctagcgaacaactccggtttgactccactcaacactgttctgatgaatcaagatatttccactttgtcgttccctatgaattttatttttttttgcatcaaatcacaaaaaagttaaatgataagaacttcttgctgtggcgacagcaaatcaagtcagcgatcactatgcgtggactcaatcgcttcgttgtgaatcctcaaatccctccgcaatatgtctttgatgaagattgcgatcttgatcgcgttaatcctctcttctcgatgtgtcaacgctctcgagctcgatgcttgctcgtgttcttggatagacagcttattgatgcacttgcttcggttggtgatgctgctacctatcgtgaacacatggatgcaattcttgaaggtctacctaggaattttgactcaacgattgctctaattgagagtcgtctaccacacatcaccattgaagaagcggaaggttacattcttgtgcaggaactatga

SEQ ID NO: 90589 - DNA, 234 bp, Glycine max
  Peptide Sequence Number=SeqID_207367
atgtcacttcaactgattcactctgagatgcagcttgccgccagccttgatcacatatttccttttccccttcgcaattgcagtcagcaccatcacaaggtcacagagacagagaaagatggattaaagagacacgggagagataaggcaaagagcgagaagagcctgaagtgtgtgactagaaacattggttcaattttgagtgggaaaattttggtgatgtgctctaggtaa

SEQ ID NO: 90590 - DNA, 534 bp, Glycine max
  Peptide Sequence Number=SeqID_207368
atgggaggcaatgttgaaaatgttgattttcataactttgaatatgagtcatctagtgataatgaggaagaatcatgtggtgttgatgataagtcatttgggattgattttgacttcataccaactgttgaaaatcaaatgcatggcattgatgagggttacaataataaggaattgtttagcaacattgatgatgatgaagaagaacattcaaatggaaagcaaaatttaggtattaccaagtcaagaaacattgtaaggagattgataatggatttaattgaaggagatgccaccaaacagtacaccctattatggaggtatgatgttgagttaactaagagatacagaggaaatacatgcaagttgcaattagaaaggccttcacttgcccttcaaccaagatttggatcgttctacctttgcttggatggatgtaaaaaaggttttgttgttggatgtagaccctttataggtttagatggttgccacattaagacaaaatatggagggtcaattattggttgttattaa

SEQ ID NO: 90591 - DNA, 147 bp, Glycine max
  Peptide Sequence Number=SeqID_207369
atgaggaaagatcgatgctggttcacactaggtgttgatcaacaatcgcacatgttgggacgttcccctatggtaatgggtgttgatggcacgctcgctcacagaggggccttgttgtggtggtggcatgtgcgagcagtggtttag

SEQ ID NO: 90592 - DNA, 192 bp, Glycine max
  Peptide Sequence Number=SeqID_207370
atggcggtttccaaactcaggaatgatgcaaaggaaggaggaagagaagaaatggcgtttttccaaagctacacggtctacaaggctcaaaacgcacaagtgattaatgctctcgggaaaagaaacgtcgcacacactccagatgtcttctcaaagatcccaacgataaatttgtggacagttgttctgtga

SEQ ID NO: 90593 - DNA, 291 bp, Glycine max
  Peptide Sequence Number=SeqID_207371
atggatggatgtgatgcatcaatattgctggactcaacacccaaaaacctggcagagaaagatggccctcctaatctctctgttcatgcattctatgttattgatgaagccaaggccaagcttgagaaagcttgcccacacactgtttcctgtgctgatataatagccattgcggctagggatgtggtagcattggtaataactcaattaagccttcaagctattttagaactgttaaattcttgcatggcacttataggaggcaattgttattctagtaccgtgtcttga

SEQ ID NO: 90594 - DNA, 2664 bp, Glycine max
  Peptide Sequence Number=SeqID_207372
atggtgtctcatgaatattatgtctttgaacatgagagggttgggagacaattcaaagagaaggaggttggccaaaatcatcaattcaggggattatgggtggttaagtctaatttttctggtcatggcttcataggtgtttgtgttgagtttaagtcgaaattattcttcttcgttaatgtttatgctccatgtaatactgctggtagaagattattgtgggagactttatataatctcaaatatggtagctctgcgggagagtggtgtctggtgggggatttcaatgcggtatctaatagggaggaaaggacgggcagaagcgaaaattgggggtatattgatatggtggattttaatgcttttgtgaatgaaatgaatcttattgatcctcctttgcatgggaataaatttacttatttctgctctgatggtattgctgctagtagactggacaggtttcttgtttcggatggcatcatgaatctatggcaatcttttattgttgaggagtggaagaagattcagattactggaagaaaggcatatgtcataaaggagaagctaaaaattattagagagagtttgaaaaagtggaataaggaggtgtttgggtggctagaccttaatatagaaaatatagtggctgagatgaatgagttggacagaggcatagaggaggggtgtaatcttaatgtggtggtgaagaagaaagaagcaaatgcattattttggcaacaactaatgatgaaggagagcttgttgaaacagaaatctaggttgcgttgggttaaagaaggagattctaacacaaaattctttcattcttgtcttcaagataggaggagaaagaatcaaattttatccttacaagtggaggggcgttgtgtggaacaggttggggaagtgaagatggaagtgcgtcgattttttgaggaaggattcaaggaagcttctttttctagaccagtgttgggggggatagagtttcagactttggggtcgaaagaaaattctttcttagtggcaccattttcagaggaggagataaaggatgtagtgtggagttgtgatggtaataaatgccctggtccggatggtttcaacttgcgctttataaaaaaatgttgggagtttgtcaaggatgatattgttgaatttttacaagaatttcagatcacaggtgtgcttcctaaagctattacggcttccttcttggctttgattccaaaggtgttggcgtctagattaaagaaggtaatagctaaacttatatctccttgtcagtcagctttcatttcaggaagacaaattttagatggtgtcttgatgattaatgaggtagttgatcttgccaaacgtagaaaggatgaatgttcgttgtttaaggtagactttgagaaggcatatgactcggtttcctggagttttttgacttacatgttgaacagaatgggttttgataagagatggattgggtggatacaggcgtgtgttttttctagctctatgtcagtcttggttaatgggagccccacggatgaattcacagctcataaaggtttaagacaaggagatccactatctccatttttatttctcattgtggcacagggactttctggtttggtacaaaaggcaattcaggttggaaattttgatggttatcaggtggcagatggtttgaacttgtctctattacaatttgctgatgacacaattttattgggtaaggggtcttggaagaatttgtggagcattaaaactattttcagaagctttgagttagtatctggtcttcgggtcaatttccacaaaagtaagttgattggtttgagtatcaatgaagggtttctagagtcagcatcaatctttctctcttgttgtatgactttaataccttttaagttcttgggtgttccggttggtgccaacccgtggcgaagatcgacttggaaaccggtggtggattctatgagggctaaattgtcttgttggaggggacgtaatctatccatcgaaggaaaggtaacacttattaattcggttctctcgagtttacctctatatcttttctccgttttcaaagctcctaaagtggttattaaggaactaacacaaattcaaagagattttttgtggggatcacatgaggaggaaaggaagatttgttgggtgtcatgggaagacatttgcaaaccgaagaaagagggagggttgggtgtgaagaatttagagattttcaacatatctttgcttgctaaatggaagtggaggtgtattcatgatcataatgcactttggagggatttgctagcttttagatatggtaatttaatagcaaagcaaacttgtagtcttgatcgatcatggggcacaaaagattcaatatggtggcaggatttgatgttgttggagaaagatttgtcacaaaaccagaatttttttcaaagagcagtgagttgtgatgtaggagatggacaatcaattctattttggtataataaatggttagggtccgagccgttgaaggatgcttttccggagctgtttgcaatttcatctcagcagtcggtgtctataggaaacgcaggttcatggaggagagaccaatggacgtggggcttgacttggaagagacagttaaatccgaatgaggaataa

SEQ ID NO: 90595 - DNA, 240 bp, Glycine max
  Peptide Sequence Number=SeqID_207373
atgcaccacctccttaaagaacaagtcagcaatatgacaagcaacatcatatttattacatggtgttgtgacctacccttcggtgggagggcgacgcgaggctcacggcttctcgctaagccaatctgccagcttagcgagccatccgctgagcgcaccactcctatggctgagcatgaggaagaatctggaagaaggatgagctggacacatgcgctaagcgatggcttatcccgctaa

SEQ ID NO: 90596 - DNA, 546 bp, Glycine max
  Peptide Sequence Number=SeqID_207374
atgtatggattcaatccattaactcctcttgacttgttgtcattgcctaacacttttgtcttaaagcataaagatggcaaatctagggctgaatatgtaaggaagttacatgaacaagtgaaagctcaaattgagaacaaaatagaaagttatgttaaacattctaacaaaggcagaaaaaaggttgtatttgaacccagtgattgggtttgggtgcatatgagaaaagaaaggtttccttcacaaaggaaatccaagcttcaaccacgagaagatggtattttccaagtgctgtccaaaatcaatgataatgcttacaagatagatctaccatgtgagcatggtgttaccaatactgttaatgtatctgacttgtctccttttgatgtaggtgatgaggatttcaattcgaggtcgaattcactcaaagaagaaggggatgacgagaatcaaacaaggaacgaggacattgaagcaatacaaggacttggtagaccaatgacaagggcgcattcttataaagcaaaggaaatcttgaaccaaatg

SEQ ID NO: 90597 - DNA, 300 bp, Glycine max
  Peptide Sequence Number=SeqID_207375
atgtctcatggactttattctcctttgcctattccagagtttccctggattgacttgtctttggactttgttgtaggatttcctcagacaaggaatgacaaggattccatctttgtggtggtggacagggggtgcccttcagcattgggcccatctaggcccatcaagaagcttcaacatgaagcaaccaacttgcctgagcgagctgagcttgcttgggtgagcatgttgcttctggaggaagcctccagcaagcctgggagagctgggcagcaacgtcctcccctattttttctataa

SEQ ID NO: 90598 - DNA, 327 bp, Glycine max
  Peptide Sequence Number=SeqID_207376
atgaacttagtttcaggagtagagaacaaagcataccttcttaagagtgcatccactaccacattagacttacctttcttgtgcttgatcacatataggaagatgtttttattatttatggacgagattcaagatccacccttggttattcttcgattatactcaatttgctcattcatcaatggtcaaatgtatcaagatgttgccacgagagatggtcaacaaacaagaggcatactcgtcacatatgtatctcaagaggaggtttcatcttcacgtgaaggacttcaaatctatgagtactttcgagtctttggtctagcttga

SEQ ID NO: 90599 - DNA, 312 bp, Glycine max
  Peptide Sequence Number=SeqID_207377
atgggttctccacctgcctccactcctcctcttcctcctcctcctcctcctccttcggacgtaacgacttcgccatctgccgtgaagcggacatgcaaagcctcacgtctacaatcgttgtccactagaacacctggtgctgagagaccagtggtgcatgttgatcctgctaccgggaaggccgacggtccgcacaggaagaaattaagaacatatttggggattgtggcgcgtgataaggtggacatcacctacgagaactggaacgaggtccctactgctcagaaggacctgatttgggaggatattcag

SEQ ID NO: 90600 - DNA, 435 bp, Glycine max
  Peptide Sequence Number=SeqID_207378
atgggctcaaaaatctatcctaaggttcatgagaaccctagggccttctttagtagctctagtccaaacttcttggagtcttctatccaatacccttggggggtaggattgcatcactttgcggtgccgtttttccacgtgtacgggttcacgttcagcctaggggcaatagtgctgtcggagatggtggtggtcatggagagttttagcttgaaggcaatgttgggtgccatggagaggaaggaaaccaaaaaggctttcaaagctatgttgcccaacatcctcgtcatccagcttggtgtggatggagttgttcttactaatgagctttctaatatattgtgctgcaagcataagatccacatgtgtttgctgggacgttttctagcagattccttccttggcagatacaagacaattggaatctttgcttga

SEQ ID NO: 90601 - DNA, 228 bp, Glycine max
  Peptide Sequence Number=SeqID_207379
atgaagaatttgatgcagaattcaaagcgcgatgtctaccttggagcctacctgaatgagccaaacaactaccttaaaggaataattaacagtgctttgaaaggacttgatgatactccacaacctaaatccaaggctggtgctaggtggattgttgttaagaccattggaagcagagagattgaaggtgcttcgcatccaatgggcacagtattatctcaaagttag

SEQ ID NO: 90602 - DNA, 1185 bp, Glycine max
  Peptide Sequence Number=SeqID_207380
atggctcattatacacatcattttatcctactctttctagccaccatcagttttttttcatttactttttctaaagatgctccctctatcaatgtgcttagctttggggctaaacccaacggcaacttcgactctaccacatcctttgttaaggcatggtcttcggcatgcaaatcaaaagaaccagccacgttttacgtaccaaaaggattttttttgttaaaacaagtgatatttgagggtccttgctcgagcaatatcaaatttcgaattgctggcactattgttgccccttcagattatagttcccttggtaataaatctggattttggatcatgttcaggaatcttaatggattttcagtacaaggtgggacttttgatggaaagggtgatagctattggcgttgtagaaaatctggatcgagttgtcctgctggagcaaggtccataactttcagttcgtgcaacgatgtgaaggttagaggattaacatcattaaatagccagtcaatgcacattgcagtggagcaatgcaaaaacattttgtttaaagatgtgaatatcaaagctcctagtacgagcccgaatacagatggaatcgatgtgacactttcaacgggggttactgtaatcgatgccaccatacgcaccggtgatgattgcatagccttaatccaaggtagcaccaatgtgtggatcgagcgcgtcacttgtggccccggacatggcattagcattgggagcttgggcacctctgaggatgaggctggagtacaaaacgtgacagtgatcaattcaatcttcgacggaacacaaaatggggttaggataaaatcgtgggcaaaaccaagcaatggatacgcaagtgacattgtgttcaggaacctcaccatgctaaatgcctacaaccctatcattattgatcaaaaatattgccccggtgacaagaattgtcctcagcagaattctggggtgaagataagcaaagtatcatatgaacatataagaggaacttcagcatgcccacaagcaataaatttcgattgcagcaaaagcaacccatgtgagggcatcaaactgcaagacatagacctcgtttatgacaatggatcatcaacatcaacttgtaagaatgctgatgggattacccgcggagaagtcatcccaaagagttgtctttga

SEQ ID NO: 90603 - DNA, 306 bp, Glycine max
  Peptide Sequence Number=SeqID_207381
atgaagaataagaaggttgcaatggctggtgtctcgctaagcgaggcatatgcacttagagagcaacatccgctaagcgaggcatcaactcgcttagcgagtgagaagaatctggaagagaatctgccatgcatgcatgcgcttagcgcgtcatcagctcgctcagcaaatcgtttgtcttctcacgcgctaagcatgcccagctcgcttagtggaatttcactaactcgcgctcaacatgaaaatggtgctaagcgagccttcgaggacagaaagcccttaaaagctgaagttggtgaaaaatag

SEQ ID NO: 90604 - DNA, 801 bp, Glycine max
  Peptide Sequence Number=SeqID_207382
atgactgaatcaacgaaaaagagaaagggttcttcttccaccaccaccgctgctggccatcgccgccacggaccatctgaagcacccacagcaccggttcctccttctgtgtcatccccacgatcatctaccttattttcttcagatgatcaatgtctaaggatgggcactattgttgatgactggaagttcgattactcgagtcatgatgctcgccgtatggtctgtaatgaccaggctgatataactggcaaattgcttgttgggtcattaacctttgactgtcgcatcatacactacatcattgttcgcaatttgttaccccgttcgtctaatcttgctcaagtctctgaggaggacttgattctcatgtgggcttttcttaccaatcgtcaaatcgactgggcacacttggttaggtactgtatgcataaggcattacagaccaatgcatctctttcgtattctcatcttgtcaccttttttcttcttcgtcatttccaaattcctttggatgatgaaccctttgttcaatggattcataaaaaagactttcttctgcctattcctgacgaacgtaccccatctcctccaccacaaagggttgattcctcttctcttctgactgaagtcctcacagaacttcgtgggggagagaacttaagggtagagtttatcatgaacttaggcataaatttaaggggagtaagggttgtgagcatgcattatcaattgcctatcgtttatcttgatttcagattattatcatcatcaaaagggggagagatagataacagataa

SEQ ID NO: 90605 - DNA, 132 bp, Glycine max
  Peptide Sequence Number=SeqID_207383
atggagtcaggagcagtttttattaacgtgagaatatcgaacttgatgagcaagtggagaacgttgatgatcaaaagcttgcatcaatatactacagcgcttcaggaggagcaggacaagttcttcttctaa

SEQ ID NO: 90606 - DNA, 519 bp, Glycine max
  Peptide Sequence Number=SeqID_207384
atgaagaagaagaagaaggttagaaagctaattctcaagaatttgatgattaaaatgcagataaagacagagcttgtagttattcagagccctgtggctactgaaccttttcaagatgacctcaatgttgaggacaatacaaatgtctcaatcaaactaaggattgttgaatccaatttggaaaaagaatgcataaaaaaggaacaagaatctcctatgaagactggagaagatgctactgatactgagaaaacactaatggccaaagctggagagaagatccctttggggtctgtgaaagatttcgtgtttaacacagaaaacatgcaaaatctcttcaactttccaatttttgacacctttgttaaagatgcatgtgaacttcttaaggtttttgaaaatattccctattctcatatccctactcctccacctatatcaacaagtcttcctaagtctttggaaagtagactcacttctatggagaaacaagtcaggaaatatcgatctaactgttaa

SEQ ID NO: 90607 - DNA, 1383 bp, Glycine max
  Peptide Sequence Number=SeqID_207385
atggcacaaaatgattcttctcaggtgaaagccatagcagccattgtggaagcatatggatggcgagaagttgtccttatatacgaaaacactgaatacggaaacggtcttgtcccacatctgatagatgcattggatgcagtggacacaaaagtaccttacagaagcgtcattgaccccatttttgaagagtcccacattttggaagagctcgaaaatctcaaggaaaattcgacaagaatattcattgttcacatgacgggtgaacatgggtcgagattcttttcagctgtagagaaagctggaatgatgagtgaagggtatggatggatagtcactgaagggttatctgttgagttagatccttcagctctagaaagaatggacaacatgcaaggtgtcttgggagtgaggacaatagtgagaaacaatgaaaagctcgatgattttaagaaaagatggaaaaccttgtcttttatggaaaacaacataaagtatcacgcttatcgtactcataccatcacattgtttgggttgtgggcttatgatacagtgtgggcattagccatggccgtagaaaatgcaaccaattatgggaaacaaagtgcttcccttgtaaatgcaatcctagctacgaaattccaaggcctatctgggtatgttgatttgaaaggaggacaattagagtcgtcagtggttgaagtgttcaatgtgataggacacaaagagagaattattggatattggagccctaaaagagggctattccaagatgaccaagaaaagcagaaagtgaggcagccagtttggccaggttacacaatggatcagccacccaagttgagatttggggttcctgtgagaaagggtttcactgaatttgtaaaagtggaaaccatatttaacaccacaaaagtttctgggtttgttgttgatgtgtttttagaggtcttgaaggcattgcctttctcagtatcatacgaattcgtccccctagaaaactatggcgcccttgctggacctattgcaaacaacaagtccatgaagttcgatgctggagtcggagacataacaattgtttatgatcgcacaaattatttaaatttcacgttgccttatttagaatctgtggtgtcaatggtagtttcaatgaagcatgatgagaaacgaaacatgtgggtgttcttaaagcctctaagttggggtctttggttgactactggtgcagccttggtcctcatcggtttcgttgcctataatactcctgaagagtatcatgaagcactttcaaaagggaccaacaatggtggggtggcggctatctttgatgaaagtccatacatcaacgtttttctatcaaaatatgacactggctatgctacg

SEQ ID NO: 90608 - DNA, 135 bp, Glycine max
  Peptide Sequence Number=SeqID_207386
atgggagtgtgggctggggaaagagatggacttgtagcggagaaggagataatggggatgccaagctcgcgcccaaggaaacattttactaaagatgatccattaaatattttggtgggaagtagtcatcaataa

SEQ ID NO: 90609 - DNA, 499 bp, Glycine max
  Peptide Sequence Number=SeqID_207387
atgtcaaacctgcatgaaagtctaagtcttcactattcccttctatgcctgttttttcttcttctatgcctatggggaagacccttcatggcaaaggaggccataccaataccaatagggatagttcttgatttgaactcctcaattggaagcatgtctaatagctgcatatggatggcataccaggatttctatgaacgtcaccctcattacaaaaccagacttgctcttcaaacccgagactctcgggataatgttgtcacagcagcatctgtagctcaagaattgttaaatgagaaggtgcatgcaatcattggaccacaaacatcagaacaagcttggttcgtcatagaacttggaagcaaagctcaagtgccagtgatctcgttttccgccacaagtccatcgctttcctcgacccagaagccttatttcattcgcgccgccagggatgattcctcccaggtggaagccatagctgccattgtccaaggcaacg

SEQ ID NO: 90610 - DNA, 196 bp, Glycine max
  Peptide Sequence Number=SeqID_207388
gcttgtagctggtgtctcgctaagcgaggcttgtgcgcttagcaagaatcatgcgctaagcgaggcactcagcccgcttagcgagttgggagaatctggaggagaacatgagaagcatctacacactcaacacgtcttcagctcgctcaacgaggcatttgtctcttcctgtgctaagtgcgcccagctcgcttag

SEQ ID NO: 90611 - DNA, 243 bp, Glycine max
  Peptide Sequence Number=SeqID_207389
atgtacaaagataattggacccaaccttggcccatgggctcagaaatctaccctaaggttcatgagaaccctagggccttcttcagcagctctagcctaatcctcctggagcctcttgctcatggctctagtgactggtcccttcctagggaggattgcatcagggagcccatccacagagaatctattcctacatcctctcccaaggggatgagatatgactatgagcacacatcctcatag

SEQ ID NO: 90612 - DNA, 840 bp, Glycine max
  Peptide Sequence Number=SeqID_207390
atggagcttgccacagcagtagctgctgctgcattcgcaattttttcactagagggttcactaattccacagcaaaagaaaaagagggagacacctttgaccagaggcaaaagcaaagtggatgatacaaaacctccaatttctcagtttggtggcacatcaaggcagttctcagggtttaaaaatgaccaaagtaacaatgctacagtggatttgaagaggcctgaaaaaaccatgacccctgcaccatcaatgaggaggagttcaacttttggtgaaaaggtgaagagtagcactgatggtaaaaaacctgagatccaagccccaaaaaggactacaacttttggtgatgagcactcggtgaacactggtgaaataaaacctgagaccccactaccaagagttgctccaccagttcatcagcaaatgcctttaaggccaccgccacctccattgccaccaccgccaccgccaccaatcaggcagacttcagcaagaccaggtaccaatggaacaaaagcagatgcctgggagagggaggagttggaaaagatcaaagaaaggtacgagaagttgttggaaacgatagattcatgggaaaagaggaagaaggcgaaagcaatacgcaagctaaataagcatcagcatagtgaaagtgaacggaaaagggcgaaagtgttgaagaaatatcaagataagatgagctatattagtcaaattgcagggggagcaagagcacaagcagaggaaagacgaaggagtgaagtgctcaaagcaaaagagaaggcaaatataattagaacaacgggcaaaattccagggccatgctcttgcttctaa

SEQ ID NO: 90613 - DNA, 171 bp, Glycine max
  Peptide Sequence Number=SeqID_207391
atggacgaacacattgttgtgttccaagatctgaccaatgaggttgcatctttactatgtggggttgaacctagcgcgaatagattctctgtggatgggctccctgatgcaatcctccctaggaagggaccagtcactagagccatgagcaagaggctccaggaggattag

SEQ ID NO: 90614 - DNA, 531 bp, Glycine max
  Peptide Sequence Number=SeqID_207392
atggcttccgaagaatcccagaacaagccccccagcgagcagtccactaccgaactcatcacgagcgcgaagctggtggcggaggcggcgcagtcggctctgaagagcgacagcgacaaagtggacaaggccaaggtggctgacgctgccggcgatcttctcgacgcggcggggaagtatggaaaacttgatgacaaacaaggcatagggcaatatgttgacaaggctgctgattatctgcataattaccagggtgataataccactgctccttcacagcctgcagagtctaaaggtgaagaaagtggtggtgggttaggtggtcttgcaaacttggctggaggcttcttcaaaaagtactggaaaattggacttcgtacgttgaagactcagcccatatggatgacaacatcactggaggagcttgtttttgtgcttctagtgctaaagcctaaagagcctaagcttgtttctttgtttcctccgggtgaaggttttctcaaggcccactgttactgcaatgataagtga

SEQ ID NO: 90615 - DNA, 279 bp, Glycine max
  Peptide Sequence Number=SeqID_207393
atgccactagagaatagacatcaagaacaagagaggaaaatgcttctgaggtggctccaaatcaggtccaaccctgtctcagcctcactccttcaagcagttttaacaaagttttttttatcggctgaggaggacttccaccaggaattagccagacatttgggtctgtcctttgatgagcacaagccctcttctgataacacgaagtttgtcaaggatatcagtgagaatgcagcaacttcaccaactatgatgggaaaggataatattgcctcatga

SEQ ID NO: 90616 - DNA, 171 bp, Glycine max
  Peptide Sequence Number=SeqID_207394
atggacaagtggaagttgctgaaaactggcttgaggtattacttatatgctttgattcacagtaaaaggcgtgagatgaaaaatccttgggaaattttgagaaatgatgtctcttatccaattaaatgctatggagaagttatttcagggccaaatggaagtatacagtag

SEQ ID NO: 90617 - DNA, 365 bp, Glycine max
  Peptide Sequence Number=SeqID_207395
ggcagatcgattatcacaagattaatccaaagagtcacccaccgttgttatccacgcaccaagcccatggagtattgggtgtgaggagcaaccagatctattatgttttgtaccctagcgttgaatcaatagaaggaaagactctgcgactgaagcaacaatacacactatgctctgcctatctccaggatatcatcgcacactttgaaaagagatcgggaaagagagaaaattgggacactctcccagataaattggtggtgcaaatgaatgatactcaactgtctctctgcattcctgagctaattaggatattggtggatgtcaagggtttaagttgggagaaagccttggaatattactaa

SEQ ID NO: 90618 - DNA, 1119 bp, Glycine max
  Peptide Sequence Number=SeqID_207396
atggcttgtcactcagagaaagagaagagaacaacaacaacaaccatcaagtttgaagaagagaaactggttatggatagtcgttctgacaccgagacttgtgctccaacaactcatccaaggagatccaagagaatgagggtgaagaagaccattaacctttccaatcacaacccttttttttctttttcttcttcttcttcttctggtgttgttcctttggccaatggttcttcacctgtgtcagaggtggagcaggaggagcaagaagaggtggctaggtgcttgatgctgttgtctagagattctagcttcaacttcaagggtggtcgttttgcttcggttactgaatcttctgataacaactcggttattctagaagcaaaattatcatctcctgatacccggattggtgtcagcaatggtaataataacaacaactttgtctctaataatcatgcttatgatcttgtggcgaagaagttgcttaaggttaaggatattaagtttaagtctgctgagtttggtgcttctgataattattcaggttctagatttttcagatatggtcccaaaaccaaaatggtagactcagatttctcgaatgatgaattcaggtggtccaaagtggagggtaagtcaagcaagtacactgcatctgtagtgaagaaattaggggtggaagatttggattatgatacaacacatggaactacaaggaagtttgattcaataaagaggaacaactatgatttagttggtgtttctagcaagaagatagcaagtggttttggcaatgaggtatataagaatggcacaagaggttggaagtatgagtgttttgaagttgaaagggacaacgattcttatgattcaatagatgatgagagtaatgaaaacagttcagagactgaatcttttcctgctccaaggtctcatcataagagtaaggctctcaatggaaagaaatgcacaaagcccaagaagaagttgaagccttctaagaaaagcaaggatcatgagtgtccaatctgctacaaaattttcaagtcaggccaagccttaggggtcacaaaagatcacatttcattggaggttctgaagaaaacactatggtga

SEQ ID NO: 90619 - DNA, 228 bp, Glycine max
  Peptide Sequence Number=SeqID_207397
atgagaagcgaaacgacgggttccgaacttgatctacgccacattgacgaccacaagcatgaggcagacgtagccagtgacggatcctacgccggagacgaccctgtcaacgcgaagggcgatgcggttaacgtccgcgatgaggtggtcgacaatgatggggtagtggaaagaggtggtgcgacgaagcctagagcggagaccaaacctagagcggcactgaggtga

SEQ ID NO: 90620 - DNA, 243 bp, Glycine max
  Peptide Sequence Number=SeqID_207398
atgaggtcgaggtctatgtcgctttacaatgtctcgtgccgctacgactatggtgccttgcatcattactatgtggccaaggtggtcatggcggaaacgggagaagtcaacagagaagattttgggacacgtgccaccactgccgaagctgaaggattttctcggcgactcctccaccgtgatgtgctactccaaccaccaccaccaccacttaggtgtgagagaacaaaggggcctacgtga

SEQ ID NO: 90621 - DNA, 186 bp, Glycine max
  Peptide Sequence Number=SeqID_207399
atggtaatctgcggtgaggttgaaaggatgtctatgttgaatcgatttggagaagatgtgaatgagcttagtctgcggtggcggaaaaaggaagatgtggtggcggttggattatcagtggcattggcggtgttaaggaagatgatggaggaatctacgccaacgacaaagggtccactggcataa

SEQ ID NO: 90622 - DNA, 291 bp, Glycine max
  Peptide Sequence Number=SeqID_207400
atgcctcataacacctttttgaggaagaaaagaaggaggaaaaagctcattctaagcctcaaaatgagggaacaagaatctcctaggaagactgaagaagatgctactgatactaagaaaacactagtggccaaagctggagagaagatccttgtggggtccgtgaaggattccgtgtttaacacaataaacatgcaaaatctcaactttccaatttttgacacctctgtcaaagttgcacgtggtcatctacctctattgcatttccttcactccttactgaacttgtaa

SEQ ID NO: 90623 - DNA, 411 bp, Glycine max
  Peptide Sequence Number=SeqID_207401
atgggtgctgctcttcagagcctgactggtgccccacgtctgcttgcagcaatagccaatgatgatattttacctattttgaactactttaaagttggagatgccagtgaaccacatgttgctaccttttttactgctttcttatgcattgggtgtgtcgttattgggaatctggatcttatcactccaactgtaactatgtttttccttctatgttacactggtgtcaacttatcctgcttccttctcgatcttctagatgcccctagttggcgtcctcggtggaaatttcaccattggagtctgtcccttgtgggagcattactttgcatagctatagatgtgagagatagtgcactcctatgttgttcgtggtggtgcagcacggagcggccccttagtgcgacgtga

SEQ ID NO: 90624 - DNA, 333 bp, Glycine max
  Peptide Sequence Number=SeqID_207402
atggagaaaattgagcttgaagttgcagacgttgatatgcctggacaacttgatatgtgtgttggtctgtcaggacaacttgatatgtgcaaagatggacacgacgtccacgtcgagggcagcttctatcatggctcgctaggccttcgcgtcgagggccaaccgctccgcctcaaatgccgccgcatcaaaggccttgttgttgttgttcttctggttgccggtggcggcttccaccttaaaccagctgctatggggattcacagagagagaacgaagggtgcaaagagaggaggggttggggaagttggcactgagcataaatggatgtga

SEQ ID NO: 90625 - DNA, 255 bp, Glycine max
  Peptide Sequence Number=SeqID_207403
atgtatcatgatgaagaagagattgaggaactcctctttgactacttgtcagatcttttccaaacgtttaacccccaacatatggaggaggttatagatctggttcagagtagaatctcccaaagcatggggaacatactgtcccatcctttcactatagaagaagtcaaggatgctctattccaaatgcacccaaccaaggtgcccagggttgatggaattcaagcctcttttgccaaagatctgggcatatag

SEQ ID NO: 90626 - DNA, 453 bp, Glycine max
  Peptide Sequence Number=SeqID_207404
atgagtcacaatgttgatgttaactctgatgaaaatgataatggagataagggcgatgttggtatcgaaaacgttgaggatagggaagatgcaacaaatgaggaagatagaagaatagttggtttggtaagtgatgaaataaatgttcttgattttggcagtgaggaacatgcgtttattttctatagagaatatgctagatcacatgggtttgttgttaggaaatatgatgttagtcagaatgttgctggtaatatcaacaaatgtcagttcatatgcaataaagaagataaagctcaagtggatagtttgcattcatttggttcaaggacttgccagataatgggttatctgttggctaaaaaaggtggatatggtagcatcagatctttaaaaaatgatttgcataaccataagaagaagagtcttataattaaaaatgatgatgtttga

SEQ ID NO: 90627 - DNA, 1611 bp, Glycine max
  Peptide Sequence Number=SeqID_207405
atggggtataagagatgccatgaggctaatgaatttgaggatctttctttgaacaaggcaaaacgttttgaatgcaacaatgaactggtttcattagctgatattgttacacccaacaaggcctttgcccagactgttattaaaggtgatgatgaagatggcttttacaatattcaatggcatgatccacttgaaacagatgctgccaaggaatttccatatactggtgacaagaatgttcaaaccagtggccacttcagctgctattctagtgaggatgatactggttctggggcaacatcattatcatctgcttcctcttgttgtttggaatttgatattccgcagaaagcatttgttcctttcgatgatgactatttggcctttggttgctcgcctagaaaatcagttcccattggaccaaatcatcaagccactgttcctgtttggaggggaaaagtgaataagatgtcagagttaggcatatacaatcatgacagtccctcctctggcttagtatcagctcataccattgatgaagatgaagagagactcatggggacttctgtgctctcaatggatgaatctagctttcatttgttaagtagtaacgacattggacaaggcaggacagagtgtaattgcatggatcgcggctccatcagatgtgttagacagcatgttagggaagcacgtgaaaatttgatggagactcttggggaggaaaaatttgtgaacttgggcttttgtgacatgggagaggatgtttcacggcaatggactgaggaggaagaagacatgtttcatgaggttgtctacagcaatcctgcatcattgggtagaaacttttggaagcatttgtcagtcactttcccttctcaaaccaataaggaaattgtcagctactattttaatgtttttatgctgcggaggagggctgctcagaacaggtccagatttttggatattgatagtgatgatgatgaatgtcaaacaagaaatcctaggatttttggttttgaaaattcagatgattctgccattgagtctcttggtgatcaagatgtccgcatggaaaaccaagataattctgatgatgatgatgacaataacagtgatgatggaactgaagataatgttcatggaagtgatatgggaaacaccactgagatagagggtgagattgatgaaagtccatcaaatttgcaagtgaactcacagattgagccttggagtaatcctgatgagcatgtcaatgggactccagggatcctgaactacaatattgctgtcggggatgactcctgtatgtctttcgaatgtgatgccaatatggatgtgtcttgccattctcatggtttaggagatgctagttctgctttgcaagctaggggatttaaatgtgatcagagtccacatatgaaggaaaaacttgatttgtccagcaatgagatggatcatgtttatttgttggagccctgtgttgctaaagattggtggtatcctgggtactcaacatgtccgactccaagtacagatttagacttcttacctacctccaatttgattgaagagttttttggtcatggtactcgggataaagagacctga

SEQ ID NO: 90628 - DNA, 486 bp, Glycine max
  Peptide Sequence Number=SeqID_207406
atgaattgcgttttcgttcatgtgtcctccacattcgagtttggagctgtgtttcatggttgcctaagtgcggaccctcaaggcaatcctccattctcccccttttttcggagctccatgaattgcgttttcgttcatgtgtcctccactttcgagtttggagctgtgtttcatgattgcctaagtgcggaccctcaaggcaatcctccattctcccccttttttcggagctccatgaattgtattttcgttcatgtgtcctccactttcgagtttggagttgtgtttcatgattgcctaagtgcggaccctcaaggcaatcctccattctcccccttttttcggagctccatgaattgcgttttcgttcatgtgtcctccactttcgagtttggagttgtgtttcatgattgcctaagtgcggaccctcaaggcaatcctccattctccaccttttttgggagccccatgaatgtcattggctag

SEQ ID NO: 90629 - DNA, 261 bp, Glycine max
  Peptide Sequence Number=SeqID_207407
atgggtgtcattttcagagatcaccttggccaattgcttgctgctgcaacgtttctggatatcaactgttaccaaccacaggtagctgagagcttagcgtttaaatggagcatccaagttgcaaatcaacttctccttcctcatgtggtttatgaaactgattgccaagaccttacacaggcctgtcattttgcaagactgtcgtcaaatgctggcaaattctcctcatactttacttatccatacaaagagagtagctaa

SEQ ID NO: 90630 - DNA, 357 bp, Glycine max
  Peptide Sequence Number=SeqID_207408
atgtccagcgtgatgagatctaaatacttcccaagagttcatccgctcgaagcccaaataggctcaaacccgagctatgtggggaggagtataatggcagttaaggatattacgttgcatggaactatttggaggattggcaatggacggcaggtgagagtgtggagagacaaatggattgttgatgcagcggataatatgttacaccctaacccagataaggagattgatgaaagtttaatggttgctgagctcattgatgttgatactggaagatgggatgtggaaaaaatctcacaggataccgattggcaaaagagcttatggacaatgactcgggatcttccagcattatag

SEQ ID NO: 90631 - DNA, 3267 bp, Glycine max
  Peptide Sequence Number=SeqID_207409
atgtatcagataattcatgatgggatgggaaccaaagttcagactctgccaggatattattcaatgagagatcttaatgaggaatccagtagttgcggctggcacctatattatggagataaaacactggcaaatgggcagtactatcatagttatctgtcaagtggtgctgcggatgcatgttcagcacatgataaggataatttgaagcagacgatgcttgagcatgaggccatatttaaaaatcaggtctttgaacttcaccgcttatacagagtacaaagggatttgatggatgaagttaaaatgaaagatttacacagaaaccatatatctgttgagacatcattttccacaggtcccttggcatctcagttgacatctgaagatggtaaaaaatggcatgttcctggatttccaatagttggaagttctacttgtgctagaccatctatttcaggcgttgagggcattcattctcctttgagttctaataaaggaatcagcaagcaagctgttctgttcccatccccaaatgggagtagtagcccgaaagatgttgagatactagggttcagaccctcaaaggtgaggagaaaaatgtttgaccttcacctccctgcttatgagtacattgacactgaagaaaatgaaaagcctggtgacgaaaagattagtgccacaacaaattttctttctgatagaaattataaacatgaaaagggagccaatatgaacctttttagtggcaatggtggcaagactgcaggccaggaagacatttcaagatctaagcagtctttaagaagcggaaatggtttggcagacttaaatgaacctgttcatgtggaagaaacaaatgatgttgcatacgtttctcctcagaaccataattcctatcaagggggaactgaatgctctgatctatctgccaaacagaagtcgaggttctttggtttgtccaaggaagatttactgaactcgcatcatggaactgaaagttgggctcgaaataatggatatttggataatgacaggaatcgaaaaatgtggatttcttcaatagagtcagggcaagctaaaagcaatccaaaacccattcctcaactcctcaaacaagatcaatcacttttatcttcccaatcaatgcaagatgaactcggtaaatctcatgagcctagatctgattgtcgaactaatcgaagcaagactgatttgttgagggaaaagatgcctagtggtttagatatcagtgaaagaaatcatgaatactctgctaataagctttcagagtctgttgcatcatcacataggcatggtctctttgcaattgctccttcctcagatttagctagatcttggtctcacttatcttgggacatggcaagtagtaccctaaaccaaaagttgatatctgtacagacacctccatctcgatgtgttaatgcatctggttccttgagtaggagttcccagtcacatcagagtaatgggatgttgggagatagttggcctctaaatatcaattcaaagattaatcccggttttctatgtgaggcatctgggaaaaatggattttaccccaggactttatctgggtccaaggagctgtcagtgaacatctcttcaattagctatctcaaccatgatagtgattgcaagaaatttcctgaacacttcaacaatggtccagcaaactgctacaagagttcaaatttgaattcaaatggcaatgacatgaagtctgcaaaaaatattaacttgaatgggatactttctaatgcttcatccaacaccttagtttcccagtcaggtcttggaatcatggatggagaacagaagcatgaggagcagcttgcagtgttgccttggcttagacccaagacaacatgtaagaatgtggcacaaaatgctggaggtttaaatgttttccaacttgcttcttcatctaacaaagatgaatctggaaaggggtctaatggaaaatttattcacaatgtaactacaggtttgtgttcaaatgatttagagccaaagaggagagaagttagtgacagctctagtaaaaggaaaattcttggggttcccatatttgacatatctcatatttctgctaaggagtcatcttcattcacctcttcgtctgtgtcagttcctaatccatctgatgtagaattagtggaaaataaccagagaaaacatatacttgatattaacttgccttgtgatgcttctgttcctgagtttgacgaacaagctgtagctcaagttattgtttgtgagacaggatcatccacaacaaaagccaactctagaaagcagattgatctgaacttgtgtatgaatgaggatgaagcatttgtgacaaatattccagcaaccaacttagaaacgaaggcagaaatagatcttgaagtccctgctgttcctgaggcagaggaggatgccattcctgaagaaaagaagcttgaaactcctctagtatcaccacttggcccacaagacacagttgaaaagctgcaggatgagcttatgaggcatgcagcagaggcaattgttgttttgtcatcttcttgctgccagcaagttgatgatgtgatcagcagtccatcagaaggcccagtggtggactctctaagttggtttgtggatatagtttcctcgtgtgtggatgatctacagaagaagagtgataattcaagggaaaaagatggtgaggataatgaggaatcttcctcagatggaatggactactttgaatcaatgacattgaaactgacagagaccaaggaagaagactacatgccccagccccttgttccagaaaacttcaaagtggaagaaactggaacaacctcgttacctactcggacacgaagggggccagctaggagagggaggcagcgaagcgacttccaaagggatatccttccaggccttgcatctttatcgaggcatgaagtaacagaagatctccaaacatttggaggactcatgaaagcaacaggtcatacatggaattcaggattaaacaggagaagtggatgtggtaggggtagacggcggtcacagccacaggttaccccaactcctccccctcctccagtggcaaacattgaaacaaacaccccacttattcagcagcttaataacattgaagtggtgggattggaagatagaagcctaacaggttggggcaagacaaccagaaggccccgtagacaaaggttccctgcaggtaatcctccatcaatccggttaatctga

SEQ ID NO: 90632 - DNA, 324 bp, Glycine max
  Peptide Sequence Number=SeqID_207410
atgaaagagaatgtgaaaaatgaaatcaaaagggcacaaaggaagcttggggccgccaatggtggctcccctaagcttgctaaaggttttgagttttggggaagaaatggggtgaaaatggcttcacccttcccctttttatgttttctcgtcagacctcgctcgcccaggtgttattgtgttcaattttacttaaacgcttacaacaccccgttgatcgagccgaatggctccggatttagtgaggaagatcgagagtgtatgttcttaaagacaataaaatgtaaaggacacaacactggaggtagagatgcaaatcattaa

SEQ ID NO: 90633 - DNA, 468 bp, Glycine max
  Peptide Sequence Number=SeqID_207411
atggagtcggagcttctcctcaagcttgactgtgggattggcagatgcttcctggatgtggcattgggagttgaccactttattgggtacctaagggagatcatagagatctcctctttgttgtcttcatcatcttctttgggcgcattggactatatgctagggccatctgatgtaggtgaggattttgagcatgcggtgtcagccatgctctctctaacacccattgcaaaggacgatgagatcgaggaggacccagagatgttagaggaggacccgctagaggcgatagagtatccttttgatcttatcatggtggatggcatagctatagtcaatggagagctttcttatggagaagtagggtggcttatgaaggaaagtagtgaggaggaccctgataaaaataggtgggatgtctctttagggagtcttgctgttaaggacctcttagttgttgattcttga

SEQ ID NO: 90634 - DNA, 312 bp, Glycine max
  Peptide Sequence Number=SeqID_207412
atgtatttcttgaaggttgctgaattgcttggtttatatgaagcagcagttctgccaaaacgagcaatcctgttgttccattcgttcaacaacagtgttttgtactctgctggttcacctgtgtactggaaccatattgccttttccttagatctcattttggttcaagaattgctagggaatcaaatcggaagaattttggaagcaatcgagcagcaaatcaggcatcggctggcagtggttttgatcatatctgtaaggaggattgggttcccagagctccccctaacaccagaacttccgcgagcttga

SEQ ID NO: 90635 - DNA, 1392 bp, Glycine max
  Peptide Sequence Number=SeqID_207413
atggctgagatggcagtgtcggaaggatcaccaacccctcagacggttggcaatgcttttgttgagcagtattactccatactgcatcaaaagccagaccaagttcacagattttaccacgagtctagcatcctaagccgacctgaagaagatggtaccatgactatggtgactactactttggaaattaataaaaagatactctctctggattacacaagctttagggtggaaattctgagtgctgatgcacagccttcttacaaggatggggtaattgttgtagtgactggctgcttaactggaagtgacaatctgaaaaggaagtttactcagtcctttttcctagctccccaggacaaaggctactttgttttgaatgatgttttcagatatgttgatgagtataagtcagttgatattgagtctgtgcctgcaaacgatgctgctgatgaaagtgctccaacagatgcttttgtccccgagcctgaggccattcatgttgctgaagatgttcccgctagtcaaactgatgttgttgatgctgacattggtgtcagtaaagaagtgagtcaaccactagagaatggaaatttatcagttactgaaaaggtggtgcctgttgatcatgttaaagaatgcagtcatcaggaacatcattcacacgctgagaaagctgcttctaataattcactggaggatactccaaagaagtcttttgcatccattgtgaatgcactaaaagaaaatgctgctcccttccatgtgagggtttcccctgtgaaacttcttgaacaaccacgtgtttctagtatacctgcaccagaagcaccagctcctagcactgacagtccaccagaaaagaataatgagattggaggtaaggcttatgcaatatttgttgcaaatttgcccatgaatgcaacagttgaacagctggaacgtgttttccagaaatttgggcccattaaacgggatggcattcaagttagaagtaacaagcaacaacaatcttgttttggttttgtggaatttgaatctgctacttcaatgcaaagtgcacttgagcaattgttcatatggaggcttctcctcctgttaccttggatggacgtagactttcaattgaagagcgacgagcaaataatgatagggggaggcattcatcaggaaggggcagttaccggaatgacagaaacgataacttcaggggccgtggcaacttcggtggtggccatggtggcggttatggaaacaggaaatgatagtttcgagaagcgaagcgagttctctggccggcctcgtggtggcaacaatggtgggcgtagcaatggagaagctgttccaaggagttatcagaatggaggagcaaaagtcactgtcaaccagtga

SEQ ID NO: 90636 - DNA, 366 bp, Glycine max
  Peptide Sequence Number=SeqID_207414
atgagaaagagatcagacgaaacatcaaggtatatgaggacgacatggtcatcaagtctcaaagcataccccaacatgtgcggaggcaagttccttggctttataatcactcaccgggggattgaagccaaccccgacaaatgcactgtcatattggagatgcgaagctcgaccaacatccaagaagttcagaagctgaaaggtagactagcatccctgtccaggttcctcacaaagcttgccgaaaaggtgaagccattttacaaaatgctcaagaagattgaggtcttttcatgggacaacacttgtgaagaagccttcatggctttcaaaaagaccattgccacaccgccagttttgagttga

SEQ ID NO: 90637 - DNA, 513 bp, Glycine max
  Peptide Sequence Number=SeqID_207415
atgggtatttatcacaatcaaagatcttggagacctgagactggtgatggctatgttaggcctccagttaaggttaggttctctgaaaatcctatcatgagtagttgtgtgaagccgttgatgcagaacatggtgaatccagttgtccttctacatggttttgacagctcatgtttagaatggagatacacatattcattgcttgaggaagctggttttgagacatgggcagttgacattcttggttgggatttctctgatctagaaaaacttccttcttcatgtgacgcggtagctgttatcagtctatcttctgaagaaatgttttggaagtctcacatcaaaggggcaatgatattggtaggcccaaaccttgactctgcagttgccagtgactttgcggtagaaaagcttgttttgattgatgctagtgtgtatgcagaaggaacaggaaacctagcaaccttacccagagctgcagcctatgctggggtgagaagatatccaacttaa

SEQ ID NO: 90638 - DNA, 189 bp, Glycine max
  Peptide Sequence Number=SeqID_207416
atggcgaagaacgagaggaaggtgaagagaatggaggtggaatcgtggctttgtcgcgccggcggcggcggcgacagaggagaagccgttgttcgttgctgcaaatccatggcgagttacgagtatgtcctttatgctttgcggtttgtttgggatacgaaaatgaatttggcttgcaagacagtgtag

SEQ ID NO: 90639 - DNA, 627 bp, Glycine max
  Peptide Sequence Number=SeqID_207417
atggatgatgatgttgaagttcctctcattcttggaaggatattcatgaagacaacaagggacttaattgatatggatgatgtacaattcaagataagggttcaagatgaagaagttgtttgtaatgttttcaaagcagtaaagcaccttaatgatgacaagtcttgtttaagggttgatgtccttgatgaaatgtatgtaaattcactaaagcaagtgtcaaattcatcttctctggagaaagccttgattgatgcatttgaagcacttaatgaggaggaagaaatggaaattgaagattgcttgaaaagtcttgacactttgaaggaaattcctaaagaaggtgttctggagcctttggatatgagacgcttcatgtccagatccaaacaacaaagatatgcagaacttgagtccagaagtctaatctgtgagcgaaaagtggacctaaaggctaaggaatatgaagaatttcaggctaccatcactaagaaaaaatgggacattttggtagagcttgaaatgaaattcaatgaagaaatagatggtattgatgatgatgaaggaggtgatgaagaagaagatgaagagttttttaagaatgtgtctcatcgaggagatgactga

SEQ ID NO: 90640 - DNA, 705 bp, Glycine max
  Peptide Sequence Number=SeqID_207418
atggttgaatgcatgaagacaattgcaaaacttgatctagaactgactgtggaagagaggaacctgctctcagtgggatataagaatgtgattggtgcaagaagagcctcttggcgcatcatgtcatcaattgaacagaaggaagagtctaaaggaaatgagagcaatgcaaaactgataaaaaattatcgccaaaaggtcgaagaggaactgtccaagatttgcagtgatattctcagcattattgatcagcatcttgttccttcttccacctcaggagaagccaccgttttctactataagatgaaaggtgactattatcgatatctagccgagttcaagaccgaccaggacagaaaggaggcagctgagcaatcactgaagggatatgaggctgctttagctactgcaagcacagatcttccatcaacacatccaatccgtcttggacttgcactcaacttctcagtcttctattatgagatactgaactctcctgaaagggcctgtcatttggctaagcaagctttcgatgaggcaattgcagagttagacaccttgagtgaagagtcatacaaggacagcactttgatcatgcagctgctgagagacaatctcactctctggacctccgatctacctgaggatggaggtatgatcatgattgagacttggcataagatgcacttggactctgcctcgtaa

SEQ ID NO: 90641 - DNA, 765 bp, Glycine max
  Peptide Sequence Number=SeqID_207419
atggaaagtgcattagatgttttccaaaaaaattccatggagcaacaattgttgaccaagatggattcccagtttataggagaagaaatgatggatgtacatacatccattaaatatctgttcaaatacatcaacaaaggttctgaccgtatcacagctgctcttggaaatcatcacaacaacaatggtaacaacactcaggttcaagatgaaattaaacaatatcttgattgcagatatgtatctccgccagaagcatgttggaaaatttttgcattcccaatgcatgcgcgatccccagcagtagagcggctatatttccaccttgaaaatcaacaacatgtttactggacagatgatcaacaaataggtgaagtcctatcaaaaaacacaatcaaagaatccatgttcacagcctggatgcattctaacaaaatatattcttatggacgggatcttacatatcatcaatatatctcaagatttgtttatgtcacccgcaaaagatgctggcaaccaagaaaacaagggaatacaataggcagactcatatgggtcccaccttcagctggtgaactgttttaccttagaatgatgttatccactgccaaaggtgcacagtcttacaatgacattagaacagtcaatggtgtggtatatcctacatttagggaaacatgttttgcaaaaggctttctaggtagtgatcaagaatttattagtgctttacaagaagctaataattggggtactgcacatacctaa

SEQ ID NO: 90642 - DNA, 114 bp, Glycine max
  Peptide Sequence Number=SeqID_207420
atgtttattgactatatcctgccttccagtatgactggtgagcatgttgcacaaccatctagtcctagagatggtgaggatatttccatcacagctggcttgccaaagcgatga

SEQ ID NO: 90643 - DNA, 462 bp, Glycine max
  Peptide Sequence Number=SeqID_207421
atggatcgagaaaatggcgacggcgacattgaaggcggtggtggcgccgacgacggtggttttcgctctccgattggtcgcaagtaccaccctgtcttggccaacgatcgcgcggtgctcgaaatgtcctccatggatcagggaccttcttcttcctcttccgcatttccagatcagcatcctaatatcagaaaagtaaatacaagtgtgaatggtagttcggatgctaaagaagagaacccttctcatgaaaaccaacctaatggatccctgcagcaggaatctaaactggaattgtttggttttgattctcttgtcaacattcttggtctcaaaaggtatatatgggctttccttgctgctaccgtcactcctcttcaatcattagatgttgcttttaaagtttgcatacagtactactgttatccgtttgaatttgagggtggattggataagctttga

SEQ ID NO: 90644 - DNA, 180 bp, Glycine max
  Peptide Sequence Number=SeqID_207422
atggctttagagttattgactgacacaaccaagacaagtaccagttttgattcatcatcagcaataagcaaggacattatagaaatgccctctttttaccaccgacaatgggcaccagaataccctaagtttgtcaactttagatatgatggaacaatataccaaatcaggctaaggtag

SEQ ID NO: 90645 - DNA, 1932 bp, Glycine max
  Peptide Sequence Number=SeqID_207423
atgacttgcgtgaaattgggttccaaagctgatgctttccagcgtcaagggcaggcctggttctgcacaactgggcttcctagcgatatagttgttgaagctggagagatgtcctttcatcttcacaagttccctttgctctctagaagtggagttctggaaaaaatgattgccgaggcttctgagtcagaggaagaatgtgtaatatccctcagtgacattcctggtggggctaaaacatttgaacttgtggcaaaattctgttatggtgtgaaacttgaacttactgcatcaaatgttgtgtacctctggtgtgctgcagagcgtcttgaaatgaatgaggaatatggtgaaggtaatcttatttcacaggctgaaacctttttcaatcaagtggtcctccacagttggaaagactctctgagggcacttcaaacctgtgatgatgttttggcccatgctgaagagctccacattgtgaaaagatgcattgaatcactggcagcaaaggcgtctactgatccaaatttatttgggtggccagttctggagcgtggtggtcctttgcagagccctggcggaagtgttttgtggaatggaataagtactggggcaagacccaaacattcgagttcagattggtggtatgaggatgtaacgaatttgagtttacctctttataagacattgatagctgtcatggaatctcgaggcattaggcaggagattattgctggttctcttgctttctatgctaaaacatatctgcctgggttaaatcgacgtcaggtttctggcgagtccagtagccgtccgtcacaggtagctatggggtctccactatctgaatacgaccagaagattctactggaagaggttgatggattgctcccaatgcagaagggtctggtccaaacaaagttcttgtttggtttattacgaacagcgatgattctacgagtgagcccctcttgcatatcaaacttggagaaacggattggcatgcagcttgatcaagctactctggaaggtctcttgatgccaaatttctcatattcaatggagactctttacaatgttgactgtgtgcaaagaattcttgaccatttccttgccatggatcaggttactggctgtgcctctccatgctcaattgatgatggtcaattgattgggtctccttcactaacaccaatcaccatggtagcaaagcttattgatggttatttggcagaggttgccccagatattaatttaaaacttcccaagtttcaagcccttgccgctgctgttccagagtatgccaggcctttggatgatggtttatatcgtgccatagatatttatttgaagtctcacccatggttggtggagtcagagagagagcaactatgtaggctgatggattgccagaagctctcattagaagcatgcactcatgctgcgcagaatgaaaggctacccatcagaataattgtccaagttctatttttcgagcagctccagcttcggacttcaatcgccggttgctttctagtttcggacaatctcgatggatcaaggcagttgagaagtggttttgttggatctacagagggtggctgggcgtcggccgtgaaggaaaaccaggttttgaaagtgggaatggataacatgaggatgcgggtgtctgagcttgagaaggagtgctcaaacatgaggcaggagattgagaaactgggtcgcacgaagggatcaagcgcttggggaaccgtgtctaagaaacttgggtttaagttaaagtctcagatgtgtagtgctcaagaagggtcagttagcaaccagaacaacgcaaataataatgttgagaagttgaaggaaagacatgtaaagcacaagaaaggttcttctattagtgacaaagcatcagtctcttcaattgttcattcgtag

SEQ ID NO: 90646 - DNA, 312 bp, Glycine max
  Peptide Sequence Number=SeqID_207424
atgactctcttggtattagtgagttgctcaaggtctgagaaaaagaaagaaagcaagaaaatccttttgacgcaattggaagaagagaacaagaataaggaagaatacgaatttcttgcttcaagagacatgtatgagatacctttgtctaggatggagctaaaatttatattagatacctccatgtgggatggagaaaagattttggacactttcatctatgatggggaaggcagtagaacatcattccatgaaatattagctcatagaccctttgaagaatctcagatttataatagttttgagagctaa

SEQ ID NO: 90647 - DNA, 1095 bp, Glycine max
  Peptide Sequence Number=SeqID_207425
atggttttcggacagggggtggaacaggtcgcttcgaagattgccgccattcaacaatggcctcctccatgctccaccaaggcagttagaagtttcctcgggctcgccggattttacaggaaattcattcaagggtatgcgacaattgcggcaccattggtagcagttaccacccttgaatccttccaatggtctcctcaagctcaggccgcctttgacaacctcaaacaagctctgtcaactgcccttatcttagctttgccagacttcactaggcccttcaccgttgagaccgacgcttcgggagtagggatgggtgcagtcttatcccagaaaggacacctcatcgccttcttcagcaagctgtttacctccaagctcttgggtgcctcagcctatgtttgtgaattatgtgccatcaccatcgccgtgaagaaatggaggcagtacctgcttggccatcactttatcatcatcacggaccatagaagccttaaagagttgttgactcaggtaatccagacacctgagcaacatatgtatttggccagattattaggttatgactatgaaattcaataccgctccggtagtcacaaccaagcagctgatgccctgtcccgcctaccagaatctgagtcatccctgtccatgatcctctcaatgccatccttgaccttcctggaggaactttgtcagcagttggaagacaaccaggagtatcgcattctgcgtcaatcccttcgagacaatccccagcaacatccccagttcaccctttctcaggatttggtgcttcactctggtcgaatttggttaccaagggatatcccaattgctcctatattgcttgttgaataccataccactccgatagggggccacgccggagtcactaagaccctgccacacatatcgaaaaacttccattgggcagggttccgcgaagatgttaaaaggttgcttattcttcatatcgaacttggggcgttgtggattggacacgtgcttgataggtggcccaacatccatggactttccaccaataaagaagcctttggattgcccatcatctatctcctatcaatggtctaa

SEQ ID NO: 90648 - DNA, 156 bp, Glycine max
  Peptide Sequence Number=SeqID_207426
atgggaaacgtacagtttaatgaccaggaggtctcagtagtggagatgcgaaaattgatccatgagaaagtgggttggagaggcagtaacagcgagagggttatcgaaagaataagggaacaagaagaggaaggatctctctggcgaccaaggtaa

SEQ ID NO: 90649 - DNA, 498 bp, Glycine max
  Peptide Sequence Number=SeqID_207427
atgaagttatggatcaattccatcccttgcagggcttacaacaaaggaacctatgtccccttacttgtttgttttgtacatggagaaattggctcttatccaagagaaagtggatgctcaggattagatgattttagggcacctctagaggagttgtttgctgtcttacaaaatagccaaaaggaaagtgctactgcgctcgggcatcgaatgttggtttatctcaagtactgctttataggtcttctcatcccaccaggccgcaaaagtattcctcccacacgcttaccatctcttagaagagaacttgtagagtttttgttaaaagactcctatactccgaaatcacatacagtttcagactttgtgtctagacgaccctgcctgaatctttatcttctcttacagccaataaacctatataggaagcaaaaaaggaaaatgataatggcactgaaactcaaaatgctttggttcagattggcaataaacctatag

SEQ ID NO: 90650 - DNA, 1056 bp, Glycine max
  Peptide Sequence Number=SeqID_207428
atggcggtctgtattgcggcatatgaagcaactggtagccaggttcaattgtctcttgagagaggtcttcctgctatgattggcaacttcatctcaagacagcttccatatccatcattatcttatgacatggttcactgtgctcagtgcggcattatgtgggttgaaaaaaatgggatgttccttatagaagtggaccgtgttcttaaacctggaggatattttgttttaacctcacctacaagcaggccacagggttcatcacgggagaaaaaaaggatcatggcaaacccaatggaagggctgacccaacaactctgctggactcttttagctcagcaagatgaaactttcatctggcagaagaccgctgatattgattgttatgcatctcgcaagcagcgtactatacaagtgtgtaaaggagacgatactcagtcatactatcggcctcttctgccatgtataagagttcagcctgaagaattttatgaagacttccaatattggagatcagctgttaacaattattggtcattacttacaccactaattttctctgaccatccgaagagacctggagatgaagatccattgcctccatataacatgatccggaatgttatggacatgagtgctaattttgggggtttgaatgctgccctgctggaggagaaaaagtctgtgtgggtcatgaatgttgttcctgcaagggcttctaatgcacttcctcttatactagatagaggttttgctggtgtcatgcatgactggtgtgaacctttccccacctaccccagaacatatgatatgcttcatgcatatggacttatctcacatctctcctcagagaggtgcagcatggtagacttattcttggagatggatagaatactgcgtccagagggatgggtcattctttctgatacaatgggagctatcgagatggctcgcatgtttgcaacacaggtacgttgggatgcaaggatagttgatcttcagaatggcagtgaccagaggctacttgtttgccagaaaccatttgtgaaaaaataa

SEQ ID NO: 90651 - DNA, 234 bp, Glycine max
  Peptide Sequence Number=SeqID_207429
atggagttggaaggagagataaagaagaagggtctggagcatgagacagtgggagtccaaaaattgatgggtgattatagagttttgcgggcgatcctatcccactggccactgcctgaccatttgatcctgccacatcatctggtacttggcaccctttcattggctgagactctcttcatcccacatcatcacgtcgggaatgtcttctcctcagcctttgatccaggttga

SEQ ID NO: 90652 - DNA, 1509 bp, Glycine max
  Peptide Sequence Number=SeqID_207430
atggaaatagacatggacatggacttctccggttacagcacaatcaccaacacaatcccctcttctgatgatgactatggttgcaactggaaccattggtcccccgtcgtcaactgggacgccttcaccggcgcccacgacgacttccaccacctcatcgactccatcatgtgcgacagcgccgccgcggaggaggacaacctcagccccgacgatcacgccgccagcaactccccctccgcctccgtcacggaggaggaggacgacgacgccgacgaagaaaccggccccgtcgacgattccaagggcctgagagtcgtccatctcctgatggccgccgcggaggccctcactggtgctcccaagagccgcgacctggctcgagtgatattggttcggctcaaggagttggtctcccacgcagcgccaccgcacggctccaacatggagaggctcgccgcctacttcaccgacgccctccagggcctgctagagggcgccagcgggggtgcgcacaacaacaaacgtcaccaccactacaacatcatcacgtcgtcatgtgggccccaccaccgcgacgatcatcataatcaccaaagcaacaccctcgcggcgttccaactgctccaggacatgtcaccctacgtcaagttcgggcacttcacggccaaccaggccatcctggagtccgtggcccacgagcgccgtgtccacatcgtcgattacgacatcatggaaggggtccagtgggcctccctcatgcaggccctcgcctccaacaaaacgggcccaccgggcccacaccttcgtataaccgcattgtcccgcacgggctccggacgccgctccatcgccaccgtccaagaaacagggcggcgcttgacggcgttcgcagcctcccttggtcaaccgttctccttccaccattgcaggttggaccccgacgaaacttttaaaccttcgtcgcttaagctggttcgcggagaggctttggtttttaactgcatgctgaacttaccgcaccttagttaccgcgcgccggattcggtagcgtcgtttttgagcggagccaaagcgttgaagccgaggctggtgactttggtggaggaggaggtggggtccagtgctggagggttcgtggggcggtttatggagtcgctgcatcactattcagcggtctttgactcgctggaggctgggtttccgatgcaggggcgggccagggcgcttgtggagcgggttttcttcggcccaaggatagtggggtcgctgggccgcttataccggacgggggaggaggagagagggtcgtggggggaatggttgggtgcggcgggcttcaggggagttccgatgagcttcgccaatcattgccaagccaagctgttaattggtcttttcaacgacggctatagggtagaggagttggggaccaacaagttggtcttggattggaaatctaggcgcttgctttctgcctccctttggactcagattaattcattttaa

SEQ ID NO: 90653 - DNA, 378 bp, Glycine max
  Peptide Sequence Number=SeqID_207431
atggatcctgacaagtttggtgtttactatgtgatagacgacatcaactcatttgtagaaaacttaggtataaatgaattggttcctatagttgaggatgatgtgggtagcaatggaaattgcccaatacaggttgatgaagtgtatgtaagtgatggagatttgacttctaaggggttgagtgaaggatcttcatctgatagtgagtatagtccttttgataagtatgcagaattgacaaatggggatgccctaagtgactttgatgaatcagtggatgtcaaaaatgaaaaatatagggtgactgttgagtgtaaggctgatgacggcatatggaggattcatgcatctccagctacaaacaaagaaacttattag

SEQ ID NO: 90654 - DNA, 669 bp, Glycine max
  Peptide Sequence Number=SeqID_207432
atgggatggttaggtgttgtatttaaagcagacacatcccgagtatctgagcatctagccattggaccgacaactgggtacttagggagcctaacaactttcagtggttggaatcagaaaatggttgaactcattgctactagacattggctcttgtttgtgctcggctttttaataggcttgcttcttgtcggttcttcaatcacctttggggtagagacagccaagggtttcaaatggtttctccgctggctaaacatgagacctggaagtggcacttttatctctaaggtcaactggaaggtagatatcttcctacgccatttggtagttaccatcgtgtacgtggtgatattaggtttgttatggggtgtcgccggtgcattggaaaaggttgagttcaaacatggtggtaatgcagcttggctgtggcttgcttgcatagttggatctctaggagggaggttgaagtggcttcaatttgagactctaattgctgatgcttatgcttcttgggtcgtggctgcacttgccattgtaaagaaatcagtattcactctttttctaagcatgttctgttatacacacttatgtcaagctgcattgactgagctcaaagccagtagaatcagaattagtttaggagaaagaggctttatggcagattag

SEQ ID NO: 90655 - DNA, 513 bp, Glycine max
  Peptide Sequence Number=SeqID_207433
atggccgagagtcggagatccacgggcacggttaagtggttcaactcgcagaagggtttcggattcataactccccaagatggaaccgatgatctcttcgtgcacttcacttccatccgatccgacggctaccgttctttatccgagggtcagtccgttgagtttctcctcgattacggcgacgacggccgcaccatggccgtcgacgtcacctccgccgttagatctcgccgtccagggggcttccgcggcggaggagggaggggaagaggaggaggccgcggcggagggttcggtcggagaggaggaggtcctgagtgttataattgtggaagaataggtcacttggcgagggattgttaccatggacagggtggtggtggtggtgttgatggtgatggtaggaatcggagacgcggcggcggtggcggtggaggaggacgagggtgttttaactgtggggaggaagggcattttgtgagggaatgtccggatgttggggaaaggaaatga

SEQ ID NO: 90656 - DNA, 210 bp, Glycine max
  Peptide Sequence Number=SeqID_207434
atgtgggcacagttaatgatcaaagattggatggtcattaatttccggagagtgatgaaacttgaatttgatggtgatggcatggatgataatagcctaatcgttgttactttaaacttaaacggagcaaatattattaggttcttaccccccaccttgcatgaggaggcatggcatgagattgagaaggtcactgccctctttctttga

SEQ ID NO: 90657 - DNA, 2085 bp, Glycine max
  Peptide Sequence Number=SeqID_207435
atggccatgacgattagggttttcctcatccttctactctttctctcatctactcatctcagttactcgctttacgaagatcaagttggcctcatggattggcatcaacagtacattgggaaagtaaagcacgctttgttccatactcaaaagtctggacgcaagcgtgttttagtatccaccgaagagaatgttgtagcttcactcgaccttcgtcgtggagagattttttggaggcatgttcttgggaccaatgatgttgttgatggacttgacattgccctgggaaaatatgtcataactctttcctcggatggaagtatattgagagcatggaaccttcctgatggacagatggtttgggagtctttccttcagggatcagtggcatcaaagtcaatattatacattccaaaaaacctgaaagccgacaaggatgatttgatccttgtttttggtaaaggttgtctccatgctgtttccagcatagatggtgaagttctctggaagaaagattttgtgggtgaaagcattgaggttaaccatattattcagtctaccgacgagatatatgtagctggttttgttggttcttcaaagttttatgtgtatggattgaatgctaagaatggagaattgctaaagaatgatcataaagcacttccttgtgatacttttggggaattattatcagtctcaggtgataagtttgttgtgttggataaaacgaggtctaagatactaacaataaacatcaagaatggagagattagttacaaacagaagcctatttcagacctcatcgaggattcatctggacaggcagtaatattaccatcaaggcttccagagttgtttgcattacgtatcaattcccatgttcttttaattaaagtgacaaatgaaggtgagttggtgctggttgacaaaattaataatgcagcagctgttagcgatgctttgtcaattccagagggtcagcatgcttttgcatttgttcaacatgaagacagtaaaattcacctatttgtaaaggatgttaatgattggaatggtgatttgctcaaggaaagagtagtaatagaccatcaaagagggaacgttgataagatttttataaacaattatgtgaggacagatagatcttacggttttagagcattgatggtaatggaggatcattcactcttattagtacaacaaggagaaattgtctggagtagagaggatggtcttgcatcagttgtagatgtaaccgcatctgaactacctgtggaaaaggaaggtgtatctgtggcaaaagtggaacagaacctctttgaatggcttaagggacatgtgctgaagctcaaaggaactttaatgattgcaagtgctgaggatgtagtagctattcaagcgctgaggttaaggagttccgagaaaagcaaaatgactcgtgatcataatggttttcgtaagttgcttatagtacttacaagggcaggaaaggtttttgctttgcacactggagatgggcgtgtagtttggtctattctacttcatactctgcgtaaaacagaagtgtgtgaacatccgattgggcttaacatttatcagtggcaggttccacatcatcatgcattggatgagaatccttctatccttgtagttgggcgatgtggaccaagtttggctgcaccatctgttctttcttttattgatgcatacacagggaaggaactcaattctttgagtcttgctcatactgttgctcaagttattccactgccttatactgattcaactgaacagcgtctgcatctaattatagacataaaccgatatgcatacctatacccaagaacttctgaagctattggcattctgcaacgtgaattttcaaatgtgtactggtactcagttgatgctgataatggtgttatcagaggtcatgccttgaagagcaattgcattcacaaagtagtggatgaatactgctttgacttcaggaatttatggtctattgtattcccatctgaatcagaaaagattattgcaacagtaacaagaaaatcaaatgaggtatggtgcctttggcattga

SEQ ID NO: 90658 - DNA, 429 bp, Glycine max
  Peptide Sequence Number=SeqID_207436
atgcctattcgaaaccctaagatgatctcccttcctccaaactcttcgacttccctttccttctcacactcctcaatttccctttctccaaactcaatgatgatctccctctcctcctcaagcacctcaattatcctaaatcaactctccattttgttgctcctcaccaatggccaacattccttgctctcatccactgtcttgtccagatcgccaaaacaccgtcaacagctacatgcacttcatccacaagagggcgacgccatcgaggacctcgcctgctgcatcaaggagaatctccaccacataaaaggctaccaccaaggactacctccagatgaggagttatcatcccgcaacgaggaggcagagatggttatggcggagaaggagaagcaggtggaggcgaaggaagagaagaggaagtga

SEQ ID NO: 90659 - DNA, 378 bp, Glycine max
  Peptide Sequence Number=SeqID_207437
atggcgggtggtggaaaggtttcgttcaaagtcacactcacctccgatccaaaattacccttcaaagtgtttagcgttccagaggctgcgccttttactgccgttctcaaattcgccgccgaagaattcaaagtcccgccccagaccagcgctatcatcaccaatgttactagtactgacttggtgagcccatcatatgttgtgacctttggcatttactgttgcactactaaaagtgtagtactgttcattgagaaggaaaagaaatatgggaaagatggtgttggcataaatccccagcagagcgcaggcaatgtcttccttaaacatggttcagaattgcgcctgattccgcgcgatagggttggtgccttttag

SEQ ID NO: 90660 - DNA, 534 bp, Glycine max
  Peptide Sequence Number=SeqID_207438
atggttgacattatatctgatgcaaatctcaaggatgaagggaacattggcaagagtaagactacactgaattggtctgagtcattcaatgaagatgatgatgaagaccttcaagagatagaggccaatgaagctcttttggcaaaggtgaggcagagcaaggcaatcgagaatagattgaatcaaagtggccaactatccattcttgataatcttcacataacaggattaagtcctagccacaagagggtgtggcttctacactgcttggccttctcctatgagcctcaggcttcaatcttccaagtggggaaagggtgcagattctcttatgtgtacatggaaagtgtcaatgatgaaatcttcctctatttagaagtggaatcagatccacaagttgctttcatagtagttctagggtttaggattggtaaaactgttttacagtgtcaagtgtacatctcacagcaccaaaccaaggttaaaaaaaatcaattcaacaaagcaaaggtagttgctgcaagcacttactga

SEQ ID NO: 90661 - DNA, 150 bp, Glycine max
  Peptide Sequence Number=SeqID_207439
atggttggtagcacgagcacggatttgcaactgcgaccaataatatgggtgaatctgcagttgcatgatggtgtggtagtggttggtgtcattgatcgggaacaaggactgccaaatgtggagtgtttatgtgttgcttgctttaactag

SEQ ID NO: 90662 - DNA, 153 bp, Glycine max
  Peptide Sequence Number=SeqID_207440
atgactgtggttatgaacatatttggggatcccaagtatcgaaagtctggccagaatggagtcggcgcagcatgtcccgcagatggagcggtggtgcaagtatcgcaggtggctagaatttctatacttatggatggtaaagacttccattag

SEQ ID NO: 90663 - DNA, 1356 bp, Glycine max
  Peptide Sequence Number=SeqID_207441
atggaggatttgcaaagtggtctgcagaatcgcaaattatcactctcaaccctcccagaaaagggtcgttctctcttggccactagggatttctatccaggggaagtgattataagccaagagccttacgtttgtgttccaaacaactcctcggtctccccccagaaaaggtgcgatggatgtttcactacaattaataacaacgtccttagcaggtgctcgcgttgccaacttgcattctattgtggaaccgcatgtcagaggtcagagtggaagctgcatcgtcttgagtgtgaggtcctctccagcctccacaaatacaagagaaaatctctcacaccatccatacgcctgatgctcagactttatcttcggaggaagttgcaaaatgataagtttgcatgtaatgcgcataccatttgtgacagtgagttgagacctgtgggaacaggattgtatcctgttatttccatcatcaatcacagctgtttgcccaattctgtgttggtttttgagggaagctcagctttggtacgtgcggtgcagcatataccctcaggtactgaggtgctgataagttacatagagactgctgaaagcactatgactcgacagaaggctctcaaagagcagtacctattcacttgtacatgtcctcgctgttctaaagtgggtcagtatgatgatatccaagaaagtgcaattctagaaggatacaaatgcaaaagtgaaaaatgtggtggtttcttgcttcgtacaactgtcactaatggagctggaacactggacagaagctttagcatattgcaaattgaccataccattctatcaaatattgctttaaaagtttacttcattgcaggagtgtatccagctgttcaccctctgcctggcttgcaatattatacttgtggaaaactagaatggtatcttggagacacagaggaagctgttaaatcactgaccaaggccgtggatatactacggattactcatggcacaaatacacctttcatgaaggacctcttgatgaagttggaagaagcccgtactgaagcttcttacaaattttcctctaaagatgagtcgcatgaatctcaatcggatgaattgctaacggccaaagagatggatgggaattatgggacaatttactttctattggtaggaaggtatttgtcaaacgttcgtgcagctgaatacagagttctgacatttgggacagcagttttagctgttgatctcgtgaatatagtgagcaagttgttttctcaagaggaacaagaaaaggatgttggagtagctgaggaattctccacctttgattgcgatcccatgctagacacctcttcataa

SEQ ID NO: 90664 - DNA, 2214 bp, Glycine max
  Peptide Sequence Number=SeqID_207442
atgcagtccaattgcataaggccaaagcgcccgctacttcctcaaagagcatcaaacatttcttcttcttccgatgccaccaattctcaagaggaagcttcttccaaggattcgcttataaccgtcgtccctgctcaaaacctagacgctcagaagaaagtccagttttcagttcgaagcaacgctgccttgcaggatggaaaggccactgagttggagaatttatcttctcacatgagttcgcttggattcgcagaaatggagtgggttgaaggcagtcaaattgaatcatcctcatcgtcgtcgcttggatgcatccagctggagaatgttccgcaggcagcgtttgacgcgagtttgaaatgtgaaagtggagtgagttccgtgctaccgaagagaagtttggttacccaggatcatttgcagcaattcagaagttttttgagtcagcccgcgacacaatcttcggtggtgggaccttcttgtgctacaactacctcggttcattcaacttctgcaccaatgctaaattcagcaacacgatattctcatttgcgtcaagatggtggctcaagtgtggctgctgagcctttgggggaggttaatgctaatccttgtcctataactgaaggggttgtgaaatcggttgatgtttccataaaagaaacgaatagaatgtcggttgatcggggggcagaagctgaagtccgagcttccggttcttgtattgatgatgcagggttgttatctaaggggagcaatcgatctaaggagcaacaagggggtgtgttgaaggaatctggcaattctaaatatacttcttgtgatgatgcgaaagggaaagaggctgtggatgttgccactgtacaaacacaggctccacttcccacaaccataacctcatcttcagatatgaagttggggtcttctaaggaggaaaaacgtgagaagactgcaagtagtaaaggtgcatcgggtacccggaaaagaacttatgaccctgatttgtttttcaaagtcaacggcaagctttatcagcgtcttggcaagataggtagtggtggaagcagtgaggtgcacaaagtgatctcatcggactgtaggatatatgcacttaaaaagatcaagctcaagggacgtgattatgctactgcatatgggttttgtcaagaaattgagtatctaaataggctgaagggaaaggataacatcatacagcttatagattatgaggtgactgacaaggctttacttgaggaagttatgaaaggctccttcagtaataaggatggcagggtcaaggatgatggatgtatatacatggtgcttgaatatggggaaatcgatttggctcacatgttgtctcagaagtggaaggaactggatggaaacaacaaaactatagacgagaactggcttcgattttattggcagcaaattcttctagctgtcaacactattcatgaggaacgaattgtgcactcagacttgaagccagctaacttcctccttgtcaaaggttccctaaaactgattgattttggtatagccaaagcaataatgagtgacacaaccaacatccaacgggattcacaggaatctggtagaatagaacattatcgttttggtttaccaattcaggtgggcactctaagttacatgtctccagaagcatttttgtgtaacgagactgatgcgaatggaaacatcataaagtgtggccgaccatcagatatctggtccctgggctgcatcctttatcaaatggtatatgggaggacacctttttctgattacaagacattttgggcgaaattcaaagttataacagatccaaatcataaaattacgtatgaaccagtttcaaacccatggcttttggatcttatgaagaggtgtctagcatgggatcgcaatcaaaggtggagaattcctcagctactccaacatccttttcttgttcctcctgtaccatctaatccatctttgccccaagatcatacctgtaaattgctacaacttatttctgaaacttgtacatatgaccctgaagcaacccaactgtgtagtcagctccaacggcttcttagtgacccacttgagaaaacaacttgctcactatattcacgagatcaacagctaaaactgctgtcccaaatgtcagaactctgtattcagctgcacgaacgtttgacaaatactgaaaacaagtag

SEQ ID NO: 90665 - DNA, 2145 bp, Glycine max
  Peptide Sequence Number=SeqID_207443
atgccgcctctccccgccgccgccgccgcctccgccgtgagatccgatttggctccgcggcacagccacagcgggagccagcgggagcagccggtggtggacgtgaagatcaatgacctcgtcgggaacggaatctccggaatactgtacaagtgggtgaattacgggaaaggatggcgaccgcgatggttcgtgctccaagacggcgttctctcctactacaagattcacggacctgataagatcgtcgtgaatcaagaaaccgagaagggctccatggtttcgacgattcgcgagagcaaatcggacgagaagcggttttcggtattcacggggacgaagaggctccaccttcgggcggagacgcgggaggatcgggtggcgtggacggaggcgttgcaggcggtgaaggacatgttcccgcggatgtcgaacagcgagttgatggctccggtggacaatgtaaccgtttcgacggagaagctgagagttcggctcatggaagagggagtgagcgaggcggcgattcaggacagtgagcaaatcatcaggactgagtttgcggcgctgcaaagccagcttgtgctgcttaagcagaagcactcggccctcattgacaccttgcgccaattagagacctggaatgatgttgcctcatgggtgaagagctggacagaaaaggttgatctggaggatacagtagttgatgagagccaaagacagcggaatgatgaagaggcttcctcaagattagcgcaagaaaaatttagtgaaggaactgcaagtgaatctgaagatgacaatgagagaaatgatgctgcagaggaagaaacagatgaagatgacaatgccttttttgatactcgtgatattctatcatccagttcttttaaaagtaatgggtctgattatcgagtatcatccttctcttcagatgatgaaggtttctatgcatttgaatcagaggatgacgtagatccttcgattagatatgttggaaccaattaccctcatgttaagcggcgtaagaaattgcctgaccctgtagaaaaagagaaaggtgtcagtctttggtcaatgattaaggataatatagggaaggatctaacaaaagtttgccttcctgtttattttaacgaacctctttcctccctgcaaaaatgttttgaagaaatggagtattcatatcttctggaccaagcatatgaatggggaaaaaggggtaatagcctcatgaggattctctatgttgcggcttttgctgtatctggctatgcttcaactgaaggaagagtttgcaaaccatttaatccgttacttggggaaacatatgaagctcactatccagataaaggccttcattttttctcagagaaggtcagtcatcacccaatgattgtcgcatgtcactgtgagggtacaggttggaaattttggggtgatagcaacctaaagagcaaattttgggggcgatcaattcaactggaccctgttggtactttgactttggaatttgatgacggggaggttttccagtggagcaagggaaaccaagagcactcgtgtaaactgaaattcaaggaacaatctataattgatcgaaatcctcaccaggttcatggtatcattcaagatagtaacggaaagactgtatcaactttgtttggaaaatgggatgaaagcatgcattatgttaatggagactacactgggaaagggaaaggtcatgatactttgtcagatgctcgtttgctctggaagcgaagcagggctcccaagtttcccactagatataacttcactcgctttgccatcacattaaatgaacttacccctggattgaaggagaagttgccgcctacagattcaaggttaagaccagaccagaggtatttggaaaatggagagtatgacatggcaaatgtagaaaagtcacggctagagcagcggcagcgccaggctcggaagatgcaagagagtggttggaaaccacggtggtttgcaaaggataaagcgagcgggacataccgctatgtaggagggtattgggaggccagacaacgaggaaactgggactcctgccctgacatctttgaccagattccttcggatcatatttctgacgaaggtcaaattacattttag

SEQ ID NO: 90666 - DNA, 330 bp, Glycine max
  Peptide Sequence Number=SeqID_207444
atggcggacacgcagcagaaaggatgcatgaagaagagagagaatatatttatatcactgcggcgaaagcggtcctgcgacgtggcggtgtcggcggaggtggatggaggtggcgccgatcaggtgaagcgtcatgctaagcacggtgtggcgatcactactggaacgggggcgtggcgtgagataaaaacggttatgtttgtgtccggattagaagatacaggctataagatgcctccgcctccatcagcacgtgacacctggggagatgccatgtggaagcaaaatgtcttccacgttttggagggaattcaattcagatttggataa

SEQ ID NO: 90667 - DNA, 207 bp, Glycine max
  Peptide Sequence Number=SeqID_207445
atgcaagagcccattgccaagaagcaagaaaaaagtgaaatgtgttggatggagttgatcgatgatcttaattgtgaaggctcaaaagatgatgttgatggtggtggtaagcttaagcttgtaggggagttggtccttaacgtggtattgaaacttaagcaatttggtggtggagctgcagtggagcaacaaggattaaacttctga

SEQ ID NO: 90668 - DNA, 1758 bp, Glycine max
  Peptide Sequence Number=SeqID_207446
atgaagtttgtttttaagggcaccttaattgaacttaaaggcaattctgacaatgcattgctggcacttactccccctcaactccggcaactgaaccaaacccatagcgcgagtgaatattttcacattcgcctttgctcttcagcttcttctcccccacccactcaccctgctatccttaccttgacccatcaattttcctccctctttcaaacaccaattgctctacccccatcccgcaccaccaaccactcaatacacctttcacctcactcattgctggtaaatgttcgcccttataggtaccctcattttcagaaacaagaaattgagtctcagcacaacggctcttggcgattctgtgtggattacaaagctctcaatgcgatcaccatcaaggaacactctttgattccaatggttgacaagccgcttgatgaactcggcggagcatggtggttttcaaaattggatttattacagggttatcaccagattctgatgactctggtggaacctggagttgaacctgtccttgctaaggttgaagttgtccttcaatggccgacactaactttagtcagagcattgcgaggttttttgggcctctcaggattctaccgccgcttcatccaagggtatgccactttggaggcaccactcacttctttattggccaaggattcagttcattggtcaaccattgccaaacaagcttttttccagctcaaagagggcctatgtaaggctcccgttttacgactgccggacttttctctgcctttcgtagttgagactgatgcctctggaaccagatttgattttgaggaacgagcgaatttggttaccacaagaaacctcatccatccccactatccttgcggaatatcactcaatgcccaccggcagccacacaggggtcatgaagactctagcacgggttcgagagaacttcacctggcggtgggaggacctctccctcgactttattgtgggactgtcgaacttctgagggcattcgattatcctagtagtggtagaccgggaccccttcttcatgagccgtttttggcaggaattattcaaggtcaatggaacaaagctctgtatgagtttggtgtaccattctcagaccgacgggcagacagaggtcatgaactatgttatagaacaatacctcagagcctttgttcatcagtgaccatcaacgtggggatgattcttgatatggacagaatgggaacttcgaatgtggaagccgtggatgagcggtttaagcaaagggaccaaatgcttgctggcctagcaaagaagctaaccaaagctcaacaacggatgaaggtatacgtagataaacaacactgtgacctgaactttgaagtaggagactgggtgttgggtagttgcgtacaaattagaattgctgccaactttaaagattcatcctgtgtttcattgttacttattaaaaccattccagtccaccaccatagacctgctctagaattacccgctctgtcagaggataaccaacccctcattaaacccctcacaatccttgacacaaaatgggaacagacagcatcaggcagacaattactagtcctagttcaatggatgggattacttgtagaagacacttcatgggagaagtgggagagcctcaaaatccattacaaccttgaggacaaggttgttttggaagcttggaggaatgttatgaatgaaaatgcagagcaagatacaaacgtagaataa

SEQ ID NO: 90669 - DNA, 426 bp, Glycine max
  Peptide Sequence Number=SeqID_207447
atgtcgcgaaactttatggattacgcggtgatgggtgttaagcgtcttaaagtgatcaaccaaggtgcgaataaccgtaaggtgtctccgcatgctaccagactctcggatcgctggatagcaaaagatgcagataaccgtaaggtgtctccgcatgccaccggattctcgggtcgcaggatagaaaaaggtgcagataaccataaggtgtcttcgcatgccaccgtactctcgggtcacaggatagcaaaagtgaacggatcttctttcttaggagatcccactgcttctgagggcaaggatgaaaattcttatcctgggtcaaggtttatggccgatgagttgagattttggctcaaaaggcttgtagaaaggccagacatgatgtatgtcagggtgttggtttggccagtggttcagggataa

SEQ ID NO: 90670 - DNA, 276 bp, Glycine max
  Peptide Sequence Number=SeqID_207448
atgagtgagaaagaaaagaataacggcagaggagggacacgtgggaagaggaatcggcggttgcagattgaagcattgcacgtctgcgtgtctgtgttggaaagcgacgaagaagaaaaaccgacaatgacgttaatgtcagcaaagacaactaaaatgccagcttcagtgggtccttcataccccttcccgtttgatccaaaacccttcactcaccttctgtttttcgaggataaataccctcagaatatgagaaaaaatcaaataattatttaa

SEQ ID NO: 90671 - DNA, 336 bp, Glycine max
  Peptide Sequence Number=SeqID_207449
gtgaaaaagaggctaaattttgaattgcaaaaagttgtagttgggctaagctcaacagatgggctaagcgcatatccatcgctaagcacagcttcagcgcgcttagtgcattcagccaagctaaactcaagactggcactaagcccaaatccattactcgcgctaagcgcgagggtggcgctaagcgcagcatcgcgatttcagagcctatttaaagcctatcttgtgcagaattatggtacaccttttgtgacaacttctacagaacggccagggcacaaaattccagagcagccacagtgcctatttggggaaaagagccctagaagcaaatag

SEQ ID NO: 90672 - DNA, 192 bp, Glycine max
  Peptide Sequence Number=SeqID_207450
atgagacagagcaagaaccaaaccacccttgaccaacataagttcaaccaacaacaattataccctgcaaagtccttttgtaaggaaagctgtaagacacgaaaaggaaagcaccatatagtgagacaagataatcacaacaattacttcaaaaatgcaaaaatggggattcatctacaggacaatgagtaa

SEQ ID NO: 90673 - DNA, 138 bp, Glycine max
  Peptide Sequence Number=SeqID_207451
atgcaagattcaggaagtctagaagcaaaggaagcgaaagcatatgccttactccgtgctataaaaggggcacaagagttaaacatctcaaagaacaaggatgatagttattccaaactcaatggtgagttttcctag

SEQ ID NO: 90674 - DNA, 3161 bp, Glycine max
  Peptide Sequence Number=SeqID_207452
ttggaggctcttatggtttgaggcatctgttatggaggttttgggaaatgggtggagggttaggactcatagttgctgcttcacttgcagcttttactgttaagcagctgaatgtcaaaagctcaaaaccagaacttaaagatgagtgcacagaagaggagcatgttctccaagagaatgaaagggtggaggaagaggagaaagaggaggttaagttaattagcagcataattaatagagcgaatgactttgaagatgatattctaccagaatttgaagatcttctgtctggggagattgagtttccattaccacctgataaggatgagaaagacaaagtttatgaaattgagatggcaaacaatgcaagtgaactagaaagattgcgacaactagtgaaggaattggaggagagggaagtgaaacttgaaggagaattgcttgagtactatggtttgaaggagcaggagtcagacattgtggagttacaaaggcaactgaaaattaagactgtggaaatagatatgcttaatattacaatcaattccttgcaggcagaaaggaagaagcttcaagaagagctcacacaaggagcttcagccaagaaagaacttgaggtggctagaaacaagatcaaggagctacaaaggcagatacagcttgaggctaaccaaacgaaaggccagttgttgttgcttaaacaacaagtttctactctactggtgaaagaagaagaggctgccagaaaagatgctgaagttgaaaagaaattgaaagctgtgaatgacttagaggttgcagtagtggagcttaagagaaaaaacaaagaacttcaacatgagaaacgagagttaacagttaaactcaatgttgctgaatctagagcagctgagctctccaatatgacagagagtgaaatggttgccaaggcaaaagaggaggttagtaacctgaggcatgcaaacgaagacctgctaaagcaagttgaagggctacagatgaataggttcagtgaagttgaagagcttgtataccttcgttgggttaatgcatgcttgaggtatgagctaaggaataaccaaacaccccaaggaaaagtatcggcccgtgatctcagcaagagtcttagcccgaaatctcaagagaaggctaagcagctgatgttagaatatgctggatcagaacgtggacaaggggacacagatcttgaaagcaacttctctcatccttcttcaccaggaagtgaagattttgacaatgcttccattgatagctctactagcaaatatagtagtcttagcaagaaaactagcctaatccaaaagtttaagaaatggggtaaaagcaaagatgattctagtgctctttcatcaccagctagatccttttcaggaggttctccaaggaggatgagtgtgagtgttaaacaaaggggtcctctagaatccttaatgctaaggaatgctagtgatagtgtatccatcaccagctttgggctaagggatcaggaacctactgattcacctgaaactccaaatgacatgagaagagttccatccagtgattccttaaattctgttgcttcttcatttcaattgatgtctaaatcagttgatggatctctggatgagaagtatcctgcgtataaagatcgccacaaattggccttggcaagggaaaaacaacttaaagaaaaggctgagaaagcaagagtgctgaggtttggtgacaattcaggtttgaacatgaccaaggctgaaagagggagtcctatatctttgccaccaaagcttactcaaataaaggagaaaccagttgtttctggcactccaaatgatcaatctgatgatggaaagaatgttgataatcaaaccattagcaagatgaagcttgctcacattgagaaaaggcctactagggtgcctagacctcctcctagaccatctggtggagctgctgttaccgcaactgcaaatccttccaacggagtaccatctgctccaccacctcctcctcctcctccaggcgctccaccaccaccaccaccgccaccaggtggaccacctcccccacctcctcccccaggaagcctatcaagaggtggaatggacggtgacaaagttcaccgagctccacagctagttgaattttatcaaacattgatgaaaagggaggcaaagaaggatacttcatcactattagttacttctgcaagtaatgcatctgatgctaggagcaacatgattggtgaaattgagaatagatcatcattcctcttagctgtgaaagctgatgtagaaacacaaggtgattttgtcatgtccttggcagctgaagttcgagcagcctccttctcagatattaatgacttggtggcctttgtgaactggctagatgaggaactttccttcttggttgacgaacgagccgtcctcaagcactttgactggcctgaaggaaaagcagatgcactaagggaggcagcttttgaatatcaggatttgatgaaattggagaaccgagtctccactttcgttgatgatcccaatctcccatgtgaagctgcactgaagaaaatgtattcattgcttgaaaaagtggagcaaagcgtatatgctctcctgcggacaagagatatggccatttcacggtacaaggaatttggaatcccagtgaactggctaatggattcaggggttgtaggcaagggtcacgctgttttgcgagaatgctccaaccatgggatcggcacaggcttacaggagcactcaaaccggatgacccccaaggcctacactctgaagagtccgtcagggcctctccctcctgattcagcaattgtggcgtttctggtgctctctagagctcctcctccgattgctctgttagggttcttgtgcgaagaagaaagagggacagaactttcttctgtacaactggcaaagaagtatatgaaacgtgttgcatctgaacttgatgaactatctggtcctgataaagaaccagctagagagtttttggttctgcaaggtgtgcgtttcgctttccgtgtccatcagtttgcaggaggctttgatgcagagagcatgaaggcttttgaagaactaaggagccgcatccaaacctctcaagctggtgaagatagcaaatcagaaacttag

SEQ ID NO: 90675 - DNA, 966 bp, Glycine max
  Peptide Sequence Number=SeqID_207453
atgtcttcacttgcagctgctagagcagacaacttttactatcctccggaatgggaaccgagtcagggttcgctgaacaagtttcatggtcaacatgccttgcgggagagggcaagaaaattagatcagggtatcctgattataaggtttgagatgccctttaatatatggtgtggaggatgcaattcaatgattgcaaagggtgtccggttcaatgcagagaaaaaacaagttgggaattattactcaacgaagatatggagtttcgctatgaaatctgcctgctgtaaacatgagattgtcattcagactaatcctaagaattgcgagtatgtcattattagcggggcccagaaaaaaactgaagattttgatattgaggatgccgaaacttttgaattgcctgctgatgaagagaggggtaagcttgcagatccattctaccgccttgaacaccaggaagaagacttgaagaaaaagaaggaagctgaaccagtgatcgtacgtctccagaggcagtctgatgcaaggcattcagatgactattatcttaataagactctccgtgcccaacttagaagtcaaaagaaaagagttactgaagaagaaaatgcttccaagaaaagaggccttggcataagacttcttccagctactgaacaagattctgccacggcaaaatcggtgaaattttcagcaaagtttgacaaaaataggaaggacaagagggcattgatcagttctgaatctatcttctctggagtctctagctattctatgtctgacaagagaaaacgagagctagagtcaaaacgaagaaaaatttgtgcgacttcagcatccagccttctagctggtagggtaaagccatcatcatggtcacagccttcaagcaagcaaaagggaactgaattgaggctgatggccgggacagttatcattgttgaacaaattgaagaatcataa

SEQ ID NO: 90676 - DNA, 375 bp, Glycine max
  Peptide Sequence Number=SeqID_207454
atggaggttgtttgctcaaaaagaggaattgttgtttcccaacagaagtatattctagacctcttggaagaaactggaatgagcggttgtagaccagcagatacccccatcgatcccaatgggaaactgtgggaaaaaggaagtgttcctgttgatattggaagataccaaaggtatttaaagagcaatcctggaaaaggtctgttttttaagagaaatagtgacttggagaagaacaaaaaacagggtgttgttgccaaaagcagtgcggaagctaaatttagagcaatggcccaagggatttgtgaaggattgtggatttatagagtcttagaagaagtcgagatggcaatagaactcccattgaagttgtaa

SEQ ID NO: 90677 - DNA, 2109 bp, Glycine max
  Peptide Sequence Number=SeqID_207455
atgcgccaagcactcctgctacgtgacgacacagaaagagacacctacggttggagccgcagagttagccccagcattgaagtagcagagttggccaacggtgacgtgtacatgggaagcttctccgggaacgcgcctagtggatcggggaagtacctgtggagagacgggtgcatgtacgagggagactggaagaaagggaaggcctgtgggaaaggcaaattctcctggccttcgggcgccacctaccagggacaatttaaatcgggtcgcatggacggctttggaaccttcaccggatccgacggtgacacctaccgcggctcttggagctccgaccggaagcacggctacggccagaagcgttacgccaacggggacttgtacgaggggtcctggaagcggaacgtgcaggagggggaggggcgctacgtgtggaagaacgggaacgagtattacggggagtggaagaacggcgtcattttcggccgtggtacgctcatttgggccaacgggaaccgttacgatggccaatgggagaacggcgttcccaaggggcaaggggttttcacctggcccgatgggagctgctatgttgggtgctggaacaaggaccttaaggtgaaccagcttagtggaactttttaccccgggagcggtgatactctcaccgtcacaatgaggaagcgttcttccgttgacggtgctagagggagcgctgttaaaagttttcccaggatttgtatctgggaatcggagggtgaagccggggatataacctgtgatataatcgatgaggtgtcgttgttgtatcgggattcgagtggaaccggttcagatcggggagatgtgaagccgtttcgccggaacccttgtctttccggtgaggtgaagagactgggtcagactatatccaaggggcataaaaattatgatctcatgcttaatctgcaattgggtataaggtactctgttgggaaggaagcttccatttcgcgagagcttaaaccgagtgattttgatccgaaggagaagttctggacaaggtttcccgctgaaggatctaagattacgccgccgcatcaatcggtggtgttccgctggaaggactactgccctatggtttttagacaattgaggaagctatttcaggtggatcctgcggattacatgttagctatatgtgggaatgatgcccttagggagctttcctctcctgggaaaagtggaagcttcttctacttgacccaggacgacagatttatgatcaagacggtgaagaaatccgaagtcaaggtgcttcttcggatgcttcgaagctattaccaacatgtttctaaatatgagaattctcttgtgacaaaattctatggagtacattgtgtcaaaccaattggaggccaaaagactcgctttattgtgatgggcaatcttttctgctcagaatatccaatccatagacgatttgacttgaagggatcttcacatggccgtacaacagataagaccaaggagattgatgaaagtaccaccctcaaggacctggatctcaactttgtgtttcgtctacaaaataattggttccaggatttcatcaaacaaattgagagggattgtgagttcttggaagctgagggaattatggattatagtcttttagttggccttcattttcgtgatgataatacatatgaaaaaatgggattgtcaccgtttcttttgcgcacaggaaagtgggattcttatcagagtgaaaagttcatgcgtggttatcgctttcttgaagcagagctgcaggatagagatcgagttaaatctggccggaaatcattgattaggttaggagccaatatgcctgcgagagcagagcgcatggctcggaggagtgattttgatcaatacaccccttgttgcagtggggaaacctacgatgttgttatatattgtgggattattgacattttgcaagattacgatatcagcaagaaactggagcatgcttacaagtctttacaggttgacccttcatcaatctcagctgttgatccaaagctttactcaaaaaggttccgggattttgtgggtagaatattcattgaagactggtaa

SEQ ID NO: 90678 - DNA, 1572 bp, Glycine max
  Peptide Sequence Number=SeqID_207456
atgtctacctgcagcaaacactggcttcggatttatcacttgttttgttctgatatccaaaatcctggctatgttgattgccattcaaattgtaataagtctacatctcaagcgtctttgtttttgtgttccgactccaacagtagaagaaatggtgtttttggtagaccactttgtgtgaacccctctggcaggagaaacctagttggtccagctttttattctctggagactagtgcttatgacgtggctgctttagaatctccttcccgtgttgcagaagaaaaagttggtgtgctgcttctcaatctaggaggaccagagacattgagtgacgtgcaaccttttctgtttaatctttttgcagatcctgatatcattcgtcttccaaggttgtttcggtttctccagcgaccattggcaaaattgatttctgtacttcgggctcctaaatccaaggaagggtatgctgctattggtggtggctctcctttacgaaaaattacagatgaccaggcacttgcaattaaaatggctttggaagcaaagggcatctcttcaaatgtctacgttgggatgcgatactggtacccatttactgaagaagcaattcagcaaattaagagggacagaataacaaggcttgtggtactacccctttatccccagttttctatatccacaactggatcaagcatccgtgttcttgagcatatattcagggaagatgcctacttgtctaagctccctgtttccattataaactcttggtatcaacgagaaggttatattaagtcaatggctaacttaattcagaaagagctccagagtttttctgaaccaaaagaggtaatgatatttttcagtgcccatggtgtacctgtcagttacgttgaggaagctggggatccataccgagaccaaatggaggagtgcatcttcttgatcatgcaagagttgaaagctagaggaattagtaatgagcacactcttgcttatcagagtcgagtgggtcctgtacagtggctgaaaccatatactgatgaagttctcgttgagcttggccaaaaaggtgtgaagagtcttttagctgttccagtgagttttgtgagtgagcatattgaaacccttgaagaaattgacatggagtacaaggaattggctcttgaatctggcatcaagaattgggcacgtgtacctgcccttggtgttaccccttccttcattacagatttagcagatgcagtaatagaagctctcccatcagcaacagcaatatatgcaccgaccagaacctctgaagatgttgatcatgacccacacagagctataaggaagcaatttttcgcacttgattataatgagaacttgcacctcggcttaaagaggattcaaagaataataattgtagaccaggatctattcaggagccaagaggcattgtctccatctccgatattaaaccccgaacaaattaatatcactccttatgattatgcaaaatgcaatttcttatcagatatgattctagcaattgtggataaattttataagtattatttttcacgttga

SEQ ID NO: 90679 - DNA, 216 bp, Glycine max
  Peptide Sequence Number=SeqID_207457
atgttggattacccgaataggtggcaagtggaagtggtaaaatgcaaaagacatagtgcagactgttatattctcttttggggccatgctaatcttctctgtatcgttccaattttatcggatgtccccgaagggacaataagtgatgcagtgcatctaattataaacgctaatattgtgtattatgataaccggtggaggaagcaagggagctga

SEQ ID NO: 90680 - DNA, 402 bp, Glycine max
  Peptide Sequence Number=SeqID_207458
atggggaatcagtctgggggagtagattgcaacaaccagtggtgggcagtggacggaagtaaaaaccctagaaaagggatagagggaatacttgcgaagagcgggagccatcttgttggtgagagtgccagcgacgatcatgcaatcagactggcgagggctgggcctgaaaatgatgccgaagcggtcgagatcgtagcgggcggcgccggtgtgcatcatttcgacggcgcagcaggcgaggccgaaggtcatgggccagatggagccgcgccgggcccagttcatcagatcgtcaaccttcgagatcacgaactccgccgccttcgacacgccggcgggaggggaagcggacggaggcggtggcggggcatatggggcgggcgtgggtgtggatgttga

SEQ ID NO: 90681 - DNA, 627 bp, Glycine max
  Peptide Sequence Number=SeqID_207459
atggcggaggattacgcccccctcaagcgcaagtacgaagaccaaccctccggcatcgagctcgccaagcagcgtgctaatggcagggttggtgtgattgttggtaaaggtggagagaccattaagtatctccagttgcagtctggtgccaaaattcaaattactcgtgatatcgatgcggaccctaattcttccactaggatggttgagcttatgggcactcctgatgcgattgcctctgctgagaaactcatcaatgaagttcttgctgaggctgaatctgggggttctggcattgttactcgaagactgaccggacaagctgggtcggatgaatttgtcatgaaaatcccaaataataaggttggccttataattggtaaaggtggagaaacgataaagaatatgcaagcttctactggagcacggattcaggtgatacttctgcatcttcccctgggtgacacatctactgaaagaacattaaaaattgatggtactcctgagcaaattgagtctgcaaagcagttagtttatcaagtcattagtggcgagaaatctaataatcttgaatgtttgatcaaaataggtgaatttatgtccatgctttatgtgattgttagatga

SEQ ID NO: 90682 - DNA, 1128 bp, Glycine max
  Peptide Sequence Number=SeqID_207460
atgtctggtggttatcctcaacaaggttaccaatctcgaccaccctctgattgggctccccctgccccaatgcagcaagctggttatggctatgtgcaacctggagcatactctggtccatcaccccacaacctggtggatattccaccaattgggaccagtctactgcaccacctccaccagcagtctactcatggtggtggttatgattactatagtcaacagccacagcaaccacaaaatcctgggggtactgcacctccagctgatggctctgcatacaattacagtcagccaccttcctctggttgtaaccaatcaggacagcagggttctgcacaggacagctataatgcatataatgcgcaatcacactcagggtatgggcagccaccgacatttgatcagcagcaaggctatggcccagctactggctatggcagtgggagtaacccggcacaggagggccacactgcaaactatgcagcacggggagattcagcccaagctccttctgcccaaccgactactgttgtgcagcaaggttatcctaccaatcaacagcccagttcaaacactgtcaattactcacttcaaggaactcctcagccaggttatggggttccccctacatcccaagcagcttatggcaatcaaccacagcctggttatggaacccctcaatctcaaaagccgactggcaatccacctgtttatggagagtcacaatttcctagtgctggaggaggctatgatcagtcagcatatcctgtgcagccccctccttctgggtatgctcaaccagagtcaggttctcagagagcaccagcatctggttatggtggtgcagtgcaaccagggtacggtcatcaaatatatggtgctcctcagggtggccagcctggttatggtcaggcatcgccttcttacagcaacagttcttttggtgctggttatacacacactctggaatatactggtgatggtgatggtaatgctcaggcaccccatagtgctgttgctaaagcatcacccaagagtttatatttttgccacccttcccctccccttctcatagactatttttattgtctttcaccgtttattgtaccagtgacacctatgtag

SEQ ID NO: 90683 - DNA, 186 bp, Glycine max
  Peptide Sequence Number=SeqID_207461
atgctcgatcagagtgggggcaaaagttgtattagtgtggagaaagagtggtctttggaggcgtgtaaggatttggaagcaagggtgatgctactaggttgggatgtggatagagcagggtttctggggaagagaagagtgggctacagggaaagtcacggtggtaccatatcaatctataaatga

SEQ ID NO: 90684 - DNA, 405 bp, Glycine max
  Peptide Sequence Number=SeqID_207462
atgcatatcctcatcataagagagcacaaaaaagaatggtccttgtggaaactcttcaacccaaaatggtaccgaattcaggtcggatccaagatattgagtgatcggagtttcagcccttacacgagcaccatagcactgtctctgtcaattggttcatcaaagctcccaaattttggcaacccaccttttcgcgctgctgaaggatgtagatctggtcacgaaggagccctcaaaggctatgaatctggccgcgaaagtagtggtcatgttgggggagggaacacctgtgcgggcaacaaggatatcgaggagagtaaattttctgacgcttatggagatgaagaaggacaaaggcatatggtgaaaatgaggctggtgaaggtgaaaaggattgaggtgtga

SEQ ID NO: 90685 - DNA, 156 bp, Glycine max
  Peptide Sequence Number=SeqID_207463
atggtgaaaccgaaggtgccaacaaaacatggagagaaggaacttcgtcagccacataatttgtctgtgaaacaagaaacatggggaactgaatgcaccctttcgtcgatggaatcatggaagtatatgacgagggttttactccctgtggattga

SEQ ID NO: 90686 - DNA, 267 bp, Glycine max
  Peptide Sequence Number=SeqID_207464
atgctccaccgatgtgggatcgacacaggcttaaagaaacactcaaacccgtacattattttgcaaatctcaacggtgggaatgccaaaaatgagtttcgaaggtggtgccatatttcaggatgatccaatggttaacaagtctgagatcgtagttttactgggaaaagtttgggtgtatgcgggaaaaaatgaggattttgggagaagaagaaggaagaacgaatttgggaggaagagaaagcgtagaaacatatcgttaatgtaa

SEQ ID NO: 90687 - DNA, 252 bp, Glycine max
  Peptide Sequence Number=SeqID_207465
atgaaagcgttcgaagtatggcgaacatctacccttgtggaggtttttctggctatattgttggtgttctctcgccatttacaaccattgatggtggtcaaaggagaagttttccctcaccccacggtgggcaccaaatgttcttatcaggtttggcagaatcttctcatggtggtgatcctccgtgagctcctccacgaacaagggtggggtactagcaaagtcacttcgacgcttaagtcaaaagtgtag

SEQ ID NO: 90688 - DNA, 1722 bp, Glycine max
  Peptide Sequence Number=SeqID_207466
atggagagtgatatgtacaccgctgcactgggcatttctggccgagatgctagagtaatagatgaaatttcccaacattccacctcaaatcctctcgttcagtgctattcacttgaccttaacaaccaatcccacatcataaatggaatttcaatgctttctggagagcaaggtgaacctataaataatgtccatggtgatgcttgcttcattaatccttcaattattgcggactctagtccgttagttacatcacaaggaaaaactattgtgggagatgcctcaagtcctatggagaacaccgagtttcaagagcatttagttggaggaatgtcaattactccctcttcccttgttgccattcttgctgctagaattggttttgaagaaaatttggagaactcatcatcagccttgcctccctccctctgctcaataggggcactgggggcattcttcaacaatttgcaaggtacttcaaattcaaaccctttgtctgcaacttttgaggactgtggttacaatgaagttcctggtaattggaatgctaacaagtttcctaaagctccagagattcatggaactgggtgtcagccttattcttctttagcaaatcttgatccaaatgaatggacatcatcaaatctagcaaacatggccaatcatgctaaccattcctctagctttagtaaggaactttctctaagtctcgcaacatcgacaaccacaggacaatgctcagaggtaagttgctctaatgtgaccccatgcatgaatggaaccatgtcaggcttggagcaagccttctgcggcagtagtagggaactttctatgaacttgggtggtgataaatatgtacagttttcaccaaaagtactggaatcgagatatctcattgggattcgagagatacttgctcaaattgcaagatattcatttgaaaatctagaacagttaaattattcagcttctggtaatagatcaggtggaaacaagtcaagttcagctttcccacccaagagaagaatattgatagataacaatgcaaattctacgtatgaagctcatgcagagcctccactgcaaaggcatgctgctgaatcaaagaaagcccaactcctggcacttctacaactggcggacaatcgatatagccagtgtttggatgagatacatactgttgtatccgctttccatgctgctacagagctggacccgcaaatacatgcacattttgctcttcaaaccatctctatcctttacaaggacctacgagagaggatcagcaattatattcttgccatgggatcaaatttcaacaactcgtgctcagaagagaatgaatggtctgctgaaacttcattccttcagaagcaatgggctctccagcagttgaatagaaaagatcagttgtggaggccacaaagaggcttgccagaaagatcagtctgggttctacgggcttggatgtttcagaatttcctgcatccgtatcctaaagatgcagagaagcatttacttgcagtaaaaagtgggttgacgagaagccaggtatccaattggtttataaatgctcgtgttcgtctgtggaaacctatgatcgaagagatgtatgctgaaatgaataaaagaaaggcttgtcgaaatgaagaaggaatgcagagcaaccacggaaacaggataagcatgagcaatcaaaggtttaatcagtgtcaactatag

SEQ ID NO: 90689 - DNA, 891 bp, Glycine max
  Peptide Sequence Number=SeqID_207467
atggcggattcagtgtcggtggacatggaagccatctctcctccacccgagttgggagctgctgccattgatccagatgatccaattctttctgctgatgacttggttgatcaaatagctgaagttcttaactattttggtcatagtacagttatgtgtatgggagtaactgctggggcttacattcttaccttatttgctatgaagtatagacatcgtgttcttggtttgatacttgtttctcctttatgtaaagcaccatcttggactgaatggttgtacaacaaggtcatgtcaaatttactctacttttatggcatgtgtggggtggtaaaagaaatattgctaaagcggtacttcagcaaggaagttcgaggcagtgattatttgccagagtcagatatagttcaagcatgccaaaggtcattagacgagaggcagagtttgaatgtgtggcggttccttgaagcaattaatggggtggagttctctgcgggatatcaattattgcctgaaacctccatgccatctatgagatatgacataagtgaaggattgagaaaattagagtgtcgttcactaatttttgttggagatatgtcttgctttcacggtgaggctctccatatgacatcaaagttggatagacgactcagtgctttagtcgaggttcaagcgtgtggatcaatggtaacagaggagcagcctcatgccatgttaataccgatggagtattttctcatgggatatggcttgtacagaccatctaagctgagtgtcagcccaagaagtcccctgagtccctcttgcatttctcctgagctttactccccagaaagtatgggtttgaaattgaaaccaataaagacacgaatttccgaggagatatag

SEQ ID NO: 90690 - DNA, 234 bp, Glycine max
  Peptide Sequence Number=SeqID_207468
atggagagtgagagaaaccctggcgaggagagaggaatacctggaactggaattctgcgagaaatgcaccatgcgccattgccagagctcttcattgtgagattgggaagccttaactctcaaggaaggactcaacagaacccatggccaggactccacacgcagagagggaaggatttgcttgggttttcgtctgttaagatccttttggaggtgcaggaagcagaaaagaag

SEQ ID NO: 90691 - DNA, 552 bp, Glycine max
  Peptide Sequence Number=SeqID_207469
atgttggaggttgcaaggaaatgtggtagtagccatagcgacctcgccgagtttctgaaggttaagtttgacgacagtgtcaacaaacatcttagtatcgacaccggtgtttccttcgggtatgtcgacgacgtaagattccaaaacaatggtgtaaaccttaccgttgtcggggttcttgaactcgttgacggaggtgacggagcggtagttgtggaggcggtgttcgccgccgacgacgcggaagctgaggaggtgcttgtcgtcgtcgaggatctcgaggcgctcggtgctggtggaggcggggaggcccgacacgacggtgacctcgcggatgctgccgacgccgccgtcgccggagcgcatgttgcagctcttgacgaagtgcttgtacttctgagggttctcgaagctccggacgaggggccacaccgtgtgtgccggcgcgtcgatgcgctgcgctatgatggagctgcagatttcaggggaaggttcgaacttgtggtgcgtgttgatgatgctttcgagttccgagaattcctctggggttag

SEQ ID NO: 90692 - DNA, 678 bp, Glycine max
  Peptide Sequence Number=SeqID_207470
atgggaatagcaaggaaatgttcatattgtggtaacttaggccacaatgcaaggacttgtaaaagcactctcagtcaaggacaactaaagctcttcggagtgcaactagatgtttcttctttttcttcatcctcaaattctttttcatcatcaccttcatattctgccatgaaaagaagtttcagcacgaattacttgttgtcttcatggccctcttcctctgtaccctcctccttttcctcgccttccctacttggtgcaaatgaaaatttagatggttacttgctcaatgcaaatagcctcatatcaacaattcaagacgcaaaaaaaggtgtcccgtggacagaggaggagcatcagatatttcttatagggcttgagaagctgggtaaggggaactggagaggcatatctagaagttttgtgacaacaagaacacccacccaagtggctagtcatgcacaaaaatattatctccgtcaatcacagaatagcttcaataaaagaaagcaccgtcccagcctgttagataattggctttctcttcgtcctcattcagtgctgaattgggctaccacttcaacttcaactaattgcactgttcagagagcgaacccagatttagacctcaaacttgcaactcccacgccatttgagctaccagtagcagatacatag

SEQ ID NO: 90693 - DNA, 684 bp, Glycine max
  Peptide Sequence Number=SeqID_207471
atgggaaggtgtttggggaagaagaaagcggtggaatgcacatcgtggggatgcatgcacatgctgcacatcatagacataaccatcctcatggcaataatgcatgtcatggcactggcgacgtcaaggaacactcccactcccactcccacatcgaagaaggagaagaaactgacgttcgacacgtcgtcgtttctcagtggagataacataacgggtgtatgtgcaggtgttggagcttgggattgtatcacattcggttataactgggttgtctttaggagtttcgcaaagtccttgtacataaggcctttaattgcggcgctatcgtttcatcagttttttgaagggtttgcgcttggagggtgcatttcccaagcgcagtttaaagcctcgtcagcaactataatggcttggttttttgcactgactacacccttgggtgtcgggattggaacggctatttcttccgggtataacccttacagcccaggtgcactcatcacccaaggtatcttggattcctcgtcgtcggggattttggtgtatatggctttggtagatttgatagctgcggattttcttagcaagaggatgagttgtaactttaggctgcagatactgtcttactgcatgcttttcattggggctggattgatgtcttccctcgctatttgggcctga

SEQ ID NO: 90694 - DNA, 2139 bp, Glycine max
  Peptide Sequence Number=SeqID_207472
atgggggtggatattgttgttggctctgctcagaggtttggggttccgatggggtatgggggtccacacgccgcattcctcgccacatcgcaagagtataagaggatgatgcctgggaggatcattggggtcagtgttgattcttctggaaagccggctttgagaatggccatgcaaactagggagcagcatatccggagggacaaggccactagcaacatttgcactgctcaggcactgcttgcaaacatggctgctatgtatgctgtatatcatggacctgaaggacttaaaaccattgcccaacgggttcatggtcttgctggggtgtttgctcagggattaaagaaacttggaaccgtggaagttcaggaccatccattctttgacactgtgaaaattaggactgccaatgcccatgcaattgctgatgctgcttgcaagaatgaaatcaatttgcgggttgttgatgggaacactatcactgttgcctttgatgaaacaaccaccttggaggatgttgataatcttttcaaagttttttctaatggcaagcctgtctccttcacagctgcatctcttgcaccagaagttcagactgcacttccttctggacttactagaaagagtccttatctgacacaccctatctttaacacgtaccacactgagcatgagcttctcaggtacattcataggctacaatcaaaagatctttcattgtgccacagtatgatcccgctaggatcttgtacaatgaagctgaacgctacaactgaaatgatgcctgtgacatggcctagctttgctaacattcacccttttgcaccgattgaacaggctcaaggttatcaggaaatgttcgaaaatttgggtaaattgctgtgtacaatcactgggtttgattccttctctttgcaacctaatgctggtgctgccggagaatatgctggactgatggttattcgtgcatatcatttggcaagaggagaccaccatcgcaatgtctgcattatacctgtctcagcacatggtacaaatcctgccagtgctgctatgtgtgcaatgaaaattgtatctgttggaactgatgccaagggaaacatcaatattgatgagttgaggaaggctgctgaaacacataaggacaacctagctgctctcatggtaacatatccttcaacccatggtgtttatgaagaaggtattgatgagatatgcaagattattcatgataatggaggtcaagtatatatggatggtgctaacatgaatgcacaggtaggacttacaagcccaggttggattggagcagatgtttgccatctgaatctccataagacattttgcatccctcatggaggaggtggccctggcatgggtcctattggagtaaagaaacacttggcaccatttttaccatcacatccagtggttcccactggtggcattcctgcccctggcaagtcacaaccacttggtaccatttctgctgcaccatggggctcagcactgatattgcctatctcatactcttacatagccatgatgggttctaaaggactcaccgaagcatcaaaaacagccattttgaatgcaaactatatggcaaaacgattggagaatcattaccctgttcttttccgtggggtcaatggaacagttgctcatgaattcattattgacttaagaggctttaagaatactgctgggatagagcctgaagatgttgcaaagcgccttatggactatggtttccatagtccgacaatgtcatttcctgtgcctggcacactcatgattgagccaactgaaagtgaaagcaaggccgagctagacaggttttgtgatgctcttatttccattcgacaagaaattgctgagattgagaaaggaaaggccgacattaacaacaatgttctaaagtgtgcccctcatccaccatcagtgctcatgggagatgcatggacaaaaccatactctcgagaatatgctgccttcccagcttcctggcttcgtgtttctaagttctggccttccacaggacgtattgataatgtgtacggtgatcgcaacctcgtttgcacccttctcccaacatcacaggttgttgaagaacaagctgctgcaacggcctaa

SEQ ID NO: 90695 - DNA, 969 bp, Glycine max
  Peptide Sequence Number=SeqID_207473
atgaggatgcatgaacctgaaggacttgaaaacattgcccaacgggttcatggtctagctggggtgtttgcccagggactgaagaaacttggaaccgtggaagttgttgatgtgaacattgtgagtgttgctttttgttgcatcatatcagctgagtatgttttcttgtctttggaatatggagcttggttgctttttagatcactattgcgttcgatgaaacaaccacctgggaggatgttgataatcttttcaatgtttttttccgaaggcaaacctgtctccttcacagctgaatctcttgcaccagaatcaaaagatctttcattgtgccacagtatgattccgaagctgaatgcaactgaaatgatgcctttgacatggcctagctttgctaacattcacccttttgcaccaactgaacaggctcaaggttatcaggaaatgttcgaaaatttgggtaaaatgttgtgtacaatcactgggtttgacttcttctctttgcaacctaatgctggtgcatctggagaatatgttggactgatgattattcacgcatatcacttggcaagaggagaccaccatcacaatgtctgcattatacctgtctcagcacatggtacaaatcctgccagtgtcaatattgaagagttggggaaaacactcaggacaacttatctgcacttatggtacaacttgcttcctatattggaattttacttgcactatttggataacctgggaatttggaagggaggggtaacatatccttctacccgtggtgtttacgaagaaggtattgatgagatatgcaagattattcatgataatggagagcctgaagatgttgtaaagagccttatggactatggcttcaataatccgacagtgtcatttcctgtgcctggcacattcaaaatagaaactgtgcttaaggtgtttaaatatatcacatatgcgtctaattag

SEQ ID NO: 90696 - DNA, 570 bp, Glycine max
  Peptide Sequence Number=SeqID_207474
atgtacgacttgaagcacttgttcttcgacgccaagctgttcatgtgcgacgacatttccgactccgttagcccctcgttgaagacgctgaacgacatgtcgttcagacggattgatttcgggacggtggcgtcgatgagggagtccaggctgtcgaagccgcatgtctgggccatcttgctttgttcctccgaggtggccgagttgtggcgccgtgggaatgtgtcgctcggcttgagcgcatccagtgaaatgaatcgagatgggacattatgtgagagttttcggttgtttccgatcgggttctctggtttgggtaatgaaaaggaatgggaaatagatgaaagagaacgcgaatgggaattaaccttggccgaggaaattagcctcttgagaatcgccttgtttgctagcctccgggcacgttccatgaatgcgaatgtggaaaaagaaaagagtgggattagtaagttgacggagttagaagagggatttaatttgattagtgaatggtgggtgagaatgagacaggacgcagaagcaggctataagaacattgggagatcttga

SEQ ID NO: 90697 - DNA, 297 bp, Glycine max
  Peptide Sequence Number=SeqID_207475
atgttggtcggtcaacgatctgctgaaaaagagcatgatgacaaccaccctttgttctgtgtgagtgatggattctttttcgctgtaaaagaagtttcactgcttgatcaagggactcagggaaaacaaagtgtatatcaattggagcaggaaatagcacttttgagtcagtttgagcatgacaatattgttcaatactatggcacagaaatgatttggaagttgcctatcactttttacaatgtttacaatataagtggaatgtttgtagtgaagagtcaaggcatgatgtcatga

SEQ ID NO: 90698 - DNA, 477 bp, Glycine max
  Peptide Sequence Number=SeqID_207476
atggcacaagaccaaaacgcagccaacacatgggtccaaaccaatgtcattccatacataaaggacgttaattttgggtacataatcataggtgacgagataacaccggggcctgtagcaccctacgttgcaaaggctggaacattcatcaatgaaacaacaaacattatcaaacagattgcaacaattttgttgcaacatggttcacccgtgatgattaactcgtacccttaccttgcatattcctctgatccccaacacgtttctctagactatgcactgtttaagtcaacaagtcctgtggtcactgatgatgggggttacaatgcgcgctatgagccttacacaagcaaattgaatgctcaggtttacaacaaaaactctgtacaacgtgtgataggaggaaaagggaattcaaggaggccaggggttgagttaatctattggatattagtacaaatgataaaattgatttag

SEQ ID NO: 90699 - DNA, 705 bp, Glycine max
  Peptide Sequence Number=SeqID_207477
atggatgggaagcttgtatttcatattggaccatcaaacaacaacaaccaagtgtgcaattcatcctccgttaaacttcaacctaagcccgttaaggcagattcaagcagcgagtgtggccaccataacgtttccttgtacaaaatagaggacgaagagaacaaaagagatcatgattatgaaaaatggatgtcttcaactgcgaggttaacgagaaaaatgatgaggctacctagcactagcagcgatctggccacaaagaaagcattgaataatattacaagggtttgtgcggattgcaacacaaccagtaccccactctggaggagtggtcctaatggtcctaagtcactttgcaatgcctgcggcattcgacagaggaaggcaagaagggcaatggcagaagctgtaaatggttttgctccttccgtgaattcatcttctacaaagatcagagtgcatcacaaggaaaagaagtctcgtacaaaccattttgcacggttcaggcttaagtgcaagttggcaactactagtactgctgaaggaacatctcagcaggagaacgtgaagattgatttgaacgattttggtttgagtttgagggatagttcggctttgaagcagcaagtgtttccaataatggatgaagtagctcaggcagcgatgcttctcatggatttatcttgcggctttgtttactgttaa

SEQ ID NO: 90700 - DNA, 864 bp, Glycine max
  Peptide Sequence Number=SeqID_207478
atgggtttaggttgggtggcgaagccgaataatcaacaatgcagaaggtggacgacaattcgtatatggggagcaacgtttatctgttgcatgtgtttaatcttcttcactcccagaatccctcgctctcccaagcatcaccaattcgttgacatgcgcaatcttctcgattctccaggagtacccaacacgttgaatgtgatgacaaatttcccgtttttagttgtgggtgttctgggccttgtgcttgccctggaagaaggtgtcttcaacataagttcccaaggagaggtttggacatgggcactgttctatgctggaatagcgggtgtggcttttggctctgcttattaccatttgaagcccgatgaccatcgtgtgttatgggacactttaccgatgatggtggccttctcctcacttttgtctagtttggttgttgagagattgggccagaggattggactgtgttgtatgtttgcactcaatcttgctgcctttctatgtgtaatttatgaacgaatttataatgatgttcggttctgcatgatgttccagttgactctgcctctagctattccggtaatagcagtcttgtaccgctccaaatatactcactcaagatattggtttttttctacagaaaaagaaaatatgaagtgggcattctttggaacacttgtgcttagcactgatcccgattttactcagcgtaatgctcatcaacagggaactaaagtttcaaaggtggcaatagaggattcgagattcacactaacaaaggtcaaggcacgtgttggcgctttagatgcgcacctggcaaaatatatgctcccttcacatgctgttgctttgtccttttga

SEQ ID NO: 90701 - DNA, 1638 bp, Glycine max
  Peptide Sequence Number=SeqID_207479
atgtggtctgcaacatcctccccttccatcttcctcccccattcccttcttcgcccccttcctcgccggcggcccctctgcgcctccctctcttgggcctcccccgacccatccgacggcctcggaggctgggccctcctcgacgccccggcccaacccgacaacaacaaagttgcggcatttccttcttatgccgttgttggcttcggcacttcgctcgctcttgtgctcgctgtctttgctgcctcaaggaaaggttttagttttcgattcccgaggccgatgtggggtgctgtggagactcggcgagatcaaaacgacgctccggagtttgacgtttcgagtgggagcaagtcaacgctgtccgaggccgacccggagagcaatgttaccgttacgcaagctgataaatctgtagctgtagaaaagcctgaacgtgttgtcatcccagtttctgtggattctacccaagaagaagcactgtcagtcttaaaatcactgaagataattgaagatgatgtggaagctaatgaattgtgtaccagaagagaatttgctagatggctagttaaatcaaattcttccttggaaaggagtcctaaacacatgattgctccaatagtatcactttctggatctgtagttactgcatttgatgatgtcggtattgacgacccggactttagatcaattcaagtcttagcagaagccggtgtgatccccagcaaattatcttggaataatagtttcaattatggtggatctgactctcaagaaaacataaatttttatcctgatagattcatctcacgacaagatctaatagactggagagctcagttggagtatgactttttctctggggtagttgacgagctcttaatacctgacatttttacagtccagatatcaattaaaaaagcaggttatatggatgtgaaggagatcacttctccagcagtttatgtggacatgctggcaggggatacgagtattcttagaaaagtttttggacagagcaagcgatttcagccaaacaaaccttcaacaaaagcacaagcagcggtggctctgacaagtggcaggatgaaggaagcaatatcagctgaattgtcaagaatagaagctgagaattctgccaggctggctgaggcaggagagatctggtctgagttgcttagccgaggagagatacagagattttgggatgaaaagcttattgaagagaaaaatcgtggttttgatgttgagaggctttatcacgtggaagtaaagaatttggaagaagaggagatcaatcaagataagatatctgctgagtatttaaaagaaaaggcaacaatggattgtcagaagcagcttctgcttaacttaaagaaagaagttgatgagatatcagaaaaagtcgcatcagagagagtcacatatgtagacgaaagggatgttgtacaaaagttgcatgaagatttagaattcaagcatgaagaattgctcaacaccaaatccacgctggaagctgaaaaagaagctcttcagattcttagatcttgggtagaggatgaggcaaggagaagccaagctcgggcagctgtccttgaagaggtagggcgaagatggaaatgggatgaccaagcttga

SEQ ID NO: 90702 - DNA, 370 bp, Glycine max
  Peptide Sequence Number=SeqID_207480
aagagaattgatcagaagaaactggcataaacagctgactaacttgactgggggaagcattgatgtgacaattgtgaaggaattctatgcaaatctttatgtcccagatgacaagtttcccaagcaagttagggttcgagggaacctaataaaatttgatgttgattccctcaacaccttcttggagactccagtggtcgtggagcaaggggagagcttacctttttactccaggtttgctaaactgaggcctgatcctcaggagcttgcagcccggctgtgtatccctgggaggggatttgttcttaatgttgagggtctaccgtggaagctcttgaggaaatatcttaccactctggcccaaacctag

SEQ ID NO: 90703 - DNA, 516 bp, Glycine max
  Peptide Sequence Number=SeqID_207481
atgagggagttcgaggtggaaggagattggaatttggtgtggaaccttcatattcctcccaaagtgagagtgtttctttggaaggcttgccgtgattacctctcaactcgtataagattgcaaaacagagcccaagtgactctggttgaatggaaatcaagtcagaatgttaattccacaaggattcaagaagttatgcagcaacctctatcagattggataaagcctccagagggattcatgaactgcaatattgatgctacatttttcatggaacatgggctggccggttttggggcctttattagagaaaatttaggccaatttgtgttagcaagaataggttgtatggaagttgttatgtcagttcgagagggagaagcctttgcaattcttcaatcgttgttatggaatattgatcttcaattattttctgtcattattgagacagattgcaaattcatagcagatcaggaagatattttagaatgtgggggtaattctcaatcacattag

SEQ ID NO: 90704 - DNA, 735 bp, Glycine max
  Peptide Sequence Number=SeqID_207482
atggaattgcaactgctgtcgctcaacaacagaagtgaacacaagtcagccattatatctgaggagaacagaaggattactggtttccatgagggtggccatgccttagtggcaatgcatactgctggagcacttcctgttcacaaggcaaccgtagttcctcgtggctcggctcttggcatggttactcaattacctgacaaggatcagaccagtatcagctgtaaacagatgcttgcttatcttgatgtttccatgggaagcagggttgatgaagagctaatctttggagaaagtgaagttacttctggtctatcatctgatatttcacacgcaactaatcttgctaggaaaatggttactagatatggtatgagtaataaagttggactagtcactcacgattacaatgataatgggaaaagcatgagctcagaaactaggcttcttattgagaatgaggagaagaggttgctggagagggcttacatcaatgcaaaaactattctgagcacacacgataaggagcttcgtgcaattgcaaacgcttttccggagcatgagacacttgcaggaaatcagataaaggcattacttgaaaaagtaaggtccaaacagcagcaacatcagaaaacaattgaatctcagagcagttcactgtctaatccaattgctagttctactgctgctgcagctgcatccaaggctcaaggtgctacccctgtgggatcatag

SEQ ID NO: 90705 - DNA, 282 bp, Glycine max
  Peptide Sequence Number=SeqID_207483
atgaaggaattcgagacaattaaagggtacttggatagattacttggcattgctaacaaggttagattgctaggcattacatttgcaaattctataattgttgaaaaaattatggttatggtgcctgaaagatatgaagcatcaataaccaatttggagattataaaggatttgtccaagatctctttgatagaggtgatacatgccttgcaatctcaggatcaaagaagattgatgagggatgaatcaatagttgaaggaactttactagtcaagcactag

SEQ ID NO: 90706 - DNA, 809 bp, Glycine max
  Peptide Sequence Number=SeqID_207484
atgttgggcagatcccggggatccattaaacatagatgcatcgaagaaaacgagacacagaggagtggagaacttccagatcttgattcgaagatccaccttacactcggagtcgacgacggaggccaccgccggagacttgccggagggaacggttcctctgattccgtcgcaggtgactcgaattccgaccttcttgctcttgagccaatccatcttcatcttcaccttggtgtccatctgaatctccacggggaaacctctcttcatcttcagccccgatctcaggctagtcaacgagtccgtgtccagatcttgcgaccccgacagcaccgcgcggaggctcgtctggttgttcttgtccgaagtaaacgccgtaacggaaccgttcccgacggggacggagttcgagaacaccgtcatggagaacgggtcgtagaagaagacgaggtggttgttagggttcttcgcgatgagagtgaggttgaagagcgtggtgaggtgggaaggggagtcggcggaagtggtgaggttcatcttcgcaatgcggaggtttgtgacggagaattcgggacggtgagggcggtagagtacgtaaagtgcggcgccgacaatggcggcgaggagagccaccgcgaggagggtgaggatggtccagaagcagcagcagcagcagaagttgcggtgggagcgttggccgcgacggtggtagtgcgattgcggccggtaaacttgacggttggggttgtagagttgagacttaacgggtccgggattgccgttagtggcggccgcggcgtctccgttgg

SEQ ID NO: 90707 - DNA, 252 bp, Glycine max
  Peptide Sequence Number=SeqID_207485
atggacttactggagttatgggcaattttcggccccggcgtcgccggcgccgtcttcggcgccggatggtggatctggcttgacgccgtcgtctgcagtaccgtcaccgttcccttccttcattaccttcccggaattttcgcatctcttgcggctttgatgttcaattgcgttagaaaagaagacatcgattattctccctacgacgaaggcgagtggagtgaatttatgtttcctcaactcgtcggctga

SEQ ID NO: 90708 - DNA, 1608 bp, Glycine max
  Peptide Sequence Number=SeqID_207486
atgaccggggaccgatgtcacccgtgggagggcatggtggaggttggtgatgctgccgccgtggagaggcggtgcgaggctaattttccggctgaaattcctcgcaactctgccgccgtgcgtgaaattgattacttgtcccaggctaggaaagcgcttgcggagcgttcgcctttcgatgttgctgaagagacgtcgacttctgccgctgcggttactctccccggtggcttggctagtttgctgaaccggcagggtgataaccggaggcgtctcaagaagtctcattctggcgcgaataagaggaaatcgtcgaatagggcaaaccagaagaagccagaggattctaacatttggactgagacggaggagtactttagggacttgaccttggctgatattgacaccttgtttgaggcctctcgcacttctagtttagtgtctcaggactgtttcaccatcccgtgtttgggaaatgctcctaggcacaatgcagttactagtaatagtgggaatgaaatggagcctgttccaaaattcaatgtagtagttagtagtgaggatggagaaaagggtgaggatgaaaacaaggatggtgaagcggtggaaagtgaggatgaattgttggtaattgaggcaattgacgatgttgctgttgaacaagctcctccccaggacgacaagagtcaggacatttctgattcttctgttagtctagagtggtttttaggttgtaggaatagggtttctttgacttctgagcgccctaccaagaaaagaaggcttttgggtgttgaagctggtttggagaaagttgtaatgacttgtccttttgatgagggccagctgttttgccattattgtggcaggggagacactggcagggattccaataggttaattgtctgtgcttcttgtaaagtggcagttcaccgaaagtgctatggtgtgcatgatgatatagatgaggcttggctgtgctcctggtgcaagcaaaaggttgatgttgatgtgtcggtgaatccttgtgttctttgcccaatgaagggtggtgcattaaaaccagttaatagcagcgcggaaggtgtggggtcagtcccatttgtgcacttgttttgctctctgtggatgcctgaggtttatatagatgatttgaagaagatggaacctgttatgaatgtgggagaaatcaaggaaacccggaagaaattagtgtgtagtgtttgcaaagcaaagtgtggtgcatgtgttcggtgtagtcatgtttttcattggttgctgagggtcgaacacaatactccttcttttcctagctttgagactggctatgagatcataggaagctgcagagcttctttccatcctttatgtgcaagggaagctagacataggatggaggtttgggctaagtatggtaatgataatgttgagttgcgggctttttgcttgaaacactcagctctaccagaaaacagaagcatctttccattggaaggctctatcgcagttaggaatgatatctcagaagccaaaggctttccagtgacattgccattgagtggtgaacagaacttgaaagatttgcaggaatcgagaattagcctctga

SEQ ID NO: 90709 - DNA, 162 bp, Glycine max
  Peptide Sequence Number=SeqID_207487
atgtctcaatggcatcaatttagaatggtggagttgacgtcgtgctcatcatctgatcctaaaaatggtaatataggagaggacacatcacatgccggtacaggacatggcgttttcacaaaccatggatacaacttcgctctagtcaggaatgataagtga

SEQ ID NO: 90710 - DNA, 201 bp, Glycine max
  Peptide Sequence Number=SeqID_207488
atggcctttacaaggaagaagatggatagagtggaagatgaaaagaacaagggggtcctagggttcgggaatgaaaatgagggtcagagtgagagggagaaaggaaggctcaatacatcgagattatcgttaccattccctgtaatcaattacattgcttcagaaaaacttaggaagctctctggaagtcgaaataattaa

SEQ ID NO: 90711 - DNA, 99 bp, Glycine max
  Peptide Sequence Number=SeqID_207489
atggggaaccgccagtcaaattggcgagttccaacagctaggcgtcagggtgcagggacgcagcgaagcaggaaggcagcagtggtgcagagcttttaa

SEQ ID NO: 90712 - DNA, 312 bp, Glycine max
  Peptide Sequence Number=SeqID_207490
tttgccaaatcctaatcaagaaacagctcgcttgagaaaggttgaaggaggcattgttgcaataatgaagtttagcggaaaacccacagaggatattgttcgtgaaaaggagaaaaccctgcgtgccaatattattaaagatggtcttaaacctcagcctggttgtttgcttgcacggtacaatgatccaggtcgaacatggacctttataatggtagatcatgagattcaagatgggatctctctcaaaatcccttattatgtgcctcttgatgtctatttatacttctattttccttcagaatcccgtag

SEQ ID NO: 90713 - DNA, 300 bp, Glycine max
  Peptide Sequence Number=SeqID_207491
atgacactcaaagccgttgacagtcactcgagcttcgtcgtgttctgcacctctagccttcttgtccagataatgaacagtggttacacaaatgggtctgtcaaagttctctctcaatatatgaaggtgaagagtgtcattgtgtggtgcctaagaacgattccaaagtctatcttcaaaaagttgcctcctacctctttgttggagtacaagtataaagtaaagtcttatcatcgagtaaaaatgaaaaatttgaacatcatttttagggacttggttgagcaaaaggaggtagagtaa

SEQ ID NO: 90714 - DNA, 621 bp, Glycine max
  Peptide Sequence Number=SeqID_207492
atggagtttttttttaccatttggcagcttattgataaaataaatggaatgaacttaaccaagtctgaggatatttttcatgaagttcaaggcaatgcttctggatgtgtctcagaagacaagtctactgcttgtttgcaaaatgcttctgtgctttctgatcactgtgttgtccattctgcttcagaaccacctgattttggtttcataaagaaggatgcaatctctagttacattcatccatacatcaacaagaaattgctgcagattcgtgatggggtgcccttggaggacattatatgttcaagtgatgagggaaattcttctttggttgaatcctttgggggtagtgcctgctcaagtacccaaaatcagaacttaactcaagttgatttttcaaagcctgatgaagtaaatatggagcagttggttagggctataaaaatgggactttttgaattttctccacaagatgaattggagggggaacttgtttattttcagcatagattattgcagaatgcagttgcaaaaaagaggcatattgataacttaatctatagtgttgccaagagtttgccacatgagattgataaggcacatcaacaaagatgggatgaa

SEQ ID NO: 90715 - DNA, 249 bp, Glycine max
  Peptide Sequence Number=SeqID_207493
atgaagacgagggcgcgtggccatgcaatttaccgttgtttagggacaccggatattttgggggtgaaacgaaaagcagggagccccaggttgggaatagtagccaataacataaagccacctcggaagctcatgccaaggctaatacccattgattggacactaacaagagaggatccatctttgatcactagaccaacaaagaaatgtttaaacgaggagacagtgaatggcaatgcaagtagagag

SEQ ID NO: 90716 - DNA, 408 bp, Glycine max
  Peptide Sequence Number=SeqID_207494
atggacacagacccaaaattggacgatgactgctctacctctcaaagtcgatacaaccacaagattcttgatagatcaccattttctggcaagaaagttcctcagagagccgctgcatcacgcaatatttccgatgaaggtggatggagatccaaatctagaaagcattcggagacattcggaaaagagcttgttatgacgtcagatgaagcatctatgaagaattcaatgctacctaaaggatatgcatatgttcctgctgattgcttgtcaaatgagaagcactctaacgaggacgtatatgctagtgaaccagtggagcatgatagtcttagtaattctgaaagggatcgtgctcgatatcagatccaccgagcatacaaattatacttaactcccacctcataa

SEQ ID NO: 90717 - DNA, 1203 bp, Glycine max
  Peptide Sequence Number=SeqID_207495
atggtggttatagacagggaattgaatgctagctcctgcacctatggacttgagaagtatgttatgacaaagttatttgctcgtgtatttgcttcacttccagatgatgtaaaatttgatgaccaactttctgagaagatggctttgattcaacaatttattcgacctgaaaatttggatatcaagccagcatttcagaatgaatcatcatggttgcttgcacagaaagaattgcagaagatcaacatgtacaaggcacccagggataaacttgtctgtattctgaattgttgcagggttattagcaacttgctgcttaatgcttcggttgcttccagagagaatcctccaggagctgatgaatttcttcctgtgcttatttatgtaaccataaaggcaaaccctccacaactgcactcaaatctactgtacatacaaaggtttagacatcaatctcgattggttgcagaagcagcatattattttacaaacatgctctctgctgagtcattcatctctaacatcgatgcaaaagccatttcaatggatgaagctgagtttgagggaaacatggaatttgctcgtgctatgctttcaggtatttcggctgatacacaagatcctggttcaccttatcaaaataatggacatcatacaagagcagaacccactaagcacaaagctttgattgatcataacgaccctgcactacgaactccatcatctgttgtgaaatcagaaagcaagaaagtgacttttgcagatgaatcattgatcacaaaagttccatccctctcagatttggagaataaaggggcaagtatgattttaaaggaggacaagttgaatgcagttttcggggagtttccatatttgtttgctagtgtaggtgacctaacagtaggtgatgttgaagacctgctaaataattacaaacaacttgttttcaagtatgtctctctttccaaagggttaggaatctctcctacatctcttccaccatccaattcccaagataattctgaaggccatgctgaagtagattcttcagacggtggacctctagatgacaataataaatcagaagaatctattgatacaacagaggatagttcagataaagtttcacttgaggagaggaaaattgaatctggtctgcccaaggatgagccagttgctcctgagggtgatgcccccccttaa

SEQ ID NO: 90718 - DNA, 1689 bp, Glycine max
  Peptide Sequence Number=SeqID_207496
atgcctcgccaacctccgccttcacctccgtctcagcctggtgttctcgaccctgcactctggcttgtctgcgccggaaccaccgtggagatccccaccctccattctagggtttactacttcccccagggacacttcgatcaagcctcttccgctccaagaaacctctcccctctccttctttcgaaacccgccgttctctgccgcgtcgaatcggttcaattcctcgccgatcctctcaccgacgaggttttcgcgaagctgattcttcaccctgtcgctgattgcttcgcttcgggaccttccgctgttgctcctgctgctgcttctgcttcggctcaaaccggtgagaataacgtcgtttctttctcgaaggttctcactgcttctgatgctaataacggtggggggttttctgttccgaggttctgcgcggactctatcttcccgccgctgaacttccaggcggacccgccggtgcagaacctcctcgtcaccgacgtgcacggtttcgtctgggagttccgccacatttaccgcgggacgccgcggcggcacctgctgaccaccggctggagcacgttcgtcaacaacaagaagctcgtggccggtgacgtcgtcgtgttcatgaagaactccgggggagggttgttcgtcggaattcgccgcgccacgcgcttctctatggggaagggtggtgatagaggcggaatgaggatcagggtggatgaggaggaggaggaggaggaggaggaggaagaggaagaggaggtgagggaggttttctcgagggacgggagggggaagctgtcggcgaaggtggttgccgaggcggcggagctggcggcgcggaacatgccgttcgaggttgtttattatccgaaggaaaggtggtcggagtttgtggtgaagactgaagcggttaatgaagcaatgaaggtcgcgtggagtcccggaattagagtgaagatcgctgcggagacagatgattcgtccagggtgtcgtggtgtcagggtacggtctcttctgtcgctcttcacggtaatggccaatggcgcggttctctttggcgtatgcttcaggttacatgggatgaacctgaaggtttgcagatagcaaaatgggtcagcccttggcaggtggaacttgtttcaaccacacctgcacttcattcagcattccccccaataaaaaggattaaagctgctcatgattctggggtgtttactaatggagagagagacccctttcctatgacaggattcactaattcgacaatgggacaactgaatcaggcattgttgagttatggtacttttcctgctggcatgcagggagccaggcatgatgcattttctgcatcaagattttgcaattatccaactgacatgtctcgtctgtgtatgggtaattcctttgggaagagcacatttccatggctgaaaacattggaaacagaggtaaatgttggcagctctcaatctgatgaattgtcacctgatagtcgtggtagtctccaatcctgtggcacagaccttgttggcaactcaagaaaacttgggtctgtttcatttcaactatttggtgcagtcattcagacagaacagcctgttgaaaatggtttgcaaggtaccggttgcacttgcacgggagatgaatgccaatgtcaaagagccctcaacagctga

SEQ ID NO: 90719 - DNA, 1008 bp, Glycine max
  Peptide Sequence Number=SeqID_207497
atggaagctttgggaagccatctaagcaacaagtactctgagggaatgcctggtgctaagtactacactggtaatcaatacattgatgagattgagtttctctgttgccagcgtgcgttgttggcttttgatcttcaccccaacaattggggtgttaatgttcaaccttattcttgtacttctgctaatttcgctgtgtacactgggattttgcatcccggggataggattatgggtcttgattcgccttctggggggcatttgagtcatggttattatactttagggggaaagaaggtttcagctgcttctattttctttgagactttgccttataaggttaatccgcagagtggttacatagactatgataagcttgaggaaaaagcgctggattttaggcctaagatacttatctgtggtgggagttcgtatccaagggaatgggactatgcgaggttcagacaggttgctgataagtgtggggcagtgttgatgtgtgatatggctcatatcagtggtcttgtagcggctaaggaagtagctagtccatttgattactgtgatattgtcacctcaaccactcacaaaagtctccgaggtccaaggggaggtatcatcttttatagaaggggggcaaaaccaaggaagcaaggtttcgttcataatcatggagatgatagtaattatgatttcgaggagaaaataaactttgctttatatccatcgttacaaggaggcccccacaataatcatattgctgctcttgccatagctttaaaacaagttgcaactccagagtacaaagcatacatgcagcaggtgaagagaaatgcgcaggcattagcatctgccttgttgagaagaaatttcagattggtgactgatgggaccgacaatcatcttttgctatgggatctaacagcacttggcttaattgtaacgagttattatttggtgtactggtgtctgaagatgggaaatgattctagtacagaagtggcttaa

SEQ ID NO: 90720 - DNA, 342 bp, Glycine max
  Peptide Sequence Number=SeqID_207498
atgtatgtgagagtatccattcctaacagaaactatgaaaaggtctgtgaggcgtgtcgcatcactctcaataaatgtgccatttatggttcgatttctcctggaggagtgagaattggtactcctgcaatgacatctagaggctgtttagaggaagattttgaaaccatagctgattttcttcgtagggcagctcagattaccagcattgtgcaaagagaacatgggaaatcatgcaaagatttcctcaagggtcttcagaataacaaagatatttctgagctcagaaatcgggttgagacattcagttcccagtttgcaatgccaggcttcgatatttga

SEQ ID NO: 90721 - DNA, 293 bp, Glycine max
  Peptide Sequence Number=SeqID_207499
gggtgcctgttcctgggatcggcgttcatgatgtcgacggccaggttgcagcagcgggtggcggcggagatcgggcacatgggcggctcgccggggatgcttctgcacgagtttcggaggtcgaaggtggccatggaggagctgagaggggagttagagagaagagggtcagggtctcagggagtggagtgggagaatctggggcagacaacattgttgctcagcttgatgatttctttgacgagattgtggaagggaggaagaggcttttggacttttgcagtcataggtga

SEQ ID NO: 90722 - DNA, 177 bp, Glycine max
  Peptide Sequence Number=SeqID_207500
atgttaaagggaattgcaatgggctgcaacggtgccttcaccttcaccaatgaacgtggctactacaatgatgatgttggacctatgacaaaaggcgttgcttcaatgacgatgaccaatgcgatagggagcaagggttggggtgcactaagcaaagaaatgaggtgctttaagtaa

SEQ ID NO: 90723 - DNA, 564 bp, Glycine max
  Peptide Sequence Number=SeqID_207501
atggcggcaccatcggttccaatcccaggtaagagaggtgtggcccaaaagggaaggtttcttggtgttgaaatggaagcagcaagagggggttctggtggcggtggtggagattgcgatggagatggcttgggccaccaccatgtttggaattggaagaagaaaggaggagctgcagctgccgagtggatgctgataattatgcaccattccgttcgttcttctcttcttctcgcagcacatcctgctttccagttcttctcttcttctccaactcaaatcttcttctcgctttcatcaaaggttctagcgcagaagtccctctcctcctccaactctccacgccaagcggatgggaggtgctgccatcacgagatggttcaatccattgtgggaatcattggagggagacgcatcgttgcaggtgggaggtgctgtcgtcagggggaaggaagtgttaggtggttgaaaggtgtaagatttaggtatggggtgtgggattcaactccccaagtgtatatgtttggatacgggtgttcatgggtcgattcgagccggttttga

SEQ ID NO: 90724 - DNA, 1974 bp, Glycine max
  Peptide Sequence Number=SeqID_207502
atgtctggggagaccacaaatttattgtcccctggccccaatttctccccactccccacacaacacgctcacaacttcttcagaatgagcattcactacttcttctgcttcttcttgtcgctctcatctttccatgtttctctagcaattaagggaagaatattgcctcagcctcaaacaacacatgaactcataaacccattcagccccaaagcctcactcattcgttattggaacactcgcgtttcgaataacaatcaaatccctcattttcttctctcaaaagcttcacctctcactccacaaaactacgccgttctcaacaaactcctaaccaaccaaaaacctagacctaatgaaaaccttcaccactctctctgctcctcaccgaacttactctgttccttcgacgacacaccaaacgctcaaacacgtaaaaatgacgacgctaactttgccctttacaacaacaaacgcttcgccaactacggatcgtcccgagtcggcggagtcgactcgttcaagaactactccaacggcctaaacgccaacaacgacgcgttccggcggtacagcgccgcctcgacgcgccgcggcgaacagttcaataactacgccgacaacggcaacgtcgccaacacgaacttctcaagctacggctccgccgcgaatcaaacctccggcgagttcagcaactacgacaaaacggtgaacgttccgaatctcggattcaccacctacgactccggcgcaagcaatcacaaactctcgttctcgagctacggaaatgagactaactctggatcgcaaagtttcacaagctacggtaaacgcgttcgcggcggaacgagcgagttcgcgagctacgccgacgacgcgaacattcttcagtcggagttcaacagctacggcgacctgagcaccggagcgagcaacgactccttcaagttctacagcttcaacggcaacaatccgcggcacgttttcaaaagctacgccgccggatcggcttccggagttgacaatttcatcagttaccggaaccgcgccaacgtcggcgacgactcgttccagagctacgccgcgaggtcgaagtccggtgccgccacgttcgcgaactacggcatgtcgtttaacgtcggaaacgacagtttcactgagtacggaaagggagcaacggggaaaacctctttcggttttaaatcatacgggttaggccgtgggtttaaagtttacaacaaagacggcgcgtcgttttctgagtatcgaaatttcagcgcagccagtggcaaagttgtaaataagagggtggagccgggtaagttttttagagaatctacggtaagagaaggaaacgtgattccaatgcctgatattaaagataaaatgcctgcaaggtcgtttttacccctcgcgatcgcgtcgaaattaccgttctcgtcgtcgagaatcgacgaaatgagggaaatattccacgcgcgggaggggtcttccacagagcgcgtgatggtgaacgcgttaaaagagtgcgagagggaaccaagcaaagacgagacgaaacggtgcgtatcgtccggggaagaaatgatagggttcgcggtttcggttttgggtcccaatgtggcggttcggagcaccgagaacgtgaacgggtcagggtcgagtgtgatgattgggaaggtctacgcaatcgacggtggaaaagtgaccaagtcagtgtcgtgtcatcagagtttgtacccttacttactgtactattgccacagtgtacccaaagtgagagtatacgaagctgaaattcttgacgtggacaccaaggagatgatcaatcatggggttgccatctgtcaccttgacacgtcagcttggggcccgcaacatggggccttcttggctttggggtttggccctgggaaaattgaagtgtgccattggattttcgagaacgacatgacttggaccactgccaattga

SEQ ID NO: 90725 - DNA, 1695 bp, Glycine max
  Peptide Sequence Number=SeqID_207503
atgggttttcaacttgatgatgctattgagaaggaggattttgaagaagcggttaagttgaagagggctctagtggaagcaacgtccaaggacactgttgctgaagttatggatcagttgaaggcaagagcagcacaatttagtgctatagatgatgaacgatatcatgatgcatcaagattatgtaaatgcactggaagtggactgaatacgcccaatggtcgatcggagtgggaatgtagtgtggataaggtgggttggtgggtagggtacccaaaagcctctgatgacccctttggtagaattatacatataagtcctggtatgggtagattcattggcaagagttacagtccaagacagttgatgagagcatctactgggactccaatttttgaaatttatgtggtaaaaaatgctgatgacacgtatcatatgcaggtagtgtatttgcgacaagccaaaggaaagtcaaggagaaaccctcaatctgtacctgctaaaggcccatccaaacctgaggtggagaatgcatctgcagttgaggtgcaggaacctgaagagaagattgagagaaatgatgagaaaaacactaatatcgagggagtaactgaggaaggcattaaaagtgtcataaattttcttaaagaaaaaattccaggattgaaaatcaaagtcatgaatgttagcgttgaagaggaagcagcagaaaacaatgattctattaagcaattgatggaggaagatagcaataaaactggctccagtgagaatcatgaagaggaagttaataatcttgatgaacctgatgcggtcactctagaaagagatggagatgccacagaagaagaaaaggatttggaaatgaagcttttaattggtggggttgtacacaacaatgaagatactcctgtcaaggatgaatttatacgtcttccagctgaaataaaaaatatggaaaaggattcttttgtctttcattttgattgtggaaatgtagattatggtatcaaagaagataaaattcccaatatcaaagtagcagccctagcagcacaaggagtctccgagcttatgcctcctgatgttgctaatgcattttggagttctgacaaagtctcttctaagatctccaaaagcatgcgtgatattgtcagagttgctatgagtcaagcacagaaaagaactaaattatctggggatacaaattttagccggattatctgttcaagaggggattctgatccttttgatggactctatgttggtgcatttggcccttatggcatggaaatagtgcatttgaggcgaaaatttggacattggaatgaagtggacaatgaaaacaaaacttcagatgtgggattctttgaatatgtagaggctgtgaagttaactggggatcttaatgttcctgctggcctggtgacattccgtgctaaaattggcagaggcaatcgcatcaccaaccaagggatgtatcctgatgatttaggagtggttgctagttataaaggccaggggagaatagctgactatggttatcgaaatccaaaatgggtcgagggagaactgctccaacttaacggcaagggcatgggaccatacatgaaaggtgcagatcttggtttcctttatgtcgttcctgagcaaagttttcttgtgttgttccaccggttgaaactacccgagtga

SEQ ID NO: 90726 - DNA, 537 bp, Glycine max
  Peptide Sequence Number=SeqID_207504
atgaatataacctctcaatacatattaactctgtttactcttcaagtctatgatggcagaggaacacttgaagaaggtgaaacagcagaagctagattcatcaagattcaagctgcttatgaattgcttatagatggagagaggcgaagacagtatgatatggataactgggtcaaccccatgaaggcatctcaggcatggatggagtggcttataaaaaagcgaaaagctttcgatcagcggggtgatatggcaattgctgcttgggctgagcagcaacagcgcgagctaaatcttcgcgtgcgtcaactttctcgttcaaagattgatccagatgaagcaagaaggattctggcaagagaaaaaaaggcttcggctgaatattactcgaatacccttaaaaggcacacccttgtactgaagaaaagagatttgatgcgaagaaaggctgaggaagaaaagaagaagactatcagccggctcttggcagcagaaggtcttgagcttgatgattcagatagtgatgaggcactgtag

SEQ ID NO: 90727 - DNA, 786 bp, Glycine max
  Peptide Sequence Number=SeqID_207505
atggatgcagcaaagggattggaagcttctggggagacccttcgtgcagaagtgaaaacctttttcgattctgctcctcctttgcagaacagtgatgagataactcagaagttgaatcagttcattcaacgcaattcttcagctaggagaattgtttgtgtgacttctggtggcaccaccgcgccattggaacaacgatgcgttcgctatgttgacaatttcagttcaggtcacagaggggccacatccaccgagtattttctgaaggctggatatgctgttatctttctgtaccggaagagaagtttccagccattttgtagatcccttcctgatgatcccttacttgaatgcttcaagcccaaccatgagtccaacattcaagtttgcgaggcttattctgaaacagtgaagagggctatcgttgatcatcatactgcagtggcaggtggtctcttgttgaaacttccattcaacaccatatttgagtatctccagatgttacaaacaattgcaatgtcaatgaggtgtattggtccccgtgcaatgttctatcttgctgctgcagtgtctgactattatgttccttggaaggaaatggtagagcacaaaattcagtcaggatcatctcaccttttggatgtgaaactagttcaagtgccaaaaatgttgtcagtgcttaggaaagattgggctcctctggctttctgcatatctttcaaggtagtggttaacaaatcggttaaaaaatctatatggacctataccattttgactaaattgtag

SEQ ID NO: 90728 - DNA, 1240 bp, Glycine max
  Peptide Sequence Number=SeqID_207506
atggcggaatgcattgacgtgaagctctctcctgcaccggaccaaaggattccgttgatgagatcaagaagaggacggcggcgcggcgacacgtgggtggtgtcggtgttcgtcataatccaaatcggtgttttcatcgccaccatgctcgtcaacgattgctggaacaattctcacggcgattgcgttctccaacccctcggaaggttctccttccagcctcttcccgagaatcctctcttgggcccttctcagtcgaagttagatgaaatgggagctcttcgatggaaccttttgacagagcatcatcaaacatggcgccttttcacatttccatttctgcatgctggactcttccacctgctcctcaatctctccagtgtcatctatgtgggagttaacctagagcaccactttggacccataaggattggtataatctatgcattgtctgcctttgtgggttccttggtggcttctctttttctccaaaacatccccgctgttggtgcttccggtgctttatatggattactgggaacattgctttcggaacttgtttggaactggaaattccattccaataagatttcagcaatagcatcattagtctttgtctttgtgtgcaacttcgtccttggttttctgccttatgtagacaattttgcaagcatgggaggtttcatatcaggattccttcttggatctgtttttttactatgccctcagatccaacctgtagctccaaataaaggaggcctgattgattatggggtcaaaagttacgtcaagttaaagttgaaggaaaagctggacagaccagttctcaggattgtttctcttatcctcttcagccttttattggctggttgtcttgtggctgttcttcatggaatcaacatcagcagttattgcacatggtgtccatatgtcgactgtatcccttttacaagctggcactgcaaagacacagaaacctcttgtgagccaccgcatttacagttaaaggccatcaagccagagatgagtgcactgacacttaacaatccacagtgtgggcctatgcctgccaaatatgcattgggttcaaagttactgtacattaaaatgccaaaatcttctgagcaaattggacacctccacaagtcacaacctcgtgcttcatcaccattcggtgcaaccattagtttttggcgacatgtggcatcttctcatcacggtgaggtaaaggaagttgaag

SEQ ID NO: 90729 - DNA, 612 bp, Glycine max
  Peptide Sequence Number=SeqID_207507
atgaccggaaggctgcttgccggttcattggctcttgaaagctgcatcctccattatctaattgtccgtatcttactccccagatcttcaaaccttgcacaggtttctaaagaagatctaatagtcatgtgggcctttcataccggccgacaaattgattgggcacatctagtccagtatcgcatgcataaggcattgagattaaatgctcatttgccctatcctcacctagttaccttactccttcaacattttaacatccctcttgattctgaatcatatgttccaatcaagagatctttcttgatcggtgttgctatggttgcctcctttggttaccgcaaagagcgtgatggctcttgggtaaaaaagggtgctcaaacaaatgatgatgaaggaaacttatcggttgaaggggactcttctctccttcagagtattttggacatgtttgatgaacttcaaacctatgttggtgagaggtttgactccttggaacgtcaagtggacacacgattcgaggagatgaactcaaggattgcaaaggttgaagaagatgtcaccattattcgcgactgctttgatttacctccatcaccaccatcagtttag

SEQ ID NO: 90730 - DNA, 467 bp, Glycine max
  Peptide Sequence Number=SeqID_207508
atggaagagagcgagaatcagaggcgaatggagccccctaaaattcagcggctgagcgagtcggtggtgaaccgaatcgccgccggcgaggtcatccaacgccccgtctccgccgtgaaggagctcgtggagaacagcctcgacgccgcctcctcctccgtcagcctcctcatcaaggatggcggcctcaaactcatccaagtctccgacgacggccacggaatccgttttgaggacttgcccatactctgcgagcgccacacgacctccaagctgtcctcgtttgaggacttgcagcgcattaagtcgatgggctttcgcggcgaggctctcgccagcatgacctacgtcgctcacgtcaccgtcaccaccattaccaaaccccaattgcacgggtatcctatagagatggtgtcatggagcaccaacccaggccatgtgctgctgttaaaggaacgcagattatg

SEQ ID NO: 90731 - DNA, 1004 bp, Glycine max
  Peptide Sequence Number=SeqID_207509
tgcctgtaaccgtgcaattggggtttggtaatggtggtgacggtgacgtgagcgacgtaggtcatgctggcgagagcctcgccgcgaaagcccatcgacttaatgcgctgcaagtcctcaaacgaggacagcttggaggtcgtgtggcgctcgcagagtatgggcaattagaagcgaaggcgagagacgtttcgaatgagaagaagagaaggagggagggagtgactgacacggattccgtggccgtcgtcggagacttggatgagtttgaggccgccatccttgatgaggaggctgacggaggaggaggcggcgtcgaggctgttctccacgagctccttcacggcggagacggggcgttggatgacctcgccggcggcgattcggttcaccaccgactcgctcagccgctgaattttagggggctccattcgcctctgattctcgctctcttccattccgatagattcaatgtgctgaatgccaagggaagcaactcctcactcaacgctttcatacacaacttctcaattcggctcgcttctcctttgcgcgggctcctgagagacggtccttggaatttcgacaaacacctcttgaacttgggtccaatcaacgacaacgaagatccagtagtgcaagtgtcgttgttccacattcctttatgggtgcaaaaagtaggcgaaggactagggaattatgttgcaaagttccgagagtatgatgataaaggaaatttgaattttctacgcgcgtttatgaggatcagagttatgctggatgtgacaaagccagtcatcaaatcgaagaaggtgaagaagattgaagagggtggagccctgatctgcgtgcagaaaatcgctcgacaggaggctatggagggccacaattatggtgaattcaatgccaacatcaataacggattgcatgttaatgaggaggatctcattaaaagatgggtgattgataattctggagtcagccttttgattgtcaccttctaa

SEQ ID NO: 90732 - DNA, 173 bp, Glycine max
  Peptide Sequence Number=SeqID_207510
ggtttggggcagaacctgacatgatgatgcaaactagtgcaaagaaaacaatgatcacaaaggactggggttttgagaaatatattgagggttttataagaaagaacaaaatggattcacccagtgaagacctaacttttcatagttgcaaaagcaaaggatacttttgctag

SEQ ID NO: 90733 - DNA, 573 bp, Glycine max
  Peptide Sequence Number=SeqID_207511
atggctgcaaggaggaagacgctgcaaaattcttctgatgattattcaaagattgtagacttagtaagccggtttgctattcatcatattaatgtcagtttctcgtgcagaaagcatggagctgttagggctgatgttcacactgtggccatgtcttcaaggctcgatgccatcaaatctgtctatggggtctcagttgctcgcaatctgattgaaattgaagcctcagacaatgatccatctacttcggtttttgagatgcatggctacatgtccaatgcaaattatgctgcaaagaaaatcaccatggtgcttttcatcaatgatcgactggttgagtgttctgcattgaagagggctattgaaattgtttatgcagcgacattaccaaaagcatctaagccctttatatatatttcaattgttttaccaccagagaatattgatgtcaatgtacatccaacaaagagagaggtgagccttttaaatcaggaagtcatcattgagaagatacagtctgtggttgaatcaacattgaggagttccaacgaggcacggacatttcaagaacaa

SEQ ID NO: 90734 - DNA, 246 bp, Glycine max
  Peptide Sequence Number=SeqID_207512
atggtagccattgcaaaaggaaaatgtgggttctttcaccagttgatcatgaagttgtacggaggagcaagaaaaaggcatgaaaagggaagcgaggtaaattggtataaaaaggaagagaaaactcaacccaaactaacctattcgcaaacaggttggttcaggttgagtcaacaggtcaaaacatttatgatgtttccaccttgcatgaaaggacatggatgttgggttcaagggatgtggtga

SEQ ID NO: 90735 - DNA, 816 bp, Glycine max
  Peptide Sequence Number=SeqID_207513
gcccctccatcattagccaatgccatcatccactatgcgaccgccaacgtcacgcctcagcagaccctccacgagatatcagtctcagcaagggtacttgagaagaagtctccatgcaacttccttgtgttcggccttggccatgacagcctcatgtggacatcgctaaattacggcggccggacggttttcctcgaggaggacaagtcctggatcgaccaaatccaggagaaggtaccctctttggagtcctaccatgtcatgtacgacacacaggtccaccaggctgaagagctcatgaaaactggaatgaaggaggattgccagaaggttacggacccgagattctccaggtgccctcttgcacacaaggggctcccgagtgaggtttatgacattgattgggacgtgatcatggtggatgcacccaccggctacttcgatgaggcgccagggaggatgagtgcaatctacactgctggcttgattgcccggaacaaggaacgcggccaaaccgatgtttttgtgcatgatgtggataggaaagtggaggacatgttctctaaggcttttctctgtgaagggtatttcaaggagcaagaagggaggatcaggcacttcaacattccaagccacaggtctcggagtgaatgggtgctcgcggcgacatgcaccaatgaaggtctatacgttctaacctacgaacaaagatgcattttgggtgaagctgctgctgtgctacgcaacaacgatggcgaagttgggtcaagtcgacgtgaaccaagtggtgcatcgtgcgcgtgtgggtggaagtag

SEQ ID NO: 90736 - DNA, 1308 bp, Glycine max
  Peptide Sequence Number=SeqID_207514
atgtatgtggaagcagtaaacaaaaagggtaacgagcatgccaataggaatgcaacaacaggtgatcaaactatgccagctagtgagcaacaaaacctggaaaactggttgcccataagtgcttctagaaaagcaaaatggtggtattcaacattccacaatgtaacggctatggttggggctggcgtgttaggcttgccatttgctgtagcccagcttggatggattccaggtgttttcatgatcatgttttcatggatcctgacattttatgccctgtggcaacttattcacttgcatgaagtggtcccagggaagaggtttgatcgatactttgaattgggaaaacatgttttgggcccaaaaaaaggattctggctagtaatgccacaacagctaacggttcaggtggcttcagccattgtgtacactgtcactggtgggaagtcattgaagaagttgttgctttcccaaactcctaacttcaataaactgaaatcagtgtcttccctggctgctctcatgtctgtctgttattccatggtggcaagttgcatgtcaattgttgaggggattggacgtcatcatcatcatcatcatattgattatggagttcgatcccacacaacccctgggatagttcttgacgcattcaatgcccttggaaccatagcatttgcttttgctggacatagtgttgctttagagattcaggctacgttaccctccacagaagaaaaaccttccaacataccaatgtggcgaggtgtgagagtggcatacaccatagttattatttgctatatttcagttgcagtgtctggcttttgggcatatggaaatgctgtcgacgatgatgtcctcatcacactcgaacaccccaattggcttattgctattgctaacttcatggttttcattcatgtcttaggaagctttcaggtttttgctatgcctgtgtttgatacaatcgagacaactttggtgaaaagctggaattttactccctcaaggattcttcgcttagttagtcgaagcatatttgtttgcgtggtaggaattattggcatgtgtattccattttttggaggattgttgggcttcttcggaggacttgctttcacatcaacatcttatatgattcctagtatactatggcttgcggaaaaaagtccaaaaagatggagtttccattggattgcatcatggatttgtgtcattgttggtggtataatagcagtagttgcacccattggaggagtacgaacaattattgtttcggcaaagacttacaagctattttcctaa

SEQ ID NO: 90737 - DNA, 1500 bp, Glycine max
  Peptide Sequence Number=SeqID_207515
atgacaggaacatattcacgcataagctgcatgactcagcacctttgttccatgttggaactgaaacaagttcaagccattatcaccaaagcaggccttcactctcaccttcccttcactgccaagttaatcttcttttctgcactttctcctatgggaaacctctcccatgctcattccctcttcctacaaacttccatgcacaactccttcatttgcaacactatgattcgagcctttgccaactcttcctaccctcttcaagctctatacatctacaaccacatgcacaccacccaatggggtgaagttccctgcactgttcttaaactcgggttggaccaagacccctctattcagaactcgttgctctgtatgtactctcaatgtgggttggtccatgttgcacaacacttgtttgatgaaatcagcaataggagtttggtttcttggaatatcatgatatcggcatatgatcgtgtcaacgattctaaatcggctgattaccttcttgaatcgatgccacacaagaatgttgtttcatggaaccctgtgataggaaggtacatcaggttaggtgatattgagggtgcaagaagggtgttccaaattatgcctcagagggatgctgtgtcatggaattctctgattgctggttgtgtctctgttaaggattatgaaggagcaatgggactgttttcagagatgcaaaatgctgaagtaagaccgacagaagtaacacttatttcagttctgggtgcctgtgcagaaactggtgcactggaaatgggtagcaaaatacacgagtctctgaaagcatgtgggcataagattgaagggtatttaggaaacgcccttctgaatatgtattctaaatgtgggaagttgaattcagcttgggaggtatttaatgggatgaggataaaaactttgagttgttggaatgctatgattgttggtttggctgtccatggttactgtgaggaagctttgcaattgttttcagagatggaaagtggtcttgatacagttaggccgaatcgagtgacattccttggtgttttgattgcttgtagtcataagggtttggtagataaagcaagatggaattttgatcatatggcaaagcagtacaaaattctgcctgatatcaagcattatggttgcatagttgatcttttaagcagatttggattgttggaagaggcgcatcagatgattaagactgctcctttacaaaatagtgccattttatggagaacattgctgggtgcttgtaggacacaaggcaacgtggagttggctaaggtgtctttccaacaacttgccaaattgggacgcctaacagatggagattatgtgttgttatcaaacatttatgctgaagctgagagatgggatgaggtagagcgagtaaggagtgaaatgattggcttgcatgttcctaaacaagttgcgtacagccaaatcgatatgactgaatctgataagcttccctaa

SEQ ID NO: 90738 - DNA, 243 bp, Glycine max
  Peptide Sequence Number=SeqID_207516
atgaggaacaatatactaccaaccttcaggaatgatgtcaatagggctgaagaggtggttaaaggcagaagaaagggaactaacaacaacaaagacgcgagcgcgaatgagaagaggaagggatctgtgagggtggaggaattccctgagcagcctgtgcaagagaaagggaagatctcgcagtctctgatagagagtggtgggttggccaccgaagaaacggttataggcatgaatctttga

SEQ ID NO: 90739 - DNA, 567 bp, Glycine max
  Peptide Sequence Number=SeqID_207517
atggatatttcttttgctattctccagatgaacacagaattgctgaaacaaaaggcagaaatgctggaggagtattttggcattcatattgatgagcatggaaatgtctctagacttcctgtgatacttgaccagtacacacctgacatggatcatgtccctgaatttgctctttgtttgggcaatgatgttgattgggaagatgaaaagaattgcattcaagcagtttcagctgctttgggaaacttctatgctatgcatccactgatgttgcccaatccgtctggtgaaggtttgcttttttacaagaagagaaaaatgatggatggttatgctgaagagaatacctgtgataatactgggagtgacgtgattgacaataaagttgagcatgaaatgttttctgaagctgagactgcatgggcccagcgtgaatggtcaatacaacatgtgctttttccttccatgagactctttttcaaaccacctgcttctatggctactgatggaacctttgttcaggtaacttcgctggagaaactgtataagatttttgaaagatgctaa

SEQ ID NO: 90740 - DNA, 3177 bp, Glycine max
  Peptide Sequence Number=SeqID_207518
atgccttttggctcccccgacgccgtcgtcaagtacgtcttggagggacacgatcggggcgtcaattgggcctcctttcaccccgctctccccctcatcgtctccgccgccgatgaccgccagctcaagctctggagaatgaacgatacgaaggcatgggaggtggatactttgagagggcacatgaataatgtgtcatgtgttctttttcatgccaagcaggatattattgtgtccaactctgaggacaagagtattcgggtgtgggatgcgaccaagaggactgggatccagacgtttcgcagggagcatgatcggttttggattctggctgcacatcctgaaatgaatctgttggcggccggtcatgatagtgggatgattgtgtttaagttggagagggaaaggcctgcgtttgctgtgagtggtgatgctttgttctatactagggaccggtttttgaggttctatgagttttcgacacagagagagacacaggtgctgccaattcggcggcctggatctccaagtcttaatcagagtccaaggactctttcttatagtccgagtgaaaatgcagttctgctctgttcagatatagatggtggatcttatgagctgtattgcatatccaaggatggctatggcaggggtgatttgcaggatgccaagaaaggtgttggagtatcagcagttttcgtggctcggaataggtttgctgtgcttgacagaagcagcaaccaagtccttttgaaaaatctcaagaatgagattgttaaaaagactgttcttcctattgccactgatgctatattctatgcaggaacgggcaacttgatttgtaggtcagaggatagggttgtcctgtttgatcttcagcagagaattgttcttggtgaactccagaccccttttgtcaagtatattgtctggtctagtgatatggaaactgttgctttgctcagcaaacatgccattatcattgctaacaagaagcttgtgcaccaatgcactctccatgagaccattcgtgtaaaaagtggagcctgggatgacaatggtgttttcatctacacgacattaaatcacatcaaatactgccttcccaatggagatagtgggataataaagacattggatgtccccatttacatcactaaggtttctggaaacaccatcttctgcttggatcgggatgggaagaaaagagccatagctattgattcgactgaatatatttttaaactctccttgttgaagaaaaaatatgaccatgtcatgaacatgataaagaattcgcagctttgtgggcaggctgtgattgcttatctccagcaaaaaggctttcctgaggttgccctccattttgtgaatgatgagagaatacggttcaatttggcgttggagagtggaaacattcaaattgctgttgcgtcagctacagcgattgatgagaaagattactggtaccgtttaggggttgaggctcttcgtcagggtaatgctgggattgtggagtatgcatatcagcgtaccaaaaattttgagagattatctttcctttatctcatcacgggtaacttggagaaactttcgaagatgctgaaaattgctgaagtaaagaatgatgtaatgggccagtttcacaatgccatgtatatgggtgatgtccgagaacgggttaaaatcttggagaatgtgggtcatttgcctcttgcttacatcaccgcatcagtccatgggctacatgatgttgccgaacggcttgcagctgaacttgggaacaatgttccatctttacccgggggaaaagtaccgtctcttttaatgccaccgtcaccgctcacatgtggtggtgattggccccttcttagggtcatgcgaggcatatttgatggcgggcttgacaacatgaatcggggtgccgctgatgaagaatacgaggcagctgatgctgattggggtgaggagcttgacttggttgatgtggatgacttacaaaatggggaagttgctgcaattttggaggatggggaagtggcagatgaaaatgaagaagagggtggatgggagatggaagatttagagctgccccctgaagctgacaccccaaaggcttttctcagtacaagatctgtttttgtggctccaacccctggcttgcctgtaagccagatatggattcagaaatcgtctcttgcagcagatcatgcagctgctggcaactttgatactgcaatgcggttactgaaccgtcagcttgggataacaaacttttctcccttgagatccacatttcttgatcttagtactggcagtcattcctatctgcgtgcattttcatctgctccggtgatatcttttgccattgaaagaggttggactgagtcatcaagtgcaaatgtaagaggcctgccagcattgcctctcagactgccacaattggatgaaaggctcagagctggttataagtcaacaactgccgggaaatttaccgaggctcttaaggcattcaccagtattcttcatgctattcccttgattgtggttgagtcaaggagagaagtagatgaggtgaaggaattaatcatcatagtcaaagaatatgttttgggtttgcagatggagttgaagagaagagaaatgaaggacaatctaactcggcagcaggagcttgcagcttatttcactcactgcaaccttcaaaccccacatttgaggctagctttgttgaatgcaatgactgtgtgcttcaaggcaaagaaccttgcctcagctgctaactttgccaggaggctgcttgagaccaatcctactgttgaaacccaagccaagacagcaagaaaagtgcttgcagctgcagagacaaatatgactgatgccaaaccattgaactatgatttcagaaacccatttgttacttgtggtgcaacctatgtgcccatctatcgaggacaaaaggatgtctcttgcccttactgcacttcccgttttgtgccaagccaagagggacagctatgtactggtgcatctggcttgtgtctaagttttgttatgacgataaaaatggacattgagcatcaattattgcagaagatccctgaaacagaggcagtggaaccaatagctaatgaagaaaccaatcttgtgggtaccagatttggaggaatggcataa

SEQ ID NO: 90741 - DNA, 1113 bp, Glycine max
  Peptide Sequence Number=SeqID_207519
atgactttgacattcacagtcacatggatcttctggctgtgccaaataaggggcagatgcttgtctcaggtggtgcagccacgggttccaccggggcaacaggttccatgcttctacatattcggtgactcattggttgacaatggaaacaacaatgggatcctaacccttgccagggcaaactacaggccttatggcattgacttcccagggggtgccactggacgcttcaccaatggtcgcacttatgttgatgccttagctcagcttctgggctttccaacatatattgctccatactcaagagcaaggggtttggaactattaagaggagctaactatgcatctggagcagcaggcattagagaagaaacaggaagtaaccttggggctcatacatcattgaatgagcaagtggctaactttggcaacacagtgcagcagttgagaaggttcttcagaggagacaatgaatcacttaatagctacctaaacaaatgtctattcttttcagggatgggaagcaatgattaccttaataactacttcatgtcagatttttattcaactagctcagattatactgttaaagcttttgcatctgtccttcttcaagattactctcgcaagctatctcaactatattcgctaggagcgcgaaaagtgatggttacagcagttggccaaattggctgcattccatatcaactagcccgttttcatggtaacagcagcagatgcaatgaaaaaatcaacaatgccatctcgttatttaactcaggccttaagacaatggttcagaacttcaatggagggcagcttccgggagcgaagtttgtgtatctggatttttatcaaagcagtcaagatttatcttcaaatggaacatcatatgggtttgatgtgatagacaaagggtgctgtggagttggcaggaacaatgggcaaattacttgccttcctcagcaacaaccatgtgaaaatcgtcagaagtacttgttctgggatgctttccaccccactgaactggccaatattttactagcaaaggcaacatacagttcacaatcatacacttatcccattaatattcaacaattggcaatgctgtaa

SEQ ID NO: 90742 - DNA, 465 bp, Glycine max
  Peptide Sequence Number=SeqID_207520
atggaaagaggcgcacatgacgtagtggttgtggccggtgaggacggaaatgcaggtgcgggactgccagttccagatgcggatggtctggtcgtcgctggcggagacgatccaggggctctcgtggtggaactggacggtgcggacgtaatcaaggtggcccaggaggctgaagaggcagcggtggagcttgtagttccacagcttgatcttgtagtcgtcgccgccggagacgaagaggggctgggagtcgtggaagtggacgccacggacggggccctcgtgctcctcgaagcgatcgaccagggtgcccatgcggtagtcccacagctggatcacgccgctgtggaggctcgcaaggatccatggacgcttcttgtggaagctcaggcccttcacacggttgctcttcgtctcgaatttcgtcaacatcaagaagaagataaacaaaccaacaagagatga

SEQ ID NO: 90743 - DNA, 162 bp, Glycine max
  Peptide Sequence Number=SeqID_207521
atgacttataagaaagaagagcaggtacaaaggaagacatttggaccccttgattttgactataaagctactaagaactgcaatcgtgctgaacagttggtgttttataaatattttgtcgtcttaaacaaaaatgaaatgccacctatagatgttatctga

SEQ ID NO: 90744 - DNA, 717 bp, Glycine max
  Peptide Sequence Number=SeqID_207522
atgaagtcccgtagtgatgatggagaccagtgtgatggaaatgcatcacgcgttgtctgcgtgaacttcacgtgccagggtcctatgtggggctgcgtgcagaggtgttttgagttagctgtgcacgtggacggtgtgatggtctttggtgatgggcgacagtggtcgaggctgcatgcgcttcgatgcactggaaatgcatctagcatagaagctgtttggtgcgtctttaagacgtgcatgagggagtgtcgatggttcgttcttgacgctgtaaacacctttctcaactccaacatccaaactaatgctgattgtctgtgtttctctcttacttcaatcttccttatgcttgatggtgccactaaccagagtgtctgtgctgagggctgttccatattccatggctttgataaagagagattttctattttatttgttcttgatgacacattcttgtgcagcactattttcactggatggatgccgacaatacttcgagcaggtagaggaatgacgcgttgggaacattccaggcctgaccctcctccaggaaagttggagctcttctcatatgaaaataaccctaatgctcgaatagtgcgtgaggcattatgcgaattggaacttccttacattcttcaaaatgtaggagaagggtctcctcgaatgaagttactcttggatgcttctggatctaaagaggttagaatttag

SEQ ID NO: 90745 - DNA, 147 bp, Glycine max
  Peptide Sequence Number=SeqID_207523
atgaaaaatagtgctccattgaaacagacaaaactcagtcaagggaagggagcattcgatattgaatatggtgctatggattttgttccccatgcaaaccttgacaagctagccaaggaagatgttgctagctaccattcatcataa

SEQ ID NO: 90746 - DNA, 168 bp, Glycine max
  Peptide Sequence Number=SeqID_207524
atggagcgtgaaggagggatcagtccccgagtatctatcacctttggcacaggcatgttattgcaaaagtgcataggaagtaaaggccataagactaaagatcaccacatagacaatatggtggctaaaaagaatatccactgtgggaataacaaaatttccacttga

SEQ ID NO: 90747 - DNA, 768 bp, Glycine max
  Peptide Sequence Number=SeqID_207525
atgttttcagaaaagagcaatttcaatcttcaaaaaccagttcaagatgccgcagactcaaaaatatcatgcagcttactgaatgtggaaggtgggatagatgatgaagcatgcgaattagtcagtggagtggagctttctcttgtggagggtgatgaagatatccgtgattatctgttcaaggcagtcaaaaatgcaatggaaccggccaattgcttctttcagatgttttcgggtttgaggattctttcactagagatattgcatatcggtgaaattgcttctaaacaaatatgcagcattctagttccagacttatttcgtggatgtccgtggacaaaggaccagccagatgtgtttgaacagtggattgctagacaaaacccagagaggatagcagaagacattaccagatggacaaaatggctggttgatgaatttatggctgtaggaatttccaagaaacttggcattattggcttctgctttggaggtggccaagtgttaaaggtgctggccaaagaccaaggtgcttgttttggcactggaatctccttttgtggtacaaggatggatccccttgctgcttctgatataaaagctcctgtcttgttcattttaggggacaatgacccactttgcaaggtaagtgaaattgagaatgttcagaaaaaaattcgtaggggctccaaagtagtgatattcccaggtagaggtcacggatttgcccaccggcctgatctcctgaacaagcctacgttattatga

SEQ ID NO: 90748 - DNA, 1033 bp, Glycine max
  Peptide Sequence Number=SeqID_207526
atggctgctttagagcctatcaaggacaatgaagaagctgtcaaggcttatggaattcacctgggaactgaaatgtgcaaaaagattttagctcatggaattaagacattgcatctttatacactaaatatggagaaatctgcattggcaatactaatggtgaaccttggcctaattgaagagtccaaagtttctaggtccttaccttggagacgccctgcaaatgttttccgtgttaaagaagatgtccgtccaatcttttgggcaaatcgaccaaaaagctacatatcaaggaccataggatgggatcaatacccacatgggcgttggggtgattcctgtaatccatcatatggtgcattatctgattatcagttcatgcggccacgtgcacgggacaagaagcttgttgaagaatgggcagttcccttgaaaagcgttgaagatatatatgagaggtttagactgtattgccttggaaagttgagaagcaatccttggtcagaacttgatggtcttcagcctgagacaaagatcataaatgagcagctggagaagattaacacaaagggcttcctcaccatcaatagccagccagctgtcaatggggaaaagtcagattctcctactgtaggctggggtggacctggtgggtatgtttatcagaaggcatatgtagagttcttctgctctaaggaaaagctggatgcacttgttgataaatgcaaggatcgaacatctttaacttatatggctgtgaataaagatgggagctggaaatctaatgtgggtcaaactgacgttaatgctgtgacatggggtgtcttcccagctaaggagataattcaaccaaccattgtagatcctgtcagcttcaatgtatggaaggatgaggcatttgaaatttggtcaagaggatgggcaagcttgtaccctgaggatgaggcatccaggaaattggttgaagaggttgatgctagagttttgagaattctttctatttgtgtcacaggttgggggcagtcacttcttg

SEQ ID NO: 90749 - DNA, 303 bp, Glycine max
  Peptide Sequence Number=SeqID_207527
atgcctccacctttttcggtgacgcctttatcaccgaagatgcgtccaccacctccggcaatgaccataccatacatcccccttctctattgtgcctccaccaacgatctcgccgcaacaacacctttgggaggagaggtggtcgtctcagccacaatggatccagtaggatacatgggagttcatgatgatacgtgcagagttggaaatagactttactacgtcgtagcaaaacaagacgctctgggaaatgggagggtttttgagacgatggaagtggagggtgcaccaccgatgccataa

SEQ ID NO: 90750 - DNA, 834 bp, Glycine max
  Peptide Sequence Number=SeqID_207528
atgaagatcattgagaaaattcgcgcagcttctgctgatccaaacagggtggtgttctcatttgagttcttcccccccaagactgaggatggtgtggacaatctgtttgagaggatggaccgcatggtggctcacaacccctctttttgcgacatcacttggggcgctggagggacaacggctgatcttacattggaaattgccaacaagatgcagaacattgtctgtgtggagaccatgatgcacctcacctgcaccaacatgcctgtcgaaaagattgaccatgctctccacaccatcaaatccaatggcctccaaaatgtgcttgcacttcgtggtgatccgcctcatggtcaggacaaattcgtccaggtcgaaggcggctttgcctgcgcacgcgacttggtgcaacatatcagagctaaatatggtgactactttggcattacaatcgctggttatccagagtgcttttctgctcctttttccaccatcattttctcttacagtccattttctttctcttcagaggcacatccagatgttatagaaagtgatgggttggctacaccggagggttatcgaaatgatcttgcttacttgaagagcaaggttgatgctggagcagatctgattgtcacccaattattttatgatacggatatattcctcaaatttgtgaacgactgtcgccaaattggaataacgtgtcctattgtacctggaattatgcccattaataattacaagggctttatccgcatgactggattttgcaaaacaaaggaccttgggggagggtggttctcaaaggaagcattaaaggtcacttga

SEQ ID NO: 90751 - DNA, 390 bp, Glycine max
  Peptide Sequence Number=SeqID_207529
atggctgagaagaaggaaatgattcccaaacaatatgacatcgatgccaaatgggacgcctgcattgatctcaccgtccgtcgcttcgtctactccgcatctgccgggagtcctgttactcgatgggcatctattgcttttggcgctggagttggaattggatctgcatatgcagaatgttctcgtctgtttgatggacctccaacaaatttacccctacctaaggtctctgaaactgctactcaggatccaattgcaaggtatgggactttagtcccacattggaagtatgggattgtggcatttttaaggctttgggctctccaatggttagcatatgcctatggtgtggttctcctaaggttcttatcatataatcatttggcatga

SEQ ID NO: 90752 - DNA, 1557 bp, Glycine max
  Peptide Sequence Number=SeqID_207530
atgcagaaactgctacgcccttcttcagttcccttcctctctatctctgtcaccgtggctactccctttctttcgttgcctcccaaagttgcaaaccaaccaatgtcagcagctgctgctggttcttctctcaagcgccaactctcttattcccgctatttggcgctctctagtaccaacacttgctctgtctgcaggtgtctcagtctaacccacacccactcccaccccaagaataacaagacccttcttctccttaaccactctagaaaccgctccttgcattcggcttcagaaggctctttcatcacccaacccgaccctgttgagtatggttctcttgtggactcaaaagagaagccctttaactccaggctaaataggaggcaaaagggttctacttcttcttctcctgctccgtcaaatcctgatttgctggccatccccggtgtgggtcccagaaatttcagaaagctcgttcagaaaggtatcgctggtgttgcgcaactcaagcaactctacaaggataagttctttggcaaatctagtgacaagatggttgagtatctacagaattctgttggaataatccacaagaaccatgctgagagtataactactttcattaaacagagtgttgacgaggaggagttggaagacaattcctcttcctctgttcagaagaagcgcttaacattctgtgttgagggtaacattagcgttggcaagactaccttcctccagagaatagcgaatgaaacgatcgagttgcgtgatcttgttgaggtggttcctgaacccattagcaagtggcaggatgttggacctgatcactttaacattttggatgctttttatgccgagccgcaacggtatgcctacacctttcagaactatgtgtttgtcacacgggtcatgcaggaaagagagtcatctgctggaatcaagcctcttcgtttgatggagaggagtgttttcagtgacaggatggtttttgtacgagctgtccatgaagctaactggatgaatgggatggagatcagtatctatgactcgtggtttgatcctgtagtatcctccttgcctggacttattcctgatggttttatctatcttagggcaagtcctgacacttgccataagagaatgatgttaagaaaaagaacagaagaaggtggagtcagccttgactatctctgcgacctccatgaaaagcatgaaagctggttatttccctcccaaagtggtaatcatggagtattatctgtcaatcagctgccccatcatattgacaactctttacaccctgatataagagaccgcgttttttatctggagggtggtcacatgcattcaagcattcagaaggttcctgctttggttctggactgtgaacccaatattgatttcagcaaagatatcgaagcaaagaggcagtgcctatgtcccaattgcaaggtatgggacttgattcctacatctcaatctctacttggaactagactagtgcacagcctggctatgtgtgctgggactggagagcatagtgggatgtga

SEQ ID NO: 90753 - DNA, 849 bp, Glycine max
  Peptide Sequence Number=SeqID_207531
atgcatggttacagccgcctgggcggagcagcgcggtcgcctccgtcgtctcctcggttccggcacggccggagcaagagcagcagctggtgttcgtcgaaggagagcaattccatggagaagttggtctttattcttatgtcggcagtttttagaaggcgtggtttgcttctcttcgctcctttgctgtacatttcgggaatgctgttgtatatgggttccttgagcatcgatgtcgtcagtataaagaacggcgtcgttcttgtacacaagcgtgctcctcccggttctgtttataggagtcctcagctcttccaaaacttgtggcctttcatggaggctgataatggaactactctcaatgtgttgatgagagcatggactaaaaaggagcttagagagtggaagccctgtgctaacagaagtgttcctgaaatagaattgccaaagtcaaatgggttccttataattgaagcaaatggtggattgaatcagcaacgcttgtcgatatgtgatgcagttgctgtggctggactactaaatgcaactcttcttattcctatatttcatttaaatagtgtatggcgagactcaaggataggtcagatgggatatcagctcagaacagttaagggcaattttggtgacattttcgatgaaaatttcttcatacaatcacttggaaatcgtgtgcatgtggtgagagaactccctgatgacatacttcaacgatttgacaataacataagtaatattgtcaatcttagagtaaaaggttggtccagttcagctcactatcttcagaaggtccttcctcagcttttggaaatggggtgtgtgcctatctaa

SEQ ID NO: 90754 - DNA, 429 bp, Glycine max
  Peptide Sequence Number=SeqID_207532
atgaccatcaccctcgatgatgtgtcatgtcttttacatttacctatcagaggttgtatccttgatcacgtagaaatgagctacaccaagaaggttatcaaagatctattaaggttaaatcttgatattatgacagaccataaaacagatgttgcaacgtcagtaggcagcatggtgttgttgagttggctagaggggctatatcacacctatgttgctagtgcattgtatgtttgggctacaagggtgtatttgttgcatttgctcgacaataccatatttgcagataagagctcgacgcatgcatatatgtttgagcatcttccaaccattccagccgatgaaaaggtgttggagtatgaccacaagcagccgcttgcagctaggtggttgttgttaagggggtaccgaaaatgttattgtgactaa

SEQ ID NO: 90755 - DNA, 1788 bp, Glycine max
  Peptide Sequence Number=SeqID_207533
atggtggaaaaatctgaagcacttgctgcatttaaaaattttaaagtgcttactgagaaagaagttggtagcctaattaaagtacttagcactgatcgtgatggagaattcaactcacatgaattcgcaaatttttgtgagacccatggaatcaagaggcaatttacagctgcttacacacctcaacaaaatggtgtatgcgagaggaaaaaccgtacaattatgaacatggtgcgaagtattttgacaaggagtggagtttccaaaactttctggcctgaagttgtcaactggagcattcatattttgaatagaagtcccacacttgctgttcaaaatatgacaccggaggaagcatggagtggggaaagaccagcagtagatcatttcaaaatttttggaggtaatagagaagaaaggcaggaaccttcggagaatgtgcaacccgcaacaattgagcaacaaccaactggcaacccacacatttcaactgctgaaactgaagatgaacgacctcaacgtgttaagcaaagacctgcttggatggctgattttaagtgggtttacaagaccaagctgaaagagaatgacgaagtggaaaaattcaaggcaccgttggtagcaaaaggctacaaacaagagttcgggattgactacaaagaagtctttgctccgatagcaaggcatgatacaattagattggtgatttctttagcagaacaaaaatcatggtccatcttccagttggatgtgaaatcaacgttcttgcacggagacttggaagaacaggtatttgttgatcaacctcccggttacattaagactggaaatgagcataaagtgtataaactgagaaaggctctttacggactaaaacaagcacctcagaagtccatgatgattgaatttgatatgactgaacttggcatgttgcattattttttgggcattaaagttgtgcaatctgctgttggaatctttatttttcaaaagaagtatgtgcaagaaatattggacaggtttcagatgacaaattgcaattttgttaacacaccggttgagtatggtttgaaactaaccaaggatcatggaggaaaaaaggttgacaacacactttacaagcaaattgtgggaactttaatgtacttgacagcaacaggaccagatgttatgtatgctgtgagtcttattagtagatacatggacactccggcagacatgcatcttttggctgccaagagaatctttcggtacttgcaaggtactgtagattatggattgttttacaagatgggattaaagatagatttagttgactttacggatagtgattatgctgaagatttagataatcgaaagagcacttctggatatgcattcatgttaggctcaggagctgtctcatggtcatccaagaagcaaccaattgttactttatcaacaactgaagcagagtttgttgctgccacaacttgttcttgtcaagctatttggatgaggaaaattcttgaagatcttcattttgaaagacaagggcctactacaattttctgtgataataattcaactatcaaactctccaagaatccgattttacatggaagaagcaagcacattgatgtgaaatatcattttttaaggaagctcacaagaaatgggacgcttgatctcatctattgcagaagtgaagatcatatagcagatatatttacgaagtccctcaaatggcctatgtttcagaagctaaggaaattactcggtgttagcaagttggagaatctagtttga

SEQ ID NO: 90756 - DNA, 267 bp, Glycine max
  Peptide Sequence Number=SeqID_207534
atgttaggcatagtccccaaaccttatcctgatggccatagccccatatttattacatccagatatgcacgccaagttgcagaattttttgaatttgtgaagaaaaggaatgaggtctcatccaaggaaggaagtagccaagcccaaccgcaggtgctgctacctcatgagggtggcctgtggctaccagatgggaagccttttccccgggaagctctcaaatctttggacttcagacaagcagcaacgtcattcatgtccggctag

SEQ ID NO: 90757 - DNA, 556 bp, Glycine max
  Peptide Sequence Number=SeqID_207535
atgggtaatcgtttcatctgcatgacgaagaaggagtcgaaagatgttggatcgagaagcaagagaatgggtagatcacagaggaagctggtgagtgaggaagagctgcatcttcaggcactttctatggcacttcaacagcatcaactgtctcagaggtttgaaggctccatgtctaggagaattggctcctccagaaggcacgctgtctctgaatctttttcagccaacaagcaggttccagtaaatctggagaacattaaaataaagaagtttgtactaatccatggagaaggttttggagcatggtgttggtacaagactgttgcccttctagaagaagcagggctgcttcctgttgccttagatcttacaggctctggaattgatctcacagacaccaacaacgtcactacattggcagattattcaaaacctttaactgtttatctgcaaaaccttcctgaggatgaacaggtttggatgtgtgatattgaattgaagcatgttattgtccaccatactgctatatttcctgaagatggaaattttgccg

SEQ ID NO: 90758 - DNA, 285 bp, Glycine max
  Peptide Sequence Number=SeqID_207536
atggtgtcttctcttctactcacagaaagtcggacattagtacttggagaaacatggatgtctaatgatggatttgatgacgaagaatcataccatgagttttatgataattctgaaggtaacgaggtcattcttcatacatctctagcagatgacgatgaacagtcaagtgactatagttaccattcaaaatatcttcagactcctaatagcactagtgatgaaggatgtagtagtaaagctgttgtttatcatcagtataatgaaggtacaaagttttactaa

SEQ ID NO: 90759 - DNA, 366 bp, Glycine max
  Peptide Sequence Number=SeqID_207537
atggagactaaagttttgttgcaatgtgccgtgtttgcatatctgtgttttatcaaaattggctttgtgactaatctaacaagactatttcatgatgttgctttagccatggtttccatgagacatagccctcttggtccaataatggagaaactgtctctatctgctgacaaatatggtactggtcgccggttttacattcaaacattggatgatcgtgcgctttcaccagatgtccaagagaagcttgtgagggaaaatccacctgaaggagttttcaagatcaaaggcagtgaccactgtccattcttttctaagccacaatctcttcacaaaattttggtggaaatagctcaaattccttag

SEQ ID NO: 90760 - DNA, 312 bp, Glycine max
  Peptide Sequence Number=SeqID_207538
atggcgaacacttgttgtcccattgagctggagcctaggacactgaatcaagtgcagttcactcaagcaagggaagtagctgcagaggtggttcaaaagttgcaaccacgtgaagcatcagctctgtttattgaggggctcatgcatccaatacaggaggtgatgcacatggatgaaaacggaaacctaactgagaagctcgttgattgcatgaagaaggctgagtctatccctgatgacaaagcttgccattgccagtgctcgtgcgctgctgtaaacccatttaaagaaccactttctgcaccgttttga

SEQ ID NO: 90761 - DNA, 117 bp, Glycine max
  Peptide Sequence Number=SeqID_207539
atggaatcaagtgttaagcaacagcacaatggtgggctgtcacttggaaagaaaacaggttttgtcgctgtgactcctccaatagggtccaagttagccggattcctctgctgctaa

SEQ ID NO: 90762 - DNA, 936 bp, Glycine max
  Peptide Sequence Number=SeqID_207540
atgaaggccactgaggccacagtaaaacagcaaaacgtacaatctggaaattctcctatttcaactcctgcaaaacagaaccagagacgtgaagctagtggaagattgattaggagcatacttctaaataatgaagctcgtcaaagtcagtctacaactggtacacaacataaaattcaaattttaagttctgagaatgggcagcgaccctctcgtcgttttggttcaaggtctgggttaaataatcaagtctcaaatcatgatgctgcacaaattaattccgaaggggattctagaagagcattggacgaaaagttcataaaaagggatcttcatggtttggggagcagtgccaaaacagaaaaacgtactagaaacaaggatagacctgatcgaggtgtttggacaccccttcgtcgttctgatgtttcgcatgctggtaacgactattcatcatcctcattggcacagcctactcagtcaaatcctgaatctgctgaaggagaagtaaaagaaaatgttccttctggaaacaggggaggtgaattctctgcttctgcaggtggacacggtggcaatccttcaattgagaatggttctcaaagaaattttattcatcatggagcttcctatgtagtgaaggatgatggtgcagtcagtagtataagcaaagggaaaccttccaagaaaagtgttgggcatagtgctcacgagtcagggcatcattcctgctatggtctccgtataggacgtaatcctcaactaattcaggtcaacctgagtctgagcgacttgaaaggatggctcagtgtaagaggttctcacctgggaagttgggggaggatagatatatgcagccccacccctcaacctgagaggttgtttatagaattagaacctgtgacctgcaagttacaaggcagtaatttgaaataa

SEQ ID NO: 90763 - DNA, 309 bp, Glycine max
  Peptide Sequence Number=SeqID_207541
atgaacaggtgtttggctgctggaaacttgggagaggaaagtgcagagagtgagaaacaggcatatgcggcttcacgatgcaaaaacacgggtgaagtagtggcaactgctgtagcagggggtgggctatgcaatttccttgtaacagaggctgctaatcctaaaatgcctcactgcatgaatgggtataggacaccaaaaatccgcttaacgaatccacgtttaatattgcctgagccaggcttaccaggcaaagcagctctagatcttctgcaaacttttgccactgctgatgaagcctatcattga

SEQ ID NO: 90764 - DNA, 453 bp, Glycine max
  Peptide Sequence Number=SeqID_207542
atgcagaggattcctgaagaatttattaaaagatttggagatgaactatctaatgttgctacggttactgttcccgatggccgtgtttggaaaatgagattgaagaaatgtggtaaagatgtttcgttccgcagcaaatggcgagagtttgtagaatactattctctcggttatggttcctacctagttttcagatatgaagggaattcaaaatttcgtgttctgatatttgatactacttctgctgagatttgttatccagacttggacaataggaagaggtccaaggttgatgatcaaacaagaaagaaagagcataaggaagctattgatgaagatgatgtgaatttgaaagcatggaagaaagaaagtgattgttcggagatagcaaaggatgcttctaccaagccaaaacacccttctgttacttgtaccatccagccttatcggttg

SEQ ID NO: 90765 - DNA, 576 bp, Glycine max
  Peptide Sequence Number=SeqID_207543
atgaaggtccgttcggaaagggaaaagacgaaagttgtgattaggcatttgcccccttctctcactcaatccgatctcttccaacacatcgattctcacttcgcttctcgctacaattggttctccttccgtcccggcaacaacagtcacaagcgtcagaggcattcccgagcgtatatagacttcaagtgtcccgatgacgttttcgagttcgccgagttctttgatggacacgtttttgttaacgagcgaggtgcccagcataaagtgatagttgagtatgcaccttctcagcgtgttccaaagccaagtgccaaaaaagatggacgtgaagggactatattcaaagatccagattatcttgagttcctcaaactaattgcaaaacctcaagagcatcttcctagtgcagagatacaattggaaagaaaagaatctgagcaagttggggccagcaaggaaacacctattgtcacacccctgatggaatatattcgtcagaaacgtgctgttgacagtggtatgcaggttctcctccagggtgcatttacttcggagcttaactttattgattga

SEQ ID NO: 90766 - DNA, 330 bp, Glycine max
  Peptide Sequence Number=SeqID_207544
atgagtattcagagcgaaagaattaaattgtcagttaggaagggggtttggttgatacttctccaagagttcatcgaacacgtcaaattgattttggaaaatgattggtatgcagccaatagatgtatatctagtgagatacaaaggaaaaagagagaagtgaaggatatgataactgacgttgagaggattcagcaagtaaacatggtttctggaccagaactgaatgtcattcaggcattagcttcccgtaacttcttcaatccaaacatgttggacggtggaactgtttaccctcagacagataagaagattcttcatcttgggtaa

SEQ ID NO: 90767 - DNA, 219 bp, Glycine max
  Peptide Sequence Number=SeqID_207545
atgggaagggggaagatcgaaatcaaaagaatcgagaacacaacaaatcggcaagtgaccttctgcaagagaagaaatgggcttctgaagaaagcttatgagctgtcagtgctgtgtgatgctgaagtttccctcatcgtcttctccagccgtggccgtctctatgagtattccaacaacaaaaactcgtcatctgttataattaaaatggttaattaa

SEQ ID NO: 90768 - DNA, 312 bp, Glycine max
  Peptide Sequence Number=SeqID_207546
atgcattgtttagctaaaacattcacgtcgagtacttggtttgggaaaaaaagccattcaagcttagctggtcctctctcctgtctctctctctctgtctgtctctctctgtctgtctctctctcaagcacatacacaaacaaagtaagggctataaataggagggatggaagtggaagaaagtctatagcgaagtttcatttctttggattagaaatttttcccaaagctgatcgagaagccagccaggccagacttatgcatcttcttgtgctaaaacaaaaggtctttggtctaatttcttcgagctga

SEQ ID NO: 90769 - DNA, 456 bp, Glycine max
  Peptide Sequence Number=SeqID_207547
atggatgggggcattctaattaatgatatttgtgctgctaccagggagctcagaatagcttgtacgttggcacaaatggagcgtgaaggagggatcagtccccgagttcgagatgctgggaatcttttgactagggcaggtttcacccttccaggggttgatgttgatgagtatgtagttaaatatgaaagtgctctggagcttatagaacatctccgtgcaatgggtgaaacaaatgctctttatcaaatgaacaatatcctaaagagggacacagcgttagcaactgcagctatttatgattcaatgttttctgcagaagacggcactgtacctgcaacattccagccttgtaggtttaatgggacgaaagatattgggaaaaacctaagtcccatattagttagagataaagtcaagatagagtatataagtgagagacaaccctcaccctga

SEQ ID NO: 90770 - DNA, 726 bp, Glycine max
  Peptide Sequence Number=SeqID_207548
atgacatttcggccaaggattgttatggattcgctcagtgatgatgaactcgcccagaagaaggatcgctggtatcgcattgtggaggagatgttggcggaagccggcgtcgccatcaacggcccgcgcgcctgggatatccgggtgcacaatccagcgctgttcaaacgcattttgcaggaaggctcgctcggtttcggcgaaggctatatggacggctggtgggagtgcgaacggctggacatgttgttcacccgtattctgcaggccggcgtcgatgagcggctgccgaaaagcctgagcgacatcgcgcgcatcgcctatgcccggctgttcaaccgccaatcgcgcaagcgcgcctggcaggtgggcaaagagcactacgacatcggcaacgacctgttccgggcgatgctcgatccttacatgcaatactcctgcggctactggaaagaggcgcagacgctcgagcaggcgcagcaggccaagctgcggatgatctgcgaaaaactgcagctgaagccgggcatgacgctgctggatatcggctgcggctggggcgggctggcgcagtttgcggcgcaaaactacggcgtctcggtgcacggcgtgaccatttcggccgagcagcagaagctggcgcaggcacgctgcgccgggctggacgtcgagatcttgctgcaggattaccgcgatctggatcgccagttcgatcgcatcgtatcg

SEQ ID NO: 90771 - DNA, 802 bp, Glycine max
  Peptide Sequence Number=SeqID_207549
atggaggccatgatgagcatgaagaagataatggaagccaatgcggttgcagttgccgctaccagcattgttgctaaggtgaacccgaagtccccatcgggcctcaaccaaatgaatcatccaacctcagctatgacacatgaaattccccatcacaatctagccgactttgagccttggctcggatatgccactgaagggcaagcagttggtggtataccccttgaaaacacttcggaaggccctcagctcatggtcattgaaggaggtgaagattatgctaacctagaagagttgttcctagtacccaatatcatcacccctctcaagttcaaggtgctggactttgacaagtacaaggggattacttgccccaagaaccatctaaagatgtattgtcggaagatgggggcatgcgcaaaagatgaggaactgctgatacattccttccaagaaaatcttactggggatgcaactacagaacatgtgcaaaaagagggcacagatctttcaaaggatacgcccaaagatggagaaacctggcagctcaagtggcacctcaatgacgaaaaaatgatgacaatgatagtagacacattaccagtattctactatggaaaatggtgggttacacaccttcaagctttgcggatttggtcttcaccggcagaaggatcaaagcggggtgaggatgaaggagaagcccgtgctgtgactgccattcctatacagccaagtttcccaccaacccaacaatgtcattactcagccaataaccaaccttctccttacccaccgccca

SEQ ID NO: 90772 - DNA, 1482 bp, Glycine max
  Peptide Sequence Number=SeqID_207550
atggtttttccaaaacccgcttctgagtctgatctctttcttcattccaactttgcttctcgttatgccagggactctcttcccaggttcagcatacccgaggactccatgccaaaggaggctgcgtatcagaacatacacgatgagttgcagcttgatgcaattccaaagctgaacttggcttcctttgtgacaacttccatggaagaagagtgcaacaagctcatcatggaatcgataaacaagaactatgtcgacatggacgaatatcctatcaccactgaccttcacaatcggtgcgtgaacatgatagcacgtttattccatgctgaaattggagaaaatgagattgcaactggagcaggaaccgttggatcatctgaggccataatgctggcagggcttgcattcaagaagaagtggcagaacaagcgcaaggaagagggaaagccttatgataagccaaatttggtgactggttccaacgtgcaggtatgttgggagaaatttgcgaggtattttgaagtggagttgagagaagtggaggtgagggaaggctactatgtgatggaccctgccaaagcagttgaaatggttgatgagaacactatttgtgtggctgcaatcttgggttcaacttacaatggagagttcgaagatgtcaagctcctaaatgacctattgctagaaaaaaacaagcaaactggatgggatacacctattcatgtggatgctgcaagtggtggctttattgctccattcctttatccagagttagaatgggattttagactcccattggtgaagagcataaatgttagtggccacaagtatgggcttgtttatgctggcattggttgggttatttggaggaccaaggatgacttaccagaagaccttgtcttccatattaattaccttggagctgaccaacccaccttcaccctcaatttctctaaaggttctagccagatcattgctcaatattatcagctaattcgtcttggccaagaggggtaccgaagcataatggagaactgcagagaaaatgcaatggtgctgaaggaagatttggagaaaagtggtcactttaacattctctcaaaagacgatggtgttcctgtggtggcattttctctcaaagacagaagccggtacgatgagttcaagatatcagagatgttgcgccgccacggttggatcgtgccggcgtatccaatgccacctgctgctcaacacatcaatgtgctccgtgtggtcatcagggctgagttttcacgcacccttgctgaacgccttgcgtttgacatacacaatgtgatggatgaacttgaaaagttgcatccccccatagtgaccaaaaacacaaaggaagagaacaaggccatggttgaaaatggggtgaagaacactgcattggatgcacacagggaaatcattgctcaagaatccaacaagcgtcagaaaatcatggcagcttag

SEQ ID NO: 90773 - DNA, 654 bp, Glycine max
  Peptide Sequence Number=SeqID_207551
atggtggcgagaggcgtgccggcgatggcggtggtggccgttgccgcccttgacttgacggaatcctccaactggtggcgggacatcaaccgctccccgctctggcaggatcgcatcttccacctcctctccatcctctacggaatcgtcgccgccgtcgctctagttcaattagttcgaatacaatggagagtgccggagtatggttggaccacgcagaaggtctttcactttctcaatttcattgtgaatggggttcggtgttttgtttttgtcttccgtcgggatgtgcagaagttgcagccagaggcacgtgccgtatctactgatggtctcagaccaagtttctatacgattaatgctgtggtttatgttattcaggataaggcttataaaaaatttgtttctggagtaaatgagggtgagccgttgattgttgttgcctgtgttggaactgagtcaccagccaccacatttccagaagcatgtgcccataatccctacagactccccccccccccaatgcagctcttaaccattggccatccatactttcaccatccctccactcctagccttgaaatgtgttctacatcattgtctgttgaattttatttttcaggggtggggttcaaaatacaaagaaattactga

SEQ ID NO: 90774 - DNA, 723 bp, Glycine max
  Peptide Sequence Number=SeqID_207552
atgataaattcgttttggtgggtccctaataagcaacaaaggagaggcatcaaccagctaaattgggacaaaatgacaatgaagaaagaagatgatggtatgagattcagacacttgcatgcctttaattttgccatgttgggaaagcaaggttggagatttatggccaaccaaaaatatctcgtggaagcaatctttagccaccatgatgctgaaaaaattctagctcttcccctcttgaacgtgatggagaatgataagataatagccatcttagaagtgaaggggattggatgctcatttggaagcttcggcaactccaaaaataaagcacttcttacggagacttttaagcttgtgatcacgcttaacatgtatggatggaagcaggactatggaacatcattgaacaaaagtgggatagtggagatcgctttctctcttttatttttactctcttgcaggaatccattccacaaattagagtcaaaattggagcggtcctttggtgtatttggaagacacgcaacacaaagctttgggaacaaatatccactacacctcgggttgcctactccactgcaatgcaaaacatcactcaatgggaagaagtccaaaaaccaaactatccagcaatattctcaaacgagcagcaacatcacatcgtggtctcctctgcaacaaaattacttcaaatgcaatcttgatgctgctactttctag

SEQ ID NO: 90775 - DNA, 2559 bp, Glycine max
  Peptide Sequence Number=SeqID_207553
atgttgctttttgcgcgcaacatcggtggcagggcctcactccgagtaagctcctttcattcctcaccccttcaaaacccttttcctcttttcctcactccttcatccctctcctctcaaaattcaatttttgctcgccccgtgatttggttcaccagctttctgtgtgttataagatacccctttgtctcaaaaccttcttttgatgacattgcttccgaatcaatgcgtagtttcttgcagcaggacggtcctcacttgtctgattcagcattggcacccatttgggtgtctaaggctttggtgaagctgaaaggggaccctaaatcagccctgaagttcttcaaggaggcaggggctcgtgccgggtttcgccatgccgcggagtcttattgcgttttggctcacattttgttttgtggaatgttttatcttgatgccagaagtgtcatcaaagagtggattttgttggggagggagtttccgggttgtgatttctttgatatgttgtggtctactaggaatgtttgtaggcctggttttggagtgtttgatactttgtttaatgttttagtggatttggggatgcttgaggaggctaggcaatgcttttggaagatgaacaagttcagggttctaccaaaagtgaggtcttgtaatgagcttcttcacaggctttcaaaatcaagcaaagggggattggcattaagttttttcaaggatatggttgtggctggcctctcgccctcggtttttacatataatatggtgataggctgtctggccagagaaggggacttagaagctgctaggagtttatttgaagaaatgaaagctaagggtcttaggccagacattgtcacttataattctctcattgatgggtatggaaaggtagggatgctaactggagcagttagtgtatttgaggaaatgaaagatgcaggatgtgaaccagatgtgataacatacaattctcttattaattgcttctgtaaatttgaaagaattcctcaagcttttgagtatctgcatgggatgaagcaaagagggttgcaaccaaatgttgtaacttatagtacactaattgatgcattttgcaaggcaggcatgttactggaagcaaataaattttttgttgacatgatacgtgttggtcttcaacccaacgaatttacgtatacatctctgatcgatgcaaattgtaaaataggtgatctcaacgaagcatttaaactggaaagtgagatgcagcaggctggagttaacttaaatattgtcacctacactgcattactggatggtctttgtgaagatggaagaatgagagaggcagaagaattatttggggcattgttgaaagctggatggactcttaatcaacagatttatacttccctttttcatggatatatcaaggctaagatgatggagaaggccatggatattttagaggaaatgaacaagaaaaacttgaagccagacctgttgctgtatggaactaaaatatggggtctttgcagacaaaatgaaatagaagattctatggctgtaattcgggagatgatggattgtggtctgactgctaatagttacatatatacaacccttatagatgcatattttaaggttgggaaaaccacagaagctgttaatctattacaagagatgcaggatttgggtatcaagataacagtggtaacatatggtgtactaattgatggtttatgcaaaataggtttagttcaacaggctgttagatactttgaccacatgactagaaatggtttgcaacctaatattatgatttacactgctctgattgatggcctttgtaaaaatgattgtcttgaagaagccaagaacctgttcaatgagatgctggataagggaatcagtccagataaattggtttatacttctttgattgatgggaacatgaagcatggaaatcctggagaagctttgagtttgcgaaatagaatggttgaaataggtatggagctagacctgtgtgcttatacttcactgatttggggtttttctcgttatggccaagtacagctggcaaagtcgttgctagatgagatgctcaggaaaggcattattcctgatcaagttctctgtatttgtctattgagaaagtattatgaactaggagacatcaatgaggctctggcacttcatgatgatatggcgaggaggggcctaatttctgggactattgacataacagttccctcttgccttactgctgttaccaaattgcacaagctctgtgcttcacagtcaggaactgactttcacagaacagcaaatctttatttggcagatgtagaggagttcagccatagtgggatgcccttttcaccactgggacatgcaaggttgttcacttgcttggaagctgaggcgctttatgcacctgatatgtgtacttcgcttcatgcaggcaggaggctgcttctagatgacatggatccaagaggtctagagctagaaatttgtgaatcattccaatgggtggaaagtttcaggcttatcttgttctctccctaa

SEQ ID NO: 90776 - DNA, 645 bp, Glycine max
  Peptide Sequence Number=SeqID_207554
atgatgaagcttgcaggatattccctggccgtttcatttgctcccataagttctaatgtcgttaaaagcaataaaagattcacggtaggtatatctcataggaataggtgcagctataggctgttttctactcatgcccagaaacaccaattacatgagaaacctggggtggttgccagataccaccttcctccttggtttagtgttgctccaatgatggactggacagaccatcactataggactctagcgcgcctcatatcaaaacatgcttggctgtacacggagatgcttgcagctgaaacaattgttcatcaaaaggacaatttggacagattcttggcatattctccagatcagcatcccattgtgcttcaaattggagggagtaatatagaaaatctggctaaagcaactgagcttgctaatgcttattgctatgatgagatcaacttaaactgtgggtgccctagtccaaaagttgctgggcatgggtgttttggtgtgagccttatgcttaaccccaaggtttcttctttatcacccactaagcatttcataattcactcgcggaaggcacttctcaatggcattagccctgctgaaaataggagtattcctccactaaagtatgtgctaatatga

SEQ ID NO: 90777 - DNA, 627 bp, Glycine max
  Peptide Sequence Number=SeqID_207555
atggaaacgaggacaaggttcccagaactagttatacaagaagagaagcgtgttcgctttgtggtagttaatggattaagaattgttgaaaaacctaataatgtgccgattgatgatgctgagtggtttaagagattgacgggtcggagtgaagttgctatctcagccaatgattacaaattttactctccaagacacaagtataggcgtggtgcatcaatttcactttcaaatatccaagatatccctagtattatctcttaccagccacaaaatcagcagcaaacaccgtgcaaacatcacttgcagtcattgccacatcaacctcagcttcatccagttctccagaacaatcaaactatgcaccaaagtcagcatgcagggccctattctcataaccctcaaagtggtccttcacacctacctgaaatttctcatgctcaccagccaatatcaatatctcaacacatgacttgcttacaaccactcactggtggcaatgttggaggacgcttgcacatgctgccaacaactcctgcaaagttttgtgatgaatgcggggctccatatctgagggaaacatccaagttctgctccgagtgcggttcgaagagattaggaacatag

SEQ ID NO: 90778 - DNA, 291 bp, Glycine max
  Peptide Sequence Number=SeqID_207556
atggagttgcgagtctctctgacttttattgttccccttgtttatcatctccagtcataccaaatggccaacagagttcaaattcctaccaacaattcagccctcattgctatgattgcagatgaggttgcaaatatgataaggtttttggttgatagctataacaagcctgttcctgcaatacttgaaatcccttctaaagaccatccttatgatccagcacatgattcagttctgtcacgagtgaagtatctcttcaataccgaatcagttgcatctgggagacgctga

SEQ ID NO: 90779 - DNA, 384 bp, Glycine max
  Peptide Sequence Number=SeqID_207557
atgttgagtgcgacggcgatcggcgcgttgttgggtttgggaacccagatgtactccaatgctctccgcaaactcccctacatgcgccatccgtgggagcacgtggtcggaatggggttgggagcggtatttgtgaaccagcttctcaaatgggaggcccaagtggagcaagacctcgacaagatgctcgaaaaggccaaagccgccaacgaaagacgttacataggttccccttttcttttcaatccaaactatagttgtgaggaatctggaaccttttttgaagttgtgaggaagctgaaactgaattggtctttgcaatggctattttggagaaaaaggatagagggtgcctctgcaggaatggttgatgtggattgttag

SEQ ID NO: 90780 - DNA, 1203 bp, Glycine max
  Peptide Sequence Number=SeqID_207558
atggctgttaaagaaacatatggaattaacagtgctgcaattccttgtttgaatcatgataaagagtataaagagaattctactatgaatgataggcctgtcttactccagctatttgttacagtcagtcctaaactatgtcaggcagtaaaacatcacgttgtgcgattgaaaagaatcatatgtggtggcaatatttctgctgaaagaaattctattgaggaagatattgttgatgttgatacgtcaatacagtttaagaatacaccagactcttttatgaatcttcctatcgactcatatccccttgtgataacatttcagaagtttctaatgatgcttgatgggactgtgggaatttcctatttagagagattcagtgacttatcttctgatgctaagaacctcagtgcaaggtctgttgctttggaaacattcatcagaaagaaagagtacactaagaaacttgattcctctagggtgttcactgaaatcatatcccatataaaagggggtatgcaaggggtggaatctagcgatggtaagctaagccgtgaggaatatctttcattatctgaaaatcaaggatcaagtcttaccaggccgaaaagagagatcatacatgatgtttatcaaagttatgagaaaatgaagaatgataaaggggattttgatttggcggacattgtaatttaccttcaccgtcgtctcaaaatgaacaaatatgagggtgacaagatgcactttttgtacattgatgaggttcaagatttaaccatgactcaaattgctttgttcaaatatgtgtgccaaaatgtagaagaaggttttgtgttttgtggggccactgctcaaacaatagcaaggggactagattttaggttccaagatatcaaatctctcttttacatgaaatttgtgctagaatcaaagggaaacacatacaatcaaggaaaagatgtattgctgtacaacttttttgactcttcacctttgaaaaatcgagggagagtgatatatgagtatatgaaggaacaagatatgctagaacctacagaacataagtcgtatccaaatttcagagattccaaacacaatctcttgagctctgaacttaagcagttatatgtggctataactcttacaagacagagattgtggatatgtgagaatacggaggaatactctagacctatgttttga

SEQ ID NO: 90781 - DNA, 3819 bp, Glycine max
  Peptide Sequence Number=SeqID_207559
atgacgaagttttcaacttttgcaattgcgttccttttgtgtttttcttctatgctactagtccttggtcaggtcaactcagacagtgagagcattttgagattgttgttggaagtgaagaaatcttttgtgcaagaccaacaaaatgttctgagtgattggtcagaggataacacagactattgcagttggagaggtgtgtcatgtgaattgaactcaaactcaaactctatatcaaacactttagatagtgactcggtgcaagtagtagtgggtctcaacctttctgactcgtcactcaccgggtcaatatcaccttcactcggtctcttacaaaacctgctccaccttgatctctcctccaacagcctcatgggtcccattccacctaacctctctaacctcacttcattgcaatctttgcttctcttctccaaccaactcacgggtcacattcccactgagttgggctcgctcacgagtctccgagtcatgcgactcggtgacaatacactaacgggaaagattcccgcgtctcttgggaacctggtgaacttagtcaacctcggcttggcttcctgtggactcactgggtcgattccgaggcgattaggtaaactcagtctcttggagaatctgattctgcaggacaacgagttgatgggtccgattcctacagagttggggaactgctcaagcctcaccatcttcactgcagctaacaacaaactcaacggctcaatcccgagtgaactgggtcaactcagtaatctgcaaattctcaactttgccaacaacagcttatcaggggagattccgagccaactcggtgacgtgagccaactcgtttacatgaacttcatggggaaccagctcgagggtgctattccaccgtctctagctcaactgggtaatcttcaaaatctggacttgtcaacgaacaagctcagtggaggaatcccagaggagttaggcaacatgggtgagttagcttatttggttctgtctggtaacaaccttaattgtgtcataccaaagaccatatgttccaatgcaacaagtttggagcacttgatgttgtcagaaagtggacttcatggtgatattccagctgagttgagtcagtgccagcaactaaagcaacttgatttgtccaacaatgcactcaatgggtccataaatcttgagctttatgggttgctggggctaactgatcttttgttgaacaataacagcttggttggttccatctctcccttcatagggaacctcagtggtttgcagacacttgctttgtttcacaacaatttgcaaggtgctcttccaagagagattggaatgcttgggaagttggaaattttgtatctttatgataatcaattgtcagaggctatacctatggagattggtaattgttctagtttgcaaatggttgatttctttgggaaccatttcagtggaaaaattcccatcactattggaaggctgaaagagttgaactttcttcaccttagacagaatgagcttgtgggtgagattccagccaccttgggtaattgtcacaaactgaacattcttgatttggctgacaatcagctctcgggtgcaatccccgcaacgtttggattcctcgaggcgttgcaacagctcatgctctacaacaattctcttgaaggtaacctccctcaccaattgataaatgtagcaaacttgaccagagtgaatctttcaaagaacagattgaatggtagtattgctgcattgtgtagctctcaatcatttctttctttcgatgttaccgaaaacgagtttgacggtgaaattccttcccaaatggggaactcaccctcccttcagaggctgagattgggtaacaataaattctctggtgaaattccaaggacattggcaaaaatccgtgagctgtcattgttggacctctcaggaaattcactcactggaccaataccagctgagctttctttgtgcaacaaattggcatatattgatttaaacagcaatcttctttttggacaaataccatcatggcttgaaaaattgcccgagttgggagagcttaagctctcctccaataatttttctgggcctcttcccttaggcctattcaaatgttccaaattgctagttctctctctaaatgataactctctgaatggaagtctcccatctgatattggtgatcttgcataccttaatgtcctcagacttgaccacaacaagttttctggacctatccctccggagataggtaagttgagcaagatttatgagctctggctctctagaaataacttcaatgctgagatgccacctgagattggaaaacttcaaaatctccaaatcattttagacctcagttacaataatctctcaggccaaatcccatcttctgttgggactctgttaaagttagaagcacttgatctttcccacaatcaactcactggagaagtcccaccacatattggggaaatgagcagcttgggaaagcttgatctctcttacaacaaccttcaaggaaaattggataagcagttctcccgctggccagacgaggcatttgaaggaaacctacagctttgtggaagccctcttgagcgttgccgccgtgatgatgcttctaggagtgcaggcctaaatgagtcattggtagcaattatatcttccatttcaactttagctgcaattgctcttttgatacttgcggtgagaatcttctccaaaaacaagcaagaattttgctggaaaggcagtgaagtgaattatgtttactcttcctcttcatcacaagcacagagaagaccattgttccaactaaatgctgcaggaaagagggatttcagatgggaagacatcatggatgccacgaacaacctaagtgatgacttcatgattggttcaggaggttcaggcaaaatctacaaagctgaattggccactggcgagacggtggctgtcaagaagatttcatcgaaagatgaatttctgttaaacaaaagcttcataagagaagtcaagacactagggaggattaggcatagacatcttgtgaagctaataggatattgtaccaataaaaacaaagaagcaggttggaatttgctgatatatgagtacatggagaatgggagtgtatggaattggcttcatgggaaaccagccaaggcaaacaaagtaaaaaggagcattgattgggagacaaggttcaaaattgctgtgggattggctcaaggagtggagtacctccatcacgattgtgtcccaaggatcattcacagggacatcaaatccagcaacgtgttgctagataccaaaatggaggcacacttgggagattttggactggcaaaagcactaactgagaattgtgactccaatactgagtctaattcttggtttgctggctcttatggctacatagctccagagtatgcatacttgctacatgcaacagaaaaaagtgatgtttacagcatgggaatagtgcttatggaacttgttagtggtaaaatgccaacaaatgatttttttggagctgagatggacatggtgagatgggtggaaatgcacatggatatacatggctctgcacgtgaggaattgatagatcctgagctgaaacctcttttacctggcgaagagtttgctgcattccaagtgcttgagatagccttacagtgcacaaaaactacaccacaagagaggccatcttcaaggaaagcatgtgatcgtctcctccatgtattcaacaacaggacggtgaactttgagaagatgaatttggatcattacaaatga

SEQ ID NO: 90782 - DNA, 129 bp, Glycine max
  Peptide Sequence Number=SeqID_207560
atggccatgcaagtggagaaggaagatgctgtatcaccagccatgcaaaacaaaaggccttatgaaaatcatccgacaagaagcatagctagcatggtgatcatcaacaaactcaaggagacaaggtga

SEQ ID NO: 90783 - DNA, 375 bp, Glycine max
  Peptide Sequence Number=SeqID_207561
atggcgaagtcattgagatcgaagagggagaagaggctgagggctattcggagggagattgttgaacctttctatgacaagaaagaagctgctaagcttgctgcccaagaggctgcccttgccgcccctaagctggaggttccttcgaaaccaaatactgctatggaagcatccgcttccactgacaacaccaacatggatgtggaggtggctgatggaagccaaagcatggcttccttaaagcctgttggtggaatagggaagaaatccaaaaagaagttgaaaatagctaaaaacaaacgccgtggtaatggaaagcacaggagaacccgttctggtatcttgaatcatgaagacagttcaaattttgattaa

SEQ ID NO: 90784 - DNA, 528 bp, Glycine max
  Peptide Sequence Number=SeqID_207562
atggccatgctagaacacaataacttttctccttcaacatctaacaaagagggtgccaagaagaggaacaccaaagtagttgcttcagcaagagaagaaagtgaacaaaattccaagaaggatatggcactaggagacactggcaaaggcagcattcatgttccaaagagagagcactctcaacactctcaatctcaaaacaggatcttcaatgctagtgcacatgaagtcccaagtggtccaaaccccatttcaaacagtgaaaggagaaatgaaggaaaagagcaagaaacctccctcaaccacaacattgttttgcgtgaaaaagtttacatggatttggcatccaaagcagcgtatgaagggtcaatatctttcttcctcaatatcccaaaatatcctcaccactttctctggaactcccttggtaccctttgtcccattccttttaaaattgaagcaaaacatggcaagctgtctctcaactcttacatctccatccagtgtctctttcttcttgttggatag

SEQ ID NO: 90785 - DNA, 714 bp, Glycine max
  Peptide Sequence Number=SeqID_207563
atggagggaagtactacaccaccatcactatcatcacctcaacactctgatttctcaactgggtatctcgaagatgctttgattgaatcatgtgagcgttccaaacgtagacgtgtgttaccatgtgctgctgatgaacatagcaagagtttcattgatgaccttgagcagagtttctggaatttcaaccccttatggaaccaaccagtagagaacttcaacttctactgcatgaaccagatagaaaggttttgtggattttcagatgagcatataagcacatcaaggagcgaggaagcaaacattcttctagcagacactaaaacaccggaagagacaatatcagcctctgaatctttaaattcatcctcatcttcatacaaacaaccggtgacatgcaaaaccacagaccccactgttgccccaacagaaaatgatgataccaggaacaagaaggtggtaacaagagtggtgtatccatttgcaatggtgaagccaggaggaagagaaggtgatgtaacattgaatgacataaatgagaggatcctaatgcctcccacaaggccagtgaggcatcctgtaggagactttgcatgtcggccatgcgtgtccgcagagggtccaggcctttcagggaaagcagtggtggcccttactagaattcacacacagggaggaagaggcaccatcactattatcagaaccaaaggctaa

SEQ ID NO: 90786 - DNA, 613 bp, Glycine max
  Peptide Sequence Number=SeqID_207564
atcacatgaaggaaacgtttcttccgcaagaaacattagcatctggcttggcacttcttatctcacacctctcattggagccgttctagcagatggttactggggtcgatactggacaattgctgttttctctgcgggaatgtgtaccttgacactttctgcatctttaccagcattgaagccttctgaatgtttgggttctgtatgcccttcagctactcctgcacaatattctgtgtcctactttggtctatacgtgattgcgcttgggatcggtggtataaagtcatgtgtgccatcttttggagcaggtaaatttgataatactgatccaaaggaaagggttaagaaggggtcgtttttcaattggtattacttttctatcaatctaggtgccattgtatcatgcagcatagttgtgtggattcaagacaatgcaggatggggtcttggatttggcattcctactttgtttatggtattatctgtggtaagcttctttagaggcacacctctctactggtttcaaaaaacagggggaagtcctgttacaagaatgtgtcaggttttgtgcacatttgtccaaaagtggaatttggttgttcctcagtga

SEQ ID NO: 90787 - DNA, 1236 bp, Glycine max
  Peptide Sequence Number=SeqID_207565
atggctgctccaagttccctattgaaggtggaggaaatacaaggaagagggaggggaatggttgcatctcagcctcttaaagctggtcaaattgtcctcagagactctcccattctgctgtattcggctttgcccttggtcagacagtctctgtcatcctcctcctcctctgcctccacttcctgcttctgtgatcactgcttcagaatcttgtctccttctttacagggagattcttcatcatccacagttttgtgccccaattgtcgccaccattgtttctgcaattcaaattgtctttcaaatgcactgaactcctcccattcttcttgggtatgtcaagcattatctcatcttagagccaattctctactgcttgaacagccccttgagcaccaagtccaagttaattttcttgttgctgcctacaatcttgccaatatctccccttcagattttcaaattatgctttctcttcagggttctcctgatgattccaccattgctgcagctcagttcctacacccccttatttcatccctctgctcacttgctctcattggccctcagaatggattttctttagaactcacgtctgctattcttgccaaggacaagctcaatgccttcggcataatgcagccattctctgaacatgatgaccagaggtccgtcagagcttatggtatttacccctatgcctccttttttaaccacgattgccttcccaatgcctgcagatttgattatgtggatgctaatccttctgatgacagccataatactgactttattattaggatgattcatgatgttccccaaggtagggagatctgtttgagttatttccctgtgaatgaaaaatattctagtaggcagaagagactgattgaagattatggcttcacctgtaattgtgatcgatgtaatgtggagtcaaattggtcagataatgatagtgttgaagataatgctgaggaagaagaggaggttatggatgaggaccaatgtgaaactatggcagcatcagacactgatgatcatccccatgaagataataacgatttccctcatgcttatttctttttaaaatacatgtgtgatagaacaaattgctggggaactttagctcctttacctccacaaggtgatactccatgtaatgtcatggaatgcaatgtctgtggcaaattgaagagtgacaatacctttgatattgatgaagggcaagatgaa

SEQ ID NO: 90788 - DNA, 1755 bp, Glycine max
  Peptide Sequence Number=SeqID_207566
atgggttccacagagaatgaattatcgctcgctgaagaggctcttcttcaggatgatgaaagcaaacaatacacaggagatggatcggttgactttaaagggaggcctgttcttaaacggaatactggcaattggaaggcttgcccatttatcttaggcaatgagtgctgtgaacgtttggcgtactatggcattgcgacaaatctcgttacctatcttacccagaagcttcatgaaggaaatgtctctgctgcaagaaatgtcaccacctggcaaggcacttgctatcttgcacctctcattggagctgttttggcagatgcttattggggacgatactggacaattgccattttctccaccatttatttcataggaatgggtacattgactctttctgcatcggttcctgctttgaagcctgcagagtgtttgggtactgcatgtcctccagctactcctgcacaatatgctgtgttcttctttggcctctacctgattgcacttgggactggtggtataaaaccatgtgtgtcatcttttggggcagatcagtttgatgatactgatccccaggaaaggattaagaagggatcctttttcaactggttttacttttctatcaacataggtgcccttgtttccagcacttttattgtttggattcaagaaaatgctggctggggtcttggatttggcattcctgctttatttatggcattagctattggaagtttctttttaggcactcccctttacaggtttcaaaaacctgggggaagccctattacgagaatgtgccaggttgtggtagcatctgtctggaagcgaaatctggttgtccctgaggacagtaatctcctatatgagacaccagataagagctctgcaattgaaggaagtcggaaactagggcatagtgatgaactaaagtgtcttgatagagcggctgtagtgtctgatgctgagagcaaaagtggtgattattctaaccagtggagactttgcaccgtgacacaagtagaggaattgaaaatcttgattcgaatgtttccagtttgggctactgggattgtttttgctgctgtttatgctcagatgtcaacattgtttgtggaacaaggaacgatgatgaacacaaattttggttccttcaggattcctccagcttccctctcgagttttgatgtgataagtgttattttctgggtccctgtctatgacaggattattgttcccattgcaaggaaatttacaggcaaggagaggggcttttcagagttgcaaagaatgggaattggcctttttatttcagtcctgtgcatgtcagcagctgctatagtggagattgtgcgcctgaaggttgcaaaagagcatggccttgttgatgaacctgttcctgtaccccttaatatattttggcaaatccctcagtatttcttattgggggcagcagaagtattcacattcgtcgggcagcttgagttcttctatgaccaatctccagatgccatgcgtagtttatgtagtgctttgtcgctgttgactacttcacttgggaattacttgagctctttcattctcactgtagtgacttacttcactacacaaggtggaaatcctggatggattccggataacttgaacaagggtcatcttgattactttttctggcttttagccggacttagcttcttaaatacctttgtgtacatagttgctgccaaaaggtacaagcagaagaagtctgcttaa

SEQ ID NO: 90789 - DNA, 273 bp, Glycine max
  Peptide Sequence Number=SeqID_207567
atgaaagtttccaaactcagaatgatgcaaacgcaagctgaaactatcaaggaacaagcacagaatcatggttacctcgaaggaaaaccacgaagggttcctctcggtgtggggtttcaacggagaacaatggcggtttttgatggctactggtggctgtgggtgatggagaaagagcttggaacgttggaaatggatttggaagaaagaaggagaaggaaatggcgtttttccaaagctacttggactataagactcaaaacgcacaagtga

SEQ ID NO: 90790 - DNA, 133 bp, Glycine max
  Peptide Sequence Number=SeqID_207568
atggcaggtggaacagctagcatagacgaggatccagaagtggatcagttcatggaggcttactgtgagatgctgatcaagatcgagtgccagttcaaatctctcactatttcttcttcgttggacactactg

SEQ ID NO: 90791 - DNA, 612 bp, Glycine max
  Peptide Sequence Number=SeqID_207569
atggagaggcgtctgttaattggttccctcgctggaaggaaggaagaatcaggattctatcttcatgcgaaggatgtccaaatgtcccttgatggaacaaggggttgtattaattataatcccgtcctcgccataagacagcttggctaccccatgagaggagtgccatcagacgaaagcatcacgcctttcatcgcacggggtttcagtgaccacaacgcgagggacagagagcttaggggaagcagtaatgggatcatcggcggctatcataagtggctgagagtccgaacacaaggattggattggctcccaaatctaaagactgtgagagacgatgaggttaaagcttcggaagaaagtgatgaggtacaagccctaaaggcagagcttgaaagagcccgggtagtcgaagagaagttcaagtccatagccatcaaagaatcatcacgggtcaaaggcatgatctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtag

SEQ ID NO: 90792 - DNA, 936 bp, Glycine max
  Peptide Sequence Number=SeqID_207570
ccggtgcgggtggtgatcgacagccagcagcgcgtgacgccacagcatcgtttgatcgcccagcccggcgaaacctggctgatgcgcacggaggctgatgcacaaagctggccgccgggcgtgagtcagattgaggtgccgccgcgcggtgagcagctcgatctggtggcgatgatgatgctgctcggtcagcgtcagatcaacagcgtgtgggttgaggccggtgccggtctggccggtgcgctgctgcaggccggcctggtggatgaactgatcgtttatctggcgccgaaactgctgggtaatgccgcgcgcggcctgtgtgcgctgccgggactggaaacgctggccgatgcgccagcgctgaattttagcgacgtgcgtcagcctgagcgcgttgccgaagagtatgatagaatccgcccccttctgcggggccataaaacaaacacccaaaggatatgtatgaaagttatcgaagctgctgttgccacgcctgatgccaatattgccatcgttattgcgcgttttaacaatttcatcaatgacagcctgctggacggtgcagttgacgcgctgaagcgtattggccaggtcaaagcggaaaacatcaccgtggtctgggttccgggcgcttacgagctgccgctggcggcacgcgccctggcgaaaaccggcaagcacgacgcgatcgttgcactgggcacggtgatccgtggcggtaccgcacacttcgaatacgtggcgggtgaagccagctccggcatcgctcatgtagcgatgaacagcgaaattccggtgaccttcggcgtcctgaccaccgaaaacatcgagcaggcgattgaacgcgccggcaccaaagcgggtaacaaaggcgccgaagcggccctgaccgcacttgaaatgattaacgtattgaaagccatcaaagcctga

SEQ ID NO: 90793 - DNA, 201 bp, Glycine max
  Peptide Sequence Number=SeqID_207571
atgggtgttaagtacctcgaagcggtcaagcgagggtcgcatgctatcaaacaatggtccccggacgaaattaggatacatcgcatcccattagtcaaaaacattgttttcttgaaaaccagcatgcaacacggacaggcatacatccccatagttaggttccctgacctcaactatggtattaaaaactataaacaataa

SEQ ID NO: 90794 - DNA, 450 bp, Glycine max
  Peptide Sequence Number=SeqID_207572
atggtggccagagcgctggcgtatagccgtgaattgcgggcggcctctgccgaggtgctggcgtctgactacatggtcgatcagcgcagtaaggtcgtggcgaaacagtatgtcggccgcatgaaagagctggtcaccatgctgtcgcaaattactcaggcggaccgcggaagagagagtgaactggtacaggcaaaagcaaaactgatgtcggcccaggcgagtctcgataacattgagcatcagctgagcgccagcaaaatcaaactggtgcgcctgctggggatcgagcctgaattaccggaaggcataagctggcacgacacggtcattccggcctcagtggccctctccgcgctggataaaaatccgatgatgctgaacctgcagtccaaagtacgggcggcagagtatgaggcagaaagcattaaatcctcggctctgccacag

SEQ ID NO: 90795 - DNA, 255 bp, Glycine max
  Peptide Sequence Number=SeqID_207573
gaggaagcaactgggcggcaagctcctccacgtttttgaaaaatggtttccggggcttccgcggcttccgtaatacttccgtaaaatttccgaaaaccttgggtaagcatattccacttaacattggtgaaagggaagagaaaaaagatgaaagaggaagcaattgggcagcaagctcctccacgtttttgaaaaatggtttccggggcttccgcgacttccgtaatacttccgtaaaatttccgaaaaccttgg

SEQ ID NO: 90796 - DNA, 243 bp, Glycine max
  Peptide Sequence Number=SeqID_207574
acaggagattcaactgtgttgaagataggaaattcggctaaagttgtgataaaacaagacatgaagggaagaaggcataaatatgggtttaacaacaacaaacgtgagaaggtagagaagaaaagggtggtggatgatgaaactggcgacaaaaatcagctggatgaacaccaagagcggctacgcaagaagcttgcacttgaggaggaaaggacatttgcagctaatgaacaactttcttaa

SEQ ID NO: 90797 - DNA, 615 bp, Glycine max
  Peptide Sequence Number=SeqID_207575
atggctatggttactatgcgttggagaggcaatgcgcagataaatatgcgtaaacgatattccgtgggacacgttgccggacaaatttgtgatcgaagggaatcacggttccggcgccaaaaaattgatcgacggctggatgaagacgattattggaaaacctatgtagaactcaactacaaagggatacaaaaaaagatcattggcgagaagtatatcgaatcggccaatggtcacgggcctgaagactataagatctattgcttccgcggcgtgccttactgcaccttactgtgtgtcggcagggataccgggtcgccgaagtattacttctttgataaagatttcaagtttctgtgctacagcgatgactgtctggccttgagccaggaagaaatagatgccttcgtgaagccagagggctacgatgagctgtttgagtacgcctcacgcttgtccgcgcccttcgagtttgttcgcgttgatttctacatctcgcaaggccgaatcatttttggcgagctgacctttaccccttccgccgggctggatacggatattctgccgccgaccgatgttttgcttggcgagatgctgacgctgcaacagcactga

SEQ ID NO: 90798 - DNA, 159 bp, Glycine max
  Peptide Sequence Number=SeqID_207576
atgagtatgcaagttgaaggaagttcccagaatggtagaaagcaggggacagatgaaacggccacagctaagaatagtgaatctcatatcgggaaaagattgttagaaagtttggttgcagatgaaacggtcacaattctcattcttgaaccagtgtga

SEQ ID NO: 90799 - DNA, 344 bp, Glycine max
  Peptide Sequence Number=SeqID_207577
ggtacatcctttatggtacaagtaaagggtacatctacttgggggttgttatactgagaacaagagagggtacatctcttgtggatcagttcaagtggagggtacatcctcttggttattcaaagagaacaagggagggtacatcccttgtggatctttggcttgtaaaggattttacaaggttgaaaagaaatctcaaaaaccacaggccacttgatccaacacccgagggtttggctcggatgatcaatgggttcctatcctcttcttacggtctactacttccctcggatgatcaatgggttcccatcctcttttcaaattcgggagttgacagagtttga

SEQ ID NO: 90800 - DNA, 150 bp, Glycine max
  Peptide Sequence Number=SeqID_207578
atgtgcgcggaggacgcccgccgttttagcgaaacctttgcccgcgacccgcagctcgccagccgcaccgccaggcgaaactggcgccctacctcaccgggccgaaaagtaaagcgcaaaatcaggcgcgcttcagccgtcgcgcgctga

SEQ ID NO: 90801 - DNA, 183 bp, Glycine max
  Peptide Sequence Number=SeqID_207579
atggagaattggcgaacagcgctacgcaataacttcgcggggctccagattccgctaggcaataacatacatggggctccgaaaaaaagtggagaatggagaattggcgaacagcgctacgcaataacttcacggggctccagactcgaaggtggaggatgcatgaacagcgctaggcaataa

SEQ ID NO: 90802 - DNA, 318 bp, Glycine max
  Peptide Sequence Number=SeqID_207580
atgaaggcattattagatatgtacgagaagccattggcaaccaacaaagtatacttgatgcgtaggttgttcaacctcaagatgggagaagttagtagttctacaaaggagaacacattaaagcttagtgacatccgtgacttgatcttaagcgaagatgttcgcaagagagatttaagagaatcttccaatcatgtttccaattcagcattgaatactaaaggcaggggaaggactacccagaagggtcagaatggtcgaggcagatcaagtggcctcagaataattaagaaccgggggggggggggggtgaattaa

SEQ ID NO: 90803 - DNA, 423 bp, Glycine max
  Peptide Sequence Number=SeqID_207581
atggagctttggggaattggtgttgatttggagagatgcatccaggctcgtaaattgttgattaaaaggctaaagcatcttgagaaggaagcttataaactggctggaacgacattttcattaaatatgccagcagatattgcaagagtgctgtatgaacacttgaagctgcccatacctgatgtgcggaataagggaaagcaacatccgagtactagcaagcactgcttggatgcactgagggggtttttaatcccaatagattggttgtataagagagttggaaacctgattgtgaggaacagaggaaggcatgcagttgataagataacatgccatgagaagcacatcacttcagaagagaagaggaacattatggtgaagaagggtacgggtagtccaagtgctaattctttcttttga

SEQ ID NO: 90804 - DNA, 342 bp, Glycine max
  Peptide Sequence Number=SeqID_207582
atggcaaagctgttgaactctacgttaggatcaatttgttccctggctaggctatctgtaagcacacagaagtatacattacatggtcattggctccagacgtccacggcaactggtcggctttcaatggaggaacctaatcttcagtgtgttgagcatgcagtagaattcaaaatgaaagatgaaaatgaaggtgatgctgacgagagttattgtacaattaatgctcgtgatttctttgttcctactcagatggtatcagagtctatcccatgttggacaatcgtgccacctgctatcagaccaccaacagatgtccagtcctgcaaacttcacgtttga

SEQ ID NO: 90805 - DNA, 1785 bp, Glycine max
  Peptide Sequence Number=SeqID_207583
atgactgcactgaacttgcactatacctacgttattcatataaataggctaataagggaaattcctgtgggtgaggtttgtgaagcattcaaagttgccaggggaatggttcaagccttgcaagagaatgctggtaggtttgcatctatggttgctgtgttttgtgagcgacttgggtggcatgatcttgaaggcttagttgctaagtttcaaaaccgtgtatcatttggagttagagcagagattgtagaacttaccactattccctatgttaaaggttctcgagccagatcactctataaagctggtttacgtacaccccatgcaattgctgaggcatccattcctgagatagtaaaagcactttttgaatcttcatcatgggccacagaaggttctgcacaaaggggatttcaatttggtatagcaaaaaagataaagaatggtgcccgcaagattgtttttgataaagctgaggaggcaagtaacgctgctttctcagcctttaaatcacttgggttcaatgtcccacagtttgatcctcaaatattatctactgctgctcgtgattctatcaggctaggaactggaagtacctctggaagtgacacaactgatactagtcatagttttgttaatgcagattgcattgataatactaataaatttactttagataaagaaaaagaagacttaataaaattatctgttaacggtactgtggcttctgtagaaggaaaatcaagaagcaggatgatatgtagcttgtccagtgttccagttgcaggacctaaaatggatgaactcaataggacttctgaccataccaaaaatgcagacatgaccattctctctgttcaattgcagaaaccaaatgataaatctggtgtacatgatgggtgcgatgctcattgtacagaggaagcgcataagaatggaaatttggctagtggtaatgctggtagttccagccagaaaggtcccattaatgcagttagtagtcctggtgggcttgattcatttttggatctatgggactctatgccagagttctattttgatatccattatatcaaacgattggaattgcactctactgctccctttgaaatacatggcatagctgtttgttgggaaaactcttctgtgtactacattaatcttcccagagatattctgttgtctgacagtataaaagatggctgtttatccttgagtgcatgcagtcataagaagaaagtttcatcttctaattctaagcaagatctagagattgctagatctagatggaacagaattagtaaaataatagggaaaataaatgtcagaaagttcacctggaatttgaagattcagatgcaggtgctgaaaaggccagcattttcagttcagagatttggttgcttggacacacttggaaaaagtatggaccttgaagttgtagacaattcttatgtgttattgccccctatacatgttaaagatgcaattgatatgtgcattgtggcttggattctttggcccgatgaagagagtagctctagtccaaacctggataaggaggtaaagaagaggttatcctctgaggatgctgcagtcgccaatcagagtggcaggtggaggaatcagatgcgaagggctgctcataatggttgctgccgtcgggttgctcaaatacgagcattaagttctgttctttggaaattacttgtttctgagaaacttgttgaagtgcttatggatatagaaatcccattgtttacctttagtgaagaatgtaaataa

SEQ ID NO: 90806 - DNA, 900 bp, Glycine max
  Peptide Sequence Number=SeqID_207584
atggtacactggcccatgccaaccaacactcattccttttgcgactttttgggtctaacgaggttctatagcaacttcatcaagggctatgcttccatcaccacccccttgacttctctgttacagaaggagaaatttcactggagcgacgccgcacagaccgctttcgataacctcaagcatgccataactcaggccccaattctggcccttttggatttttcagtgccatttacgcttgaaacagatgcttttggcttagccatgggtgccgtcctcatgcaacatggccaccccttagcatgttttagcaatttcttttgcccaagattgcaatgcgcctccacgtacgtccgggaactccatgcaatcaccaccgccatacgtaagtggtgccaatacttgttagggcacccattcattatccttacagaccataagagcttgtacaaacttatgaaccaagttatccaaacgtcgaaaaagcaagtttacttgtccaagctgcttagatatgactactcgatacaatacaagtttggcaaggcaattgttgtcgctaatgctctatcacgacttcctcaatattccagtgggcaatgtttaatcttgtccatgcctcatcccctattccttgatgcaatacgtgcttacatccgcacccacacttcggtccaggaccacattcacaaggtgacatcatccaccaatttcgtacaatacaagtttggcatggaaaatgttgtcgctgatttcaagtttcatggcaggctactttttttcaagaacaaaatctggctggacccagaccacctatttcgtacttcacaaatagaggagttccattccacccccatcggcggccatataggattcgctaagactctacaccgactttag

SEQ ID NO: 90807 - DNA, 462 bp, Glycine max
  Peptide Sequence Number=SeqID_207585
atggaactccaacgtctcaaccaaaatgaagagaccgacaaaaggaaaagaagcatagcactcaaagcctcctcctcaatgcaagaagaagaagaagaagaagaagaagaagaagaatctgatgatgaagaggacttctcactcttggtgaagaagtttcataaattcgtcaaaaatagaagaatggagagaagccataacttcaacaatgggaagagatctcaagaagtttctcctacacttaaatgctacaagtgtaatcaaccgggtcacataaaggcaaattgtccctcaaatgagtcatggtctgagaagaatgagaagaaaagctataaagaaagaagatccaagaaggtgtatatttcttgggatgacaatgactcatccaatgattcggagaaggaaatcaaccttttatccaaggactatgaaagtgatgagaacatatctcaagaagattaa

SEQ ID NO: 90808 - DNA, 501 bp, Glycine max
  Peptide Sequence Number=SeqID_207586
atggcggaaccatcaaagaagcacaaaggttcttcaagtagaagtcaaaggcattctgaggttcaggatactccaattccttcctccatttcatcctcctcattgttctcatctgaagaacaacatatacgaaactacctcgatgtacacttattcagcactactgtcgacttaatggctctcataatccttcagtggttcaatcagatgatggttgtcgttggcatgaggagaaactgggagagtcaaacgataagccacgacaccaatagcttcagtgatctggaagggcccataatattgtttggaaagcttgtggaaagtggtcctggacaaggatgtttggcggttagggcaaagcttaacttatacccaatcaccaacgttcgagctattaataaggtccaaaggtcttggcgtgtggttagcatgttgtcgatggcttctacctgtgacgatcctggaatgtatgtggtaatggaaagtggagccttgccatag

SEQ ID NO: 90809 - DNA, 561 bp, Glycine max
  Peptide Sequence Number=SeqID_207587
atgtgggggtctagaaaaggtgggagtattttaggaggagtaagtggatatcaggaagtggatgatgtaagggaggggtggtttcattcgaggggggatgagaaatggagatatggaagaaagctgaggcagaatggcatccgcctgaagtgtaacagaactgccgacatggtggaactgcatggtcagtgtgtcgtagttggtgatgacaggcccgagttgtttcaaccattgatgggaaatgtggtcacaagggaggatggtgttattaccgatggtgacctgaagaggggtagtggtaccggaaagggtgttgaaacttatgagggcatgggttgggtcaaaagaaggtgggataggtggtttggtaacataggtttcgagtgggatagtggtgctaggattgtcggcaatcaacaaaaagaaatgagcgcgacaacgatggggtggaggccaggttgggtggtgaaggtcggtaagggcggcaatggtcctccaacttatcctcctggagtttggcaagagagaaggcctgcggaagagatatgggttgcaaagctt

SEQ ID NO: 90810 - DNA, 294 bp, Glycine max
  Peptide Sequence Number=SeqID_207588
atggggctaaaatggtgtttttggggtccacatcaaagagacatcattttgaaattccaatcatgccaatgtgatcggggttcaacaaagggttccactccttgcggtggtcgggcgacaagtggtggtggctcatggtggtcaccgatggccgtaggtggaggaggaggggggtttaggggagaaatttcactcgcctacgtgagctggcccaacttaaactcgcataaggttgccattaagcgagacattcgcgctaagggcaatttctcctttgactggaattgcatttag

SEQ ID NO: 90811 - DNA, 261 bp, Glycine max
  Peptide Sequence Number=SeqID_207589
atgactcaaacaaaatctaacccttatataccacttaataacttagaaggcatcatcagcaaatccttcttcttctcgaacaaattcttaaattatcacattacaaacctactaccattagaactttcagaactcagtggtcttgtacaatttaagttggatgactattgggaatgcaccccttgtcacaaagtaatgacaagattcttaccaacacggttatggctcgcatttgttaggattgccaagttggcaccttga

SEQ ID NO: 90812 - DNA, 321 bp, Glycine max
  Peptide Sequence Number=SeqID_207590
atgtcaaatgaagaattgaagttgcaggatccacgatgtcggatacaatgtcctgacatcctgcccgaaaatactggagttgctgcacaatgcataagtcaagataaaatgaagaatgatagatctcctccagcacaagctgttgcagcccagatacgcacactgctatataaccatggaggctgcacgagttttgtaccaagtccgggattgaagagttattttgtgagtttgggacttgagtgttttgtgagccaccttgatggtaccctaacatcaagtgttggacctgagtgtgtagagttgatctctagtgtgtag

SEQ ID NO: 90813 - DNA, 282 bp, Glycine max
  Peptide Sequence Number=SeqID_207591
atgtacaaagataattggacccaaccttggcccatgggctcagaaatctgccctgaggttcatgagaaccctagggccttcttcagcagctctagcccaatcctcttggagcctcttgctcatggctctagtgactggtcccttcctagggaggattgcatcatggatgatccgaccagaaaaagagagaaggtgaatccctccccgactagagaggagacatcatcggcaatcccgaagtcgagaagacatagggcgaagagaaagaggcccaaagcatga

SEQ ID NO: 90814 - DNA, 453 bp, Glycine max
  Peptide Sequence Number=SeqID_207592
atgggaataaatctaaaggaggatccaaccactttgatggaggagcaaccactagcacaactaatggcaacccactctggcaacaactacttaaagtggaagacttgtagaacaagaacgatgcccaacaaaaacttaacaaagagactcaacaacaacgcaccaaggcagagatgcaaaaaaagggaggtggaagagaggaagagtcaagccgacacaatatccgctttggctagcctttctcagatgagattgactaagtggtggtggattgatgtagctccatgtggagcttgtaggccttggatcttcttcatcaatagattcctatgcttcttgaggtctgattgcagcggaatggagaaggagaaagatgaatggagacgccacttcaagttgaagatgagtctagaagaggctcaccaccataggaagccatggataagagcttga

SEQ ID NO: 90815 - DNA, 2139 bp, Glycine max
  Peptide Sequence Number=SeqID_207593
ggggcaagtaaagcaagggtgccaaagcgaataggggtagttgtgcacatggagaagaaggagtgtttgtttaatagtctggtggatacactgaatgatcctaagatgtttgataagctaagggtagcaattgtgttggaggaatgcttcacatcgttgatggggatgtttcaagctttggtggcggatgatgatgaaacagtgaagataaagagattagatacaacacaactacttgtttgtatctcgtattcaagccagatgggatcattagaaggtgtgattggcatggaccaggcttcatctgacttgaagtgtaaccaagatgaggtaggtgaaggagagagtgcacggtggtcaaagcctaagtttctggatgaggaaggtgtgagggtttatctagtggttaatgagaaccttatcattaacggtcttgttgaaactgttgtgcaagatacattgggtattgatactttaagccaaatcagagttagtgtggaaggttccagtgagcttgtggtccaaccaatcaatctggatgtagaaggaatgcttgatcctgggactaatgcttgtttgaaagaaggtggccctattggtgctagctcgagctctttgtcagcaggctccaagtttaagcaatcctctctagggtgtaccactactttgtatccaagaaacaaaaaggaagaagtgactaaagaagtttgctatgctttgtgggggaataatgaggtccaatggtcttttgttgcatcggagggagaattgggaggtatgctatgtttatgggacactccaaatttcgaagttacatcttgctttataggagaagtctacatcgggttggaagatttcaattgtgttataagtcctaatgaaaaggagggtgagggagatcttgattatggtagagcggagtgggaggagtttaatgattttattgatagtatggaggtggaggaggtgttggttattgtgggtaagttgaaagtggagttgaaccttcttcattgtgccgatgatactttgttctttggtgaggctaccttagctaatgtgattactatcaaaactttgggtgtggtacaaatttttttggagagctatgcaagtgttatgaattgcaaaatcataaagttgcatttcatataccttggtattccggtcggtgcaaatcccaggaaggaagagactggaggtgccaattatggagaaaattacagggagactacaatcttagaagcacaaaactctatcttttacgggaagggtgtgggagagtttgagaggaaaattatgtgggtgaaatggttagcagtttgtaggcctaagagtcatggcggtttgggggtaagagtcctagtgatgcaatcctaccccccaagggtattggatagaagactccaaaaggattgggctagagctactaaagaaggccctagggttctcatgaaccttaggctaagctctagcttctttaggaatattctcaaggaatcttctcaaggagcatcctcttcaatcttcttatccaaggcaattcttggtggtgaagctccttcttccttggcttattccctagtggatggtgcctcccctcttctcttctcctttgccttccgctgcatctccatggtggaactagtggatgctaactcctcaaagaaggcatccatatgggcaaaaatcgttgaagtgtccttgagggaggaacttagtgagatgccaagtcatatatctttaaagaggcacgaggaagattcatggctatggctatgtgattctagtggtgtctatctggtgcattcgacttatttggctattagtgtgatgaaggaggggagccaagcttgtccaatgttctcttccatttggaaagctcaagtttcgcaaaagctttgtcctcctgggaactgcaatatctcatttcttgcaacaagagggagctacctcgagcaacaaagtaaggtgagaatggtggtttgggggagcaactctttggaatatctgggtacatcctttgtggtacaagtagagggtacatctacttgggttgttgactgtgaacaagagagggatttttacaaggttgaaagaaatctcaaggaccgcaggtcgcttggggactggatgtag

SEQ ID NO: 90816 - DNA, 345 bp, Glycine max
  Peptide Sequence Number=SeqID_207594
atgagaattcaagggactaaccgcctaagaattctttgtcttaacacattggagggtacatcctttgtggtacaagtagagggtacatctacttgggttgttatactaagaacaaaagagggtacatctcttgtggatcagttcaagtggagggtacatccacttggttgttcaaagagaacaagggagggtacatcccttgtggatctttggcttgtaaaggattttacaaggttgaaagaaatctcaagaatcgttggttgcttggggactggatgtaggcacgggttgtggccaaaccagtataaatcttgtgtttgtcatcttcttccttacactctttaa

SEQ ID NO: 90817 - DNA, 463 bp, Glycine max
  Peptide Sequence Number=SeqID_207595
atgggggattcacaagaaaataacaaaggaaagagtagagacaaagataattatgtatcttggactatggaggataccaatgagttgttgcacctcttggtggatgctatgaataggggattgcgtgatgccaatgggtcacttagcaaacaaaattttcgaaaccagtataacatgatgtcaacccttatgcgcaacaactctggctttggatgggacccaattggaaaaactttcactgctcatgaggatgtatggaaagattacttaaagtcccacccaagtcacagcaaacttcgaggaaaaagtatggttgattatgagtatttgaagatcgttgttgggggtggagtttctagcgggaataattctatatcagtcgatccagatgatactgatgcaacaacttttgagccagaaaatagaactgttgggatagaagaattttcatatgatcctaata

SEQ ID NO: 90818 - DNA, 291 bp, Glycine max
  Peptide Sequence Number=SeqID_207596
atgcagagtctgcaacagaaggcttccgaatggagcggtgtttccatagacgacgctttcggcatcgacgacaccaatctcttccagaaactcggcctccaaaccttcattaacctctccaccaatttctacaacagggtttacgatgacgaggaagaatggtttcgttcaatattcgcgaattctgagaaggagaatgccattcaaaaccaatacgagttcttcgtgcagcgaatgggtggtcctcctctcttttctcagagaagagtagatagtgtaattgctccgtga

SEQ ID NO: 90819 - DNA, 171 bp, Glycine max
  Peptide Sequence Number=SeqID_207597
atgttagtagtccaaaaggagtgtggtgaaagagagacggagtgtgatgaaagaaagagggaaggagggaaccaatggagtgtggtgaaaaaaatggggagtgtgttaccaaaagggagcgttcaagggaagggagaatgtctgaaaaagggtttcggtttgaccgcttaa

SEQ ID NO: 90820 - DNA, 216 bp, Glycine max
  Peptide Sequence Number=SeqID_207598
atgaatgtaaagaaaagagaatatatggttggtgtgcttccaaagagaagaatattgatgcggtatggagagtcgcaagggaactgggacacgatgacatacaacaccatacccgaccacaacattcagtcaatggtgcaaggcatggcccaggccctctgcgtcgacaagcacctccatcacgtgatagacagcgatggctgctccgctgactaa

SEQ ID NO: 90821 - DNA, 327 bp, Glycine max
  Peptide Sequence Number=SeqID_207599
atgaaggatatcaagaagtattggttcaatgcaagcagcccaagtactactcaaagcataaggttgggtcggagctacacaaaaccgcactatgagagcaaccgtgatggcacaaaaccaatgtggcaaatgctttggagaaagctcaaaagggatcataagaagaaagggtttggttcaatggagggtatttatgacccggaatcatactctatgaactttgatcatggaactggatggatggagcctgataacctccctcgttccttctcttctcggtatgctgacccatctaggatcttaccacctagacatttattggattaa

SEQ ID NO: 90822 - DNA, 3294 bp, Glycine max
  Peptide Sequence Number=SeqID_207600
atgtgtcataacttgcgtcaaggagttgttggcgaatgctttcaacactccttgcatattaattgcattggtaccattgatgctttcagtcagggcgccactccaaagagcacaaaccgctcggttcgtcgtgtctcttcaactcggctctcgcgaagcatcaaagcaacgcattatgcgacgttgtatgatgcatcatcattctcatgcctagcgcaaggcgaagaagaagaacaacaacgaaacacaacgcttctcgttcttcacatggcttctccttcgcatcgctctcgcatcgatcagttttacgcttcgaagaagaggaaagcagcgtcgcctgttcctaaagccgggagattcgaaaaaggtgcgaggcatggggctgatgagtctccgagtgccaaaggcactttggagggttacttggtttcgtcacaggacggtggtggtgacggctgcggtgacgcaaacactgttaaggttaagagaaacttgacatcggagattggtggttctcttgacaatgagcttaataagcatactgtttcattgggtcaagggtgtggagattctcaatctattcagccgagtgaaattggacagggtgtggcgaaatcggagaggaaacagtttgctgctgactttttgtctttgtattgcagtgtattgcatccgagtgtgggtttgccgttggagatgaaaatggatgatcacaagagacatggttcaccaacattagtagagggaaatagtgttttactgcggaagaataatgacactgctggtgagctatgtttcggtggtgaaaatacattgttgagtgtgaagatcgatgaagacatcaagtctggtgttgttggtaataataattctatgggatgtgttcctggctcttgtacgaaggtttctggtggtggtgatactactggctttgagacaggctttaggaaatgtaataatacacctaaaccatcaatgaaattggctgaatactacaacacaccggggtctttgattgttaaagcaagtgttagggagactccaaagtcaacacgcggcagctcatcattttcgcctggagaggcattttggaatgaggcaattcaacttgctgatggtttgtgtgttcccatgggtaatgatccttctaaggttatgggagaaagtaatgtggtggaagaggaacctgagatgaagaactcatgcaatttacaaaattatgatggcaaaccaaggaaaatattggatcaaagtaaaaacagaatccggaatagggaaatgggtgctcctttagggttagttgggatgcacactaaagattctgtgaaagaagcatccagccttcctgttaaacattttgatttttcgtttgaggacaacaatttggaagaaaataccttgcaagactgtcgtgttggtgattcaatcaatgttacttgtgtggctggtaaacagtatgattcatgttctatgataggtcatacatatgaaaagatgaatgaagtgcaagagaatactttagtagatacattaggcaaaagggtttgtcaggataatgttagcatgacatctaattcaccccacaatgaggtcaggacaccgattagtgcacatgcatctgatgaagccagtactccttcaactagtgtatcacttaatgatcattttgacctaaacagctggcttcctcctgaaatatgcagcatatatagaaagaaaggaatctcaagactttacagttggcaggttgattgccttcgagtggatggtgtcctacagagaagaaatcttgtatattgtgcttctacaagtgctggtaagagttttgttgctgagattttaatgctgcggagggtgataataactggaaaaatggcactacttgttcttccgtatgtatcaatttgtgcagaaaaggctgaacacctcgaacgtctccttgatccacttggtaaacatgttcgtagttattatggaaaccaaggtggtggaacacttcctaaagatacttctgtagctgtctgcactatagagaaggcaaactcactagttaatagattattggaagaggggcgtctatcagaaatgggaattatcgtaattgatgaactgcatatggttggtgatccaagaagaggttatctacttgaacttatgttgacaaagcttcgttatgcagcaggggaaggtattccaaaatcaagtgatggagaaagttccggtggaagcagtgataaggctgatcctgcccaaggtctgcaaattgtcggaatgagtgcaacaatgccaaatgttgcagcagttgctgactggcttcaagcagcactataccagaccgagttccggccagttcctctagaagaatatataaaagttggtaattccatttacaacaaaagtatggaactttgtagaataatctcaaaagcggctgaacttggtggtaaagatccagatcatgttgttgaactatgtaatgaggttgttcaagagggacactcagttttaatattttgctctagccggaagggttgtgagtcaactgcaaggcacattgcaaagttccttaaaagctttactgttgatgctaatgattgtgagtttgccgatattacttctgctattaactccttgggaaagtgccctgctgggttggaccccatattacaggaaactcttccttctggtgttgcatttcaccatgctggccttacggttgaggaacgagagattgttgaaacctgttatcggaagggccttttacgtgtcttaactgccacgtcaaccttagcagctggggtaaatctgccagctaggagggtaattttccgccaacctagaattggttgtgattttctagatgggacgaggtacaaacagatggctggtcgtgctggtcgaactggaattgatacaaaaggagaaagtatacttatctgtaaaccagaagaactaaaaaaggtttcgggactgcttaatgaaagctgtcctccattacattcctgtttgtccgaagacatgaatggaatgactcatgcaatcttagaagtagtggctggaggaattgttcaaactgctagcgatattaaccggtatgttagatgtacccttttaaattctacaaaaccatttctagacgtggtgaaatctgcacaagaatcccttcgatggttgtgccaaagaaaatttcttgaatggaatgaagacactaaactctacagtaccacacctcttggacgtgcatcttttggcagttctctttgtccacaagagtcacttaatagttccttataa

SEQ ID NO: 90823 - DNA, 426 bp, Glycine max
  Peptide Sequence Number=SeqID_207601
atggcccagtctaactcctctagactagggttccctgctcttatcacagctttatgtaggtctagaggagttgcttccgacagcttggtctttgaacgtttgagcccggtcattaatttggcctacataaggaaaaactattggaacccggatgatccaacagttattattaggggggccagaagaccaagggcaaggccaactaaggctccttctacattagtagcccctcatccagcttctacatcagcagctcctcccccagctcgtatgaaagcagttccttctaccttatctcttgcagattttcaacattttgaagccatgcttcgaagcatacatcaaggcctggctagggactcagcctcctcttcacagggaattcaaagatcccaccactcaggtaccccatcagccaaaggatga

SEQ ID NO: 90824 - DNA, 299 bp, Glycine max
  Peptide Sequence Number=SeqID_207602
tggagcttgaccctcgccctacgccgattgagatctttccttgtgcggtacaggtaaattttgctcttgagggaatacccggttcatcggaacttcaaccagaagaggtaggctcggggataaactttcttagtcagacttccttgataggtgagacttccacgaaagcacttattagaagaatcttagtatgcaaggccttcgatctaaagggagcttcggtcggtgaaactgtccctgtagctaaagtcaagccagttcattcattcatggcaatcggtctagtaaggaagaagtga

SEQ ID NO: 90825 - DNA, 448 bp, Glycine max
  Peptide Sequence Number=SeqID_207603
ctacatgctcgctcaactcaagcctccttcttattctgcttcaagttctgatttggcttcttctactactgatgcggataatgcttcttctttgcctactaaagctgctaagcaaaagtccctcctttcactttcatctgatattaagctagcaactgactcaccaacggattcaggaaccgaaactgcaacaggaacagaaacttctgcagcttaccttacaactctagcttatccggattcaccaacagattcagaaacttattctgttgatgctgctactgccgattctgattcctcttcttctgcttcttccggagagagggagactagaagagcttacctctggcaccgggctttctttctatcttctggctggaatttccgagcttttgaaataatagctgtggcactctctttcttccatagagaaggaacttatccttag

SEQ ID NO: 90826 - DNA, 349 bp, Glycine max
  Peptide Sequence Number=SeqID_207604
atgggtgacctagaggaagtacaggaacaaatgaaagccgacatgtcggctttgaaagaacaaatggcttccatgatggatgccatgctgggaatgaaacaacttatggagagtaacgcggccaccgccaccgctgttagttcaactaccgaggcagacccgactcttctgactgctgcgcaccaccctattccaaatatggtgtcatacgtgactacgcgagtcatgttcctcccctcctacttgaaggggagcctcctcgacatctggacgtggtccacgaggatcattgagagcatgctcagggagacatcgactcctactccccgtttcccgctgaggggccagc

SEQ ID NO: 90827 - DNA, 999 bp, Glycine max
  Peptide Sequence Number=SeqID_207605
atgcctactgacattagagaaattgaggctgcactgtgcatacccggccaagggtttattctaaatgctgaaggtcactcggggaatatcctcagaaaagatctaaccacccttgctcaggtctggagtgttctatcctactccaacctggctctgacctcccacacatcagatctgattatggatcgagctaggttaatctttggcctagttactcagctggacatgaatgtcggagccctcatttttgggcagattacttctatggcccagtctaactcctcaagactcagatttcctactcttatcgcaactttatccaggaccaaaggagtttcctctaacagtcttgtctttgaacgtctgagcccggtcattaatttggcctacataaggaagaattgttggaaccctaataagccaacaattattattaggggggccagaagaccaagggcaaggccagctaaggctccttatacatcagcagttcctcatctagcttctacatcagcagctccttcttcaacttgtattgcagcagctccttctaccccacctcctgcagatttcaacgtttcgaagccatgcttcgaagcatacatcaggggaagattattttgctgcaaagtctccaactggactcggcctcctcctcacagggacaacgaggatcccgccgctcaggtaccacatcagccagcggatgagtcatcagagtcttccactcctgagcccttgatcaggaagaggagggtagttgtaactcaggaagccgcagccactcctgaaaagtctcctgaggccactccagagcctccgacaccaatggcagacaccacttctccacagcaggcagcaaatccttcaacacctgaagatcaaaccacaccagtccagtctccgaacacctctcttgtatctactcttgtactgcatttgactgacgaggaggaggttcaaacacaagacacccagaaccaatcacatgacttttaa

SEQ ID NO: 90828 - DNA, 207 bp, Glycine max
  Peptide Sequence Number=SeqID_207606
atgactaatgcaaactgtctacaagagtcattgcattcagtctcaaacaggaatctaagattatggaaatctatccactattgctttaagtctgaaggaccctcgcaaatagataatatatgtgcgagagccaaagggcatgaagatgaagacaatctctggatattgtgttttggtaaaagacatatcagtttcgaaagcagctaa

SEQ ID NO: 90829 - DNA, 198 bp, Glycine max
  Peptide Sequence Number=SeqID_207607
atggggatcgcacccacaaagacactcggtggacccagaaaagtcaaacagagccctgggatttccagctctggttacgggcctctatcagtcctacagggtgcccgtacccccccggcaaggtcacgtcatcatagggattgcgcctgtagtggacccgaagaagtccaacagggtcttggagttgtcaagctctaa

SEQ ID NO: 90830 - DNA, 231 bp, Glycine max
  Peptide Sequence Number=SeqID_207608
atggacctagtactttgcttacctttggctttggacttggtcgcttattggtcggccatgggtcaggtgaactctagaggtggcggcggtgcgtctattgcccgctaccggccatcccaatgctactgtggtgtctcgccctgcacccgtctgggggcgcagtacttcttgatgaaagctcgattagtagggggcctgatgcccttgctggaggtgacaggtactccgtag

SEQ ID NO: 90831 - DNA, 342 bp, Glycine max
  Peptide Sequence Number=SeqID_207609
atgtgttccggtctggccgttctggctcttgtcaccggcttatgcgtattctcccgtaattatcgtcatcgtccggtgtaccagttgggcaaccacatcgcgatctgcggaaagatcatcagaaggatgatggtcagcaccatgaggaagaagaacggctcgcatcatgaagagattgtagccgaagggcggcgtgatatacgcgatctggcaagtgatggtgtagagcacgccgaaccagatggcgttaaagccgaggctcttgaccagcggtatgtaaagcggcgctacgatgaccagcatggccgtatcatcaaggaacatgcccagtatgatgaatga

SEQ ID NO: 90832 - DNA, 649 bp, Glycine max
  Peptide Sequence Number=SeqID_207610
atgggcatgagtgagaatagcaagcttaacaaacgcgattttctcaagaaagccgggctgacaaccgttggcgcgctgggtgcaagcacgcttgcaacgccatatgtgagggcgcaaagcccaatcaaatggcggctccagacttatgcaggtccggcacttgcagagcacgtcatcaagccgtctatcgacgccttcaacaaggctgccaatggcgagatggtgatcgaactttatactgccgaccagcttgtgccgcagggtgagctgttccgcgcggttcagtccggcacaatcgacgccgcgcaaagtgatgacgactccatggcgtcaccagtcgatgtcgcggtgtttggggcttatttcccctttgcatcgcgctacagcctcgatgtgcctgccctgttcaactggtacggactcaatgaaatctgggaggaagcctataaggaaattccgggcgtcacatggctcagcgccggttcctgggacccctgcaatttcgtaaccaccaagccgatccgcagcgttgctgacctaaagggacttcgggtcttcacattcccgaccggtggccgtttcctgaccaaattcggcgtcgtgcctgtcacgctgccttgggaagatatcgaagtcgctatccagacgg

SEQ ID NO: 90833 - DNA, 702 bp, Glycine max
  Peptide Sequence Number=SeqID_207611
atgaaccgtatttcaggcaaagtggtggtgattaccggcgccagcagcgggctgggcgaggcgaccgcaatacatctggccgcgcagggggcaacgatggtggtggcggcgcgcaggaaagatcgtcttgacgcactggttcggaaaatcgttggcgacggcggcaccgcgttggcgctgcaggcggatgtgacgaagcgtcaggaggtcgaagcgatgatcgcccaggccgtcaggcagtttggcaagattgatgtcttggtcaacaacgcggggctgatggcgatcgcaccgctgagtgccgtgaaggtcgatgaatgggaacggatgatcgatatcaatgtgaaaggcgtactgtacggcatcgcggcaaccttgccgctgttcgaaaagcagcaattcggtcattacatcaccatttcctccattgccggcaagaaggtgttcagccccggcggcacggtctatagcggcacgaaattcgcggtcagcgcgatcgccgaaggtttgcgtcacgaagtcggcgggaagatccgaaccacgacgatcgcccccggcctgatcgacaccgaactgaaacaaggcagttcgcacgcggaaagtttgcaggccgtcggcgaactctaccagagccaggcaatttccgccgatgccatcgcgcgcgccatcgcctatgcgatcgagcagccttcggacgtggac

SEQ ID NO: 90834 - DNA, 719 bp, Glycine max
  Peptide Sequence Number=SeqID_207612
gcccgcgccacgatcagccagatggcaccgatacaggccaggacggcaccgaccaggtgggaccaggcgttgaagcgttctccgtagtacatgcaaacacagacctcctgaggtgggctggattcgtgcgtccttctgttccggcctcttcgcgggtaaaccgctcccacagggatcccacgataccagagggtggcgcactacctgtgggagcgggtttacccgcgaagaggccctgtgtcttacatcctacccaagctcaggttgcaattgcgcgtcacgcaccagccgttccagcccggccaggtccggcacccgcgctacctgttcgcccacctgcaccgccgccacaacaacgccaggtagcgcagaccggtatcacccaaggcattgagcaccaccacgcgtgcccgctcgccgcagggtgtctcgccaccgcacgcggcttcgaagccgatcagcggcaggcgctgctggcgccagtcgatccagcccaggtgccaggccggctcgccgcgttggcacaccacattgcgctggccactcaactcggccaccgccacgttgggcaacaccagggtacggtcacccaacggcagcaaaagcccggtcaggctgctgcgttggccggcgatcagttcaagcatgggtctggctccagtgggcaatgctctgcaacaggaccgactcctgatacggcttgcccaggtattcgttga

SEQ ID NO: 90835 - DNA, 341 bp, Glycine max
  Peptide Sequence Number=SeqID_207613
atgtccagctccttctattctatagttccttccctctttccttcaccaccagctggagcgcagtcttcgccggtctccaggttatcaacaagacaagacctatcacgtgactacgagctttttccttactcagacagaccccaagcaggcacgttgggcgagatgcaagactttttcttcaaggagttagagcagaagttgtttactcacgctcagctcaagccaacttctatcagttcaggcggaaggtcagggggagtggtacaattaggccttcccttcggtaaatcgggccctccccctgtctacagctatgctatctctatcactgctaaggtcag

SEQ ID NO: 90836 - DNA, 890 bp, Glycine max
  Peptide Sequence Number=SeqID_207614
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgttctcttgcatagagaggttgctatcttctctaaacgtggaaaagttggtgcttcctgcagccagggatgctgagtcaatttggactatgaaattaggcttccgaaagatgagtgaagatcagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 90837 - DNA, 324 bp, Glycine max
  Peptide Sequence Number=SeqID_207615
atgaccggaaggcttcttgccggttcattggctcttgaaagccgcatcctttactatcttattgttcatatcttactcccaagatcttcaaaccttgctcagagatctttcttgatcagtgctgctgtggttgcgtcctttggttacctcaaagagcgtgatggctcttgggtaaaaaagggtactcaaccaaatgatgatgaaggacaattaccggttgaaggagactcttctctccttcaaagtattttggacaggttcaatggactcctaacatatgttggtgaaaggtttgatgctttggaacaacaagtggacatgtga

SEQ ID NO: 90838 - DNA, 788 bp, Glycine max
  Peptide Sequence Number=SeqID_207616
ggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatcaagacgccggtgctggcgctgacggcgcgcatcgatatcgaggatcgggtgcatgcgctggatgctggggccgatgattacctggccaagccgttcgacttccgcgaactggaagcgcgttgccgggcgttgctgcggcggcccagcgtgcaggcggcgggggtgttgcggtttggcgatctggtgatcgacagcgcggcgcggcaggtcagcctggcggggcagcgcatcgatctgcccaagcgggagtacagcctgctcgagatcctgctggccggcatgaaccgcgcggtgagcaaggccgagatcgccaacaaactcttcgcgttcgatgatgatgccgcgcccaatgccatcgaggtctacatcgcgcgcttgcgcaggaagctggaaggctcgccgctgcgcatcgagacgcagcgcggcaccggctacctgctgaaggcggtcgaatcaagcttatcgataccgtcgacctcgagggggggcccggtaccagcttttgttccctttagtgagggttaa

SEQ ID NO: 90839 - DNA, 207 bp, Glycine max
  Peptide Sequence Number=SeqID_207617
atggcgccgactaggcaccctctggacccagagaagtccaatagggccctgggatttccggctttgatcacgggcctctgccagtcctacggagtacctgtcacccccagcaaggcacagggtaacgcacatcaggccgcgggcgcaccgccaccacctcagcaggccgatctggctggaccattgggcgtggagcattatatatag

SEQ ID NO: 90840 - DNA, 666 bp, Glycine max
  Peptide Sequence Number=SeqID_207618
atgttccttcgcggcaagcccctgttgatcgccctgctgctgcatctggtggtcgcgctgctgcactgggcactgattccgctgggaatgaactggtatcgcgaccatttcggcttcacctcccatcgcgacatcggcctgggcatcgcccagttccatctattctggatgttcattggcgcccagccgctgatcgcggtgttgcggccattgttcgccaagttgctggtgctggcgatcccgttggtgttcgcgacctggacgctgatgcacaatcatccgctgcgcctgctgtacttcaccatcgggcccggcctgctggcactggccgcaatcgcgacgctacatccgcctgttctggctgctggttgcgttgacctggctggcgctgatcgctgcactggtcaatgccggcttcactccggactactggctgctgcaccacctggaaggcgccgagctgccctatccgaccagcaccgtcatcgtgttcgcgctgctgggagccgtcgagctggtggtggccgcgctgatcgtgcagccctggaaactgaaacgcctgtggctgcgcctactgatcgcgttcgcgttgctggtggtgtggtcgataccgtggatgctgtcggcgatgcaccagccgccggaacaaggcatgcacctgctgtg

SEQ ID NO: 90841 - DNA, 885 bp, Glycine max
  Peptide Sequence Number=SeqID_207619
atggctccattgtcgtcactccaaaatggtcaagtgattaaatcaaaatggtcaaatgagaggccctctcaaagaattaacctcttgctttcttgtaaggttaaagtcctttggtacttgtacctattggctcgccttcagaggactgcatgtcctcaccttcagagggctcacgccctcgctatcagaggactgcatgtcctcaccttcagaggactgcatgtcctcaccttcgtagggctacacgccctcacctttagaggaccacacgtcctcaccttcagagggctacacgccctcgccatcagaggactgcatgtcctcaccttcagagggctacacgcccttgccatcagaggactgcatgtcctcaccttcagagggctacacaccctcgccatcagaggactgcatgtcctcaccttcagagggctacacgcccttgccattagaggactgcatgtcctcaccttcgtagggctacacgccctcacctttagaggatcacacgtcctcaccttcagagggctacacgccctcgccattagaggactgcatgtcctcaccttcagagggctacacgccctcgccatcagaggactgcatgtcgtcaccttcgtagggctacacgccctcacctttggaggactacacgtcctcaccaacagagggctgcacgccctcaccttcagaggactacacgtcctcgccttcagaggactacacgtcctcgcctttaaagggtcatgtaccttcacctttgtagggctacacgccctcaccttcaaaggactacacgtcctctcctttagaggactacacgtcctcgccatcagaggactacatgtccccaattttcaaagggggacatgccctcacctttag

SEQ ID NO: 90842 - DNA, 991 bp, Glycine max
  Peptide Sequence Number=SeqID_207620
atggatttctatggcaagagaaccctcctcagcctaatggacaccgaaaagccagaacaaccgccacaatcccccgtccaccttcgcgtccaaacccacagagagattagcgaacaagacgttcagttcagtcctccaaggccttcaagcactactacttccgatggcatgttccctatgatgatgccagattcaccatggacactttcccctctcccaaccccttcaccttctcttctttatcactgcatcgcttcgctccaccgccacgaaggtaacatctacgcaattgcagcttcaaagggtttagtctttaccggctcaaatagtagtagaattcgcgtgtggaagcaaccagattgcatggacagagggtacctcaaagcaagctctggtgaggtgagagccattttggcttatagcaacatgcttttctccacgcacaaggatcacaagataagaatatggaccttcaccgtttcggatagcttcaagtccaagaaagtaggtacactccctagaaaaacttctattcttttgttcccctcaagaggaaaaaacacgccaaagcacaaagattctgtgtcttgcatggcttattaccactctgagggtctcttgtacactggctcccacgacagaacagtgaaggcgtggcgtgtttcagatcgaaaatgcgttgactcgttcgtggcacacgaggataatgtcaacgccatattggtgaaccaagacgatggttgtgttttcaccggttcctctgacgggtcggtgaagatatggagaagggtttacactgaagactctcacactcttaccatgactctaaagttccaaccttcaccggtcaatgcccttgcattgagttgctcgttcaaccactgtttccactattcaggttcctcagatgggatgataaatttttgggagaaggaaaggttgtgttataggttcaaccacggagggttcttgcaggggtcaccgttttgcg

SEQ ID NO: 90843 - DNA, 168 bp, Glycine max
  Peptide Sequence Number=SeqID_207621
atgtggtgttatgagtggaaaaagagtgaggccttgagagttggaaggttaaatctggattctgtggatttgaattgggcaagattggatgaggggaaagtgtggttttcgaaatctacactttatgcagaattttgctgtgaaattgtgcagcagaattttgcataa

SEQ ID NO: 90844 - DNA, 183 bp, Glycine max
  Peptide Sequence Number=SeqID_207622
atgtgcaaagttttccatggctgcaattatcataagttggattttgtgcagcagagaaacaaagagcaacctgaagagcctataagagtggaatgccacatgtttgagaagaatacattttgcagtggggctgcctttgtccccagagacggggtcttgaagaacatgacggatggatcatag

SEQ ID NO: 90845 - DNA, 125 bp, Glycine max
  Peptide Sequence Number=SeqID_207623
gattaaccacgccgtttgggagagaaaccacgcactgtgcggacagactggccaatgtaaacctggtgctagagcctcctagtttcaaggatcacaatgtatctaactatgtcttaaactgttaa

SEQ ID NO: 90846 - DNA, 1740 bp, Glycine max
  Peptide Sequence Number=SeqID_207624
atggaaacgcatatggcattggcagcttcatacatgactcttgcacctaaatactgctgcgttcagaaacgaccctttatcataacttcaggactttcctccgccttcaagccgatcttaagagcgttgcctcaaattccactgcaaattgatgcttccaaaaccttcacagacatcaaatcgaaatttcttaacgccgttgtggattcagcatttgagtttgtcgaccagcttgtgcttccatctcagagtaactttgctccggtggaggagttaggggaagccgtggctatcactaacattgaaggtgacataccagatcactttccagagggtgtcttcattagaaatggaccaaacccactctttggaggattgaaatcatccaagtctatcttggggaggacaaatagcgtgtgggtggaaggagaaggaatgcttcatgctttgtatttcaaaagggaaagtgacgggtgctacaccatcgtctacaacaacagatatgttgaaactgaaacttacaagcttgagaaacaaagtgccaagcctttgtttctccctgccgtaaaaggagattcattggccgttttgtcttctatgcttctaaacgggttgagatttggacaactgaataaagattatagcaacaccaatgtgtttgagcattcgggcaagttctactcggtttcggagaatcacatgccgcaagaaattgacatctacacactaagtacattgaaatactgggatgtcaatggagcatgcaatcgtcctttcgccagtcaccccaagaaagttccaggcacaggagagctggttatttttggcgtagatgcaactaaaccttatcttgaaattggaatagtttctgctgatggaaaggaattagttcataaagaagacataaaactagacagatgctctttatgccatgatataggtatcacaagcaggtatatagcgatattggatcttccactgattgtagattcaaacagactacttaaaagaggcccattaatcaagtacgagaaggaaaaatatgccaggattgggataatgccactctatggtgatgaaaaatcaacccagtggtttgaggtggaacctaatagcacatttcatatcatcaattcctttgaggatggtcatgaggttgtgttgtggggttgtagagcattagattcaataattccaggacctgaagatggtctaaatgaatctacgatgttctctcggtgttatgaatggcgattaaacataaaaagtggggaggttaaggaaaaatatatcactggaccagaacagtttatggattttcccgtaattaatgcaagttttacaggaattaagaatagatacggatacacacaagtggttgatcccgctgcaagttatgctgcagatattcctaaatatggagctttagcgaagctatactttagagaaccatgttcagaatttccaaagggagatacacaacaaaagcctataagggtggaataccataggtttgaaagaaacgtattttgcactggatctgcctttgtccctaaagaaggtggtattgaagaagatgatggttggataatcacttttgttcacaatgaagataccggcatatctcaagttcatataattgaaacaaagaagttttctggtgaggcagttgccaaaattaccatgcctttcagagttccatatggatttcacggagctttcatgccactctcattgtag

SEQ ID NO: 90847 - DNA, 1272 bp, Glycine max
  Peptide Sequence Number=SeqID_207625
atgtgtaacagtaacaccctcaagttcaacccctttaagaaccgtttgctaataatgttcgtgctggttctttctctcccctccaatgttcaatcccaagccaaagatagtgaagaaaagaacctgccagaactccctcaaatggttcatccaagcaagggaataataatagcagttctcaccacaatgtttgccatagcatttcccttacttctctatgttaaattctgtcgagttatccctcatgaactccttaggcaaaactcaaatctccaaaactttcagggcctaactcgaccaaggtctagagtttctggtattgacaaacaagtaattgaaacacttccttacttcaagttttcttcccttaagggttccaaagaaggcctagaatgcacggtttgtctctcaaaatttgaggacacggagactctaaggcttcttccaaagtgcaagcacgctttccacatgaattgcattgacaaggttgaagcaggggacatgaagaacctcaattattcattaagctcgaggttccttcgagttccttcgaatcccacggaggatatttcaaaccttgaaatcttcgttgagagagagccatctaatcgagggtcatcgagaaaaggcttttgggacgtgggcaagtgcaagaaacaagaaccactacttgttgaccaaggtggtggtgcttcaaagtggaacaaacatgagcacgtgatgaatcataagatagttatctctgatgtttttacgaggagcaggtggagtgatcttaattcttcggacctgttgtcattgaatagtgagatgattaatgatgtttgtgtcgtttgcagcacgaggttcagttcctgtcctttggaatccaccgaccctagtggaaggtttcatgggacttcgagttctaatgagaaagaaaacttgtttacgacactgaataatcctgcggagaagaggtgcatgtctgagattgctaatgttccaaggtttgcacaaatggggaaggataattggatcgaagaacagtccaattgtttgcaaaacaagaaaggaatttacataaaacatgttaggaaaatattcaagtcttatatcggctgctgcctcacgcattgccttgttttttgttttattgcttgttgctttgtctggtttaataatatcacttatcctagtgagttttacggattcactaggccagaagcttctcaagctcaaacatttacttttctagttagaggccaacatcttccactctataaatcatga

SEQ ID NO: 90848 - DNA, 1366 bp, Glycine max
  Peptide Sequence Number=SeqID_207626
gccacgagcttcggcctccaacacctcgggtattgctattggcattaccacatttgctaatggcactatccacctaggggaaggaactgcaggtctatcatctgagtctgaaatggttaagaatatgacgtttttgaatgaagcaaattctactggtgaaaatacccttgagattgttaatgaaactaggacttctgaggaaaaggactctgtttcaagcactggtttaacctcagaatcaggaagggaatcaagcagatctttaggatttgatgaaagaaatgaaagttccactgtggaatgtattgagagagcaaataatggttcagcaacagagcagataggaaatcttggactgagcatttacaacaatactatttctcattccccttctcatgcaatagctccacctctaagtcaaacagaagtgagcccaaatattacgtctccaatgttatcaaatgcttatgatgaaactgatttcatggaggaagagaggttcaggccatcaaaagatgaattcaatatagtaggcaataattcttctatcaaccgtgtgcctaaggagactgaaatgaatgagttattgcttcagaaccgtgcctcatattgttctatgaggccaaggtggtcttcagctgttgatcaagagctattgcaggccagatcggagattgaaaatgcaccaattggatggttcatgaggctgatggaagctagtaaacaatttgtgactaaagacccaaagaaagcccagctatgttacttacctttcagttctcggaggctagaggaaactttgtatgtaccgaattcacatagttctaggaacctgattcagtatctgaaaaattatgtagacatgattgctgggaaacatcgtttctggaacagaacaggaggtgctgatcattttcttgttgcttgccatgatggggcccctacagaaacacggcaacacatggctaggtgcttaagagccctatgcaatgctgatgtgaaagaaggttttgtcttgggaaaggacgtttctcttcctgaaacttatgtccgcaatgctccgaagcccactagaaatgttggcggaaaccgagtttcaaagaggaaaactctggcgtttttcgcaggaggaatgcatggttatgttaggccaattctgttgcagcactgggaaaataaaaaccctgccatgaaaatcttcgggagactgccaaagtctaagggcaacaggaactacatccagtacatgaagagcagcaagtactgtatttgtgcaaagggatacgaagtcaatagcccaagagttgtggaggctatcttccatgaatgtgcgatacatcctctacccctcacaaataacgaataa

SEQ ID NO: 90849 - DNA, 435 bp, Glycine max
  Peptide Sequence Number=SeqID_207627
atgttgagaaggtttgacgtgaggaatgcaaagcctgaaagtattccattggcaaaacgctttaagctttctgtaaatcaatgtttgaagacaaatgatgaggtggaatacatgtcaaaggttccatataccaatgcaattggttgcttaatgtatgctatggtgtgcactagaccagatttgacacatgttagtgatccttcaattgtgggatatgtggattctgactatgctgatgatctggatgacaaaaagtctacaataggaaccaaacatatggataggttccacaagatcagggagttgatggaatttagtcaggttttgctcaagaaggttcacactccagagaatgcaactcatatcttaactaagatagttacaaccgacaagttcaagcattgcttagagttgttgaatgttgttcagtactag

SEQ ID NO: 90850 - DNA, 1917 bp, Glycine max
  Peptide Sequence Number=SeqID_207628
atgggtttgcttcaatttcttcttctgatctctctaggggcagaaactacgagattagtttcatttgtaggaataacagtggctatagttttcatggttcagtattctgaacttcctagtagtaaattcttatcttctgttactaccaagtttactagtttcacaatggatacatcatcttcagttaattctaaagtggagggtaataatttgcacctaaatggttcaaattcaaactctactcatgcattggaagagacagcaattagtcctcaggtacctctctttcacaatggcagtgattcaattacttcccctgcagcagatacatctaaagatcttgatagtgttgtcaatttcacagccagaaatgatggttccccggtgagtagtgttcagggaagagaaattaatttgacatcacaaggggcttcatcaccacagcctatggtgccattgcccaacagaacatccttagattcagaaacggattcaagaagtcctgtggtatctgtcacttcagctgcaacttcagtgaaatcgaatactgatccagtttataaggatggaaactcaggttctttgccaggtaatagtaacttgacatccaataatgtcaagcctgtgactgcaaagaattccaaaaagaggccatctaaagtagtttcaatatctgagatgaacttgctgttgcagcataatcatgcttcttccaagctagcgaaaccagcaagggcttcagctgttgatctggaaatattgcatgcacaatcagagattttaaatgcacccctcattatgaatgatccaaggctttaccctcctttatacaggaatgtctccatgttcagaaggagttatgaactaatggaaaatatgctcaaagtttacatctaccaggatggggatagaccaatctttcatgagcccttactggatggaatatatgcatctgaaggatggttcatgaaattaatggaggcaaacaaacagtttgtcactagagaccctgggaaggctcacttgttttacatacctttcagttcaagattgttgcagcaaactctctatgtacgtaattcacacagacgttccaacttaattgagtacatgaaaaattatgtggacatgattgctggaaagtatcctttctggaatagaacttctggagcagatcactttgttgttgcgtgccatgattgggctcctgcagaaacaagagggcgcatgcttagttgcatcagagccctctgcaatgctgacattgaagtaggattcaagataggcaaggatgtttctcttccagaaacatacataaggtcaagtgagaatcctgtaaaaaatatagggggtgatcctccttctaagaggcctatcctggcttttttcgcaggaggtttacacggttatgttcggcctattctgttgaagcactgggagaacaaagaacctgacatgaagatatctggtcccttgccacatgtcaggggtaatgtaaactacatccagctcatgaagagcagcaaattctgcatctgtgcacgaggtcatgaagttaatagcccgcgtgtggtagaggcaatattccacgagtgcattccagtcatcatatctgacaattttattcctcctttctttgagattctgaactgggaatcttttgctgtgtttgtcaaggaggaagaaatccctaatttgaggaacatactgctgtccatctcagaagaaagatacttagagatgcataagagggcgaaaaaggtgcaagagcattttctctggcatgctgaacctgtaaaacaagtcactgtgattgatagcttgatgatgtatagattgtttgagttaacaaatgaagcaagaacaatatggttagagaaaaagttcattgattctagagaaaatgttattgtttga

SEQ ID NO: 90851 - DNA, 789 bp, Glycine max
  Peptide Sequence Number=SeqID_207629
atggtgaagggggtcaagtcaattgcccaagatgtctcttccaagcccaagattgattctttagctctcaagaagaagctaaacacctcaatcaagcacccgcctgattctaagttgaagtttgtcaccactacagtcacaaaatctgaggtgaaatcaaaaccggtaactacatcatcagcatcgtccaaaacaataacaaagacaactactaccaaaaccaaagtgagagagaagaaagtctatagtctgcctggccagaaacatgatcctccagaacagaaagaacccctgaggattttctatgagtcattgtcaaaacagataccaacaagtgaaatggcagaattttggaaacctccttgtcatttattaacagtttatactccatggaaaatagtggtggctcactttcgttattacacctctctattttcttggtgggacttaggagcaaccctgttaagaagcaatcgacagtcatctttattgcctgtttggatacaagctagaaaagcttctgaagagtgttttagcaagttaatggaacatgggttgctatctcctgaaaaagctaagaaagcatttgagaaaaggcagaggaagcaaaaagagcttcgaacaggaactcctgttaagttatcaaagccgccaactaagactgcaacatcacagaaacaacaacaggtatcaaagaacggtgacataaaagccaagaaaagaattgtcaatgagagtgatgatgatgatgacgatttcattttaagtcataaaagaagaaaatggtaa

SEQ ID NO: 90852 - DNA, 822 bp, Glycine max
  Peptide Sequence Number=SeqID_207630
atggaggatttggattggaaaaagttgcaagagagggttatggcaaccatatgcttgtgtttagcaaacaaggcccctttatcacgtgatggagttgacatctttagggaggaacatttcaagagagattgcccagagttgaagaaatctagtgaagggtcatcccgcttagcaaatgtgatacagactgacgatttggactactacagtgaaggaaatgttcactctggttcatgcagtcagttgacaaatgcatggattcttgattgtggatgttcttaccatatgactccccaaaaggactggttcaccacatacaataagtgtgagatggcagagcttcataagagacgagtcttgaaaggagttcggagttgcaagttagtcttgtgtgagtattgtctgcttgggaaacagactaggggtcctactagagattcatccttgggtgattctcactattttgtgaccttcattgatgatttttcttgcaaggcctggctgccagtgattcttgagaaggcagaccaatgcagtccaagacctaaggtcacacccacacctaggcttggaccagtgagtccaggtggactgcatcaggagtataatcttgttatagatagagatcatcacaccattaaacatgttatccaatatgtgtttgaagaattggctaaattgattgcttttgcacttctcactagtactagagatcctttttaccttttaagaggctatgaacatccaggagaaagacagatggatgagtgttatggtgaagaagatggagtctttgcagaagaatcaaaaatgggctattga

SEQ ID NO: 90853 - DNA, 1185 bp, Glycine max
  Peptide Sequence Number=SeqID_207631
atgtcatcttgtcacgggcacgaaggatacatgctgaaggtcatgtgcggcggactggaggattacgagcgtttcatcaaggacaagatcgcgaagctgaaatgcgtggacaccatcgagaccagcttcgtcatgaatacgatcaagacgcggcgcatctgggtatcaggtgccccattctcgggcggctcttccgcaagcaacaaggcacatcctgacatgaacccggacttcctcgtcacccattccggcggcttccatgccgatgaacttctgtcgagcgttgtgctgacacggcttttcccgcaggcccgcctcatccgcagcagggcaccggaatggctcgctgccggtgcggaccgcatcatctacgacgtgggcggcgcctacgacgcagcaagaggaatgttcgaccaccaccagcgcggcgcgccgttacgcgatgacggacagccctacagttcgttcgggctgatctggaagcatttcggccgcgattatcttgctgccttcggcgttccagaagaccacatcgaaaccattcacgcttctttcgatgccggttttgtgttgcctgttgacctggttgacaatggggcactcagcccctcgacggccggaccgctcgccgggctgaccctgcccgtcctgctcgaaactctgaaacccgtttttgatgacaccgatcccgaagcggacaatcgcgatttccacgcggcgctgggcattgcccgcagcttcgttgaggcaaaaataaccaacagcgccgcaaagttgcgcgccgaagcgctagtaaaacaggctatcgtggatgctggcgaagggcatattctcgagttgccgatgggaatgccgttccggcccgccatcgtgaaggcaggcgccgatcatctgctcttcgtcgttcatccgcgtaacaacgactggtgcctgaccggtatccggcgcgccgacgagggcttcgcgttgcgggcggatctgccggcggcctgggcaggcctgactgacaaggatctggaagcggtttgtggcgtggaaggcgcgaccttctgccataacggccggtttgtcgcagctgcaaagacccgcgacgccgcgttggccatggcagaactggcggtaaaagaggctctctccttcagcaacaatgcaccggcgacagagccgtcaaatggcgggacctga

SEQ ID NO: 90854 - DNA, 768 bp, Glycine max
  Peptide Sequence Number=SeqID_207632
atggggtttgttacctggtgggagaaatattattcgacccgttcagttggagacactactatcatgatctccagacttgagagtggttttacacaaccaacggtcgagaatatccgctcaaaccttcaagctcgaggcaaaacaatcatgacgaagaaaagtgctgaaacgtctcgagctgatgtgagacccaagaaacccactggggtgaagatccaagaagggaaacaagaagagaaggaagaaaaggaaagacctcttataagaaaaagaaagttacctgcgacttcgaccaagtctgctgaacaaacagaggcaggcaattcccaggctcaaatgcctaaaaagaaaaagaaagtaaagcaggtcgagcctgaaccttctgtggctgttgagggtggtgaaccaatcaagaagaaaaagaaaaagaccaagccttcaaaagaacaaggtgacaatcaacctgttgacgtccaaccaccttcgaccgatattgacggcactgaagtagaggctactccttctgttgctgagatgggcaaccctgtcgatcaaccggactcaccacaagaacaacctgccgtcgaggtacaacaaaatgtttctgtagaagaaataccctcacatgctcgaacatctcccactcctgagacggatgcagtgaatgttgaagaacagggtgaaggtcaaggcattggatccagcagtcctcatggatcgagtcaaaaaagttcatccgaagaaacttttccgatgaagaggccatag

SEQ ID NO: 90855 - DNA, 150 bp, Glycine max
  Peptide Sequence Number=SeqID_207633
atgacgactctttgcaaatccaaaggaaggaaatccgaacatttccataaggattacctaaagtgcaagtcttggttcgaaaagaaaagtgagcttaatgctcgtgtatgttttgaatcaaacttaactaaagttttccatgatacatga

SEQ ID NO: 90856 - DNA, 900 bp, Glycine max
  Peptide Sequence Number=SeqID_207634
atggagttcattttgaatgctaagggccatccagggaggattctcaagaaggatttgactaccttggcccaggtgtggagtgttctctcttactctaacctggcccctacatctcacacatcagatcttactgtggatagagccaggttgatctttggcctggtctctcatatggacatgaacatcggtgctcttatctcaggacagatgacttccattacccagtctaactgttgtagattttggtttcctgctttgatcaccgccttatgtcgagcccgaagggttgtctctgacagcctcacatttgagcgcttgagcccggccattaacttggcctacatcaggaagtactgttggaacattgattatttaacagttgctttccaggggactaggagggcaagggcgaggctagctgatattccatcttcttctgcagctccagcatctacttctgcagctccttcagttccagctcatgttgactcgcaacattttgaagccatgcttcaaagtatcaatcagggtcagattctattgctgcagagtctacatgtggtagctcctccaggatccatcctgtcagtggagcagttcttagagagggtagcctggcctggggcccaaccttctcttgatagagaaggtgaaggtcccgcagcccaggcaggggaagaacaggcgagaccagagactgctgctactcctaagagatcccttgagggcacatcatggcctcctactctagtggcagacctctccttatcaacacctgcaactgacctttccactcctttacttggcataccaaaggaccagaccacaccaatcctggcactgaacacctctcctccagctactccagtactttatctgatagatgaggaggatgattag

SEQ ID NO: 90857 - DNA, 177 bp, Glycine max
  Peptide Sequence Number=SeqID_207635
atggagcatccaactcagatgatggaagaatcaacaatggagactgtccagacggaagatgaatcccaagtgagccgatcaacaagagtcagacaaccatcaaagaggtatctctctgatgaatatgtcaatctccctgatgatagggaacctcagagtttccaggaagccattcag

SEQ ID NO: 90858 - DNA, 174 bp, Glycine max
  Peptide Sequence Number=SeqID_207636
atgatgaccaagataataccaaccaagaaggttgaagactgctgtcaaggtgctggtacaatggtgcacaccaattatgtcggaagggggaggaagtcacacccctcttctataaataggaagacttgtgaagagttggaacatctcatccaaagagaagcaaaacaagagtaa

SEQ ID NO: 90859 - DNA, 1074 bp, Glycine max
  Peptide Sequence Number=SeqID_207637
atggctattcaagaaggaggaaaaattgagtcagatatatggtatgtggatacaggttgcagtaaccacatgagtggattaatgggaaaaggtgatgtcaagataaaaaccaagaatggctttgtggaaacaatctcaaatgtgttgtatgctccgaatttaaaaagcaatttattaagcgcgggtcaattacaagagaaaggttatgtcattacaattcagaagggagcatgtgaaatttatgatcctgttagaggtgccattgcaattgttcgaatgagttcaaacagattgttcccattgaaaattgaaagtattcagacttgcttcaaggctgacatggaagatccatcatggttgtggcactttcgttatggtcacttgaattttagtggactaaagaccctgcaacagaaaaacatggtgacagaccttcctcaaattactattccttcccaagtttgtgaagaatgtgttgttggtaaacaacatcgatctcaatttcccaaaggaaagtcatggagagtaaaagatgtcttggaactggaaaaatcagaagtgttttctacatttaaaagcttcaaagcaagtgttgaaaatgaagcaggaaagtctataaagactctttgcacagatcgaggtggtgaatattgctccaaagaatttgaaattttttgtgcagaacatggcattcgaagagagcttacaactgcatatacaccacaacaaaatggtgtctcagagagaaaaaacaggaccattttcaacatggtgagaagcttgctagcaagaggaaatgtcccaaaatcattttggccggaagcagtaaattggagcattcatgttttgaatagaagtccaaccttttctgttcaaaatatgacaccagaagaagcttggaaagggaggaggccagcggtagatcatttcagaatctttggatgcatagcatatgctcatgtaccagaggtaaaaagaaagaaactgcaaaactacaaactaggaaaaataagtgtaacatgcatagtgctacaacaacctcctaaagacttggtaaactcaattaatatctaa

SEQ ID NO: 90860 - DNA, 519 bp, Glycine max
  Peptide Sequence Number=SeqID_207638
atgaagagaaaatatgaagactctgtcagagtgaagcgtgcacagcttcaagccttgaggagagattttgagacactggctatgaaggatggagaatctgtgaccaactattttgcaagaacaatggagattagtaacaagatgcggttccatggcgaaaagatgacagatgccactattgttgagaagattttgcgctccctaacaacaaatttcaattatgttgtttgctcaattgaagaatcaaaagacatagatgtgctgtctattgatgaattgcaaagctccttgttggttcatgagcagaaaatgaatagaagctctaccacagaggagcgagcactaaaggcttctaccactacaatattcattcctccgatttcagaggaagggggagagggagaggtagaggtaggggtagaggaagaggagaacgtggaaacagagaagataacaagaatcccagagctaatactacaagcaaaggcagaggacaatactctgacagatccaagctag

SEQ ID NO: 90861 - DNA, 1072 bp, Glycine max
  Peptide Sequence Number=SeqID_207639
tccattatcatgcagagccttcagagcatgggccctccatccatcatgagcatggatgagtttgacacgcaggtagcatggccaggagcccagccttctccttctggagagggtggggcctccacagcccaggagcctgagccagaggagccaacagcagcagtagagggggaggatgagctgactcctcctaagaccttttattttgatgcaggtgtacacatggctcaggaggaggagacttccacagaccagattccaaagccatcttcaatacccatacctgatgattccatgccagctacaccaacatctgagctagagcagcctatccctcaggattcaccaattgctcagaaagcttgtttgaacagtgaactggttgaatttgatatgcagtggattgttttgtatgaaatgagtccattagaagagaatgagcatgtgattggaagtatgcttgaaaatgttagtcactttgttagattgattgtgaaggaatgcattgactgtatcccagccatgtttgattgtgatagccacttagccaaaaagctgaccacgagagcatcatctgcagggagcttggttcaaagcaaatttgtcccaaattttgggagtaattatcaagctgtctgtagaatatttccattggatttaatgatgaaatctgtgcaatttcaggttaaaaagaggctaagtcgtgaagtgctaagagtgacagttaagcttagctcatcagttgggctaagcgcgcatccatcgctaagcgaagctttagcacacttagcgcgacaggagaatctggcaaagcatcaatatcagtgtgctaagtgtagcaaattagggtacacaattacacaaatagcatttgcagagaattccaaagtgttgcaacctacccttcggcgggagggcgatgtggagctcgcgggtgcgtcttccatggaaggaaaatgcgcggagtcgccaccaacgtttattcgaggaaaacgtcggaaaaaccggaaaaggtgtggtctacgaactttaagtgtgaaaggttcaggagttgtatttatgcacggggaag

SEQ ID NO: 90862 - DNA, 192 bp, Glycine max
  Peptide Sequence Number=SeqID_207640
atggagaatgaggaaagaattacccccacttggctctttatcctagtccacaacatcatacccttcccgtttcgaaacatcacccatctcttcaaatggtgctctaaggtgatgtgttgcaaggttaagtggtggctggacaaaaatatagaaatggaaataactgaagctacagggctccaaatgaggtga

SEQ ID NO: 90863 - DNA, 234 bp, Glycine max
  Peptide Sequence Number=SeqID_207641
atgcggaaattgattaaggaaaggatggaaaataaggtggataatttcgtgggtcttaataaggtggtttctggcataaaatggatgaatgagatggtaaaacaggtggattttctggaattgtggtttgaaagaacaagggtggagatgattggaaggaaagaatcactctttccagcgagggcaacacacaaaggttgtgaaagtcctttgatacagccagggtgttcttga

SEQ ID NO: 90864 - DNA, 222 bp, Glycine max
  Peptide Sequence Number=SeqID_207642
caagaggccgagggtgaagctgaggagatgccagaggacacccctgttgccacaccaattgaggccactgaggaaggagacggtgctatagatgccgattacgttgcagatatggcaacagcacagagcacttgggatccctggcccactccagctctggatacatcattgccagttcagcatgctccctcctcacctcatgatgaccctacaccggcatag

SEQ ID NO: 90865 - DNA, 318 bp, Glycine max
  Peptide Sequence Number=SeqID_207643
atgctttggaaatgcatatatgtgaagataggtagcaaaatatcttgcacgcatgagatggccctgaaaaagcttcctgcaaaaaggtctaggaaggacacctccggagaaggctccagcgctgccctgcaggctgacatggacttcgatcatcaccgatttcgaagtgccgaacatcagcagcactttgagaccatcaaggggtggtcatttctcagagaaaggtgggtccagttgagggacgatgagttccctgactttcaggaggagatagttgttggatcaagtggcctcagaataattaagaatggaggttga

SEQ ID NO: 90866 - DNA, 744 bp, Glycine max
  Peptide Sequence Number=SeqID_207644
atggcccttctctatgtagggaatagatgtaatcgaagcatcgagcccagggattcgaatggacatcgcttcatcttggtcgtgatcgactacttcaccaagtgggttgaagctgcttcatactccagcgtgacgagaagtgtagtgaaaattatcacggacaacgccatcaacctgaataacaatatgatgaaggaaatgtgtaaggatttcaagatccaacaccataattccacgccttacaggcccaagatgaatggggcagttgaggctgccaataagaacatcaagaagatagttcagaagatgatggtgtcatacaaagattggcacgagatgctccctttcgcagagcatggctaccgaacctcagtgcacacatcaactagggcaacttcatttttgttggtatacaacatggaagtcgtactgccgttcgaagtagatgtcccctatttaaggattctggcagagttcgggttgaaagagtcagagtgggcccaagcacgcttcgatcagcttaatctcatagaaggcaagatattggcaaaaaggagaagatttgcattgagtgatggtcaataccatgttgaattcaagacaaaggtaaatcaagggattgtaggcgatggccttaggcctatggtgcatcctgaagtgaatgggcatgtcagattacccctatgccccactttttcatgcctaaaggtggctgccattgttgagtctagggacagtttgtag

SEQ ID NO: 90867 - DNA, 237 bp, Glycine max
  Peptide Sequence Number=SeqID_207645
atggaaagcgattgttgcatccatgttagaaaatgccacaagtgccaggcatttgcggacaatgtcaatgctctacccatgcctttgaacgttttggcagcgccatggcccttctctatgtggggaatagatgtgatcggagccattaagcccaaggcttcgaatggacatcgcttcatcttggttgcgatcgagacttcaccaaatgggttgaagctgcttcatactctagcatga

SEQ ID NO: 90868 - DNA, 738 bp, Glycine max
  Peptide Sequence Number=SeqID_207646
atgaaagcatttcctttctcctgggctgacacagcaaaggattggctgtattttaatccagcttccatcaaaagctggaatgatatgaagaggcagtttctagagaagttcttccctgcgtctagaacaataaccatcagaaaagacatcagtggcacaaggcaactttctggagagactatgcatgagtatcgggataggattgcttccagtatggaaagaagcatggttgatgcagccagtggtggagcattgatggacaagacagcaactgctgccagacaatggttcttcaacatggcacataattctcaacagttcagtaccagagttttaccatcaagaggagtccatgatgagactgttgctgctgattattatgggctagaaaaccagataacagagttgacttcccttgttaaacaactagatattggccaacaccagcaagttcaagaagcaaatattccaccccccagagcatgtggcatatgcacctctctaaaacatcctagtgatgcttgccgcaccctccaagagactaaaccaactgcggatgttgttggaatcatcactggcccacaatatagacctccacaacaacaggaaaaatatgatcatcctaacctgaaatatggttctgtgcagggtaatatgctgcacactatgaatgtccccataccaatacatttatttctcatgaggcatactggtagtctaaaccaaagaaaatcttaa

SEQ ID NO: 90869 - DNA, 144 bp, Glycine max
  Peptide Sequence Number=SeqID_207647
atggctaatggtactgtattagtggttgattggcttcttgaacttttggcaccgaggagaggtgcgcactgtgaggataaggatcttaccatggcatgtgttccttggcctatacacttatgcattggcaatagcaacagctga

SEQ ID NO: 90870 - DNA, 219 bp, Glycine max
  Peptide Sequence Number=SeqID_207648
atgtacaggggaaatggcctaaaagggaaaaagcctaacactaaatcaatttccaattgcaccatctttcagaaggcaggaataggttttagaagggatcaattgaaggttcaagtgacctcaaatctcaccctaaggctaatgggtgaacgattgatcactgacaacagtgttggatcaagtggcctcggaataattaagaagggggggttgaattaa

SEQ ID NO: 90871 - DNA, 1017 bp, Glycine max
  Peptide Sequence Number=SeqID_207649
atggacattgattatgctatcaggaaggaagaaccatcagctgttattaagaccaacactccagatgcggttgatctttatgaaaagtgggagagatctaatcgcctttctgtgactttcataaagaccaacatttttgctgtgagaatttataatccacaagagaagaaactagacccaaggactattagtaggtatttcattggatatgctgaaaagtctaagggttataggttctattgcccatctcacaacgctagaattatggaatcaagaaatgcaaaatttcttgaaaatgacttgataatcattcatgtccctcaagttcaagtgggtgttagacaaccaatagttgaagttccactagtcgttgaagatgatcatgtagatcaagttgttaatgaggaacaacaagccaatgttgaacaactggttgaacaacaagttcctcaacaagataatgagacaacattaagaaggtctactagagtcaaaatgtcagtaattcttagtgattatcaagtgtatttgcaagaaccaaactataacattggagccgaaaatgatcctgaaacgttttcactagccatgagttctacagaattaaatttatggtataatgctatgaaagatgagatggattttatggcatctaatcgagtctgggatcttgttgagtttcctaatggagtaaatgctattgcatgtgttgaccactggaaagctacaaagaaggtaatgagaaatcttcaaggaacaaaggactacatgttcatgtatagacgaattgatgatttggaggtgattgactactttaatttagactatgttggctacattgctatgaggaaatccacttttggctatgtttttatgctagttggtggagttgtatcttggagaagtgcaaagcagtccttggctactacttccactatggaggctaagtcgttaaagttgtactgtgacaactctactgcagtatttgtggctgggaacaataagagtggaagttga

SEQ ID NO: 90872 - DNA, 393 bp, Glycine max
  Peptide Sequence Number=SeqID_207650
atggccactgtctctccctcactcctcttctttgcaagagtcttagggcttgcagtggcagtgcttgtcctcatatgggcccttgcctttaagtccagcttcctcactccctcactctcccaacaagacctcatatatgcagttcttcatcctctgctcatggtcattggctttatcctcttaagtggagaagcaattttggtgcacagatggttagttggatcaagggggttgaagaaattggtgcatttgtggcttcaaggggtggctttagcttctgggatctttgggatttggacaaaattccagggaaaggatgggattgtggcaaatttctatagcctacattcatggatgggtttggcttctgtatccctcttcggagcccagtaa

SEQ ID NO: 90873 - DNA, 387 bp, Glycine max
  Peptide Sequence Number=SeqID_207651
atgaaggcatgtcctgtatatgtcaataagattgataaaaatagaggctctccgcatggaattaatgtaaatttcacttcattttcagctgctggagtctcgctaagcctgggacatgcgcttagcgagtatcctccgctaagtgagacatcagctcgcttagcgagtaagagaaatcttgaagggaatctgccacgcaagcatgcgctcagtgcattattagctcgcccaatgagtcaattgcctcttctagcgcttagcgtgcctggctcgctaagacaaagttcacttactcgcgctaagcgcgaaaatggcgctaagcgtgccttcgaggacaaaaagccctttttaaagcctaaagtgaaaaatcaagaaatgagagcgtag

SEQ ID NO: 90874 - DNA, 830 bp, Glycine max
  Peptide Sequence Number=SeqID_207652
ggtacatcttttgtggtacaagtagagtgtacatctacttgggttataatactgagaacaagagaggatacatctcttgtggatccgttcaagtggagggtacatccacttggttgttcaaagagaacaagggagggtacatcccttgtggatctttacttgtaaaggattttacaaggttattggaaatctcaagaaccggtggttgcttggggactggaagtttaggagaagtttatggtattgtgaaaccaaatattttgatgatggatcctctcccatccatcaacaaggcttatgccttagtcttgcaacaagaaggacaactgcaaagaaatggaactaatgactcaaagtttttttttacctcctcaaatcagcagaataatctagggaattggaggccacaaaggagagggggtagcagctttggtagaggaagaggtaatggaatcttgggtagaggggatggaaatgctggaagaggaagagaacacaactatacaagcaaacagtgcacatattgcaataaatttggccacatagttaaccaatgctactcaaagcatggttttcctttgggtttcaaaccaagaaacaactatgcaattaacaattttgtggcacccgagggagaacaaagtcagtctgaaattgataattctcttcaaggttcacaaggtggaaccgtcacctcttcaggagttcagttcaaacctgaacaactacagcagctgctcactatgttgcagcagtcttccactaaatcaactcacttagtaagtcagatcagttcagggaatgttgatgaatcttcctcacaacaataa

SEQ ID NO: 90875 - DNA, 318 bp, Glycine max
  Peptide Sequence Number=SeqID_207653
atggtccttgtttctcctcctctaaatgccaacaattatcacatatggagcagaggtatgtttagagctttatggtcgaaaaacaaactagaattcgttgatggtacactgccaatgccaaaaatgaaagatgcaaattataaagcatggcagagatgcaacattatggtagtctcctggatcactcgatccctttcccctcagattgcacaaagtacaatttatatagataatgtcaaaaagctatgggatgagctcaaagaaagatttacaaaagggaatttgtggaagcaaagctttccaagtttattttcatga

SEQ ID NO: 90876 - DNA, 834 bp, Glycine max
  Peptide Sequence Number=SeqID_207654
atgaaccaaagacatataaccaagccattaagtctaaggaatggatacaagttatggaaagtgaattacatgcacttgaggcaaataatacttgttgtaggtggatctataagatcaaacatcaggttgatggttcaattgagaggcataaagctcgattggtcgccaaggcaattggatgttgataatgccttcttacatggtgatcttcataaaaagcaacatggttcctctttcatagcccttcttgtgtacgctgatgatgtcattctcattggaaattcaccttttgagataacctctatcaaacaacttctacatcacaagttttgcatcaaagatcttggcaaactcaagtatttcttgggtcttgaagtatctcggaccagtaaaggcattcatatatgccaacaaaaatatgcacttgatattctttctgaatcaggaatgattgcttctaaaccatgctctactcctatgatcaaagggaacaaactgctatatgatgatactcctcctccctatgaccaaactgcctacagaagacttattggacatttattgtatttgaccacgaccagacccgatatttcatttgttgttcaagatcttagccaattcatgcagtcacctaggcaacctcattttgatgtcactacttatgtccttcgatatattaaatgttgtcccgctcaaggtcttttcttcccagcagattctgacttacaattgaaggcttttagtgacttggattgggcaacctgccctactactcgtcagtctattactggatactgtatttttcttggatcatccttaatctcttggagataa

SEQ ID NO: 90877 - DNA, 420 bp, Glycine max
  Peptide Sequence Number=SeqID_207655
atggagttttcttgcaaggacttcaaggtgggaaaatgtgagggagaaaaagtagtagatggggaaaccatgcccttggtgctaaaacctccagtgcctaacaagagtgacttggaatccttgctgttggctctgaagaacaacaaagaatggtttgagcaaatgatcatcaagaacagtgctgttctgcttagaggttatgatgtcaagaatgctgaggacttcaatgaaattgtagaaatctgtgggtgggaagacattcgttatgttggaccagcacctcgcacacatattcacaaaagggtgtggactgccaatgaaggacccctctcagagttcatctactatcaccatgaaatggttttgcttcttacatcatctagcagcttgcatatatttcctaatcaatcaaaactataa

SEQ ID NO: 90878 - DNA, 528 bp, Glycine max
  Peptide Sequence Number=SeqID_207656
atggctataattatagaggacgtggaagaggaaggggaactgggagggggttggtggtttggacttttggatgggcaggggggtttacacccagtcacaaaattcactgaggattttgatttcatggcaatgaatgagaagttcaaaaaggatgaagtatggggccatcttggtaaaagtaagtctcattcaaaagaaaaagatggggaagaaaatgcctttgatgaagattaccaagatgaagacaatgacgatgtatcaaacattgaggttaagcagcctatttataacaaggatgacttctttgactcgctctcttccaacgtgcatggtaatgcttcacagaatggaaggactagatactctgaacaaatcaagattgatactgagacgtttggcgattttgtgaggcaccgtggtggtcgtgggggccgtggtggacgtacccgaggtggttattatggaagaggagggtatggctataatggacgagggaggggacgtggcatgcccagtcgcaatttgtag

SEQ ID NO: 90879 - DNA, 600 bp, Glycine max
  Peptide Sequence Number=SeqID_207657
atcaaggaatttcccaagaaagtgatactcttttgtgagatacctccccctgaagggggagagaccccttttgttccaagcttcaaagtgacagaaaagatgatggaggagttcccagaagaggtgaaggaaattgaagagaaagggttaaagtatacatttacagctcctagtgctaataacgtctcctccatgagaggtagagggtgggaagatacctttgggaccgaagatcgcaaagaagccgagaaaagggcaaatgctctaggaatggacgtggagtggcttccaaatggtgggatcaagacaatacttggaccaagatgtttaaccaaggtatttgaaggaaggaaaggaagaaaaatgtggttcaacacagtagtagggatgcatggaaaagagattagctcggccatgatggcagatggaacagagattccagaacatgtagtgaaaaggtgtgaagagatcattgaagaagagagcatacagttcaagtgggagaaaggtgatgttctcttctttgataactatgctttgcttcatggcagaaggccttcacttcctccaaggaaagtccttgttgctacatgcaagtaa

SEQ ID NO: 90880 - DNA, 1056 bp, Glycine max
  Peptide Sequence Number=SeqID_207658
atgggaattcggcctatgtgtccaagtgtgcgatcttttggaacagaaggaagaaaaaaggatggcccacaaattcctccaggtgacaaggtttatgagtatatacttttccgtgggactgacatcaaggatttacaggttaaatcttctccacccgtccagcctattccacaagtcaacaatgacccagctattattcagtctcactatcctcacccggtctctacatctacaagtttgccttctgctcttggacttcctggggcaaattttcaagggcccttgcctttgtatcaacctggagggaacataggatcgtggggagcttctccacctgctcctaatgcaaatggtggtaggcttgctatgccaccaatgtattggcaaggatattatggtgctccaaatgggcttcctcaattacaccagcaatctttgcttcaaccaccacctggtttatcaatgccttcatctatgcagcagccaatgcagtatcccaatttcaccccctctttgcctaatgtatcttctaatttgcctgaattaccatcatctttgctgcctgtgagtgccagtatccctagtataacatctgcttccttgcctccagcaccttctgctttggctcctgctccatcagctttgcctcctgcaccatcttctctatcttctgcatcttctgctttatcttctgtaccttctgtaacacttgcttctgaaattttgccagtatcagtaacaaataaggcacccattgtttcaacttcagcagccatgttagcttccaacttactatcactgaccatttctggtccagatataaatgctatagtgccacccatctccagaaaactgcatgcaatttcaggttcaagcttgccctatcaaactgtatcccagttgtcttccacagttttgggatcatcaacttctatccatacagaaacatcagcaccttctctcgtaaccccaggtcaattattgcagcctggaccaagtatagtttcttcagctcagccttcacaagcacctcataaggatgttgaagtggttcag

SEQ ID NO: 90881 - DNA, 339 bp, Glycine max
  Peptide Sequence Number=SeqID_207659
atgaagatggaagccctcagtagctttaaaactcaaccgaaaacaaaagaaaaaagtgtaagtgaagaggacaccaaaatgaagaacaaagaatggaaacaaaggaagcaaattggtggggaaatgacacaaatgaaggaagcagaaaacaaagacaaactagcaagccaggtggcaaacaaccaaggccaaaactggaggggtaaaatgaccaaaaaaccagcaaaagtgccagatgtcaaactctcagccatgggcacaacagacatttcattggacttctcttttattatataccttggactagtagtggaattcgttcaatgcatggttttttaa

SEQ ID NO: 90882 - DNA, 609 bp, Glycine max
  Peptide Sequence Number=SeqID_207660
atggcatctagggtcatcgagcacaagcttcgtactgttggtaaaatttctcaatcccccacttcattcgttcttttgtttttcctcattcacgggtgtttgattttgttaatttcgatctttttgcggtttttgttatttttatttggaccaaggtgtctatggcttagtggtattttgggttcaatcgcttacaattggtctcgacccaacatgaaaactggtgttaagatcattcacgcaagggtgtctgtggctcagtggttgctggagttagaagtactattactcatatccatgaagacttgggttattttcaacaaacagtggaaacattggtgttgtgttaagcaacatggtaagactcagatccttgtggaagcaatgtctttcaaggttattttgatgatgccaaagaatctagagttaagcaaattccaaatattcaagaatctagtttcaagaatcaagattcaagattcaagaatcaagtttcaagaatcaagattcaagaataatcaagatcaagattcaagactcaagattcaagaatcaagagaagactcaatcaagataagtactaaaaaagttttccaaaacattgagtag

SEQ ID NO: 90883 - DNA, 345 bp, Glycine max
  Peptide Sequence Number=SeqID_207661
tgaagaaatctacccccaagaagaaggacaacctttaatgcttaaggaggagtgtaaggagacacttgttagcactgccacacctcttgggcttgaggttattcctcaagtaaaggagttgttggatgagggtttggttcttaagagcttaaatccttgtgctttgttggtgcccaaaataggggttcccacagaccctaagagaataaagatcattcctgattggcccactccaccaacaccattcattgagttggtgaggaaccatgttccctcatgggaagatgtccatgaaaggagtgtcgagggaaggagcccagagtatgaagaacctcaggatttgag

SEQ ID NO: 90884 - DNA, 363 bp, Glycine max
  Peptide Sequence Number=SeqID_207662
atggctctgaaaaaactttccacaaagaggtccaggaaggacgcccctggagaatactccagtgctgcccagccagcagacacagattttgaaaggcaccgattccggagcgccaagcatcaacaacattttgagaccatcgagggatggtcattcctcagagagaggcaagtccagcgaagggatgatgagttccctaacttccaggaggaggtggctcgcaggcgctgggcaccacttgtgatgcaatccgaccccgcaagggcattggatagaagactccaagtagattgggccaaagatccaagggaaggccctagggttctcatgagccttagggtagattttgagcccatgggctaa

SEQ ID NO: 90885 - DNA, 159 bp, Glycine max
  Peptide Sequence Number=SeqID_207663
atggaggagttgattaacaaaacacaactctctcccaaaataatcccaacatcatcacgtcggctcggtgactccacaaaggaatctcacttctcgtactctactgttgtcattctgttcccacaaacaaaggttcgcgatcatcacagattcaactag

SEQ ID NO: 90886 - DNA, 480 bp, Glycine max
  Peptide Sequence Number=SeqID_207664
atgaggatgaacagattatccgcaatccgtcatgtcagcgcggcggcgctgtgtctctccacgctgtggtctgccagcgtgtgcgctgctgaagacgcaggcgctttcgacaaggtgcaacaaatcaacgccggcgatttgaatatcggttatgtcgatatggggccacgcgatggccaggcggtaattttgctgcacggctggccgtatgatattcaaagctacgcgcaggtggccccggcgttggcgcagaagggttaccgggtcatcgtgccgtatctgcgcggctacggctccacccgtttcctgtcggctaaaacgccgcgtaacggtcagccatcggcgatggcggcggatattgtgcatctaatggatgcgctaaatattaagcaagcggatttcgccggctttgactggggcgcgcgtacagcggatatcgtcgcggcgctctggccgcagcgggttaagtcgctggtatcg

SEQ ID NO: 90887 - DNA, 204 bp, Glycine max
  Peptide Sequence Number=SeqID_207665
atgtctcctccacctcttggacctcacaatcgctcacaaactcatctcaagctctcaggacagcttcctcttccagctctggtctctacagatcttcacacaacaaattctctcaaactctctggaacttggacctttctctctctagaactttcaagacatgcagaagcttcaagaaaaggccaaactcccctcaaaatctga

SEQ ID NO: 90888 - DNA, 390 bp, Glycine max
  Peptide Sequence Number=SeqID_207666
atggccagttctagaaaagattggtatactaaattggatgatgctctctgggagtacaaaacaacctatagaacccctattggtctttccccattccagatggtctatggtaagggatatcatcttccagtggagttagaacataaagcttattgggccttgatgtttctaaatttagacctaaaagcttccgaagagaaaagcgaactacaactccttgacatggaagaaatgagaaggaacacttatgagtcttcaagattgtacaaggaacaaatcaaagtctatcatgacaagaagattcagcataaggatgccaagccatatggatatcaagccatacagtgcagtggagttagaagaccccattacacaaagatcttggattag

SEQ ID NO: 90889 - DNA, 459 bp, Glycine max
  Peptide Sequence Number=SeqID_207667
atggcgaaaaggtgtggaatgaccataatttgtctccgcatgtcatcgggctcgccgcctctagatgacaaaagggcgcaaaatgaccataatttgtctctgcgtgccatcggacacgatcgtctggggatggcaaaaaggtgcggaatgaccataatttgtctccgcctgtcacatgacctcaggacatacatagttctagataactgtgagaaccctagggccttcccttggatctctagcccaatctacttggagtcttctacccaatgcccttgcaggataggattgcatcactaccttattcaaagcaatgtagtggataaagaaaatggggaagatgaagaaaactcaggaaactatatgagaaatgcaaaaatcagagagtggaagtgggaagtgacagtgattgtggggcgtgggagtcaccctttcttaaataagggagaaaggtggtaa

SEQ ID NO: 90890 - DNA, 2148 bp, Glycine max
  Peptide Sequence Number=SeqID_207668
atgttcacgccgcagagaaaggcgtggccggccgcggtggcgttcacgccgcatcggggcggttccgcctccgcgaagggaaaggccgtcgcggagggtccgccgccgccgcctttgggatctctgacggaaaccacggtcgcggtggggctcgaccccgcggggaacgtcgaggacctggaagcggttcaccgagttggggttgctggacgaggctgtgatgcagcggaaggaccacgaggcgctcgtggagaagaatggagttcgatgtttgatcagctggggcaagaactagctgaaactcaggagattctcaaacgagaacagtcagcacatttaattgcattatttgaagttgagaagcgagaggaaaatttgaagaaagcattaagcacggagaggcagtgtggggctgatcttgagagagctctgcgtgcaatacaagaagagcatgcccaagtccagtctttctctcatacaaagctagctgaagctaatgcattggttgatggaattgaagagaagtctttggcggttgataagaaactgcttgatgcagaagctaagcttgctgagataaacagaaaaaatgcagagctggatatgaaattgcgacaggtggatgttcaggaaagtttgcttcaaaaggagcgtttgtctttagctactgatcgagaatcatttgaggcaacattctacaaacaaagggaagatttgaaggactgggaaaggaagctaaagcaaagagaagacatgctatgtgatggtaggcaaaatcttggtgagaaagaagaaaagatagttgaaactgagaagaaccttaggcagaaagaaagagacctagaagtgttggagaagaaaattgattcatctaattctttattgaaaggaaaggaagctgagataattaaaagagtagcagatttagatgtggaagagaagaaagcggattctttaaagagcatgctggagatgaaagagaaagaattgcttgcactggaactgaagcttagtgctagagaaagagaggggatcgagaatctccttggtgaacaaaaggctactctggatttaaagttgcagcaggttgaacttgaaatggaacaaaagcagaaatccctcgttgaggagtttagcagcaaggaggaagtctttgagcagagggaagtcgaagtcaaccgtagggaaaaaaaggttggaaaagaagagcaggcattgaataagaagactgagagaataaaagagcaaaataaggagattgaagcaaagttgaaatccttaaaggagaaggaaaagactatgataatcaaagagaaagagttggagaaggaaaaacaaaaactgcttgctgaccgggagagcctggagaatttaaatgctgaacttgggaagatgaaagctgagatttctcagaaggagctgcaaatatgccaagagaccgagaatttgaagcttactgaagatgatagggcagagcattctcatttgcaattggaactaaaacaggagatagagcataccagattgcagaaggactttattatgaaggaagctgaaaacttaagggaggagagacagaggtttgagaaagagtgggaaaacagcgaagaaaggttgaaaagtgagaaacaacatatgcaagatcatataaagaaagagctggagaagcttgtattggagaaggaatcattcagagattcaatgaagcaagagaaacatcttttgtctgaaaaggtgaaaaatgaaaaggcacaaatgcttcaagattttgaatcgaagacgaggaatcttgagaatgaaatccagaaaagacaggaggaaatggagaaagacttgcaggaaagggagagaaattttcaggaggagatgctaagagagcttgacaacattaataacttgaaggatgttattgagaaggaatgggaagaagtgaaggctgaggggattaggttggaaaatgagaggaaggaacttgagtcgaacaagcagcaactgaagtctggccaacatgagatgcatgaagactctgaaatgcttatgagtctcagccggaaggttaagaaggaacgggaatgccttgttgctgaaagaaaacattttcttgaacttgttgagaagctaaggagttgcaagggctgtggtgaagtt

SEQ ID NO: 90891 - DNA, 1026 bp, Glycine max
  Peptide Sequence Number=SeqID_207669
cctcctaagaactcccaggacaatgtagcttcttctgagtttaacatctctggatctgtaaggcctgtgtcttggctccgtaaatgcacaaccaagattttcaatttgtccccaagtaaaatagctgatgctgttggtgcttcagacatggctgggacatcaccactttcagatgtcaattttagtgtagagaacatagatgcgctgcctgcatctcttcctaatataggagctagagttatttttgatgaacgtcaaccagcaggtgggatggcacatcactcttcagatacaccacacctccaatctgataacattgataaagaggttggtgatgaatactctctatccataggtgatcacagccatgtggatagtttcatagatggagatccaggtgattcccagcagtctgttccaaagcttggtcggtgcaaacctgggaggaaaagcaaatctggaattgctagaacatgctcagtgaaggctgttgttgaagaggccaaggagtttctaggaaaagacccaaagaaaatagaaaatgcaagcttgcagtctctcaatactgatcatatcagagaagatagtcgagaagactccagtttcaccgagaaagccattggtaacactagaaggaagcggcaatgggcacaaacttccaggattacagaaactgagctgaatgctggtgatagtgaaggacattcagatagtattacagctggtggtgctggcaaagattcatcaacacagaacatatcaaatgcaacaaagagtgtggagaaagaagctgctgctggtaaattggagggtgataaaaacaatcctgaagtttttgaaacttcattagcagtagatgatgacaatgtacaagacacaaacctggtgcaggtctcgacagtaaagactgtggagttctcagacgatagagctgttaggatggaagatggaagcactattcatgaagttgaaaatgatgatgatgatgaggaggaggaggaggaggaagaggaacatctgggtgag

SEQ ID NO: 90892 - DNA, 1398 bp, Glycine max
  Peptide Sequence Number=SeqID_207670
atgaggaacttcaaggctgttggtcaagccatcactgctctcttcatcatctctctgagtgcatggtgttatggacaagtagaacttgacatggctccaatggagaaggcagagcgggatgctctatactccaccattcaaggctttgttggtgattggtggaatggctcagatctctatccagatccttgtggctggactcctattcagggggtctcttgtgatctgtttaatggattttggtatgttactgtcttgaacattggaccaatccacgataattctctaagttgtgccaaaattttggaattcagaccacagttgtttgagctgaagcaccttaaagctctatccctattcaaatgctttgaatcacaacacaggcatcaagttaccatccccaatgcaaactgggaaaagcttgctggcagcttagaatcacttgagtttagatcaaacagaggtctcattggaaaaattccttcaagttttggtgccctcaagaaccttcagtcactagtactattagaaaatggtttaacaggtaaaattccaccagatattggtaaactgaacaagttgaagaggcttgttcttgctggaaaccattttagtggacacattccagatatttttagtgcattaggcgagttattaattcttgatttaagtagaaattcactatctgggactttacctttgacacttggaagcttaacttcccttttgaagcttgatgtgagccataaccatttggaggggaatctgctgaaagaatttgcttatcttaagaatttgacccttatggaccttaggaataacagattctctggagggttgacattgagtattcaagagatgtattctttagaggaaatggttctgtccaacaatgcaataggtggggatatcaggacccttaagtgggaaaaccttcacaacttgatcattttggatctctctaacatggggttgaaaggggaaattcctgagtctatatcggaattaaagaggttgaggtttttaggccttagtgacaacaacctcacaggcaacctttcaccaaatctatctactcttccttgtctcaatgcactatatgttagtggcaacaatttgacaggagagcttaaattctctgtggagttttatggaaaaatgagaacacgttttggggcctggaacaaccctagcctttgctaccctcttggagtaatatcaacaagtcatgttccatatggggtaaaaccatgccagcaagagatcaaattgctaaaatctaatacaactgatggggatgtgaagaggactttccattccatagcctctttgagccatactcctaattccttctggtggatttttctattttttttaatatcttatttaggtctttaa

SEQ ID NO: 90893 - DNA, 2022 bp, Glycine max
  Peptide Sequence Number=SeqID_207671
atggcctggagagtggactgccctaaggtagccaatgccactgtcgtctttgctgaagctgtgaagtcaaaccaccaattgtcttccaaggttggcagagttttggccaagtgtttgctcactaggttgaacagtgatgagttgtttaagccttacaaggacttgcagaaagagaaagatgacttggctagcaaggtggaaagcattacggcgaagaaggacgagcttgccaaggtggtcgtagacctcgaggccaacaaggaacttgaagagaagctgctaatgtacaagaaggaggttgtggagcaacatgaaaagggctttaacaaggccgtcagacgggccgagttctttgccaagaaccttgacttgggtttctttgaccctttcaaggacgtgatagacgatgttctgcttgacgaggaagatgtggctgctgaggaggaggctgatgaggagcaggatgctgaggagcaaggcgatgatgccaatgacttgccgactagtctaatggtagttttccttgtggaacctagacctttgactgtggtcgtcgtgggcggaccttgggattttgatgttcctacagacttgtattcttacatagataaaagctcaccaagggtggaccttgggtttgacaagcctttagagaaaagagattcaccaagggcagaccttgagtttgatgagcctttagagaaacgatcagcgatgccctttggagaagcaagactcacaaagggcgcaccttgggttttacgagcctttggagaagcgagactcatgaaggactcaccaaggactgaccttgggcttgacaagcctttggagaagcgagactcaccaagggcggatcttgggtttgatgagcctttggagaaacgagactcaccaagggcggaccttggagaaactcaccaagggcagatcttaggttttgtgagcctttggagaaccaaccagggaattatccatcctggagactctccaagggtgtaccttgggttttacgaccctttggagaagcgagaatcaccaagggcggaccttaggtttgctgagcctgtggagatttttgcaaaagcgaaacttggtgatggaaaggctcaccaacgggcggaccttggtttgacaagcctttggttcccttttttcttcattctgttgttcttggaaaaacaacctctttatcaacggttccctaacttcaacgaggatcatggcgtctatgccatatgtgagtcgataaagagtttcattagtggttccctaacttcaacgaggatcatggcgtctatgccatatggccttgaggataactctgttggctgcctctgcctatctattggtctggcaatgcttgatagaggtgtcattgtcagtgacaatgacgtaaaggaggccatacctgcatatgaggtgtttccagagtggtcccagtatgtccattccccagatggagaagggccaaagggagctcaggctgtgcagattgttaggagaggtacgtggcacgtttgcaaacttttggcgtcggtttcatctcttggtgaagtcgagggtgtcaaccctgagtgtcggccaatagtaactgatgcgcaccactttggtgtcaagggagtgtcccctgtatggttcctcctcttctccgaccataacttcttcaatgtctatggtaggagtttggagtttctcctggatgatagtcttgaggtgtccgatctttttggtgctagccaacttggagagcaggtctgctttagtgttgctctccctgggtatgtagtacatctcgaagcatttgaaattgtcaatgagattcttggcaatatgagtgacattgtgagggccttcgaggatgattcccgccccactccccttcacgttggacacaccatcaatgtaaaggctccactagtctggggtggtttggtcgttcccaatgaattctgccaagaggtctgccacgaactgtgtcttgatggggccacagtgtttgtactggagatcaaactctga

SEQ ID NO: 90894 - DNA, 960 bp, Glycine max
  Peptide Sequence Number=SeqID_207672
atggcaaagctaacagcttcgtcagctattgagagatataggagtaagggtactcctagactgggtcgactcaggactgtttgtagaatggcttcgccttctcggcaagctttgggagaaacttggacagggatgctagtctactgttcaacttttggacttcttggacgttgggttggtttctattccccgatgcatgatcatgaatcccaggaacttacctccgtcgaccctgaaagtgcatttttttgggttgaggtgcatgtcgtatttgtggagttctctgaagacttctttaggaagcttagtacttggaactcaaacgctccattgactagcttgccaatgttgggcaaaggccttttcgaccatgacgatgttggtgagctaggtagagtacctgacttctctgatgaagttggctttgaggagcttggacaaatggcaagcttgtggcagataatgctagggtggattcccggcatgttagatggttgtcaagcaaataggtctgtgttcctatgtaagacatcaactatgcgtctgtgctcatggctggtgaggtccctgttgagctacatgcactacccgagtttgggtccgagttgtagcttgacgagttcttcaggctcagactggagacccttcgtccacactcatgatttgagtggtaccatctgctgtggggtaaagcttggcaggctccctgtcatgatctctcccatcaaggtggagaacttcatctttagatgttctatggagacgatggctccaagctcgttgagtgttttcctggcgaggctcacgggtgcgcttcccaaaggaggaaagatgcgcggagtcgccaccaacgaaggtattagcacctctcacgtcgacaatagcggggcttttgctcctacgtaccctccatcgaagaggaaatcagacctacgtagttctttcttatacgtgaatcaa

SEQ ID NO: 90895 - DNA, 687 bp, Glycine max
  Peptide Sequence Number=SeqID_207673
atggttctattccatctacaagaaggtgagattatgttgagaaagtggatgatggaaagagatacactaggatatagtgggaagagagttgggagcttggggattggtgtacgttgtatccatatgtggcgatcactcccgattgtcatccacataaacataaatgtaaaagatcatcaagacctaggaggctttgcggcaaaggagcagaggactcatccctacaaccaacaactttcaggtattgatgatgttgaggatgtcgatgcccttacgagcttagtatgtttgcctgtacttggactggaggaacctcgtcatgacttggagttcaagttgacttcggtggggtatgatagacaaggcaacgctttcagctaccatgtggagccagtgagcataattgaagtaaccgaggatagaggagaccattcggataagacgttcgaggagattaaggagaacaaagaacttttgcggcaactagagcctttgtctgaggagcagtgtgacgatcctcctaggacatctcttagatacaatcatgggcaccaggaaacagaacgggtggttgtggctcctggtgctccgcatgctacgcatgaccaacattctctacaggctccacttgcgcaacaggatccaaaggctctatcacttgagcttctacatgtcacctttgattag

SEQ ID NO: 90896 - DNA, 726 bp, Glycine max
  Peptide Sequence Number=SeqID_207674
atgcattttgagtaccctggacagtacataatcccctcaagctctgagccagcttgtgggcaaaagaggttgtccagtgtcaaaggaaattgtctgatgtccggggcctggacaagtgttgtttgggctgcttctgtcaagttgtccgaggtggacatgcttttggttttgcaggcgaggtctgacgtgtcagagtacattgaagaaaaacattatgttttgtcttttgctgcaaacgtgtgcagtgcacgtgcaatactcttgcatacatgtcactcatggagtcgacatatactagagacgtggtgcatgggtgagtggggttgcgtcattattgacgagtccacctcctctttaaatggaatagacgacactcaccacggtgcttctgacagtgaatcctcttcctcagagaggttgagggtttcgtgtcgtgttggtggaggagcttcttgcctctatgggagggtgcaaccttctgttgcttccccgaccggggagtctgttccgattactatgattctcccccttctacttcaaggggaccaaggaacaatggtggcggggatgttaggatgtccccccgtgtgtggcatagccatagtgcttggtcgacatccgcactatcctccggctaagcgcacagaagaatctggaagaaggataagctgtacagaggcgctgagcgagtgtgaactcgctaagcgcaccgcctttaacccttag

SEQ ID NO: 90897 - DNA, 270 bp, Glycine max
  Peptide Sequence Number=SeqID_207675
atgaaaggagaaaacttacattcagtggtgtcgtgcaaaggaagagggggaaaaaggtggcatgaaggtggagaaggagattccttcctccctttctcttcttcgtccggcgacgccacttacctcttcactgccaccaaccccaacaaggtcgggatcaggtacgagccagtccaacttcaccatcatgtaccgcgagtccgcgacatcacagagaaaaccacacctcacacaatgctgaaatcgcttcaccccatttcacaacgctaa

SEQ ID NO: 90898 - DNA, 669 bp, Glycine max
  Peptide Sequence Number=SeqID_207676
atggaaccaccgatccagatgaacatttggatgcttttctcaccagaaaaattttatggtggacttcctccaaggtccaccgatagtttcgacactcttgtcaagcgcttcaatgcgcaatatgcaactagctggtcacatcgtgtgacaccgatcgcattggctagccaacgacaagtagatgatgaatttctttggaaattcatggataggtttggacacattgtcgtccaaatccgcaatctcaactcggaggtagcattacacttcatgctcctcactctaatgcctgccaaaagctacatccagatggaagagatgtctaggttcaacaacgaggtccgacaagacagacaaaagcacaacaagcaagaaggaagcaccaagaccaaatcatacaagtcggataagaggcacaagccggacaagcgccagcctctcccaaaagggcccaggtatgaatgctacacacccccaacgcctaatcacactacaatccttaaggaagctttcaacttggaggtacccatgaagctacctccaccgcgtcctcgcaggccagggctagatgtgaccaaatactacggataccatcatagctggacagtcatgcaacaggagcgagacgtggagggcaccaagaggatcaacataggaatcatgacgtaa

SEQ ID NO: 90899 - DNA, 180 bp, Glycine max
  Peptide Sequence Number=SeqID_207677
atggcgaaaatgcatattcctttggggtcctcgggtttctactctctgttcttcgacaatgacaacattctccgtcttctttacgatggtcttgaagtttctgccattactggccacatccatggctggcatcttggaaagctcattagggacgcagtgcatgcccgacggagtagtgaa

SEQ ID NO: 90900 - DNA, 330 bp, Glycine max
  Peptide Sequence Number=SeqID_207678
atggggttgaaccaagcgcagtcttttaagaaaaagtttgttcaagtcaagatgcgtgccaagattaagataatgattgccataaaacaagaacagaagcagatgaaggctgatatggaggccatgaaagagcagatgacaacgatgatggaagcaatgatgagcatgaggaagatgatgaaggagaagaggaaggatttgtgtgaggatttcaagatccaacaccataatttgacaccttatcggcctaagatgattggtgcagttgaggctgccaataagaatatcaagaagatcattcaaaagatgatagtgacatacaaagactag

SEQ ID NO: 90901 - DNA, 171 bp, Glycine max
  Peptide Sequence Number=SeqID_207679
atgaagctgaatgaaacaagagagattctcaagagaaagcgcaataaccaacatggttttccatacaaaagcatggttttcaacttcttccccaaagggccggtgccaccttcagggttgcaaggattcttatcagatcaaatgtcaagccccaatagatcagatccttaa

SEQ ID NO: 90902 - DNA, 213 bp, Glycine max
  Peptide Sequence Number=SeqID_207680
atggaagttgtcctccctttcgaagtagagattccttctttaagggttttgtcagaagcagaattggaggaagtagaatgggttcaagagtgttttgaccaattgaatcctattgagggaaaaagattggctattatgagtcatgagcaattgtatcagagaagaatgaagaatgctttcgacaaaaaagtgcttatcgcgcaaattcaatga

SEQ ID NO: 90903 - DNA, 240 bp, Glycine max
  Peptide Sequence Number=SeqID_207681
atggcctttcactcagcaaacatgcacaactcatccttcttccagattcttcctcgcgctcagtcgaggagtgttgcactcagcggatggctcgctaagctgacagcgcagaagccgagcttagtgcgccttatgaaaatttactcatgggctaagcgcgatagcaacgcgcttagcgagagaactcagaaaatcattttttgcagaataggcttagcggagcaggcgtgcttagcctaa

SEQ ID NO: 90904 - DNA, 757 bp, Glycine max
  Peptide Sequence Number=SeqID_207682
ccccgaagtgcctgccaaggaacagcaggcgcatggcgcattggccgccgcgcagccggtgcccgacaaggccgacgaaggcgcgcgcagcgaggacatccgcgccgccgaagcgaactggaagcgcgccgaagccggtgcgacgctggccgaggccacctaccagcgcgtgcagaacctgttcaacgaaggggtgatgacccggcagaagcgcgatgaagcgcatgcccaggccaccagttcgcgcgaactggcccgtgctgcccgcgcgcagtacgacatggcgttggccggcgcgcgcgagcaggacaagcgcgccgcgcagggccaggtgcagcaggcacagggcgcggtggccgaagtcaacgccgcgcgtgtcgaagtcgaagggcgcgcgccggtggccggcgagatcaacaagcgcatggccgaccccggcgaactggtgccggccggctacccggtgttcaccctggtcgacatcgaccgcatgtgggtggcgatgaacctgcgcgaatcgcagatgcaaggcctgaaagtcggcagcaagctgcagggcagcgtgccggcactcggccaggacggtgagttcgaggtctacttcatcaacccggccggcgactacgcgacctggcgtaccacccgccagtcgtccggctacgacgtccgcagcttcgaggtgcgggtgcgcccggtacgccgcatcgagggcttccgccccggcatgagcgtgctgttcgcatggccccagcactga

SEQ ID NO: 90905 - DNA, 498 bp, Glycine max
  Peptide Sequence Number=SeqID_207683
atggtctctggtaatcgattaccagggaatagggatgggtcactggtaatcgattaccagatcgtgatggcggcgctgctaatccgtgatcgagtagagatggagtgcctagagggagcttgggagaccctcgaaggcaacacgaggtgccgatttcggggcaccattcgattcacggctacttctttggtgcatccagatgaacctgcatggacgcttcagcgcacggtggagtggatactacccacgcctacaccctatcgtctagtggagcccgtccaagtgatcgaggtaacgtcatccgaggaagaccctgaggaggatcttgagaagctacctcctaagcctgctgtggatgctcttgactttctagagggtgatgaggatccacttcttgaggtggattctcccgaggaagtcatgtcggcatcagaggcagattctaccgaggatagtggcccgggggagatggcgatcagcggaggctcttcatcatag

SEQ ID NO: 90906 - DNA, 246 bp, Glycine max
  Peptide Sequence Number=SeqID_207684
atgaccataatttgtctctgcgtgccatcggacacgactgtgtctagatggcaaaaggtgagcggaatgaccgtaatttgtctccgcatgtcatcgggcccgccgcctctggatgacaaaagggcgcagaatgaccataatttgtctctacgtgccatcggacacgactgtgtctggatggcaaaaggtgagcggaatgaccataatttgtctctgcatgtcatcgggcccgccgcctctggatga

SEQ ID NO: 90907 - DNA, 303 bp, Glycine max
  Peptide Sequence Number=SeqID_207685
atgtcatccacatcatctaatccgtatgaagccaaaaacaaaccaacactagaagccattaacgaagaacacgaagcttacctcgatggcggaagcggcacagatgggtggaaacgtcctcaatgccgacagcaagagcactcaacaacgacgacacaaaggaaaccaatgaagaaagcaagaagaagaaggtgtagcatgaggggaagaggagacaacacagcgtacggaagaacagaggaacaatcaggtcagaagtctaaagatcatctgattatacatcaagatgatgtattctgctga

SEQ ID NO: 90908 - DNA, 484 bp, Glycine max
  Peptide Sequence Number=SeqID_207686
atgaagataaaatcaaagggtgcaccaaagtctgtgaaatctaccaagtgtgaaccttcaatgtgggagcatgttgatgaaatgaacacaatggttggtagttcagtaactccaaatgtgacttgcaaagggtcaattgaaactatgctaggccagggtcaggagtcttggtttctcgtttatcaagatttgattcaagaacttcaaacctggcactctgtctatgttcaagtatttgactcaaaagagagactattggaattaataatctcgttgtatgtagaatgtggtctagtgccctatgagaagtggatgaccattcctgacaagggttatgctattgctaatgtctccgacggcggtggcggcgaaggaagaaagggggctgatgaagccctgaacagtgtaaatgcaagtggaagaatcccgttaatcactacaaggtgggaaggggatggtggcgatggtgggcgaggcacaggag

SEQ ID NO: 90909 - DNA, 237 bp, Glycine max
  Peptide Sequence Number=SeqID_207687
atgggggtgcggataaccatgaggtgtctccgcgtgtcatcagacttgccgtcttcgaatgacgagggtgcggataaccatgaggtgtctcctcaaaagacactaaggtctccgacaaagggagcagatgaccatattggtttctgcgtgtcatcggacttgctgcctccggatgacgagggtgcggataaccatgaggtgtctccgcatgtcatcggacttgctgtctccggatga

SEQ ID NO: 90910 - DNA, 165 bp, Glycine max
  Peptide Sequence Number=SeqID_207688
atgagaggcaccatgcatgagcctcaagcaaacctaggggcagatcaaaatttctcacccgtcatgagcatgcatatgcatctttgttgtcctgcaagtcaaaagatcgaagaaaatttgtttcaagagttggttgataccacaccaagtccaaggccaaggtag

SEQ ID NO: 90911 - DNA, 594 bp, Glycine max
  Peptide Sequence Number=SeqID_207689
atgttatcagaccttacaaagaatcacttactagggaaagtcgttgcattagagataccttcacaagaagatgatccagaactctataaattagtgcaaaatcacatggttcatggtccatgtggaattttgaggcctgcatctccacgcatgaaggaaggtaaatgcagtcgattttatccaaaaaaatttcagctcacaactcttatagatggagatggttatcctgtggatcgtagaagaaacactggtcagacaataaccaagaatgagattataattgataatagatgtattgtaccctacaatccaaaattgctgaaaaaataccaagcacatataaatattgaatggtgtaaccaaaacacttctatcaaatatttattcaagtacatcaataaaggatatgataaagttacggctgtcatggttcatgatgacactagaacagttccccatgcaaacactctgaatgatgaaatcaaggaatatctggattgcatgtatgagccaagtttaatatatacatttctccatgtgaatctacttggaggatctttggttttccaatacatggtagaaaaccttctatag

SEQ ID NO: 90912 - DNA, 427 bp, Glycine max
  Peptide Sequence Number=SeqID_207690
ccgcgacgtggcggctgacggcaacgttagggagtccggagaccctgcccaccctggaaacggctcagccggaggtagggtccagcggctggaagagcaccgcaagtcgcatgcctctggtcgatggaacaatgtaggcaagggaagtcggcaaaatggatccgtaacctcgggaaaaggattggctctgagggctgggcacgggggtcccagtcccgaacccgttggctgtcggtggactgctcgagctgcttccgcggcgagagcgggtcgtcgcgtgccggtcgggggacggattgggaacgggcccttcggggcctcttccccgggcgtcgaacagtcaactcagaaatgtgctctgaatgtcaaagtgaagaaattcaaccaagcgcgggtaaacggcgggagtaaccatgactctcttaag

SEQ ID NO: 90913 - DNA, 789 bp, Glycine max
  Peptide Sequence Number=SeqID_207691
tatcctttcgaaggtcatgacactgatatgtctgcaagcgaatattcatttggtggtgttgcggaaacacatcctcatttttcatggccgaccatgaccccttcgcagcaacatgatgccctaatggcaacacctaatgccccattagcttcgcaatgggatgtacccggagcaatacctgatatgggtgacttattaggtgttgatttgcgtcacgagttttctacagaggctgagcaacaagggcagagacagcgcgcaagaagaaatcaagatcgtctagcccgaagttttgggtttggggtttggggtttagggtttacgacttatggtttagggtttaggggtttagggattatggttaatggtttagggttaagggatttaggtttagggcttagggttgaggatttagggtttagggttagtggtaaaggtttaggggttatgggggtaatgggtttggtttatgagttgggtttagggattagagttttgggaggtttaggtttaggacttagggagttaggtttcgggtttaggactcagatttttctcaagggtacatcctttgtggtacaagtagaaggtacatctacttgggttgttgtaactgagaacaagagaggatacatctcttgtggatcagttttagtggagggtacatacattaggttgttcaaagagaacaagggagggtacatcccttgtggatctttgcttgtaaaggattttacaaggttgaaaagaaatctcaaggaccacaggtcgcttggggactgcatgtag

SEQ ID NO: 90914 - DNA, 117 bp, Glycine max
  Peptide Sequence Number=SeqID_207692
atggcaaaaatcccattgaggcatttcactgagcacttggtgggcgcatttttgggtaccaacaccaagggaatgggggcaatgtggcttgccccatcttctcagtacacaacttag

SEQ ID NO: 90915 - DNA, 228 bp, Glycine max
  Peptide Sequence Number=SeqID_207693
atgcagtatgtcgtgcttggtgctcgcattccaaaagcgacagttgccatcgccatggtctggtccaccgatccaacagcactggccgtgcacatgctccactgccagactggcaaaaaatataatataaggcgaacactttcgcccaatgctcggattgcttgctgtgcttcggttggcaggcaacggccaagtgagcagctatgggctgtgagcggtaaaaattaa

SEQ ID NO: 90916 - DNA, 392 bp, Glycine max
  Peptide Sequence Number=SeqID_207694
atgggagaagtcgtggaaaaattcttaaaaaagtacttcccagaatcaaagaccactaaagggaagatggagatttcttctttccatcaatttccagatgaatcccttagcgaagtgctagaccatttccatgggttgctaagaaaaacaccaacacacggatacagtgagccaatcaagctgaagactcccgaagaagcgatggagctcatcgagaatatggcagctagcgatcaagctatccttcatgatcgcacttatgtccctacaaaaagaagcctcttggagctcagtacgcaggacacaacccttgcacaaaataatgatgccccacgtatggagggacgcatgagcctggacaatgcgcaatccaataagatccctctcgagaa

SEQ ID NO: 90917 - DNA, 303 bp, Glycine max
  Peptide Sequence Number=SeqID_207695
atggccgcagccatgcatcttgccgtcgtggcgcgaacggtgttcgaactggttctcttcctgcatcggcagggcgtccatgtcggcgcgcaacatgatggcgcggtcggaagtgccgcgcttgatgacgccgaccacgccggtcttggcgatgccggtgtgggtctcgatgccccagccgcgcagggcgtcggccaccaccttggcggtgcggtgctcctcgtagcagagctcgggatgggcgtgcaggtcgcgccgcagcgccacaatatcgtcgagattggccaggtcggacaccgctga

SEQ ID NO: 90918 - DNA, 396 bp, Glycine max
  Peptide Sequence Number=SeqID_207696
atgactaagaaatttgatatgattaaagatattgacggaaaaagagaaatattaaagattgttgttaggattacaaacctttggtttgtacaaagtgtagataagaaaaggcatcttgagatgactgtaatggatgcacaaggagatgagatacaagtgattgtaaaaaatgaagagttggtgagatgggagtcaatgttaaaagaccaaaccacttatgttatgcataattttaagatactacctaataaaggacaatataagggatcaatcactatcactaatcttcccaagtcttggtggtcttacaaaatcatgtggatgacagtcaggagtgatcgttacatatggatacatcgtacaccgatcccttatttcccaactcaaaaagcatag

SEQ ID NO: 90919 - DNA, 605 bp, Glycine max
  Peptide Sequence Number=SeqID_207697
accgcctcgtggcccgaacgcaccgacaggaagctggtgtcgccggtcgattgcgccagccgcagcaccgccgattcggcgatcgccttgatgccgtggcggctttcggccgccagccccaggatgtacgactcccgccccaggctgtaggtcttgagcttgggattgagcgccaggaagccctcctgcagcagggccgacagcatgcggtgcgcggtgggcggcgtcaggcccaggtcgcgcgccacgtcggtcaggccgaccccgcgcgcgggcgcggcccccacgtacttgaggatgcgcagcacgcggaagatgctctgcgcgccgccgaccggatcggcgtcgcgcgcggcggcggaggatttggcgggactcaccggcgcgccttcaatgcaccgtggtgccatcgggcggcgactggttcaggcccagcgccgcctcccaactgcgcagcggcacgcaagtctgcaggcgcacgatggcgcgctggatcagggccggatgcagttcgtggccgacgtgcgtggccacgtcaatggtggaatccccgtgcagctcgtccagccgcgcctgcgccgcctggatcaaggccaccggcatga

SEQ ID NO: 90920 - DNA, 480 bp, Glycine max
  Peptide Sequence Number=SeqID_207698
atgagtaggagggcgcggcggtcgctgcaaaacccagggcgcgagcccgggcggagcggtcgtcggtgcagatcttggtgcctgcccaccctggaaacgctcagccggagtaggtccagcggctggaagagcaccgcacgtcgcgtggtgtccggtgcgccccgcggcctgaatccggaggaccgagtgcctcccacgcccgtgatcataaccgcatcagtctccaaggtgaacagcctctgggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaacaaagcattgcgatggtccctgcggatgttgacgcaatgtga

SEQ ID NO: 90921 - DNA, 971 bp, Glycine max
  Peptide Sequence Number=SeqID_207699
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcttactgcctggttcttcttctaataaagtctgcaaattacataagtccttatatggactgaaacaggctagcagacagtggttctccaagttatccactgctcttatctcccttggatactcaccttcatctgctgaccattctttgttcacaaaactacataattctcatttcactgctcttctagtctatgttgacgatattgtcttgacatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 90922 - DNA, 367 bp, Glycine max
  Peptide Sequence Number=SeqID_207700
aggagtgcctgtcgcccccagcaaaggtcatcagacccccctaccaatcgagctttcatcaagaagtactgcgcccccagagcaggcgcaggagcgaaacaccacatcaacattgggatggccgagtagcgaggcaatagacacaccgccaccacctctagagttcacctcagctcatccacaaaaaggtttgagtattgcctacaccacatggccgaccaataggcgaccaagtccaaagccaaagggtgaatgctgtgaaaattttcccggacgcccaaaatggactcgaatgaatgcacaaattgataaaagaacatattttggaaacattgggttgactaaaaatagaggaaatgaatcatga

SEQ ID NO: 90923 - DNA, 828 bp, Glycine max
  Peptide Sequence Number=SeqID_207701
atgccctcaccttcagaaggcgtttgcttaagaggactacacgtcctcaccttcagaggactacacgtcctcgccttcagagggttacacgccctcgccttcagaggactacatgtcctcacctttagaagactacacatcctcaccttcatagggctacacgccctcaccttcagagggctgctcgccctcgcctacagagggctacatgttcgcacctttggagggctgcacgccctcgcctttagaggaatacacgtcctcaccttcagagggctgcacgccctcgccttcatagggctacatgccctcacctttagaggactacataggactacacgtcctcaccttcaaagggttgtacgccctcaccttcgtagggctacacgccctcaccttcagagggttgcacgccctcgccttcagagggctacacgtcctcgtcgactacacgtccttgcgtttagaggactacacctcctcaccttcagagggttgcacgccctcgcctttagaggactacacatcctcacctttagagggctgcacgcatttgccttcatagggctacacgccctcacctttagaggactacatttcatctccttcagagggctacacgccctcgccttgagagggctacgcatcctcaccttcagatggctgcacgcccacgccttcagagggctgcatggcctcaccttcaaagggcgacacatcctcaacttcagagggttgcacaccctcttctttagagggctatgcgtcctgatttttagtgggctctacatctgcaccttaagagaatttaaggtcgtttgcctttaa

SEQ ID NO: 90924 - DNA, 968 bp, Glycine max
  Peptide Sequence Number=SeqID_207702
gtgcgctttacgcccacccacggcaacttccacctggcggtgtgcagtcccggcgctatcagcccggagtggatggtggtgtttgttcccgccagcggtcgcccgttctccgtcattcgtgccctgagcggctggcagccggagctggtcagccacaccctcagcctgacggcgcgtctcgatgcggacggttacagccaggccagcatcatcagtattctggcagcggagggcgcggcatgatacctgcacacctttcactggttcccttcagccctgagcgacgcgccgcgatggaggctatcgctgaggttgaacgccggcggtcgcgcggcgcggtgtccacgatgtatccgtatgccagcgcctttttccggcgactcacgggcagcacacgcatctcactcagagaaatccatcattttgcgccggtgctgacggcgcgggagttgcggggcagcagggacagctggctcagagccatcgatgccctgattgaaagccgcgggacgtgttgctggctgccgcttcctgtcggtgcgggtcagcgcctctttccggaggtggcctttcagcaggccgagcgggttcgctgtcaggacgccctgcgggatgaaaaatacacccgccagcgccacaaagaacagtgtcagcgtgagcgggcataccaggcgctggcggggcaggcggagattgagctggcattccatacgcccgaaacggtcggcagctggagcgcgcgctggtcggggactgaactgcgccagtacgacctggaggagatgttctggcgctggagtgagcgttttccgtctttatccgggctggatcactggatgtttgagggggaacctttctggacggtgatagctgaaacgaaagtgctggcgcgggaaagcccggaatctgtcaggcaactggagcgctggatggtacccaacaaactaacaatgcgggaccgggtatga

SEQ ID NO: 90925 - DNA, 970 bp, Glycine max
  Peptide Sequence Number=SeqID_207703
atggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggtccatcactttcattacatagatgtggattgccccgcgaaatagcaatagaacttttccagacatttctaattcgtggtctaattcgaaaacattttgcttcgaacataggaattgctaagagtaaaattcgggaaaaagaaccgattgtatgggaaatacttcaagaagttatgcagggacatcccgtattgctgaatagagcgccgactctgcatagattaggtatacaggcattccaacccattttagtagaggggcgtgctatttgtttgcatccattagtttgtaagggattcaatgcagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgagcttatcaacaaaaaagaataaacttcgatagtcctttgtggctccggtggcgactagatcaacgcattatttcgtcaagagaagttcctatcgaagttcactatgaatctttag

SEQ ID NO: 90926 - DNA, 156 bp, Glycine max
  Peptide Sequence Number=SeqID_207704
atggcgaccctacaggatcactgccggtttttcccagggtgcgcattgatgcgcaccggtataagtgccgcacctgcgggggtgcgcattaatgcgcaccggtataaatgccgcacctgcgggggactcaagcctgatcgcggaaaacaagcataa

SEQ ID NO: 90927 - DNA, 331 bp, Glycine max
  Peptide Sequence Number=SeqID_207705
atggaggccatgaaagaagagatggccacaatgatggaggccatgatgagcatgaagaagataatggaggtcaatgcgactgcagttgccgctattagcgttgtttctggggtggacccgactcccccgtcttgcctcaacctaataaatcatccaaccgcggatacgggagacccccattttgtgcaagcccagaacaagcaggttttcccgccatatggtttgcctccaaactatactccacccaatgagaatgtcaataacttcacttctatacccattgagagccaacaacctcaatctgatcatgcacatgtctctcaacccatgg

SEQ ID NO: 90928 - DNA, 635 bp, Glycine max
  Peptide Sequence Number=SeqID_207706
ggctacacgccctcaccttcagaggactacacgtcctcgcctttagaggactacacgtcctcgccatcagggactacatgtcccccattttcaaagggcgacacgccctcacctttagaggactgcacgtcctcgccatcataggactacactccctcgccttcaaaaggcggcacgtcctgaacttcagagggctgcacaccctcgcctttagagggccacgggccagtagtttccttttatcagttcccgggtcaccccctgatattggaggggatcgcgcccacaagacgcccagtgggcccaaagaagtccaacagggcccttgggtttccagctctggttacgggcctctgtcagtcccacagggtgctcgttcccccagcgaggaatcgcacccacaaagacacccagtggacccggagaagttcaacagggccctggggtttccagctctgggtgctcgttccccccggcatggtcacatcatcatagggatcgcgcctgcaggacacccagtggacccgaagaagtccaacaggttctacggagtacccgtcacctccagcaagggcatcaggccccctactaatcaagctttcatcaagaagtactgcgtccccaggcaagcatag

SEQ ID NO: 90929 - DNA, 714 bp, Glycine max
  Peptide Sequence Number=SeqID_207707
atggtattagctgagggagaaactctactcgcatattccagatactgcaggttgcctacagacttcagagagatagaagctgctttatgcatacctggccgagggttcatcttgaactctgagggccatcctgggaggattctcaagaaggatttgactacactagctcaagtgtggagtgtcctctcatactccaacttggcccccacgtcacatacctctgatttgacagtgaacagagctaggctgatctttggcctagtctctcacttggatatgaacataagagcgctgatttctggccagataacttctatagctcagtctaacacctctagacttgggttccctgctctaatcatcgcattatgcagagccaggggggttgtatctgacagccttaccttcaagcgcctgagcccggtcattaacctggcctacatcaggaagaacaattggaaccctgaggatctaacagtctctatccgaggggctaggagggcgagggcaaggctagctaagcttccttctacttctgcagcccctactccaacatccacttcagcagccccttctatcccagctcagacaaattctcagtgctttgaagccatgctccaaagcattcatcagggaaagatcattttactacagagtttgcaaatgatggcacctccagactctattcctacagtagagcagtttaatgagatg

SEQ ID NO: 90930 - DNA, 405 bp, Glycine max
  Peptide Sequence Number=SeqID_207708
atggcatcttttagccagatgcagtcccagtttcaatcccagatgcaatctcagggagttgcactacctccagagcctatggttggtccctcaggtcctcgtgtcagcacaaaggagagttgtgttgatccctcagggaacgatcctgagacaggtgactcaaacaagtacgggttgtacattgaagaaaatcctccctgcctggttgccctaggaagagtttatgagggatcaacagttcacaacattcctttgttgcctggccaagtgaaggttggtgttgaggagtgtaattatttaactatgtttgatcagcagacaactgtttctccagcaaaaccttcacaaaggccggatcctgaggtcgatgatccgctatatctgatgacattgaccatcccatag

SEQ ID NO: 90931 - DNA, 309 bp, Glycine max
  Peptide Sequence Number=SeqID_207709
atggaggagttgattaacaaaacacaaaataatcccaacgccaccacgtcggattggcagctcctcaacagaatctcacttcctacaccctactactgtcattctgctcccacgaacaaggttcgcaatcatcacagcctgggccacaagggagttccctaccaggtgacacaccccttagtacaaagtacatactgccacaatttatactatttcccgtgtcatatgaggcatgaaacatgggcaccatcaagtacaatgaccatggatgagttaaagatcctaagccattccctcggagatgcttaa

SEQ ID NO: 90932 - DNA, 201 bp, Glycine max
  Peptide Sequence Number=SeqID_207710
atggcgagtctgatgacatgtgggggtaccgtaaggttatccgcaccttttgttatcccgagacagtttttactctcgtcgttcggagacattcaagtccaacaacgcacgagattcttctctactgggcgggaacgattaagtttgatagcgtgtggaaacgttgtggttatcccattttatcgctttcaagacacttaa

SEQ ID NO: 90933 - DNA, 687 bp, Glycine max
  misc_feature (4)..(4): n is a, c, g, or t
  Peptide Sequence Number=SeqID_207711
atgncgaagtatgatcctgaagtagtcatggagttttacgcaaacgcctggcccactaaagaaggagtcatggacaagcactccggggtgcggggccaatggatcccatatgacatagatgctatcaaccaattcttagggcatccactgatcttagaagagggacaacgatgcaaatacactgagagaagaagccaattttcaggttttgatgaagaggccatagatcagctactttgctccccgggacatgattttgcgcggagcatagtagggaggcaggtgcggatcatgcacactagcatgaccactctaactcaaatctgcatgacacttctactcagcaacatccttcctagtgaccataactctgatctcacactacccaaatgccagttggtctacagcatcatgacccagatcagtgttcatatggcgcagcttatctcagatgccatccaccagttcgtagatattacacctccgagatacccagtggacccagagaagtccaacagggcactgggattttcaacattgatcacaggtctctgccaattctatagggtaccggtcgcgccgacaaagctcattcagcctcccattaacagcatcgctaggaccctaacccttaccctgacctactcccgagcaattcagagccactgtcgcatggcctggggatag

SEQ ID NO: 90934 - DNA, 786 bp, Glycine max
  Peptide Sequence Number=SeqID_207712
atgaagaaaaggcaacatgacacattgatgactgaaaatccagccctcattgaggaccccttatctcccattcaaagacatgtcaagtggaagatggcccgcacgaatcaatatgggaagatgacatctgaggccgcaagacaaattgctgataaaattgtcaattccaacttcaatttggattacaacaatttcaattttggattaaatgactcgttggaagaacaagtgacacagggtgagtttgtcccccagggtcgtcaagatatacttaacatggccataggaagaccagatcatggaggttgtgttcgtgcagctgggtctggggtcacaattagtcaatactatgggaggacatcacgtgcctcaagtacctcatccatagcattcaccaaagaacagttggctgaaatagtagtaaccattagggaacaagtcatgaaagagattgaagaagaaaataagcgaagtctacaagcttggaaaaatgagctgaaggatgccattattactgacatatttaacggagataaggactcagcaccggctaattttgacttaaatgtgttaggtgcacgcgtgagcactaaggagagcaatgctgaaattgttgtgaacccgtctggggaagtacatgttggtcgtgtaacaccgcctatggggttgtacgtccaaagtcaagattgtacaaagctggtggcgttgggaaaaattcatgatggaccatctaccatacattgcgtagcctatgcaaatgatgtcgtaagggttagcgtcgaaaaa

SEQ ID NO: 90935 - DNA, 240 bp, Glycine max
  Peptide Sequence Number=SeqID_207713
aaagatgcacttcctcctcaagatgagcgtactccttctcctcctcctcagcgagatgattcagccctcatgactgaagttctttccgaattacggggtcttcgtacttatgttggcgaacattttgattctctggatactcgctttgccggcatggatatccgtctcacacagcttgaaaaagatgtgggttatattcgtcagagcttcgaccttccaccaccacctccaccttcttag

SEQ ID NO: 90936 - DNA, 493 bp, Glycine max
  Peptide Sequence Number=SeqID_207714
atgtggtcactaaggagtttacatgctcttgatctttcccaatgtcttcaactaagtggagcaattcctaattccatagcaaacttgtccaacctgtcatatctagacttaagtaccgccaaattttctggccacattcctccagagattgggaagttgaacaagttgggatttctgcgtattgcagaaaataaccttttcggtcacattcctcgagaaattggaatgttgacaaaccttaagcttattgatttctcagcaaattctctctctggtactatccctgaaacaatgagtaacatgagtaatttaaataaactttaccttgccagtaactcccttttatctgggccaattccttcctccttatggaacatgtacaacttgacattgatccacctttatgccaataacctttctggatctatccctgcttccatagaaaacttggccaaactagaggaacttgcactggatagcaaccaaatttcgg

SEQ ID NO: 90937 - DNA, 120 bp, Glycine max
  Peptide Sequence Number=SeqID_207715
atggcaaatatccgacgtttaccagcacctgaatcggtggactgggctagtctcccgggagagccaaagctagggattccgtataccctctttttcttcgacctgggattggcaaagagg

SEQ ID NO: 90938 - DNA, 243 bp, Glycine max
  Peptide Sequence Number=SeqID_207716
atgggatttgggaatttttcagagaaagagagaaaaaataatttaatggctattatcactcatggctggttccatgcaaaagaaagaaacataggaggacacagtgaatcagtgatgcccacctccacgtgggtcccactgcctgccgaaagtggagcgagtgagaaacacgcgcttggaacattcaatatgccgatgcacaagaaagcaaattgtactagctttcttttcaaaggcatctaa

SEQ ID NO: 90939 - DNA, 1038 bp, Glycine max
  Peptide Sequence Number=SeqID_207717
atgatctccggaagtcatgcatcaaccttggataggctatatgcttgggaaaggaaactctatgatgaagtgaaggctagtgagattgtcagaaaggaatatgacatgaagtgtaaattcttaaggcaactggaatcaaaaggagaaaagacctccacagttgataaaactcgtgctaaagtcaaggatctgcactcaagaatcagagttgcaattcataggataaattctatatcaaagaggattgcagagttacgggacaaagagcttcagccacaacttgaggagttgattgaagggttgaatcggatgtgggaagtgatgcatgaatgccacaaacttcagtttcagatcatgtcagcagcatataacaacagccatgctagaatcaccatgcattcagaattacgtagacagattacttcctatcttgaaaatgaactccaatttttatcatcaagctttaccaagtggattggagctcagaaattctatctggaggctataaacggatggcttcacaaatgtgttcgtcatgaagaaaaatcattcaagagaaaaaggaagcatcaatctgaccttaagtattctgatcctccaatatatgtcacctgtgcagtctggttgaataaacttagtgacttacctgtaaaggatgttgccgattcaattaaaagtttggcgacagatactgcccagttcttaccacaccaagacaagaaccaaggaaaaggtgctcatcctcatatgtcaacatggaaggctgatattggtggtgaatcagcagatggtttattgagagatgacacatcagaggactgggttacaggtcttgatcaatttcgacgaagcttgattcgatttcttagtcaattaaataatttgtctggttgttctgtcaaaatgtacacagaacttcgacaaaccattcaggagatgatcatcaaaattccgaatctcagagttgatccatcagagctacaactcaagtggtttaggctgaaaacaaacatccacacgataagagaattgcgatga

SEQ ID NO: 90940 - DNA, 216 bp, Glycine max
  Peptide Sequence Number=SeqID_207718
atggtgttgaggaaagtgggtaagtatgagattggaaggaccgttggagagggaacgtttgcgaaggtaaagttcgctcagaacacagagagtggcgagagtgttgccatgaaggtgctagaccgtagcgccatcatcaagcacaaaatggtcgaccagggactaatatggagtattgctctttacgttttgctacttaaaagtgatgacaaataa

SEQ ID NO: 90941 - DNA, 333 bp, Glycine max
  Peptide Sequence Number=SeqID_207719
atgattataggtgatccacctaaacagaagagaagtcaaggaaatgagaaaaagacagaagacgacaatatttctcaagggccatcaaaacgaagaaagcaatttagggttggagatgatggtaaaatattatttgatgaagaagagctcaaaatgatcctagattttaagagaggtgaggactatattgaggttctttgtggcgctacaaacaaaaaatatggagattatgttgggaggctaaaaattaataacgaaggtcaatatttcatcacttgtgagtgttgccctgagtgtcccttgggaactgcagaatctgttgatcttttttag

SEQ ID NO: 90942 - DNA, 324 bp, Glycine max
  Peptide Sequence Number=SeqID_207720
atgtcatcgggctcgccacctctggatgacaaaaaggtggagaatgaccataatttttctctgcatgccatcggactcgatcgtctctggatggcgaaaggtgtgcggatgaccataatttgtctccgcatgtcatccggctcgccgcctatggatgacaaaaaggtgcagaatgaccataatttgtctctgcgtgccatcagattcgatcgtctctggatggtgaaagggtcagattgttgggcggccgacaaaagcaaggctcttgctcctacgtatcctcaatttgtgatgaggaactcagacctacgttgttctggataa

SEQ ID NO: 90943 - DNA, 528 bp, Glycine max
  Peptide Sequence Number=SeqID_207721
atgtcgcgtcgcaggcctctacacggcagctgggcggttatattacacttctccaatgctggatatacgagcactttcctacaatgcatacatccgtcgttcatgatgcttatgatgaggggagcccacgggcctgcaggtggcttacagatgccctatggtgagcatcggggagtcagggcctttgacttgatatcgtcgtacaccggccagctcagatggggtcagattatggtgtacgttcgacctgagtgggttcttcgacagtttggctaccttcagacggtccctccgccgtcggttcactgcgaaggatgtcaggggatggctcaggatttaggagcgattgttgaggatttggagcgggtcatcaacctccggatggtcactgagggcactaacttacatgagatcatgactcattgtccaaggagagctagaggtgatgccgtagatgaaagtcttaggccggtgccagagacgccgcatagattaggatttatatttttattgtacttaaattattaa

SEQ ID NO: 90944 - DNA, 399 bp, Glycine max
  Peptide Sequence Number=SeqID_207722
atgattggccctctcgatgagtcaatctcttgctttcgcataagggtggacccttgggtacacgccctcaccttcagagggctacacgccttcgccttcgtaggactagacatcctcaaattcagaggactgcacgtcctcgccatcagaggactgcacatcctcgcctttaaagggctatatcccctcgccttcagagggctacacgccctcgccttaagagggatgcacgacctcgccttcagaggactacacgtcctcgccgtcagaggactatacgtcctcaccttcagaggactacacgtcctcaccttcagagggcttcacgccctcgccttcagagaactacacgtcctctccgtcagaggactatatgtcctcaccttcaaaggactacac

SEQ ID NO: 90945 - DNA, 511 bp, Glycine max
  Peptide Sequence Number=SeqID_207723
aacctgccccaagacacaacagacacttgtgcatacagcccttacccctaactatgttttgaagagtttgattgctttgtggtgtgaaagcaacggtaagaaggatgctgctactgctatcttcaacctatctatttatcagggaaataaagcaagagttgtaaaagctggtatagtagccccactgatacaatttttgaatgatgctgggggtggaatggtagatgaagcactagctattatggcaatccttgcaagccaccatgaaggcagggtagcgatcggtcaggccaagccaattcatattcttgttgaggttatacgaaccgactctccacgcaatcaagagaatgctgctgctgctgtcttgtggtcaatattcaccggagatccactgcaattaaaactagcgaaagaacgtggtgcagaagcagcactgcaggagttgtcaggaaatggaactgatagagctaagataaaagctggaagcatattggaactcttgcagtga

SEQ ID NO: 90946 - DNA, 506 bp, Glycine max
  Peptide Sequence Number=SeqID_207724
ccgttgcatccccgcacttcgaccccgcccgcgttgccgcctggagcgcggccatcgccctgcatctgctggccttcctgttgctgctgatcccggcgacctaccaggctgtgcaggtcccgcgtgacaagactgcggtcaggctgatcgagaagatcccgccaccgcccacgccgccggttccgatcccgccgaaagaaatcgtccaggtgatgccgaaaccgcggacgcagccggtgaggtggacacccacgggcagccggcggtggtcagcatcgagcgcagcagtggctcgcgcagcctggaccaggctgcacgccagcaggtgctcaggcactggcgcttcgagccggcccagcgtgatggcgtggccgtgccggccatcggcatggtgccggtgcagttctcgctgccggactgaagtgatcgccggcccggcgacctgccgggccggcccttccgtccgggcgggtacggacggaaccggatcaactgttattgattaa

SEQ ID NO: 90947 - DNA, 542 bp, Glycine max
  Peptide Sequence Number=SeqID_207725
ggtatgacacccatggagagccgacaacctcaatctgatcatgcacatgtctctcaacccatgggcgagacacgcgaagtaccccaccacaatcttgctgactttgagcctggcctcggatatgctgctgaagggcaagcaattggtggtgtacccctgccaaacactttggaggaccctcaatatcacccacaatcacaacccttacattttgcgatgggaagagtccctcctgctatggtggaaatggagaaattggatcgtatagaagaaaggctaagggttactgaaggaggaagagatcatgcttttgctgacatggcagagttgtgcctagtgcctgatgtcaccatccctcctgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgcatttacgcacggggaag

SEQ ID NO: 90948 - DNA, 585 bp, Glycine max
  Peptide Sequence Number=SeqID_207726
atggacatcctcaccctgggtcaaggtttatgggataaaggggatgtcccacattatttccatgacacacatgcaacaatgatgattaggaaattttatgcaaaactggtcatgcacgcacccatgtggacactcaagcatcatgtattttgctacctaaacatatgtatatttttgaaggatcatgagcaactaggtgtgtcctactatgacttgagaaacaaaagacctagtactattgcttgcctttggctttggacttggtcgccttctggtcggccacgggtcgtaggccacgctccagcctttgtagatgagctgagggactctggaggtggcggcggtgcgtctattgctcgctgccaaccatccccaggatgttgtggtgtctcgccctgtgcctgctcggggggcgcaatacttcttgatgaaagcccgattaatatggggcctgatgaccttgttgggggtgacagacactccatagaactgacaaaggcccgtaatcagagctggaaaccccaggaccctgttggacttctccgggtcccctgggtgtcttgtgggtgcgatccctgcaaatag

SEQ ID NO: 90949 - DNA, 558 bp, Glycine max
  Peptide Sequence Number=SeqID_207727
atgccgcagtgcatcgccgccggcgaacgcgaatacccggagatccgcatcatgctgcgcgatcaggcgcagcagcaggtactgcacagcgtgcgcaacgccgaggtggatttcggcatcgtggtcgatccggtgcaggcggtggatctggagtgcgaagcggtgctgcatgaaccgttcctgctgctgtgccgcgacgaccacccgtttgctgcgcagcaagaggattacgcgtcgggcagccggccgttgatcgacagcgcgctgaggcagcagggcgtcgaggcgcaggtggtgcaggaaatcggccatccggccacgctgttcccgatggtggcggaagggattggcatcagcatcttcccggcgttggcgctgccgctgccggaaggggggcggctccgggtgcggcggctggtgccggagatcaatcgcgcgctgatgctggtgcggcgtaaaaatcgctcgctgacgccggcggcggaggccatctggcaggtcgcgcgtcagcaggcggcgctgctgcaccagcgccggcaggaaaacgcggaatattga

SEQ ID NO: 90950 - DNA, 379 bp, Glycine max
  Peptide Sequence Number=SeqID_207728
atgaccctttcatcatggcagaataagctaaataggaaaatggctacaccacccagttcccctcctcttcctcctactgattcaacatcacattcaccttctaccttgaagaggacaagaaaagtgacctggctaagatcattggctactagaccagttggggcagagagacccctggtccatgtggatcctgcaactaggaaagccgacgccgacaaggacggtgtcgatgacactgtttgcgaaaagtacgacattaacaaggagaagtggacccaattttgtctaattcgtaaagacccttcgtgggaggatgtgcaaaagaaggcacaagccattcagaaacaaaacattgtccttccagtgttgtctcgtggag

SEQ ID NO: 90951 - DNA, 383 bp, Glycine max
  Peptide Sequence Number=SeqID_207729
gtccaagcagaagaagagtatggaggagcaccagaaggctgggaagctgcagggaaaggaagaggtgcggtaccgcggcgtgcggcggcggccgtggggaaagtacgcggcggagataagggatccatcgaagcaagggtcaaggctgtggttggggacatttgacactgctgaagaagctgctagagcttatgaccgtgcagcttttaacctaaggggccatcttgcgattctcaattttcctagtgagtactattctcagataaggggttcaccaccatatccacctcatttagcaacaccatcttcctcttctggtgcacaacagaggcctgtttttgagattccgtgtttggatgataaggtgttggaggatcttcttg

SEQ ID NO: 90952 - DNA, 246 bp, Glycine max
  Peptide Sequence Number=SeqID_207730
atggccatcgaggaaggaagaagcactagaccagaggttagaataacaaatctaacattgggacaactagatccggtgagcaatggtgtgtgcgcaaagctcttagcaaggatctttactagattggtgtcatttttttcaccaaatgttaattttctaaaggatgttgatagaaaggacatttctcttagcaagtttaagttgtttgacatcatcaaattactcgaagctatcacgcttgcatga

SEQ ID NO: 90953 - DNA, 271 bp, Glycine max
  Peptide Sequence Number=SeqID_207731
atggatgtcaagataactttaatattgcatcatgaaggaagattcactccacgtgccagtgatggaaaggttgaatatataggcggagaatttgacgtttgggaggatatatctgcagattacatgaacacatttatcctatgtgatctggtgcaagcatatccaattctagaagaagtcccactgatgttggacttgaaatgtcatccaattccagaagctagtaatgaggatgatttagatgatgtacctgttgctggccatgaggaag

SEQ ID NO: 90954 - DNA, 129 bp, Glycine max
  Peptide Sequence Number=SeqID_207732
atgttccctcatggtgttgagggaagaagcctggagtttcaagaatctctagatttgagctcaaacccttttcctcgtggagaggatgatgcgatcccaccccccaagagatgcaatcctaccccgtaa

SEQ ID NO: 90955 - DNA, 1062 bp, Glycine max
  Peptide Sequence Number=SeqID_207733
atgcagcaggagccggtgcactacaactcgcagttcggcacctataccaacttcacgaacctggctgacctcagcgcgctggcgctgcctggcccgttccgcgccgatgggctgcccgcgggcatcacgctgatcgccccggcgtggcacgaccgcgcgctggcgacgtttggcctgcgctggcagcagcagctggcgctgccgctcggggccaccggcaaagcgctgccgccgcagcccgccgcgctgccgccgtcgcctgaccacgtgcgcgtggcggtggtcggtgcccatctcaccggcatgccgctgaatttccagctcaccacgcgtcaggcggtgtgggtcgaagagacgcaaaccgccagccactatcgcctgttcgccctgcttgatggcccgatcaaaaagcccggcctgctacacggcgacagcggtgccgccatcaccgtcgaactgtgggacatcccgctggcgcgctttggcgaattcgtctcggaaatcccggcgccgctcggcatcgcaccgtttctgattgctaaccgtggcgaaatcgcctgtcgtgccatccgcaccctgaagcgcctcggcgtaaccagcgtggcggtctattcggatgccgaccgcaatgcgcgtcacgttaccgaagccgatgtggctatcgcccttggcggtgacaaagccagcgacagctatctgcgcatcgacaaaattctggccgatgcgcagcaaaacggtgcgcaggccatctggcccggctacggttttttgtcggagagcctgccgtttgccgccgcctgcgaagaggccggcatcgcgtttgtcggcccgaccgcacagcagatcggcgaattcggtctcaagcatcgcgcccgtgaactggcggccagcgccggcgtgccgatgacaccgggcacgccgctgctcagttcgctgcaggacgcactcagcgcggcggaagatatcggctatccggtgatgctgaaaagcaccgccgccggcggcggcatcggtctgacccgctgcgctgtcgccacggccctggagaacgcgtgggagagc

SEQ ID NO: 90956 - DNA, 846 bp, Glycine max
  Peptide Sequence Number=SeqID_207734
atgcatttccccctgatccttgtctcacccgctcgcccggagaatatcggcgcggccgcccgcgccatgaaaaccatgggatttagcgagttgcgtattgtcgccagtgacgcctggcaggatccggccgcgcggcgtgtggcccacggcgccggtgagattcttgaccacgtgaaaacctatgacacgctgagcgccgcgctggcggatgtcgatttttccgtggccacgaccgcccgcagccgggcgaagtttcgctattacgccacgccggcgcaggtcgaaaccatcctgcaggagaagcgtcagtggctgaatcgcatcgcgctggtgtttggccgtgaagacagcgggctgactaatgaggagctggaacaggtcgatctgctgaccggcattccgatggcgcaggactatccttcactgaatctcggccaggcggtgatggtgtactgctatcagctgtcggcgctgcaccaggtagcggccgcgccggttgaggcggctaacgcgcagcagctgcaggcgctgcgccagcgctttcatcagctgctggtgacgctggaggtcagcaatgatgccaagctggcggactggatcgatcagcgcatcggtctgctggagcagcgcgacagcgccatgctgcacctgagtgatcgggcgtctgtgacgctgcctgaacgatcgcaatccgtttcggcgtctgcggcgcagcactgcgcagcagcaccattcgggtgcaaagacaaattcgttgacttaacgtgcgctttgctttacttctggaaggcagacggacaagacaaagacagacagaaaaaatctcaatgcgtaaccacagcctga

SEQ ID NO: 90957 - DNA, 759 bp, Glycine max
  Peptide Sequence Number=SeqID_207735
atggaccaagccggtatcattcgcgatttgcttgtctggctggaaagccatctggatcaacccctttcgctcgataacgttgcgctaaaagcgggctattccaagtggcacctgcagcgaatgttcaaggaagttactggccacgccatcggcgcgtatatccgcgcccgccggctgtccaaggccgccgtcgcgctgcgtctcaccagccggccgatcctcgacattgcgctgcagtatcgcttcgattcgcagcaaacctttacccgcgcgtttaaaaagcagttcaatcagacacctgcgtggtatcgccgctcgtcggagtggaattcgtacggcattcgcccgccgattcgcctcgatgattacccgatgccgcaagcgcagttcgtcacgctgccggaaacggtgctggtggggcaaacgcaaagctatacctgtacgctggagcagatctccagctaccgcgacgagatgcgcatccacttctggaagcagttcctgctggagaccgataccgtgccaccggtgctgtatggcctgcatcaggtacgcgccagccatgagaaggatgatgagcaggagattctgtacaccacggcggtgccggccgaccagcaggcgctgagcatgcagtcaaaccagagcgtgattctggaagccggggagtatgtgcagttcagctatcagggaccgcgcactgcgctgcaggagtttattctgctgctgtacggcacctgtatgccgaccctcggcctg

SEQ ID NO: 90958 - DNA, 357 bp, Glycine max
  Peptide Sequence Number=SeqID_207736
atgggagaaagaaaaaggaaaagaaaagaaggaaagaaagctcctgatcaaggatcgaaagaaaacagaagaaatgtgcagagaggtctttggaccggacaatatctgaacaatacagaattgtcaccaaatgaaacaaaaaagaaaggaaaccacgacctaaaatggtcttctccctttaattaccaaccaaaatccccatgtttgcattttagtggagaaaacaccgagactttttcaagtctcacaagttatccagaactacgtaggtctgagttcctcattggaggatacgtaggagcaagagcctcgcttttgtcgaccacaccgccttttattgccataactcaagagccg

SEQ ID NO: 90959 - DNA, 748 bp, Glycine max
  Peptide Sequence Number=SeqID_207737
gaagaccctgaggaggatcccgaggagctacctcctgagcctgctgtggatgctcttgactttctagagggtgatgaggacccacttcctgaggtggattctcccgaggaagtcatgtcggcatctgaggcagactctacggaggatagtggcccgagagagatggcgaccagtggaggctcttcatcatacccttatcagaatggtcaaaatgtctacagtcaaggcttgatctatgatatgagatctagtggcggtaaggggggtgtagtgggtgtaatgcggttctcggggaggtctgtccctccttccatcgtattgagctttgttggagttggatttttcattatcttgcttggccaatacggaatccattcgctattcaccaaaactttaggccttaaccctgttatcaaatggtgcatagccactgtggggtcaaggttttggatattcaacacaaattttctgaaatgttctatgaaggttcacaatggtcggctagtggtgaactatgtgccaaactgggctgccaaagtgtcaaatgaatccatggtgttggggggtagacaggcttacctaggtgatgtatacgtctatgtgttcatctgggtatgtggttctgtcatacttctcaatgtgttgagggatagggggatggtgtctgagcatacacttaaattggtagctttgggtaagccaacaacgtttgacttcacttctcctctttcaagcagattaacctcag

SEQ ID NO: 90960 - DNA, 282 bp, Glycine max
  Peptide Sequence Number=SeqID_207738
atgccagccgacgtcggccaggaaaagatgacagatcgaggtctcaaaaagaagcatgaccggatgactccgatcgaacgtttcctaatcgacatcgtccaagtattattcacccccccgggtggaatagaaagaacaatagccagcatcggtcggctaggttttttcgtgcgagctcaaccaaagttgtatttccgccgacaccggcatgttctcgtttactctgccaggaacacattaacccacctcggcaaaaaaccattattctccgatactgattga

SEQ ID NO: 90961 - DNA, 855 bp, Glycine max
  Peptide Sequence Number=SeqID_207739
atgggtggaaaagatgatattgcttatgaaaacggtcagaaaatgctgaaagaactggataaaatcggaattaaatatatgtacacagattatccgggaggtcatacatggccggtttggagaaatagtctgcatcagtttgcccaggagcagaaaatcagattctcagtttcagaaaaaaataatgttatttcattaaaaacaaatgagctcttgctttccattaatactaaaaatggagtgatcacttatgcattgccatccggaaaagagcttttgaaagaaaccgcaaatgacttcaagccattcaatgatgccggaacgcagacctattccgtaagacaggattttcagcttgaaaaagacgaacctatttacggtctgggaattctgcaaaatgaaaaaatgtcccagcggaataccgatgtaaaaatgattcaaaataatacctgggattttgtgccttttttccagtctgtaaagggatatggcatcttttgggacaactattcgccgacacaatttacagatacacctcagaaaacatccttttcatcagaagttggagatagtattgattattatttcatctacggtaaaaatgcagatggagtaattgccggaatgcgtgatcttacaggaaatgtacccatgcttcctttatggacctatggttattggcaaagcaaagaacgttataaaagtcaggatgaacttacagagattgttaaaaaataccgtgatctgaaagttcctttggacggaatcatacaggattggcaatactgggggaacaattaccagtggaacgccatggacttcatcagccccgactttccggatgctaaaaaaatg

SEQ ID NO: 90962 - DNA, 390 bp, Glycine max
  Peptide Sequence Number=SeqID_207740
atgacaattggatttattgtgggattctggatagtgattgctcctttgctgatttgtagatcatggcgagggagagtagctgaacgtaaagaggggaaggataggaggtgtggggaaatggaactaaggataaccaaggcagagattaatataaagccatggcatattttgttgggagggttgaaagaaggcactacgaggataccatggctgaacagagagccttatgcttactggaaaggtaatccagctgttgctcaaaccagacaagatctcatgaaatgcaatgtttctgaaaatcaagattggaatgctcgtttatttgcccagaaactagaaataacaggcaaattcaagcaacacaatggccagtatcaatattgtatataa

SEQ ID NO: 90963 - DNA, 351 bp, Glycine max
  Peptide Sequence Number=SeqID_207741
atgtcacggaacttcacgaattacctaacgatgggtgccaagtacctcgaagtggtcaaacgagggtcgcatcccaacaacggatggtccctggacgaaattagggttacaggttgtaccatctgtggtgaggctcatgaaacaggccaatgtattctcattgaagaaaacactcaagaaggtccttataaccaacaaggacagtggagatcacaccctaacaatcaattcatcaaggaccagggtggaccttccaacagaccaattcaacaagggcctaacatctttcagaggactactaagctggaggagactgactcagtttatgcaagtaacaacgtcaaatcataa

SEQ ID NO: 90964 - DNA, 618 bp, Glycine max
  Peptide Sequence Number=SeqID_207742
gattccctagatgagcaggcctcacagggaagctttgtcgtccatggatgtcggaatgtactaattgttgacattgggcgaccagagcaccctggtcgtgtccgtgctgctagagagctcctgcatgactacatccatggctccttaacacttggagcagctaacacaaaaaatcagggaccagctagaggaatcaatcacaaaaaatatgacttgacaactaatgttgttcttcatccaaatgcagttctaaatgcaatcacagggactcgcaactgccttttaagcctgaggttagtccttctactgcttgtgtcaacacaaaggaaagttgtgtcaatccctagaggtaggacccagacacggatgactcaaagaaatgataaacagggagctgagggaccaaaaaaacctatagataggctagatcctgatgttgatccgttatacctgatggcattgaccattccgcaacttttcctcaagtcgttgcaggtgccgtgggatgctaccgtgtttagggtatatgatttagacaagtatacgagcggggaatgcctctgtgtatggattcctcaagccacaatccatacagagatatgggcaattgcaatttga

SEQ ID NO: 90965 - DNA, 369 bp, Glycine max
  Peptide Sequence Number=SeqID_207743
atggggaaaaaggaaaagagaagaacactaaaatggaaggggcaccatcctcataatcactcaccctaccaaaagctattgagatgttttgggaaggctaggacaggggagtcttcttttgttgtggtgatctactgtggagggtttcttagacataggtttacttggcccgacatgaggatgaatgttgataatatccaacaacatctagacaaggatcttgctatagatgcatggcaagattcttggcctcatgtacaagtctctgctttccctcgctacaagtttgaccataatcctattttggtctcctatagctcttcccaacaatcaaagaggaagaacaaatccagaccaaaactctattag

SEQ ID NO: 90966 - DNA, 222 bp, Glycine max
  Peptide Sequence Number=SeqID_207744
atggctacattcagcaacatttctcaaatgttcctatgtttcatgattagttccacattgatggtcaaaatcgggctttcacaagatgctccggaaccatcaaatgcaccagggccattgtcatcgaatgagaagtatttaaccaattgtggatcgcatttgtatccaaattgtggtgatgaggactacccttggattggaccggctgttgctgaatcatga

SEQ ID NO: 90967 - DNA, 213 bp, Glycine max
  Peptide Sequence Number=SeqID_207745
atggatcaatacatcagggacattggaaactctgtgcagagggagcaagtgagtctacctgaagcctgggaaagcttcttaaagatatctcacgagaaggcacactacgaccatgatgaatctaccacgaccattatcatagatggcactgaagccttggactatcatggattgaccacaactctcttggttgaccataacccgtttggttga

SEQ ID NO: 90968 - DNA, 417 bp, Glycine max
  Peptide Sequence Number=SeqID_207746
atgccattgatgctcgctttgaaggaatggatgcccgcatcactcagcttgaagaggatccgtgtatttggctacgttttaagtcattattctctaaactttgtagaagcaaagcttcatggtgaatcaaaggtgattcaaaggtgttttgatgataacaatgtaacaaaagatgatgacaaaggtgatgacaaaaagctcaaagatcaatcaaagaacaactcaagtgaatcaagaacaattcaagagttcaagatagaatcaagaagaattcaagactcaagaagaaagttaagagtcaagaatcaagattcaaggttcaagatcccaagaatcaagatcaagattcaagaatcaagagaaggcttaatcaagataagtatgaaaagtttttctcaaaaattgagtagcacatga

SEQ ID NO: 90969 - DNA, 261 bp, Glycine max
  Peptide Sequence Number=SeqID_207747
atgccacatcgtctcgtctcccagtgtgagacaaaaatcatttcaagactcagtgttaatcccataatgaatcgttcattgaagtctataaaatgcagcctcaactcaaaactccatgtagagcttgtaggccttggatcttcttcatcaataaagtcttttgcttcttggagatcaatggcagcagaatggagaaggaagaaaggtgattggagacatcacttcaaggagaagatgagtcaagaacataggaagccatga

SEQ ID NO: 90970 - DNA, 267 bp, Glycine max
  Peptide Sequence Number=SeqID_207748
atggagaagatgaatgaaaaaagggcacttgggaggggcgagctaagacttactcctgaagtaactgacttgcccaggcgagctggttccttcagccttaagtcttttgagggcccaggcgagccagaggctagcctgggcgagctagggtttagaaaaatcaataaaaagacccttttgcccctcctctttggtatttttcgcattcctgatcaaaacactgaatggttccctgctttgcattgtaattggcgttcaacattgtaa

SEQ ID NO: 90971 - DNA, 171 bp, Glycine max
  Peptide Sequence Number=SeqID_207749
atgcatgatgcgatcaaggaacaagccagagaactatcagcggcaatgcatcaccaaaagaggaaaactctagatgaggcttcactgttatcatgcgagtcggagacccagcatgaccacagatcgacctccactccttatggctcactgttagtcgtcttatacgactaa

SEQ ID NO: 90972 - DNA, 222 bp, Glycine max
  Peptide Sequence Number=SeqID_207750
atgcatacctttcaacataggaagacttctgtccgcttcatcttcgcgactctgctatctccttctgcagtcatcgtgacagctcgccaccgtacccaggttaaatatgtgaactgtgattctgttaccattcctgagctacggtttgtgatagaaagctttaagttcaactcaacagtgaaaggattcataatcactgtgtccaaatccatggtgctttag

SEQ ID NO: 90973 - DNA, 306 bp, Glycine max
  Peptide Sequence Number=SeqID_207751
atgaaatcagtcaccaaaactgcagagggaaagccacctcagcatgggcctcagtggattgaagcaaagagtcatgttcaaataggaaattacgagtgcggatactatgttatgcattggctatggtgcatcgtaagtggtggattgaaggatgactggattcacggtggtggtgaaaaggactacaaggaggtacccccacctcctttgtttaaacctgcagggggacacatcaaccaagctgtgaccttcaacagatcttattacaaggtaatcagttcaatggagaaatggttgagtcactaa

SEQ ID NO: 90974 - DNA, 252 bp, Glycine max
  Peptide Sequence Number=SeqID_207752
atgtggaagaagttcagaaattgggatttggtagaaattgggattaaggaaattgttcagacaaatgacgagaaaaagggaaaccatgcatgtagaattgttcagagctctcaggtggttgctcccaaagctgagcacgtatatgattttaaattatctagtgttagtgcagaactagtgtctgttatagtggtgatatcaggaaagctggattatgaacatactatacaatttaattatgtttcagagtag

SEQ ID NO: 90975 - DNA, 432 bp, Glycine max
  Peptide Sequence Number=SeqID_207753
atgggtagtcctagcatgggaggctcaaagagaaggctttcaagcagagggcttggaggagcccttagggagcaaagggcaaggctttacataattaaaaggtggaagcagcatctatccaagaaagatttggggaaaactgagacacagctagagaagcaggaaatgatcaaagaaaaatgctatctccgctttcctacactgccattcattcccaaggaacctgatgatgtgattgctacagattatgacaatttttctcttgtttcaggagctaaggatcaaagttttattcagatatactcaaggacacctaaccctggacctgaattgatagagaagtacaattcttaccttgcaaactatggatatgctcctagcaaaactaaagatacgccaggcaatttaatccaacaaatcagcaagcattaa

SEQ ID NO: 90976 - DNA, 291 bp, Glycine max
  Peptide Sequence Number=SeqID_207754
atgaggaaacctgatctgatggccaacaagaacaaaatgaacaacattaagagcaagttcagaaaagggttgtggtcactagatgaagatgagaggctcgtaaagaagaaaaaaaaaccagaggaaaacaaagtggaggagaaaaaagcagaggaagaagaaaagaaagaagaagagaaaaaaccagaggaatcaaaagatgacaaggaatccaaggaggaatctgcgccgccagaaatcatgcaaggcacaacctttgcaatgcatggacactttaagcacgatttttga

SEQ ID NO: 90977 - DNA, 282 bp, Glycine max
  Peptide Sequence Number=SeqID_207755
atgaaggatcggtgtacgatgtatgcatgtgtagcggtcagtcccgactgtcatccacatgattttgccactagatcacccttctgtcagaatatggccatcaaagtctacaaggatgtgggagattttagcgacaatggggatctcacgccatccaaaatcgctttctacctaagtgtttacggtgaagagatatccaagggagaggcggtttcacctcacgaggaatgggattcctcgggggatgaaagcgaccattttgaagatatgacttcaccctag

SEQ ID NO: 90978 - DNA, 264 bp, Glycine max
  Peptide Sequence Number=SeqID_207756
atggccaaccttgtgatgctaggaagatatgaaggactcaagattctaagagaaaggaatgcagaatatggcttaaatgagagcaaagaatgctttggtaccaatggaatggttgcaaggaaaacaacgaatgtccttcgggtcaaattgcgagcgtcattcagacacaatggcagtgacgagatgaattttttggaagcaagaaacttaccaagactagaccatgagcgcaacgatggcctgagggtggttttgcgagactga

SEQ ID NO: 90979 - DNA, 231 bp, Glycine max
  Peptide Sequence Number=SeqID_207757
atgtctctctattcaaacctctctcgcattctctgtaagtcaggcttaaaagggctttctgtccgcgaaggcacacttagcaccattctcgcgctaagcacgaaagagacaattgtctcgcttagcgagctgcatacgcgctgggtgcatgctggcatggatgaactctcttcaagcttatccttaatcgctaagccactgttgtctcgcttagcggtttggtctcgttaa

SEQ ID NO: 90980 - DNA, 444 bp, Glycine max
  Peptide Sequence Number=SeqID_207758
atgttctaccaatcattagtggccttcttttcttcctcacctacgccttctcctaccgtgacggtctcaacattgtcaataaatgagaatgagttgtcggcgttgacgaagttggagaatgacatgatgaatatggaagacttggtgacgttgcagcacatcgagacaacaatgaaagggagagtgggctcagaaagtgatgcatgctacggagttttggatgacgccacttccagtgaaggaagatacgtcaggatagacgccacaaggattaccttgataagtctaagattggttcaacaaggaacccagagagaagctctcaccaaattttatcaaatgccaaaagtttctttattgaaaacgaaaatcaatagtgtatctgaacaaaaagataaaaatagacataggccttctaaacagtttgggccaaaattacaatga

SEQ ID NO: 90981 - DNA, 225 bp, Glycine max
  Peptide Sequence Number=SeqID_207759
atggagatgaaaaggtgggatgctatacattttgtggttttgaagatgagaataaagaaacttgtcaagaagttaaagatatatagaaaggcattgttcgaggagttttgggaggtgtctagaaactatgaatccattgtccataaaaaatctaggattaggtggttaagggagggagatgccaataccaacttcttccattcttcagttaattggagaaggtga

SEQ ID NO: 90982 - DNA, 504 bp, Glycine max
  Peptide Sequence Number=SeqID_207760
atgtctttcactatttcctataaaaagaaaatagtgacttgtccatatgagtcactattcaccttcttcttcctctgctctccttcctcggctccgtgttctgctattgcttaccgtgccatgaccgtgatcgtgccttctactgctgttgttgttcgtgctgttgctgctgctgtgaccgtgatcgtgatcatgcctttcgtgttctattgttgttgcttcttccttcttcttctctttcgagagaatgatttttgtaaaatgtatttcaaaatgtcacgttctgctccgtcgtcatcatggttaaccaccgtgaacgaggaactggagatgattcttgcgattctgcctaaattaacaattgaagagcacggagaatggtgcaagatggcgaagaccatgtcaaaggtcgtggctccaccatatgctattttaaacaccatttacggtgaaattagcatgtcatttgctgtcaggtgggaggacatacttggcggcttatga

SEQ ID NO: 90983 - DNA, 236 bp, Glycine max
  Peptide Sequence Number=SeqID_207761
gtcttccagcgggttcaacacctaaatgtggtatttggaaagacctaaaagaaggaaaaaaactcatcagtgggctaaacacgcatccaccgctaagcgcgatagaagaatctggaagagcatcaatatcaaggccgcatgctaagcgtgagatcagtgtgctaagcgcagtagttgtcttcagccaggatcaacgcacgactagcgttaaactcaaatccacttacttgcgctaa

SEQ ID NO: 90984 - DNA, 342 bp, Glycine max
  Peptide Sequence Number=SeqID_207762
atgattgttgggaagtataattgttttccaatggtagtcattgtatgccctttgaatgccaatactaaaagcaaagtcgtgacattgggtttatactttttacagagggctggagtgcagtttgctcaaaaggatcaagtggtccaaccaaataatcctacttcacaacctagtaggactactaatgtaccaaacagggagcaggcctcacctagacatgaagcaattgctcagccagtagaatcccaggctgtccctgagtttctactattgattcagaatatgaaaattggatctctctatacatacagagatcaacaagaaagtaactacaacagttaa

SEQ ID NO: 90985 - DNA, 473 bp, Glycine max
  Peptide Sequence Number=SeqID_207763
atgcagttcgcaggccacgccgaaccacgacatcagttgcgcgccggcctgttccatgcggctccaggcggcgttgcgggtgacttcgttgaaggtgcccgaggcatcggtcaccacgaatacgtcgaagccttcctccagcgccgacaaggcggggaaggccacgcacacttcggtcaccacgccggcgatgatgagctgcttcttgccggtggccttgaccgccttgacgaagtcttcgttgtcccaggcattgatgttgccggggcgggcgatgtagggcgccttggggaatttgtccttcagctcctgcaccagggggccgttggggccgtcctcgaaactggtggtcaggatggtgggcagcttgaaataggcggccaggtcggccagcgccagcacgttgtttttgaattgatcgggttgaaagtcgcgcaccagggacagcaggccggcctgatggtcgaccagca

SEQ ID NO: 90986 - DNA, 147 bp, Glycine max
  Peptide Sequence Number=SeqID_207764
atgttcctcgtattcaacaatgctttgaaaggacttgatgatactccacagcctaaatctaaggttgctgctaggtggattgtcattaagtattttaacgatgctagaccattggagccaaagagatcaatattatctctgacttag

SEQ ID NO: 90987 - DNA, 363 bp, Glycine max
  Peptide Sequence Number=SeqID_207765
atggttatgggggatttcatcagcagactctccttccctgcatgtttgcattttagtggagaaaacaccgagactttttcaagtctcacaagttatccagaactacgtaggtctgagttcctcattggaggatacgtaggagcaagagcctcgcttttgtcgaccacaccaccttttgttgccatgacccaagagctggtaacccgcggagacaccttacagttatccgcacctcgtcattcagtgaccccaagtgtgattcatgaacagagggcaatgtggtcatctgtgccctttccggagatgtcagcatcttccggtgcagactttttcaagtctcacaagttatctagaacaacgtag

SEQ ID NO: 90988 - DNA, 165 bp, Glycine max
  Peptide Sequence Number=SeqID_207766
atggctacagccaggtgggcactcaagcatcccgtttatggcattgtgatactacggttgggaatttacacaaacagacccaacgtttccaagacaacgttcctaaatgaaaaactctacacggttccgaaatttcaacaaacactattgacaacaacgaagtaa

SEQ ID NO: 90989 - DNA, 438 bp, Glycine max
  Peptide Sequence Number=SeqID_207767
atgactgaccctctcgatgagtcgatctcttgctttctcataaaggtggacccttgggtactagtacctatcacttttagaggactatatgtcctcgccatcagaggactgcatatcctcgcctgcagagggctgcacgccctcgcctttagagggctacgcgtcctcattttcattcctgggccaccccctgatattggaggacgaccaactgtgcaagcacatccagagagggaggctatcacacatctactatgcataccggggcaagatttcacccgtgccgctgcaaaaagacgagtgcggatcatgcgcaccaacatgacccctcttacatggatatggatgacgttgctatttagcaacactctgcccagtgaccacaatgccaatctctccctgcagatgtgtcagttggtctgtgccgtcatgacatag

SEQ ID NO: 90990 - DNA, 492 bp, Glycine max
  Peptide Sequence Number=SeqID_207768
atgggtgaccaagaggaagtacaggaacagatgaaagccgacatgtcgactttgaaagagcaaatggataccatgatggatgccatgctaggaatgaggcaactaatggagaataatgtggccaccgctgccgctgttagttcggctgtcgaagcagacccaactctcccagctaccgcgcaccatcctatcccaaacgtggtaggacaagaaagaagcacactggggtacatcagcatcccccatctgggatacaaccgagtggcttacccctatggattaccacctaattacatgccaccagtcatacatgatgacgcgggtcatgtccctccccccatccttgaaggtgagcctcctcgacagtcggacgaggttcacgaagatcgtcgagagcatgcccaaggagacatcgattcctactccccggtccccgtcgagggaccggcacccaacacactacctcagcccaacctcacgggagaaccttga

SEQ ID NO: 90991 - DNA, 1110 bp, Glycine max
  Peptide Sequence Number=SeqID_207769
atggcactcacacaaagctgcgcgaatcacttcccccgacggagtttaatccgtataacgtgggaaaaatcatcggaaccagggattgagatgaagagcaaacggttaacgctggtgctgtcgcaggcggtgagccgcgtgatgctggatgacatccgcgccatcgtgccgcccgaggcgctgaatgtgttcattaatggcttagatagttgccactacgccacgctggactgcgtgcagagcgaagagaactgcgcgctgctggcgtcagccattgtggtgtggcgtcagctcggccattatgatgaaaacccaccgcgcgctaatccagctcgcctaacgctcaggatgcatatgaaaatcggtctgctgttccccatcgccattatcgttgccggtgtcagttttctggtctggtttattgccagcggcgccatgatgcccggtcgccagcgttcatctgcttcactcttccttcacatcagtttaacaaaaccgagcgtggagcccctgcacatgacccttcatcatcaacactacattaatggcgcgtttgtcgaggcgcataacgatagctggattgaagtgattaacccggcgacggagaccttgctgtcacgcgtgccccagggcagcaaacagcaggcggcggcagccattaccgccgcagaagccgctcagcccggctgggaagcgttaccggcggtggcgcgcggcgactggctgcaccgcatcgccacggcaattcgccagcgcgagcctgagctgagcaccaccctcgtggcggagggcggcaaaacccaggcgctggcgcaaaccgaagtgctgtttaccgctgactacttcgactacatggcggaatgggcgcgacgctacgaaggggaaatcgtcaacagcgatcgcccaaacgaaaacatctttgtgtttaagaaagcgattggcgtgaccaccggcattctgccgtggaattttcccttcttcctgattgcgcgcaaagcggcaccggcgctgatcaccggcaacactatcgtgctgaagccgagtgagatcaccccgaacaacgccgccctgttcgccgccattatcgacgacctcggcctgccgcccggg

SEQ ID NO: 90992 - DNA, 117 bp, Glycine max
  Peptide Sequence Number=SeqID_207770
atggcgatcgtgatcgcgcacaaaacagacgcagccggcgctgagcgcctgcggctgaccattaaatacgtggatgcccgagccctgttccaccagcacgatttcatgaaaatcatg

SEQ ID NO: 90993 - DNA, 646 bp, Glycine max
  Peptide Sequence Number=SeqID_207771
gactttcgcgctccagctggctgatgacgccgcgcgccagcgccatgccgcgcgtggtcagacgccagctggcgggtgtctcttcatcctgtggcggcagcagctgctgccagtcgagtgccagactgaagcgatcgcggcagtagagaatattgtcgagcgccagatcgttgacgctatcaaagctgtggcaatcactgtcgcggatgtaaaacacgtcgccgcaggtgatcagccacggccgatcgttgaggatatgcaggccattaccgcgccagacaatcacaatctcgctgaactcatgccggtgcggtgggaaagagggctgcggcatgcgttctgccacggcaataggcaaattgctggccgggaagtaatcctcgcgcggtacgcagcgacaaacagaagcgatcggccagcgcttcccacgcaatttcctcactgtagtgcgcattcagccagtccagcaagcggtgcaggcgggcatcctggtcctgcgcctgatcattgtgcgccgcctcgcgcagcagcaccagcagctgcaaaaagtgctgttcctgctgcgcctgacgttccagcgaccagctggccggctgcttcatctgcgtcaccagctgcagcgcctgcgccatcactttatggttga

SEQ ID NO: 90994 - DNA, 309 bp, Glycine max
  Peptide Sequence Number=SeqID_207772
atgaggggcatcgtgcatgagcctcaagtgaacataggggcagatcaaaagttctcacctgtcgatgtttttaaacaagaaaaagaaaaggggggacaaaccctaggttttcaatggattgatcaaacatcaaacgactccattcccgtcactccaaaacggtcaattaccctcaccattgagaggactacacgtcctcgccttgagaggactacatgtcctcaccttcagagggctgcacgccctcaccttcagaggactacatgtcctcgccttgagagggctacacgccctcaccttgggtactag

SEQ ID NO: 90995 - DNA, 185 bp, Glycine max
  Peptide Sequence Number=SeqID_207773
atggataccgtagagctttacactagggcaatgaaaggcaccatgcgtgagcctcaggcgaacctaggggcaggtcaaaagttctcacccatcgatgtttttaaacaaaaaaaagggagtgacaaaccctgggatttcagtggattgattaaacggctccatcgccatcactccaaaattgtcaa

SEQ ID NO: 90996 - DNA, 448 bp, Glycine max
  Peptide Sequence Number=SeqID_207774
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtccgtcagcaaaatatgtgatacaggatatattccgcttcctcgctcactgactcgctacgctcggtcgttcgactgcggcgagcggaaatggcttacgaacggggcggagatttcctggaagatgccaggaagatacttaacagggaaggcgttttccccccctggcgggctcccttcgagcgctcctcctgttcccggccctttcgggtttacccggtggtccattcccgctgttatggcccggcgtttgtctcatttcccaacgcccttgaacacctccag

SEQ ID NO: 90997 - DNA, 381 bp, Glycine max
  Peptide Sequence Number=SeqID_207775
atgcgaggttaccctatagttacctgcacctttcgtcaaccaggggccaacgagcctgttgacgcgcagagactaacatcgtctcttgcacctttggtcgtcttgacccgtgaagtcaggattaccttatggttacccgcacctttcgtcaaccagggggcaaacgagcccgttgacgcgaagagacggacatcgtcttttgcaccttttgtcatccagggacaacgagtcaggtggtttttactctcgttgtccggaaacattcaagcccaacgacgcgcgagattcttctctgctaagcagggacgatcgagtgcaatggcaaagggaaatgtcgtggttgtccaactttgtcgttttcaagacactgaagtttgttga

SEQ ID NO: 90998 - DNA, 482 bp, Glycine max
  Peptide Sequence Number=SeqID_207776
cttatgctgcaaacatctacaacaggcctcctcaacctcaacagcaaaatcagccacaacagaataattatgacctctccagcaacaggtacaatcccggatggaggaatcatcccaaccttagatggtcgaatccttcacaacagcagcaacaacaacaacagacttattttcaaaatgttgttggtccaagcagaccatacgttccaccaccaatccagcagcaacaacagcaacagccccagaaacaacaaacagttgaggcccctccgcaaccttcccttgaagaacttattaccttctcaatttgtccagaatcccaaaaatgtgaatctaaagagaagcagcatatccctcttccattccctccaagagcaatttccaacaaaaaaatggaagaggcagagaaggagatcttggaaacatttaggaaagtagaggagctgtgcactaataagcggaagcttaaaggaagtgaatga

SEQ ID NO: 90999 - DNA, 927 bp, Glycine max
  Peptide Sequence Number=SeqID_207777
atgaacgaccctaatggcctggtctggtttgatggctggtatcacgccttttatcaacatcatccgtattcgacccagtggggcccgatgcactggggccatgcgcgcagcaaggatttagttcactgggaacatctcccggttgcactggcgccagaaggagcagaagacaaggatggctgtttttccggatcggcagtggtggatggcgatacgcttgcgctgatttacaccggacataaattccacggcgatcctgatgatgaggcaaatctctaccaggtgcagtgtctggcgaccagccgtgatggtattcattttagccgggaaggcatggttgttgacacgccgcctggcctgcatcacttccgtgacccgaaagtgtggcgtgagggggagagctggtacatggtcgtcggtgcgcgggacggcgaaacgggtcaggtgcgcgtgtatcgctctgaagatctgcacgcgtggcaggatatgggcgtgcttgcggtggcagaaaaagagatggggtatatgtgggaatgccctgactttttcactctcaatggcaagcgcgtactgatgttttcacctcagggagtggtggctgaaggatacaaaaatcgtaatctatttcagagtggctatctgttgggcgagtggcagcctggtcagccttttgtgcgagaaggtgagtttgtggagatggatcgcggacatgatttctatgcgccacaaagtttcctgacccctgatggccgccgcatcgttatcggctggctggacatgtgggaatccccactgccggagcaggaagatggatgggctggcatgctctctttaccgcgcgaactgacgctgagtgcggataaccgcctgcaaatgcgaccggccagagaggtcgaaggcctccggggagagtggttcccctggcca

SEQ ID NO: 91000 - DNA, 283 bp, Glycine max
  Peptide Sequence Number=SeqID_207778
aaaaactttaaatttcggacatacgatcggtcatgctatcgaaagctcttgtcttgaacagggaaatccggttttacatggagaagcagtagctgccggaatgatctgtgaagcacatctttctcaccttgaaaagttaatttcaaaagaagattcggaaatgatcattgaccatatcaaaaggtcctccacatcatcatatagaaaggagatagcgcacttatgtttcgggttgcagttccaaagtcgtaaacagggagaaattcgatgctgtcatcattga

SEQ ID NO: 91001 - DNA, 174 bp, Glycine max
  Peptide Sequence Number=SeqID_207779
atgccacatcctatcagagcgttgtgtctcgacgtccttcagcacaaggttccttacatcaattcacctagtcatctgctccccccgaacacaaagttcaagatcatcacaggatccaaacacaaacaacacacggggatgaaaaaccaccctggggcgcttaagagtacataa

SEQ ID NO: 91002 - DNA, 270 bp, Glycine max
  Peptide Sequence Number=SeqID_207780
atgtctgaagaagttgatatgaatgaaaaaaatgaagacgaagatggtgtgaatgaagaacatgttgattcttcttatgcgttcaatacttctcaggtatttgctacctgtgatgatgttctgcattgggctcgatttgttgcttatgaaattggttttgtgacagtgattatgaggtcagacataaatagtggtattagagaaatgacctcatttgttttaattggttgtgaaaggagtggtgtgtatagggctaagaagaaagatttg

SEQ ID NO: 91003 - DNA, 180 bp, Glycine max
  Peptide Sequence Number=SeqID_207781
acaaacgtagtgcatcatcatctaagcaagcaattccaagaaggaccatgccgatgttggatcaatttcatccatgcattcatgattccatttaaaacattgttgatgtcaaagctgatggttatcatggataagtggatgaatatatccaacatgggatatgtgattgcatcaaggtaa

SEQ ID NO: 91004 - DNA, 1182 bp, Glycine max
  Peptide Sequence Number=SeqID_207782
tgcattgaccgataacctcacgctctacgccaactacaccaccggccaggagccgggcaacgatctgttcttcctcagcccaacgcagaccgatctgccgctgacgcgagcgcgccagtgggaggccggcgccaaagggcagttctggggtaacaaaggcgaggcgacgctggcgctgtacgaactgcgcaaggacaacctgtttgtgcccgacgcgcagcggccggatgcgttgaacgcggtaggcaggcagacgtcgcgcggcatcgagcttggcgtggtgctgcgtcccgacgagcgctgggagctggccggcaacgccgcctacacgcatgcccgctacgacgactatcgcggcggtagcccgctgcgcagctacaacggcaatcgcccggcctatattccggactggactgccaacctcagcgtgcattatcaggcgacggagcgcctggggctggcttcttcgctgcgctacgtcggcagcagttataacgacgacgccaaccggcgcaagatgcgcgcgtataccacgctcgatctggcggcggactatcagctgacgccgatcgtcgatgtcggttctgacggcgtgaaacgccggcttgctctgctgttgtgcgccctgggattgggcggcggcgcgccgctgcgcgccgatgccgtcagcctgcaaaattgcggggtaacgcacgattacccgcagccgccgcagcgggtgctggtttacgccaacccggcgctggaaaacctgctggcgctggggctggccgcccgcgcgatcggcgtggtcgggtatgaccgcgcgcgcgatcccgcgccgacggacgatgcgctgcaggcgcccaccagcccggcgccgcccacggcggaagcgttgttgctgatgcggccggattttgtctattcggccagctattactggctgcacagcccggaaacgcccgaccgggcgctgctggcggcatggggcatcggcacttatctctcacccggcgcctgcagcggccagcaaagcgcgatcgccgccgcgctgacgtttgaagacattttcaccgagctgcgggagctggcgcgcattttcaacgtcagccgcgccggtgaagcgctggtcgaacggctgcgcgggcagctgagggcgctcgaaccacagcgtgctcagctgccgcatttgcgtctgct

SEQ ID NO: 91005 - DNA, 351 bp, Glycine max
  Peptide Sequence Number=SeqID_207783
atgatggattctcaaaacattgctattggaggacattatatggaagtgttcaataatttcattcatgagtgggaggtggaggatattccaatgatagggaggagatacacatggtatatatcaagctctcgttcaaagaataggagcttctttgatcattgccccattattcttaagaatgcaacaaatgattggggacccaaaccatttaggacactagattgttggttcttagagcatggctttaaggaaaaagtgaaggaattatggaactcctacgtgattcaaggaaaatgtgtgtttgtacttaaagaaaagataaaacttctaaagaaagatcaaagaaagtga

SEQ ID NO: 91006 - DNA, 376 bp, Glycine max
  Peptide Sequence Number=SeqID_207784
agatgttgtcaggaaggttttaagccataatgtgagagggttgggaagaaggttgaagcagagagctattagagattgcattgttaaggagggcatcaattttgcttgccttcaagagacaaaaattgaaaagatgactaggcatgtttgttcaaatatatggggtgatgatgattttgagaggagacaatcacacacatctaattcggcgggtggtttgctttgcatatggaacaaagaggtaatggatgttaatacttcttttgttgggaaaggctttcttggagtgcaaggagtgttgaaagaaggcaatgttccatgctttatttttaatatttatgcaccttgtgattttaaggagaagataagactttga

SEQ ID NO: 91007 - DNA, 237 bp, Glycine max
  Peptide Sequence Number=SeqID_207785
atgtctcctccacctctagaacctcacaattactcacaaactcatctcacgttctcaggacgacttcctcttcaagctccattctctgcaggtggccttgttggtgcttgcatgcttagcgcaactctaaactgcttagggcgcattagtgagttttggcttagtgcgcgtcttcacgctcagctgatggactcaaacagtgcgcttagcggatggctcactaagccaacagattga

SEQ ID NO: 91008 - DNA, 7646 bp, Glycine max
  Peptide Sequence Number=SeqID_207786
atggaaaacgccgccaacgcctccgccgccgtcatttccggtcccccgccgctcgaggagcccgagtacttggctcggtatatggtcgttaagcactcgtggcgtggtcgctacaagcggattctctgcatttccagcgtcaccgttctcactctcgatccttccacgctctccgtcacgaactcttacgacgtggcgacggacttcgaaggtgcctcgcccgttctcggccgcgacgagaattcgaacgagtttaacctcagtgtgaggaccgatggacgcggaaaattcaaggccacgaagttctcatcgcggtacagggcgagtattttgacggagttgcaccggattcggtggaaccggttggtgccggtggctgagttcccggtgcttcatcttcggcgaagggcagctcagtgggttccttttaaattgaaagtaacttatgttggtgttgaacttctcgatacaaaatcgggtgaccttcgctggtgcttggattttagagacatggattcccctgcaattattcttctatctgatgcttttggaaaaacaaatgttgatcatggtagcggatttgttctttgccccttatatggaagaaaatctaaagctttccaagctgcttctggatgcacaatatcagctattatctcaaatttggcagttggagcagaagataccccaatggggggatggtctgtaacaaggctgcgttctgctgcccatggaactctaaatgttccaggattgagcttaggagttggcccaaaaggaggactaggtgagcatggtgattctgtatctcgtcagctcattcttacaaaggtttcacttgtggaaaggcgtcctgagaattatgaagctgttactgttcgtcctttatcttcagtaagtgctcttgttcggtttgctgaagagccccagatgtttgcaattgaatttagtgatggatgccccatccatgtttatgcaagcacatctcgtgatagcttacttgcagcagttcgtgatgctttacaaactgaatgtccaagtgcttgtttgacttctagtgatgtttatttacagggtcaatgtgccatacctgtattgccaagactgacaatgcctggtcatcgtattgatcctccctgtgggagagtttttttgcaatatggtcaacaaaagcctgttactgatgcagaaagtgcatccatgcatttgaaacatttagcagctgctgccaaagatgccgttgctgaaggtggttctgttcctggatctagggctaaactatggcgtagaataagggagttcaatgcctgtataccatatggtggtgtgcctacaaacgttgaagtaccggaggttactttgatggccttgattactatgcttcctgctgccccaaatcttcctccagaatctcctccattgccacccccttcaccaaaagctgcagcaactgtgatgggttttattgcatgtttacgcagactacttgcctcaagaagtgcagcttcacatgtgatgtcttttccggcggcagttggaaggataatgggtttactcagaaatggttcagaaggtgtagcttctgaggctgcagggcttgttgctgcacttattggtggtgggcctggtgatgcaaatgtaacagattctaaaggagaatggcatgccacaattatgcatacaaagtctgttttgtttgctaatcataattatatcatcattcttgtcaacagattaaagcccacgtcagtatcgcctttactgtcaatgactgttgtcgaagtgctcgaggctatgatctgtgatccacatggtgagactacccaatatactgtttttgttgaattgttacgccaagttgcagggttgaagcgtcgcttgtttgcactgtttggtcaccctgctgaaagtgttagagaaacagtagcaatgatcatgcgatcaattgcagaagaagatgctattgctgcagagtccatgcgggatgcttctttgcgtgatggtgctttgttgagacatttactgcatgcatttttccttccgtctggtgagcggcgtgaagttagtcgacaacttgttgctctttgggcagattcctatcaaccagctttggagctattatcccgaatactgcctcctggcctcgttgcttacttgcacacacgtgctgatggagttctagccgaagacacaaatcaagaagagtcatcaattgggaaaagaaaaagacgtttacttcagcacaggaaaggtcgcattgggagaggacttacctcgcaagaacaacctttcccttcagctaataactttgatgcttctgattcagctaggcagacagtgggtgctattgttagaggctcagacagctatcataaaactgttatggacccaggttctggacaggcttcaaatattcaatcatcagttgttcacactagtgaaaatttgaacaatggatcttctacaggagaagttcaaaatgggcattcaacttttgtggattcagctattgcggtatcaacaaactcaaatgaagctccaggatctgaattttcaaattcagttgatcctgacagcaatgcagttggtttgcagaatgcaggcattcctgctcccgcccaagttgttgtggagaacacccctgtaggatctggtcgacttctatgtaactggcctgaattttggcgagcttttgatcttgatcacaatcgtgcagacttgatttggaatgagcgtactaggcaagaattgagagaatctttgcaagctgaagttcataaactagatgttgagaaagagcgtactgaagatattgttccagggggtgctacattggatatggtatctggggttgagagtgtgccacaaatatcttggaactaccctgaattttctgttcgttacccaagcttgtcaaaagaagtttgcgtgggacagtattatcttcggttactgcttgagagtggcagtggtggcagggcgcaagacttcccattgcgtgatcctgttgctttcttcagggcactttaccatcggttcttatgtgatgctgacaccgggcttactgtagatggtgctgttcctgatgaattaggtgcgtctgatgattggtgcgacatgggtagattagatggttttggtggaggtggtggatcatcagtgagagaactttgtgcaagggcaatggcaattgtatatgagcagcattacatgaccattggcccttttgaaggtacagctcacattactgttctcttggataggacagatgacagtgctttgaggcatcgacttcttttacttctgaaggcattgatgaaggttttatcaaatgttgaggcttgtgttctagttggaggttgtgtattagctgttgatctgcttactgcggttcatgaaacttcagagaggacatctattcccttgcaatccaatttaattgctgctagtgcttttatggaaccacttaaggaatggctgtatattgataaagatggtgctcaagttggtcctatggaaaaagatgctattagaagattgtggtccaagaaggctattgattggacaacaaggttttgggcatctgggatgctagattggaaaaagttgcgtgatatccgtgagcttcgttgggcacttgccctcagagttcctgtccttaccccacctcaggttggggacactgctttgtccatattgcatagcatggtgtctgcacgttcagatttagatgatgctggagagattgttactccaactcctagagtaaagcgaatcttgtcaagtccacgctgccttccacatattgcacaggcctttctttctggggaaccaagtattgttgaggcagctgctgcattgcttaaggctattgttacacggaatcccaaagctatggtccgtctatacagcactggtgcattttattttgcactggcatatcctgggtctaatctactttcaattgggcaactcttttctgtcacccatgtccatcaagcatttcatggtggggaagaggctgcagtttcaacttcattgcctttggcaaaacgtagtgttcttggtggacttctccctgaatctttgttgtacgtactagaacgtagtggtccagcagcatttgctgcagcaatggtttctgattctgacacgccagagataatatggactcacaaaatgagggcagaaaatctaattcgtcaggttttgcagcatcttggtgattttccgcagaaactgtcacagcattgccatgttttatatgactacgcccccatgcctccagtgacatacccagagctgagagatgaaatgtggtgtcaccgttattacctcaggaacctatgtgatgatattcgttttccaaattggccaattgttgaacatgtagagtttcttcagtcactacttgtaatgtggcgtgaagagttaactagaaagcctatggatctttctgaagaagaagcttgcaagatccttgaagtatcctttgaggatgtgtctagtgatggtgtaaataaaagaaattctctggaagttatggatgaagcatctagcttatcgaagcagattgagaacattgatgaagaaaaattaaagcgacaatatcggaaacttgctatgaaatatcatcctgacaaaaatccagaagggagggagaagtttcttgctatacagaaggcctatgaacgcctccagggacaatgtattttatacagaagacatggagatgtattggagccattcaaatatgccggctatcccatgttgctgagtgctgttactgtggacaaggatgacaacaattttctttcttcagatagagcacttctccttgttgctgcatcagagcttgtctggctgacatgtgcatcttcttcattgaatggtgaagagctggtaagggatggaggagtacatcttcttgcaactcttctttcccgttgcatgggtgttgttcagccaactactcctggaaatgaaccatctgccatcattgttacaaacatcatgcgaacattttcagttcttagtcagtttgaggctgccagagctgagatacttgagttttccggactagttgaggacattgtgcactgtactgaatttgagcttgtacctgcagctgttaatgctgctttacagactattgccaatgtttctatttcctctgaattgcaagatgctttattgaaggctgttcatcaagggaaagggaccttgactaattcaaagttcggtcaggagtatgactcaactgcagaagaatctgatgcaacagaatctcatggtgtcggtgctagtgttcaaattgccaaaaacatgcatgccataaaagcatcacacgctttgtcaaggctcagtggtttgtgtggagatgagagtgcaaccccttacaatcaggcagctgctgatgccgtcagagttttgctaactcccaagctctctagcatgttaaaagatcaaatgtccaaagatttactgtccaaattaaatgcaaacctggagtcaccagagattatctggaactcttcaacacgagcagagttgctgaaatttgtggaccagcaacgtgcagctcaaggtcctgatggttcatatgatattaaggattcacatgactttgtctataaagcactatccagagaattattcattggaaatgtttacttgagagtctacaatgatcaaccagactttgaaattagtgaaccagaaactttttgccttgctctgattgattttatatcttatcttgtacacaatcaatgtgttgaagatgccggtcataaggttgaaggcacctctagtttctttgagacttttgagcatacaagtgaggctgttgatggatctgtcaatgagcagcaggttctggaaaattctggcacaatgtctgaagaacaatctttagggaaggaagagcttgagctgattaaaaatctccgttctgcattgacctcccttcagaaccttctgactaataatcccaatttggcatccatattttctaataaagacaagttactgcctctttttgaatgcttttctgtgcccgaagcatcactcagtaacattcctcaactttgcctaggagtgttatcactcttaacagcacatgctccttgtttgcaagccatggttgcagatggatctagtcttctgcttttattacaaatgcttcactcatccccaagttgtcgtgaagggtctctccatgttctctacgcattggcaagcacaccagagctagcctgggctgctgccaaacatgggggtgttgtctacattcttgaattgctcttgcctttgaagggtagaagacttcaaagagctatggcggcctccttgttggggaagcttgttagccaaccaatgcacggaccaagagtttctatcacacttgcaaggtttctccctgatggccttgtatcagtaatcagggatggacctggtgaagcagttgtagttgcccttgagcagactacagagacaccagaacttgtatggacgccagcgatggcgacttccttatctgcacaaatttccactatggcatcagagctataccgtgagcagatgaaagggcgtgttgttgattgggatgtgcctgagcaggcatctggacagcaggaaatgagagatgagccacaggttggtggcatctatgttaggctgtttctgaaagatcccaaattccctcttagaaaccctaaaaggttcttggaaggtctactagatcagtatttgtcgtccattgctgccacccattatgaggtgcaggttattgatccagagcttcctttgctcctgtcggctgcactggtttccttactgcgtgtgcatcctgcactagcagatcatgttggatatcttggatatgtaccaaaactagttgctgctgttgcatttgagggaaggcgagaaacaatgtcatcaggtgaggtaaacaatgggagacatgcagaacaaacatatgacccagataaggaatcagcagagaacacacaaactcctcaagaacgtgtgcgcctgagttgtttgcgtgtcttgcatcaacttgcagctagtaccacctgtgcggaggccatggcagcaaccagtgttggaacacctcaggttgttccgctgctaatgaaagccatagggtggcaaggtggaagcattttagctcttgagactctaaaacgtgttgtggttgccggaaaccgagccagggatgctcttgttgcacagggacttaaagttggtcttgttgaagttcttcttggtcttcttgactggagggctggtggaaggaatggcttttgttctcagatgaagtggaatgaatctgaagcatctattggcagggtgcttgctattgaggtcttgcatgcctttgctactgaaggagcccattgcactaaagtgcgagaactattgaacaattctgatgtttggagtgcttacaaagaccagaagcatgatctcttcctcccttcaaatgctcaatctgcagctgctggcattgctggtctcattgagaattcatcatcgtcgagactcatttatgctcttactgctccaccacaatccactacttctagaactcctccatcatcctctcccgacttcaatggaaagcaggatcaacctttata

SEQ ID NO: 91009 - DNA, 321 bp, Glycine max
  Peptide Sequence Number=SeqID_207787
atgcgtagcggctcacggattcgacctgggggagatacgcgagggtgtggacacgtggcgcattgtggaagcggaggaagaaccagagtccctgctgctgcgacgatggaggtttcgattggagtttcgatgaggaagggaggggttagggttgcgggaatcggaaaacggaaaatcgaatcggagcaagcagtcgcacgttggagtgagagaaatagcgagagagaagggcgtagtgggaggagggggaggaataggcgaggaccgaacgcaccgtctgatgctgatcaaaatgacgtggccgtttcttattcgcgatga

SEQ ID NO: 91010 - DNA, 2115 bp, Glycine max
  Peptide Sequence Number=SeqID_207788
atggcttccctcaccccaggcattctcctgaaaatgctgcaggccatgaacaccaacacccgcgtcaccggcgaccaccgctcccctctcctccaggtcatcggcatcgtccccgctctcgccggctccgacctctggtccaaccagggcttctatttaaacctctccgactccctcaactccacctacgtcctcctctcccaccccgacaccgacctcatcctctccaaccgcctccagctcggccagttcgtccacgtcgaccgcttccacttcgactcccctctcccctctgtctccaacctccgccccctcgccggccgccaccccttcctcggcaccccggagcccctcatcacccgcatctccccctcctctcgccacttcctcatccaacccctctccgattccgaacttgaccccctctcccacctctccctcaacaacaacaataataaatccccaatccctaaccctaaccccaaccctaaccctgaagaaccaaaacaacatcacaatcacaaagacagcaccaaagaacgaataatctccagagaccctctcgcgcctcgcgacaacaacttaccgcctcagagattctcatctccggcgaccgccaaaaggtcacagtccgccgggaggaataagagtgttattactacggcggcggagagggatccctctcccgcggggaaggggaagaggtccgcgtctccggtgccttccaagtgtgtggttccgagcctcgtctcggcgcgggaggagaaccggaaggtgtcgaaggagccggcgattatcgtgccgtcgaggtaccggcagccttctccgaccgggaggaagcagccgtcgccgagtccacggcgaacttcgctttctcccgggaggaggttgtccgggggacttaaggtttcgccgctggtggtggactcctccgggaagaagaagatggccaccattgtcgccggaatctcaaaggtctccgatgcgttggttggatccaagagtgcccggaagaattgggatgagcaaccgccggccacgcctgttgaagctggtggttccaagagtaaggttgatgcacaagcaattttgcgtactcaggctgcgatgtcaaggcggttaagtgacgtgagtggtaaaaaaccaggtagtaatgattcttcgagcaatgagaaaactaaagctggttctcctcaaagttgtgtccttgaagagaaatccaattttgcagcaacgggtttcaccattcatgagaagaaatggactgatggaagtgttccattagatgctgtgtctgggaaccttgctaggcttggaaaggaagcaatgcaaaggaagatccttgcttctactgctgctgctgaagcgttagaggaggccaatgctactgaatgtattataagaaatttaagcatgttttcagacctctgctcagtgtgccaggccagaaatccattgccaaccatagacagattcttcactatctatgatgatgttctgaaatcaactgcaacagttgaatccgttgccagcagacataattctgagacacctgatgaaagcattccaacagaacactcaaaatcactttctctttgggttgatgctgccttggccactgatctccagatagtgtcccttcttactggcacaaccacggatcctccatcgacactgcaaaaaagcttatcaaaaagacactctctcggtgcagctaagaaccaaaaggttccttcatcaccacaatccagtctgagtattggtgtgtggacaagaggtagtggaatgaaagagacagtagagcttggagcaaatttgctgtctgaaatgcaaatgtggtttctacattttgttgaagagtcccttgatgcaggattcaaagtgtttggagagtgtacagctgatgggaaaaaagcattgcccctggatggtggctccattgctgttgttttgtcacacttgaaacgtgtaaatgcatggctggaccgtgttgtttccaaaggggatgactcacttacagaaaagattgagaaattgaagagaaagatctacggatttgttattcagcatgtaggaacaacttttgatagttctgtttcctctgcttcatcatga

SEQ ID NO: 91011 - DNA, 695 bp, Glycine max
  Peptide Sequence Number=SeqID_207789
atgcgctcaaacgatgcatttaagggacttccacatgatatttttgcattcactatgtttcaagaattcattgctagagtgttgaattgtgagttagggaaatattatcactatgtatcaagtatgcatttgtatgaagtagatctagacaaggtaagtgatttgcagagtgaaggttttatgagtacccgtgctatcatggaagaaatgcctctagtaacatctcttaattataggtatcagttattagaggtagaaagaaacttaagggagaacaaactatttgatattgactcggagaaaatggacgattactggaaagatctcatgagaataattaagattcattatctttttagagctaaagatgaaccgtctatactcgaagctaaaaatgaaatcgataaacttgaaattgaaatgagaagacatgagcatgtatcctctttagtcgaagatttaaaaaaattccataaggatgagtaccccttgaatgggctgagttcagaagaatgttatattacctttgcaatgcaattgactgatagtatccgaaggataagatatgtggaaatcacatcaaatccggatagggatattaatccactccgatctgaaccaaattctgactatttcgaacctttgctttcagctagtctatatcatagagcgggaaattatgacgaggcttgctg

SEQ ID NO: 91012 - DNA, 1479 bp, Glycine max
  Peptide Sequence Number=SeqID_207790
atggaacaagaaaaggcactttgtgttagatacctagcggcattccttcttgtgttcttcaccatggcctcatgcggctcaggtgttggagttaactggggaaccatggcaactcataagcttcccccaaataaggtggtcaagatgcttcaagaaaaccgtatcgataaactgaagctgtttgatgctgaagagtggattatggcagcactgatggggactgatattgaagtgatgctggcaatacccaataacatgttggaggaaatgagtaggaatcctcaggttgcagattcttgggtttatgaaaatgtcactggttacatgtaccctggtggactaaatatcaagttaagtagtccaatgtatattgctgtgggaaatgaacctttccttaaggaatataatggcgcctatctacagtcaactctgccagctcttaagaacatacaaacagcactcaatagttggggctttggttcacagattaaagtcactgttcccttcaatgctgatgtttactattcccctgactcaaatcaagtgccatcagctggtgacttcaggcctgaagtacgagaccaaaccattgaaatagtccaattcttatatgcaaacaatgcacctttcacagtcaacatctaccctttccttagtctttatggaaatgatcatttcccttttgattttgcattttttgatgggagcaacaggcctcttatagacggtaattcggcttataccaatgtgtttgatgcaaatttggatacccttctctgggccttagagaagtcagggtatccagatattgaagttatagttggagaagttggatggccaactgatggtgacaaaaatgctaatgtccagaatgcaaaaaggttcaacatgggtttgcttaagcatgctttgagtggaaacggtacccctaaaagaaaaggcataattgacatttatctattcagtctggttgatgagaatgctaaaagtattgctcctggcaactttgagaggcactgggggatttttgagtttgatggcaagccaaagtatgaattggacttaagaggacttgaagagaataacggtttggtccctgtggagggtataaggtacatggaaaagcaatggtgtatcttggattcaaatgttaaggacctgcataacttagctgagagtattgactatgcttgtagcaaatcagattgcactgctttgggctatggttcttcttgtaacagtctaagtctccaagggaatgcttcttatgcctttaatatgtattatcaagtaaataaccaaaaggattgggattgtgatttctctggcttggctacagtaacagatgaggatccatctgaaaagggttgtcaattcccgataatgatctcttatggctcttctttactacagcaggaaaggctaacaaacattctgaagaaagctttgggtatatatatatttgtaattttactatag

SEQ ID NO: 91013 - DNA, 1356 bp, Glycine max
  Peptide Sequence Number=SeqID_207791
atggtggccgggggcaagttccgcgtgctcgagcgccaccagtggcagggcatgaactttgccgctcaggcccagaagattaaaggccttaccgaaaaatattgcgtggagtacatcggcatcgatgcgaccaccgtcggccaaggtgttttccagctggtacgcgagttcttcccggccgcgcgggaaatcaaatataccccggaaatcaaaaccgccatggtgctgaaggcaaaagacactatcgggcgcggctgtctggaatacgacaccagccacaccgacatcaccgccgcctttatggcgatccgcaaaaccatgaccgccagcggtgcgcgctccacctacaccgccagccgcagcgaagaagccagccacgcagatgtcgcgcagcggccacagcagcccgaacattttggagttttactgatgagcaagcgcaaaggccgcaaggcatttacccccccggcgccagccccggcagcagagcagaagcaggattttgaggcgttcacctttggcgagccgtcagctgtgctggataagcgggaaattctggattacatcgagtgcacgaccaatggcaagtggtacgagccgccgatctcattcgacgggctggcgcgcagcgtgcgcgccgccgtgcatcacagctcgccgatgtacgttaagcgcaatattttagcgtcaacgtttatcccgcaccggctgttaagtcagcaggagtttagccgctatgcgctggattatctggtgttcggcaacgcctatttagaagaacgtcaaaaccgcctcggtgcgccgctgcaactgaaatcctccccggccaagtacacgcgtcgcggtgtggagcgcggggcttactgcgcgcttaactccgcctggctgaacgaggcggcgacgctgttccgccgtaagtattaccagaacggggcgcacgccggttacatcctgtatatgaccgacgccgcgcaaagtacaagcgacgttgacagaatgcgccaagccatgcgtgacaccaagggcttagggaatttccgcaatttgtttatgtacgccccgaacggcaagccggacggcattaagattttgccgctatccgaggtcgccaccaaggacgactttttcaacatcaagaatgccagccgcgacgatttgctaagtgcgcaccgcgtaccgccgcagatgatggggattatcccgaacaataccggcggcttcggggacgtgaaaaaagccgctcaggtgtttgtacgcaacgagctaacaccgctgcaagagcgcatgaaggaggtgaacgactggatcggggaagaggtgattagattcgcgccgtatgagttgccgaccgaataa

SEQ ID NO: 91014 - DNA, 1208 bp, Glycine max
  Peptide Sequence Number=SeqID_207792
gactggcgcagcgcctgccagcagttaccgcgctgggtgttcgtcaacggcgtcaaatcgccggggctggaacggcgtcgggcggcggagctggcccactgcctgatcggggccgcgcaatgagccgcgcgatcgggtggtttctggtgctggcgttggtggtcgccggttggatgaaatggcaggttgtcacgttgggtgatcggccggaaagcgcccggcaggagaacggccggatagcggcggcgctgaccgatacccgcgcggcgatcgacacgctgcaggcggcggcaggctactcaatgaaaatcagcaattacgcgattggtttaacactgctttgcctgctgacgttgcccggctgcaccagcgccccggcttcaccggcgccgcggattatctacgttggctgtccgaaagtgagtccgtgccaaatcccggccagccgcccggcgactaacggcgatctgagcgccgatattcgccagcttgaaaacgccttggcggcctgcgcggtgcagcgcaaccctgaaaacctgcaagttcgggtagagcgcggcaatgtggccgccacgcttgccacctcgctgtcccatgagtaccgctatacgctgaacctgctgtttttggactacaccggcgatctggatttaatcatggtgccgattcaggcatggctacgggaaaaccagccggacatcatggcaacggaggaaaagcgccgcaccgggatcacctttgcgagcgacttcaacaacaacggctcttacgatttcagcgtgtcgctgcagctgaccgagcgtgttttggtgaaagagcaaggcgatggcgcgttgcatgttgaacacctgccggagccgccgttaccggaggacgtgacgcggccgatgcagctctttgttcacggcgaattatcgcgtaagtcgctggccgttgccgtttcaaagcgcctacgcgccggtcaacagcaacacatcaaacgccagcaggcgccggacggcacaccctacgcgccgcgcaaaactcggcttcgcaacaaaaagcgcctgcgcgatcgggcaatgttctccaagctgcgcacggcccgttacctgaaagcccagggcaacagcgatgcggccgtggttgagtttgtcgggcgtgtgaaacgcatggtaaacgttcaccattacggcctgcgcgatcggccgacgccgcacagcgaggcg

SEQ ID NO: 91015 - DNA, 1455 bp, Glycine max
  Peptide Sequence Number=SeqID_207793
atggtctacaatacaccgtgcaatagtttcagtacagtgcactgtaatttggaaacactttggtgtaccttatacatgcagcagaatgattgcagtgtggctttatactggggattactgtattttggaaacattttggttgaaaagaaatccactctgcatcctgagaggccagatcgtcttcaagcaattgctgctagtcttgctagagctggcatatttcctggaaaatgctattcaattcctgctagagaaatcacaccagaagaacttattacggttcattccttggagcatattgaatctgtggaagttacaagcgaatcactttctagttatttcacttctgacacatatgccaatgagcattcagcacttgctgctaggttggcagctgggttatgtgctgatctagcatcagcaattgtttctgagcgagccaaaaatggatttgctttggttaggcctcctggtcatcatgctggtgtaagacatgcaatggggttctgccttcacaataatgctgctgtggctgcattggcagctcaagctgcaggggctaggaaggatgttcatcacggaaatgggacacaagaaatatttgaacaaaacaaatcggtcttgtatatatcattgcatagacacgagggaggaaaattttatcctggtactggagctgctgaagaggttggtagtatgggtgcagaaggatactgtgtgaatattccatggagtcgaggaggagttggtgacaatgactatattttttcatttcagcatgttgtccttcctatagctgctgagtttaatccagattttaccatagtatctgctggatttgatgctgcaagaggtgatcccctaggatgttgcgatattactccctctggctatgcacatatgacacatatgttgaatgccctttctggcggaaaattgcttgttattcttgaggggggctataatcttcgttctatatcatcttctgcaactgcagtaatcaaggtattactgggtgagagtcctggatgtgaactggaaaatagtttcccttccaaagctggcctgcaaactgttttggaagtcctcaaaattcagatgaacttttggcctgccctgggtcccatttttgtgactttggagtcacaatggagggtgtactgttttggaaaaaaaaggaaacatattaagaaacgacaccgaattctggttccaatgtggaggtggggacgaaattggtcaggcgcagtagccacttggtataatttgggagacaatggttctgccagttgtggactaagcttaagtgggtttccagtccagggttctttgtatgagccagaggatggagatggaatggaggtgatggcaaacatagacatagatatagcagtagacataaagccaccaattcctccctctctcctctataaaactcagatatcttgtgcttga

SEQ ID NO: 91016 - DNA, 1230 bp, Glycine max
  Peptide Sequence Number=SeqID_207794
atgtcgccgccgccgccgccgccatcactaagctccgacagtgttcaattcaattcaatgttggacgagagcaagttcgaggtgcacctcaaactctgggcccttcgaatcccttgccaacattgcaagctcgccacgagaatcctcaacggttacttgctcgacaagccccgagttaaacccatcgccgaggacccaacctgtgacaaaaaccgttaccttatactctctgacaatgttcataatcaagatttatctgatattccaaaacaaaagctagatgagctcaagggcttgtgtgagattgaaattgtgccctattcgttgactttaggatcatgtgctgaagcagatactgcctactggagtggagaagaggaatttggactgtgcagtgctgtaacaaccttgtctacatggcaaggagtatggcaaaatgagaaaaactatccaagaatcaaaactattgttaataaagttggaaccattacaaatgaatttcgtgtgccagagtttgaaattttagcaggagagcataatatgattacagaagtgaagcaatatggtgccacttttaggcttgattacagattggtttattggaactcgagattggaacatgaacacaaaaggttagtctcaatgttccaagctggacagaccatttgtgacatgtttactggtataggcccttttgccattcctgctgcacaaaaaggatgcatagtctatgcaaatgatttaaatccggatagcattcactatctgaggattaatgccaaaatcaataaggttgatgatcgcatttatgcatacaacatggatgctagaaaattcatctcccagatgatggaagttccaaataatgaagttacattagaaacctcacatgaagttcccattttggatacacgagacaatgctgaatcaaattctgaaaatgagttgctaactggtaatctctttttggtaaacaactgcaagtatcttaattatgatatgagaaaatgttccttggtaattaatactaatattcctgctgtagttgataccaaagacctaggagatagcaataatagtgggttagaggatgtaaagggttcaacaaggcacactgctacatctgtaattgctggtaaaagatcttctactagttatcatgaaggtattctacagactgcaacatcacatcaggctgtcactagatgtagctgctacttgatcttctag

SEQ ID NO: 91017 - DNA, 609 bp, Glycine max
  Peptide Sequence Number=SeqID_207795
tggtccaatccagtcattcatagaaattcaagagaagccagtagttcatcttcaactacgattacatatcttgactggaacagtggtttagtggtttctacagacgaaaatcaacaccaggggagaatgtgtagccttcaagacataggaggtcatttcatgaaagtaccaattattgtattccaggttcttctttgtatgcatctagagggaacacctgcttgtgctgtacatatacctcttccagttattttctctccccttttcctactgcaaggagctggggtaatgttatctgcatctaaattaggggagaaacttgtgcttctgctacgaagtggagctggtggaggaatatattttagattttcttcaagagctcatgattgcttggggttcttgcatcatggttctaggagaaagtgttatgcagagtttgtttcgagggagagattaacgttgtactgctcccatgtaggcatcgtgttctttgcagctttggtcttatgcttgatttccatgtactgcagcacttgctcagagaagtgtaagaagtgcccgatttgccgtgactccattgctgagcgtctgcctgtatatgatgtttag

SEQ ID NO: 91018 - DNA, 1890 bp, Glycine max
  Peptide Sequence Number=SeqID_207796
atgagtcagtctccttcctttaaagttaaagaagaacttagtcccagtcttgatccagagtctttacagagatggattgttgctttatgtgctataaggtttgatcttgaacaaggccaactcgtagaagtatgttatccacctggttgtcttacacatgatgaggaactggagattgcttatagttcgtttccagattctatttcccagcaacaaaatcgctccaccattcatgattgtatcttctttttccgattccgtaggcaccttaaatgtcaaaccagcaatgccactcattccaagataactgaagtggacaaggagttttctctaaagtccatagataaaaatagtgttagtaaaagattatccagtacaagtagtggtaatgtttctaaatacatgtatggctttgtctttaatagacagagacacgatgagaggctaaagcgaggaggggagcagaagtctgtggttattttgtcccacagtccttattctagtgtgttcaggcctttattacaaattgtaggtcccttatattttgacattggtaagatagcactggagcatattgctgcttatgtttcaacatggcctgctcctgttcctggtaagttaatggatcttccaattgggaatacaatgcttaaagtgaacctgccacctgcacacagcttgcccatggaaaatggagtatctcttgatgaatctgctgctcctgtggctccttttcttcctaataatcagtatatcccacagggcctttttcacgattcagatctgtttggtgcttttcgtggccttctattgcagctttggttgttatgggagttgttactcgttggtgaacccattcttatcattgcaccaacccctccccaatgttgtgaggccgttgctagtcttgtgagtttggttgcaccattactttgcagtgttgacttccggccttattttactattcatgatcctgagtttgcatgcttgaactcaattcgagaaggggaaaccttccccccaatggttttaggggtgacaaatattttcttccttaaggctctccgtaaaatcccccacattgtctcagttggtagtccacctcctagttcaaacagggtacccctttcgactaggtcttctactggaaaggtttccaatagacctgaaagtcttgggcttcaacaactttccctgcagaagttttctccttcaagtttattgaatgcaattaagctacggagagaaggtcctctttgtctcatgacacaacataaggaagccatttggactacatattctgccacaactaagccagacacctctattttaaataggcttatagatgctggcatgtcgccaagagttgaggagtcaatgtcagttgttaacaatgagatcttacggcgacatttcttggagctcacaattaattttttggccccttttggtctatattttaggactacagcgccattggaaggatcttctccttatgtagatcctccttctttgcctccatttaatgctgatgaatttcttgcaagtttatcagccagaggtccagggaagttcattttgaagcgaatgaaatctaactggcttgacttctacaggcggttcctgaacggacccaacttcatgccttggtttcagaggaggcatgctgtagctgaacaggaacaagatagattgtggaggcatgcaagaatgaaaactgatatacagcatcttatatctaaaatgtctgagttggaagttgtggattctttctgtgttatagagagacttctgcttagagaattactgtcatcgaggagaatgcttgcttgtgtcactcatccagtgatgggtggcggccagtgtgtgaacaaggagcaactagcttaa

SEQ ID NO: 91019 - DNA, 381 bp, Glycine max
  Peptide Sequence Number=SeqID_207797
atgtatggaaaggtgtgggtaatattttcacctctttggatgttccatggtgttgtggctcgaggaaggttttcattacctgcgccatctgctccacgtaatcgaaattgggcaccatgccatgccgtcattgcaacaccattgcttattgcatttgaattgctcctttgtatataccttgagagcttatatgatcttggctatgctgcagttgatctaaagatagtgtttcttcccttactaacatttgaaatcattattctcattgacaatttcaggatgtgtaaggctctaatgccaggggatgaagaaaatatgagtgatgaggctatatgggaaactctccctgtatcctatttttggcactataaaattgcttaa

SEQ ID NO: 91020 - DNA, 183 bp, Glycine max
  Peptide Sequence Number=SeqID_207798
atgtccattggatttgatcatgaaattttgcaatttcagttgggcttagctcatcactgggctaagcgcagcttcaccacgcttagcgcgacagaagaatctggcagtgcatcaatatcaaggctgtgcactaagtgcgagggtggcgctaagcgcaatgtcgcggattcagagcctatttaa

SEQ ID NO: 91021 - DNA, 137 bp, Glycine max
  Peptide Sequence Number=SeqID_207799
atggctccgaaaaagctttctgcgaagaaatctaggagggacaccgcagctgaagggaccagcgccgctcccaagtttgatagccaccgtttcaggagcaccgaacatcagcagcgttttgaggccatcaaaggatg

SEQ ID NO: 91022 - DNA, 663 bp, Glycine max
  Peptide Sequence Number=SeqID_207800
atgccaaatactgctgaagttgttgctttgattattggtgatgagcacatagactgcaatcaagggacaatgaagctcaaacaatactacattcaaggagattgtttcaacaatggattgttgatggctagtgaactcagagttgacaagtacatgaatttgagtgcctataataatgaccccgaaacacttggcaatcaaaaaggaatgagagttatacttcctagttcttttgttagtggtaagaggtatatggaacaactatattttgatgggatgacaatttgtggccatattggatttccggacctattcttgacattaacatgcaatccaacatggcaaaaaatacaaagaaaagttaggaaatccaatctgacacctcatgattgccctgatgttgtctcacgggtattcaaaatgaagctaaatcaattgatgaatgatctcaaacgtggacatgtctttggtgccattcttggatttgtttacacaattgagtggaaaaaaagaggattgcctcatgcttatattttaatatttctgcaaccttcaaacaagtatcccaatccaaaagacattgataacctaatttctgaagagataccaattaaggacacatatccagaattgtatgtgttggatcaagtggcctcaaaataa

SEQ ID NO: 91023 - DNA, 357 bp, Glycine max
  Peptide Sequence Number=SeqID_207801
atgatcaaaattgttaaggtggctgtaaggcttcgtggagtttctacctttatgcaagaaatgcttgaaactgcatcaatattaaagggagctactgacaagtccttgataatcattgatgagttgggacgtgggacatcaacttatgatggatttggtttagcttgggccatttgtgagcatattgttgaagtaatcaaagcacctactttgtttgccacccactttcacgaattgactgcattagcccttgaaaatgtaagcaatgattcacagaagcaaattgttggtgtggcaaactatcatgttagtgcacatattgactcatcaactcgaaagctaaccatgctatacaag

SEQ ID NO: 91024 - DNA, 1776 bp, Glycine max
  Peptide Sequence Number=SeqID_207802
atgtttgaaacaattgctcgtgatctccttttggagagaacagaccatactcttgagctctatgaaggtagtggttctaattggagactggtcaaaagtggaacacctggtaatattggcagttttgaagatgttctgtttgctaacagtgaaatgcaagattctccagttgttgttgctttgtcacttaactatcgggaaaatgggtgcaccattgggttaggatttgttgatctaactaagagagtacttgggatggctgaattccttgatgacagtcacttcacgaatgtggagtcagcatttgttgcacttgggtgcaaagagtgcattctgcctatagagtctggcaaatctactgaaaatagaatgttgtgtgatgtgttgactaaatgtggtgtgatgttaactgagaaaaagaaatctgaatttaaaactagggatctggtacaggatcttggcaggcttgttaaaggtcctattgaaccagttcgagatttagtgtctggatttgaatttgcacctggtgctttaggggcattactatcttatgcagagttactggcagatgaaagcaattatgaaaattatactctgcgtagttacaatcttgacagctacatgaggttagactctgcagccatgagagcacttaatgtcctggaaagcaaaactgatgcaaacaaaaatttcagtttgtttggtctcatgaataggacttgtactgctggaatgggaaaacggttattgcacgtctggctaaaacaaccattagtagatgtaaaagaaattaattccaggttggacatagttcaagcatttgtagaggacactgctcttcgccaagatctgaggcagcatctgaaaagaatatcagacattgagcgattgatgcacaatattcagaagcgacgagctggtctgcaacatattgttaaactttatcagtcaagtattagactaccttacatcaaaagtgctttggaaagatatgatggacaattttccacaatgatgaggagtaggtatctggaacctattgagttatggactgatgatgagcacctgaacaaattcattgggcttgtagaagcttctgttgaccttgatcaactggagaatagggaatacatgatttctccaagctatgactctatactagctaacctaaaggaccaacaagaattactagagagccaaatacaaaacttgcatagacaaactgctgatgatcttgatctgcctatggacaaggcattaaagttagacaagggcacacaatttggacatgttttcagaatcacaaagaaggaagagccaaaaataaggaagaagctcaatactcagtttattatactggaaacccgtaaagatggagtgaaatttaccaacacgaagctcaagaaactaggggaccaatatcaacaaattcttgaggagtataaaagttgtcaaaaaaagttagttgatagagtagttcaaactgcggcaactttctctgaggtgtttgaatctttagctgaaataatttctgaattggatgtattactgagctttgctgatttggcttctagttgtcctactccctacacaaggcctgacatcacttcatcggacgaaggagatattactttagaaggatgcagacacccttgtgtagaggcacaagactgggtgaattttataccaaatgattgtaagcttgtcagaggaaaaacttggtttcaaataataacaggacctaacatgggtgggaaatcaacatttatccgacag

SEQ ID NO: 91025 - DNA, 395 bp, Glycine max
  Peptide Sequence Number=SeqID_207803
gggctaagagggcaagggcgaggctaactgatcttccttccacatctgtagctcctactccaacatccacttcagcaactcctttagtcccaagggtagcctggcctggggcccaaccttctcttcatagggaagatgaaggtgaagagcaggttaggccagagactgccaccactcctgagagatctcttgagggcacttcagagcctcctgctccggtggtagacctctcctcaccacagcctgtagctgacccctctactcctgtagttgatacgccagaggaccagaccacactagtcctgactctaaacacttcacctccagctacttcaatacttcatctgacagatgaagaggatgttcgaactcaggatactcaggatttaccttag

SEQ ID NO: 91026 - DNA, 858 bp, Glycine max
  Peptide Sequence Number=SeqID_207804
atggcgatttccaattcaatggactttcttcaactcttcattgctgtcttcatcgcgttctcaatcgcattcagagctcaccgaaaaaaatccctcagcacttctggcgcaatcgctgggttcttcgttatggcccttcacatttttgtgggttacaggtttggggcgatgctgcttgcgttcttttactcttcgtccactctcacaaaggtaggagaggatataaagcgaatagttgatcctgaattcaaagaaggtggacaaagaaactggatacaagttctggccaatagtggcattgcctcggttctggtcgtagctatatgggtactcaccgaagggaaggataaatgcttgaactctgaagagtcacctctgatcactgctctcattggtgctgttataggccattattcctgctgcaatggagatacttggtcttcggagcttggaattctcagtgatgagaagcctcgtctaatcacaaacttcaagtttgtgaagaaaggtacaaatggtggtgtgacaaaaagaggacttctagcagctgcagcagctggaagtgtcattggactgtcgtttgttcttttgggaatctcagctaccagatgtgagggtaagggtagtacagttcttaagcaactactggtcatacccatcgccacccttgcaggactatgtggaagtgtcattgactctctcctgggtgcaacattgcaattcaccggattttgctccattcgcggcaagatggttggaaagccaggaccaacagttagaaggatttcaggtgccaacattcttgacaacaacgcagggttatgcagccaaaaggatccagagttcgaaaccttgtaa

SEQ ID NO: 91027 - DNA, 1017 bp, Glycine max
  Peptide Sequence Number=SeqID_207805
atgctagttgagagaaaggtagaaatataccaaacggagttggatgagttcaaggctgaattggagaggcgtaacttccataagcgccttaccaatttagctgacaacagcatcaacctagccttggtgaaggagttctacgccaacctctacagtcccgaggggccttccccaaaacaagtcaaaatccgaggccacttgataaaaattgatgcaaacaacctcaacaccttcctggagacacctgtggtactggctgagggtgaatccttacccacttactctagatactgcaggatgcccactgatattagagagattgaggctgctttgtgtatacccggccgagggtttgttttaaatgttgaaggccatcctgggaagatcctcaagaaagatctgacaactcttgctcaggtttggagtgttctctcatactccaacctagctccaacttcccacaccttggatttgactttagatagagctaggttaatttttggcctagtctctcagctggacatgaatgtaggagctctcatctctggccagatcacatctatggcccagtctaactcctgtagacttgggttccctgctcttatcacagctctatgtaggtccagaggggttgcttctgacagcctagtcttcaaatgcttgagcccggtcattaacttggcctatatcaggaagaactgttggaaccctgcagatctgacagttactattagaggggctaggagagcaagggcaaggccagctaaggctccttccacatctgcagctcctcctccagcacgtaccttagcaactccttctaccccatcttttgtagactttcaacatcttgaagccatgcttcgaagcatacatcaggggcagattgttttattacaaattttacagctggtagcaccttcagactctatcccttctgctgaacagtttaatgaatgggtagtctggcccgggactcatcctctccttcacagggactcggcctctcctttatag

SEQ ID NO: 91028 - DNA, 207 bp, Glycine max
  Peptide Sequence Number=SeqID_207806
atgaatgcaaaaagaagagaagatatgacttgtgtacttccaaagagaagaatattgatgcgacatggggtcgcaaggaaaccgggacacaacagagtataccaccatactcgaccacaacattcaacggtgcaagacatggcccaggctctccgcgccaacgagcatctccaccgcgtgatagacagcgacgctgcgcgagtttaa

SEQ ID NO: 91029 - DNA, 2475 bp, Glycine max
  Peptide Sequence Number=SeqID_207807
atgcagcattatgtcaagtggaattgggtctgtttgagtatgtttttggattcatcaatgggacaagagttggagctggatcttgatgacaagtcttcagtgggtttgagtcccaatactgtacttccacctcatcaatactgtgtgaatgtgaagaagagatctaaaaaggggaagcccactgggaaagatgattcttttactctcaaggagggcttcgctgagatcaaatttgctcgcttccgcagttcttcgtgtaagagccatctctctagacctcatggattggaaggtaatatagaaaccaggcgcagttccatgtaccagagttcagaggaagtgaaaagtataaataaaatgggaaccatggtagagggaaggaaaaaaatagaaatttcaaggaggagtgacacctctttcgcaggcagcattgttgattctttatgcggttcagatgatgaagcttctgggctgagatcatcagagattaccaggtccaggacttgcaaggtgccagactctccaaatagctttattgaaatctgcataaattcagatgttaaaaaaaaaaagaactctaccacagtacaagggagagactctataaatttgaagcccagaagtgataaagtttctgattctgtaattaatggcaattgtcgtgttgaaaaggacacagtccactcgctgctaaaatcactctcagctaaggcgagggtctctcacgtgccatctccattaggaagtgattgttcatcaagagtaagtccaaaagtccaagtcactcattgcaggaaaaggttgaatcatttcacaaagtcaaaatcattgagaagtccagtgagtaagatactggaaaatagtgagatcaaatcaaatgagactgcaaacattgcaagacataggacatatcaaaagtcattgctaaatgacttatccaacacaagaaagcattctgacattatttctgagtttatcagcagagaaatccagtattcaggtataggttcttcaccagttcacctgcatggcaatctcaaattggaaaataaaaatggagtgccgttttttgagttcaaggtgaagtgccccaaagatgtgtttgtggccaagacatggagaacaggtaatgctttcaactgggtgtatacctttcactcaattgataatagaaagaagagcaatgtcaatgggttgggatcccatgattttgataaagatccctcaatagtagcacagatgctagtttcctgtaatttatgttctgaactagaagacaaagaatttgacaactctatggtgacagaatttgtgttgtatgattttacacaatcaaggcagagtgtttcgtgcgaaaaaaagtctttgagtgaactagatggttccaaaactccgaaagctttccatgttggatcgaaggaggaaactttggggctgcatgagaaccgtgcggttaaaaataaacttcaagacaaacctctatcaagcaatgttgaatttgatgatttaaatttttatccttacttgtccacggaatgctattcaaaccttgaaaatgctgtcattgtcttgcaaattccattttctaagagagaaagcttgaagtacaaaagaggagatagaataagtgctaaagaatattccaacagaagtgatctctctgcagtgaaagatagaaagagtcttcatcgccaccaaatccaggaacaggtaaaggtggtaataccaactggcaatcatggtttgccaaatgctgaaagccatggtccctcgtcattacttgatcgactgaggcacggtggaggttgtgactgtggtggctgggacatggcctgtccccttattcttttaggcaatcctactattcaatttgctgaagactgcccactcatggaggaacatcagccattggaactttttgttcagatgtatgcagccttatccccctcacccggagcaaaaggaagcagtcctaccttcagcatgacaagaattgaagaggggcattatgctgttgattttcatgcacaattatccacattacaaacattctccatctgtgttgccattttgcatggaacttctgccttcagcagtgcaagtcacgagaaaaaccaacagttatctcagtgcagttcactgaaaatgcttcttgaggaggatgttgatttctttttcaaatcagtcacaactgagaagaagactgtttgcaagaatcaaaaaggaattcctcgatcctatgtgctgaacccgcctttttctcctattgcacgtggagtttggttagacgttgttgacgtagtttctgatgtttctaccgtgattccaaacacacggctagtttcttatctttataccacctttatgccattgctggttggagaagtatggtcttggagatggcctgtgaaaattggtaacaagtgtgtggaggatcttagtgagggtggggattgcaactttgcatcaacataa

SEQ ID NO: 91030 - DNA, 1620 bp, Glycine max
  Peptide Sequence Number=SeqID_207808
atgggaaatcgacgcttcactcaggtcgcaaccagcgaagatgaggacgaagcaccgccgcctcctcctcctcccaagcagcaatcgtcggtcagtgcccccgaagagaaccgttcgaagcagcagcagcgcaagaggaagagaatgaagcttcaagaagaagaggaagaggaagaggagaaagaggaagagaagaagaagaagaagagaaagatcaaagacaagcaagaagagagatcgaacgaagaagaggaaccgccgcaggaagacgcaaagcccattggcgaaccggttaggttatccggaaagggaaggggccgcaaaaagcattacgaatccttcgagtacgacggaaaccaatacatgctggaggaccctatacttctcacgcctgaggacaaagatcaaaagccgtatgtggctattatcaagcgtatgttgttgagcagcttgagctgcattgatgttattttgggtctggacattacgcaatccctaaatggcagcatgatggtcacaggacagtggttttatcgtcccgaagaagctgaaagaaaaggtggtggcagctggcaatcacgtgacacaagggagctgttttatagtttccaccgtgatgatgttcctgcagaatctgttatgcataagtgtgtggtgcattttgttcccatacacaaacagcttccaaatcgtaagcagcatcctgggtttattgtgcaaaaggtgtatgacacagtagaaaggaaactctggaagcttactgataaggattatgaggacaataaacagcaagaaattgatgagcttgttcagaaaactcttaaacgtttgggcgaactacttgacattgagcccgaagaacctgttgctgatcaggaagatctgatgaaaaataaaagaatcttaaggaaaaagagcatttcacctcttgatgtttcgaaggaggaggaaacaactcgtaagggggaccaacctttgaaacccgaaacaccatggagttgtataaataatgcctcagaacattatcgcatattagtagatttcaatgttctaacaggagatactcatcgtgacaaatgtttggagaagttgcttcaaagtgttgaattcatgtttaattctgatgacagcataaagagggaagagaaaggaaatgacaattctgatgcaaccaacaatggaagcaataacaaaagtttagaatctgttaatgaatgtaaagacaaggttcaaaagagttcaaagccttttgtttggccagatgatgctgttccagctgtagttgctctggaaaaagcttcacatgataccttatcatcggattatcagaagtataaccaaaagctacggcaattagtatttaatctcaagaacaatgcaatcctagcacgccgcctactaaatggagagttggaaccttctaaaatattgaatatgacacccaatgagttgaaggtggatttgggattatacggagtaaccagcgcatccacattgagaagtgacaccaacacattctggtggacactagtgaagacgaaggtcaggaggactgtgacagaggagagtgtgaccaccaggaggtggattgtggaagtagaggaagaaccggatggctaa

SEQ ID NO: 91031 - DNA, 1926 bp, Glycine max
  Peptide Sequence Number=SeqID_207809
atgtctggatgcaagaaatcaccaaaaaatgatcaacaatcaatcaaatattggcggattcaacacggaggggcatcctctgaggctgatctttcttgtgtagattattcgcaatctctttccaccaatgagaacaagcaatgccatggaagttctcaaccaaagtcccctcagatactgagcacagctcagctcatctcagctataggccagatatgggattctgccagtcgcccgctttcggttttactcccaaaggataatgtgaatcaggatgataaaggattccagaaagaaaaaattctggatagcgttgatgagaaaaaaaatgacttggtatatgcgtcaagtgacattaagtactatcctgttaccaagggtggtggtgcaaagattgtgcagggaaaattggatttccctaaggtaatgcagaagatatcagtacttgactcttctaatgacagtcaagattatattcattctttatttcagaggtgtttgcaggctagtgataaaaatacaaatcaagattggaaagaaatggaacttaggagggaggaaatgtcttgtatatcaggaaatgtattttggtgggtaggtaggaatattactaaggcgctaaattgtcaagtgaatgctacccgacctgagaacctggaaactaatgctccagttgctgggggtaacatttcagtagacacaagcacccccacattggctaatgagagtgatgtgtgtagtcctaattcaatcacacatgaaactcaatcattatctaatgctgcaattctgaactcaagaatagttagccctctttgttcagactattttcttcaagctgtgcctgatactaaggcagacgctggtgcttgtcagatcctttattctagtatctgtgcggactatcatatttactctctagcttcatataatagtgcgtctgatcagtgccaacatgagattgatgataatgaatctcaggaaatccaaagaaagcatttcttggatataactgatgataaacctaaggttcagatcgctgcaacccacctaaaaccttgtaattcccaagccaaacaagaacatgctttttctggggcgttagctggtgtatgtgtcagcctttgtctgcatcctgttgacacaattaaaacagtcattcaagcatgccgtgctgaacacaggtccatcttttacattgggaagtcaattgtttctgatagaggtttgcttggactgtatcgtggaattaccacaaacattgcatgttcagctccaatttctgcagtttatactttctcctatgaatcagttaaggcagctttgcttcctcatcttccaaaggagtattgttcttttgcccattgcgtgggaggtggttgtgcaagcattgccacctctttcatttttactcccagtgagcgaataaagcagcagatgcaagttggttctcattatcgcaactgctggtatgccacagtttttgggatcatcagttggagagctgtactattccggaatgttccacattcaattatcaagttttacacatatgaaagcttgaagcaagtgatgccatctagtattcaacccaactcgtttaagactgtagtgtgtggaggattagctggatctacggctgctttattcacgactccttttgatgtgatcaagactagattacagacacagattcctgggtctgcaaatcaatatgatagtgtgctccatgccctttacaaaattagtaagagtgaaggattgaagggcctgtacagggggttgattccgaggttgattatgtacatgtctcaaggatcactgttctttgcttcatatgaatttttcaagaggacattttctctggaagcaccatatcccactgatttatgcattcaggacaatgatgggaatgctgaagagtga

SEQ ID NO: 91032 - DNA, 137 bp, Glycine max
  Peptide Sequence Number=SeqID_207810
ctaataaggtggcggatgccattgctaataggggcattggtacggaggaggagtttttgttgtatgagcaacaaccagatttcttggacctcttgttacttaggatgttctgggatttcaatctcccagagttgtag

SEQ ID NO: 91033 - DNA, 1086 bp, Glycine max
  Peptide Sequence Number=SeqID_207811
atgtttggttttctcttttttgttagctttgtgggcctcttccccattgtgcctctgagaaaggtgatgattctgaaatacaaactatcatacccgagtggaactgccacggctctcctcatcaatagcttacacaccaaaaggagcaaagctagcaaatggtttttcactgcaggagatgattgtgggttcatcacttttcccacatttggtctccaagcctacagtaaaaggttctactttgatttctcatctacctatgttggagttggaatgatttgcccatacttaataaatgcatctttgcttcttggagctatattttcatggggtattctatggccattgattgagcacaagaaaggaatctggtatagcgcagatctaccttctggcagtctaagtggcatccaaggatatagggtcttcattgcaattgccatgatgcttggtgacggtctttaccattggatcatcatgctaatacgagttgcctatagtctcaccacccaatacctaaagaaaagagggtcatcaacggtagaccctgaagatgctgaccaaaactcaagtgaaggttttgatgctcaacgttgcactgagtatttcttgaaagatgagattccctcttgggttgctatcattggctacagtgttcttgcagttatttccatcataactgtgtcgcgcatctttcctcaacagaaatggtatcatgtactaatcacttacctcattgctcctattctggccttttgcaatgcctatggatgtggcctcactgatgggtctttggcatcaaactatggcaaacttgcaatcattatattcagttcatgggtaggccttgagcatggaggcatcattgctggccttgcatcatgtggtgtcatgatgggcattgtatccacagcttctgatttgatgcaagacttcaaaaccgggtatctcactcttggatctcccaggtccatgtttgtgagccaagttttaggcacagccaccggttgtcttgtttcacctttgatgttttggttcttccacaaggcttacacacttggtgacccaaacattgtcttgaactag

SEQ ID NO: 91034 - DNA, 273 bp, Glycine max
  Peptide Sequence Number=SeqID_207812
atggccttgaccatcccattctatcttggtgggtacttttctattgacatgtgcattgggagcttgattctgtttttatgggagaaaaagaacaaacagaaagcaaaagattatggtcctgctttagcatctggacttatctgtggtgattcattgtggagtgttcctgctgctatactgtctcttgctggacccaatccaccaatttgcatgaagttcttgtctagagctatgaataagaaggttgacaccttcttgagtggtggtcattga

SEQ ID NO: 91035 - DNA, 1136 bp, Glycine max
  Peptide Sequence Number=SeqID_207813
gccatttcttccagggcaaagtcaaagccatacaacaattgagtttgttggtgatgatggagaactgattgttggcaatcctcttaaacaaggaaaagaaaatcgcaagctttttaaatttaataaggttttcggtcaagcaacaagtcaagaggaaatattcaaggacactcaaccattgattcgatctgttcttgatgggtacaatgtttgtatatttgcttatggtcaaactggctcgggaaagacatatacgatggaaaaacataccaagtattgtttccttgacttgcacacacttgggatttggaatactgcccaaccaaatgggttggctgttcctgatgcaagtatgcattctgtgaattcaatggcagatgtccttgagttgatgaatattgggttgacaaatcgggcgacaagtgccacagccttgaatgaaagaagtagtagatcacacagtgttctctctgttcatgttcgaggaacggatttgaagaccaacactctgttgcgtggatgccttcatcttgtagatcttgcaggaagtgaaagagtggatcgttctgaagcaaccggagataggcttaaggaggctcaacatataaataaatcactgtctgcactaggagatgtaatatttgctctatcacaaaagagttcacatgtgccatatagaaatagtaaattgacccaacttcttcagagttcgttaggtggtcaagcgaaaacccttatgtttgtacagcttaatcctgatgttgcttcatattctgaaactgtaagcaccttgaagtttgctgagcgggtttccggcgtggagttaggcgctgctcgtagcaacaaagagggaagggatgtgagagaacttatggagcagttggcatctctcaaggatgtaattgcaaggaaggatgaagagattgaacggttacagtcgctcaaggctaatcataatggtgcaaagcttggtatgatctcagcaagacatgggtcatcatctccaaggagacattccatagggactccccgaaatagcatgagacttgcaggagcgaggagctttggagtcaatggaaaggcagcttctgaaatggataactgctcagagtacagtgataagcattcagaagctg

SEQ ID NO: 91036 - DNA, 408 bp, Glycine max
  Peptide Sequence Number=SeqID_207814
atgttcctatatattcgatggttttcttttggtggggtgtggacagtttatcctgttgtcttttctatcagtattctttgtggagtttttcactcaatcgttacagcaatcttgtccatagccaccatttcctttttcagctttgcagcatttagatgtgctggcactccaccaaatatattatggggaagctaccctgctgtagggaaagatgaccttgaaaattatacatactgtcactactgctcaaagccaaagtcacctagagctcatcattgtcgttcttgtagaaaatgtgttctggacatggatcatcattgcccattttatgaatctcagttttgtgaggagtatttgggaggtgggaaccaagagagggggcatgagaaaagtattgaagtagaatag

SEQ ID NO: 91037 - DNA, 1317 bp, Glycine max
  Peptide Sequence Number=SeqID_207815
atgaacatgcagtgggagcaggaggggcgggggagagggggaactgacaacggaaatgggtttcctcgggcaggtagccagcagcttgtgtctctggtgaagtggataaatgcggtgcttcctaattttaatctgcctttagatacttcagaggaggaattgagggcatggttgagggatggatctgtattatgcagcattttggacaatcttgttcctggttcggtgaagggaagtggttctttgaatgagctaatcggtgtgaaaaggtttctgggatccatggtgcctgtgttgcaatgcctcgagactctgaaaactcattttgcttataatgctgcacgagaaaatatccaaagttgttcaagaaagagatgggaccagtcaaatttaacatcctttgaggaatctgatagttgcctcaaggatgcttcaaaattgcaacatgctgttgatggttctgttgtatcagatgaaatcacttccgtagatcatactggaataaagtctaacgaactgttccagttgaagcaaggattgcttgcagatttttctgatgctaaacttaatgaagtattgaaatcaaacaatttggatagtgtctcaactcaattgctttttaatataggaaataggatcctaagtgatatctttgaaaggaaaaatggagatgtacctcaggctcatcgtgctgcatgcctgttgaggaaaattctgcaagtaattcagttgcgcttttcaaatcaagcagaaagcatgaaaaatcaaaaccatcttttcaaggctcgtgagggaaagtatcaaacaagaataaatgcacttgaaaccttggcggtagggacaacggaagagaatgaggttgttacaagttgggttcagcagttgaaggttgaacaaactaagtttgaggagaagaagaaacttgaagagcaggatttttctcgtttaaagaaagaaaaagttcatagtgaaatcaaaatttctgaattgaagcaagatttggaaatagccaaaagaacatatgaagaacatgtttcagagttagaattgcaagctactgaatctaaagctgaatatgaaaaaagaatagagggacttaagcttcatcttgcagatgcaagaatgcaagtgaaggaactagaggcattttccgaatccagatttttgaaatggaagaataaagaggatacctatcaaactatcgtaaatttccaagttggagctttccaggaactgagagctgccatgaagtctgtcaaagatgatgtgataaaaacaaaaagaaactacttagaggaattcaagtactttggtagg

SEQ ID NO: 91038 - DNA, 129 bp, Glycine max
  Peptide Sequence Number=SeqID_207816
atggccaccgttgaaatactcccttgggcacataaacgggataggtttgagcattcttttatggcagcagctctcctatatataccaggggaaaacttatttgagtcacttgagttcacaaacagataa

SEQ ID NO: 91039 - DNA, 198 bp, Glycine max
  Peptide Sequence Number=SeqID_207817
atggtgattttccaccatgaagatgcagcggaagacaaaggagaagagccatggatgtcattgatgattaagttcttatataactggcgtgaagcggttgcggtgcttgtttatgccaccgcattgtggtacctcttcgagcgtgttagttacaatttcttgtccttcgtcaccaaagtttttgccaacaagctttga

SEQ ID NO: 91040 - DNA, 246 bp, Glycine max
  Peptide Sequence Number=SeqID_207818
atgtgggaaaaaggtgagggagatgaagctccgctttgcaaaacagagatcaaatccaatgtcctggaagaatgcaatgtggatgaaacagcaacaagggagcggttacggatcgatgaaaatcgcggggaaatgatcttgaagaaatgggcatgggcttttctttgttttcaaatgacagtgtcaggacctgctggaattttggaaaaattaggaaaggctgaattggattacaagccaatttga

SEQ ID NO: 91041 - DNA, 192 bp, Glycine max
  Peptide Sequence Number=SeqID_207819
atggaatttccagtggaggccacaatggttcctttgggaaagaaccatgataaggagcagaaatctttatggaagatcacttggttcgctgtcatacatatggtggttgtggcagcatcgaaacgcaattgtcttcaagaaaatgaaactattggtggtatgattgatctatggcaccagtgttgtgtttga

SEQ ID NO: 91042 - DNA, 300 bp, Glycine max
  Peptide Sequence Number=SeqID_207820
atggatttcgaactggacctcaaccgtgatccgccgctggttcgagaagaggaggaggaggaggaggagggggggccctcaaggcatcagcagcaccaccaccaccaacaagaacctcaaactcccattgtcgatgtcgacgccattgacgacgatgttgttgaaagctcgcctaggtctttcgctcaggctaagagcaatgctgatgagaggaggagagttcgcaggaggacgactattgttgatttggactcagattgtcccgatctgggggtcttgcctcatcaaggaagtaattag

SEQ ID NO: 91043 - DNA, 1713 bp, Glycine max
  Peptide Sequence Number=SeqID_207821
atgtttagattagaagagattggtaaagtggaagggctcccgccaaagctaaagaccccgaaatcacacactgtcaacaccataaaccctagcacttggcactcactcatggaccccaaaaacgtgaaatcggacctggttctcattctcgattacggttcccaatacacccacctcatcactcgccgcatccgcagcctctcggtgttctccctatgcatctccggcacctcctctctttcaaccatcaccgacctcaacccctccgtcgtcattctctccgggggcccccactccgtccacaccccggactccccctccttccccgacggcttcctccagtgggcccattccaatggcgtcaccgtcctcggcatctgctacggcctccagctcctcgttcagcgcctcggcggcgacgtccgcgtcggagacaagcaggagtatggccgcatggaaatctgcgctgacaaaccctccgcgctcttcggccccgagaaagtcggtaaacgacaggtcgtctggatgagccacggcgacgaggccgtcacgctacccgatggattccatgtcgtcgcccgcagcgaccagggcgccgtcgccgccattgaaaacccctccgccaagctctacggcctccagtatcaccctgaggtgacgcattcggaggaaggaatggagacactgcagcgttttctgtttgatgtttgtggtgtgggagcagggtggaagatggaggatgtgatggaggaggagataaaggtgattaaagaaacggtggggcctgatgagcatgtgatttgtgctttgtctggtggtgtggattccactgttgctgctactctcgtgcataaggctattggggataggcttcattgtgtgtttgtggataatgggttgcttaggtataaggagagggagcgggtgatggagacttttgagaaggatcttcatttgccggttgtgtgtgttgatgccgtgggtcagtttcttaccaagttgaaaggtgtcgtggatccagagactaagaggaagattattgggaaggagtttatttgtatttttgatgcttttgctcaggagcttgaggggaagctggggaagaagccttcttatttggttcaggggacgttgtatcctgatgtgattgaatcttgtcctccacctgggaccgggagaacccattcccataccattaagagtcatcataatgttggaggccttccaaaagatatgaagttgaagcttattgaaccacttaagcttctgttcaaggatgaggttcgtcaattagggaggatcttggatgttcctgtggcctttctaaaacgtcacccattcccagggcctggtcttgcagtgagagtcctgggtgatgtgactgaaggaaatgctttagatattctccgactggttgatgaaattttcattcagtcaatcaaggatgctgggctctatgattcaatatggcaagcttttgcagttttcttgcctgttcgatcggttggagttcaaggtgatcaaagaacacactcccatgttgttgctctcagagctgttacaagtcaagatggaatgactgctgactggtactactttgagcacaagttccttgacgatgtttcccgaaagatctgtaatggtgtccgtggtgtaaaccgtgttgtgcaagatattacgtcaaagccaccatcaacaattgaatgggaatag

SEQ ID NO: 91044 - DNA, 1150 bp, Glycine max
  misc_feature (1060)..(1060): n is a, c, g, or t
  Peptide Sequence Number=SeqID_207822
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggcaaaacgagagagagccgacgaacggtagcctcttttggccaaacatagtagaagaagtaagggataccggattgattgcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccanctgacaatgtcttccgcccggatcgaccggccgaagccgaccttgggtccaaaaagaggggccgtgccccgcttccgattcacggaataa

SEQ ID NO: 91045 - DNA, 624 bp, Glycine max
  Peptide Sequence Number=SeqID_207823
atggaagaatcatcaaagaaaagaaagggtgttttgacctcatccgcggccaccggaactcgaagtcacggagcctctagagcgctgacaacaccaattcctccctccatttcatcttccacgttgttttctttgaaagaacaacgtatccggtacacttcctttttctcctctcgttctatactagaacctaagtttcttgacttgaagtcttttgatgatgaaatgtttgactgttttcaagcatttcaaaacttcgggttaatccaattcatgtctatgaaacttcttttctatcctgaattagttagagctttttattcaaatttagaaattcaggagggtactctagtttttgaggtatatgggattaaaatggttattgatgaatcccttttctttcaattaacccaattgtctagtgatggtgtaccatttgagggcaccattgatgaggactggaagtttgatttctccaatcatgatgcccgcaggtttctgaggaagacatggttgtcatatgggttttacttatcggtcgtcaaatcaactgggcccaccttatcagatatcgcatgcaaaaggcattgcgatcaaatgcaccccttccttatcctcatctaa

SEQ ID NO: 91046 - DNA, 2382 bp, Glycine max
  Peptide Sequence Number=SeqID_207824
atggcgagaagatctcctcctcgggttaaccaaacgtacgagacaggttgtacgtggcgaatgttaagaatcttcaattttcgtgaaggtcattctgacagaagattggtttccaataggaggctgaatgctcatgctaatggagatggaaactctagaactagatcagatgtgcttggcacagttgacgagaagcgccttcaaattggtgtaagttccagaagaagaagagattatagttgtaaaagtatcagaggcgtggagaatgaacaggtagcagattggagagaagaagtaacaaagatgattgttgatcagagatttgtcaataaaaattaccagggaaaagacgggacaggctgtgagcctaatcagttcttggatgctttacagattttacattcaaacaaggagcttttcgtaaaacttttgcaagatcctaactcttggttagtaaaacagattcatgacttacaaagttctcaagtgaaagaaccatgtcagcaggcaaggcaaaaaaggatgactagattaaataatcctgaagatagtaatgctacacaatgtgtaaaaccttttgagtcctttgatagatctgatttgaggtcaagttatatgcctcagtcgtcgaacagaatagtagttttgaagcctggcactgttaatgtggaaaattttgtggaaacaagctttactagccctccctgttcgcctgatagctccagttctaatgcacaaaacattaggccttcatattttccctttagttgtataaagagaaagttgaagcatgtcatgagagtaaggagacaagaacagcagtggaggacagatgatgaaatgtcatgtaaattttcctgcagttcccagggcttggaagatggtaaaaaagtaaaagaattggaaattgctgaaagaaattcaccaattaatgcccatcctaatactggaaataggttgaattcatatcctgatacgaagaagaggaacaatattatcaagttgaaggattctgagttctgtatggggctggaagctgcttcatttggtgaaagttgtagtaagaacacatacaatacttcagtttgccattgtgaggaaaatatattgaacatacatattgaaggtaggaaaggtccatctcagatgttaaactgtggaagtgacgaatgtgaacaatgcacaaactctctagcgagatcaattcctcttcctgactctttgtacttgccaagcatgcataggtactgcgagcacagttccatcactggaaggatgagagattatagcaactatcaaatggtccacagaaccaggttgggggttccaaaagaaggagaaatcaaggattcaccattgaccattgttaatatacatactgataagttgcaactttttggtgaagatactggtatcagaaatagtgctcctggcgacaatctatttgcacattatgatattcctagagatggcagatacacggatagccctactcagaacatcgacatgaatgatataaccggaggaagtggatcctttctggatttgcatccagagatccagacttttcctttttcacaatatgttatttcatccggtcaaagaacagatgattctctaaacatgggaaacaaagttgcactcaccagggctgaatctgttgttgagcaatttattaaggatgatgttacctaccgacaaatcaccacctttcaaccagatgagtcaccagttcaagtaaagcaagacaaatttgaagagaaccattttgaagaccttataagattctctttaaatccaatgaacaatttaacctcctctaaggacatcttacactatgcaagagaaattctgcatgctctcaactacaaatgggatgaacttactctgaagagatcatgtgacaaattgctggatccatccacctttgttgaactgaaggaactaactagccaactttctggtggtagaatcttgcatgactgcgtcattgaaatttccatgcaggtacatcagaactgtggattaccacctcatgtttcaacaaaaaatccaaacttccaagcatatgttgtgaagaaacatctggctaaagagattacagaactagttaagttgcactttcaccctcgtccatcgcctttaacgttagaacaacttgttgaaaaggacttagcaagacgtggttcatggctaaatatccaagttgatacagaagatattgcaatagaggtggagagagatgttcttgaaaaactggtattggaaattgcatctgagatggaggatgtcagaaactggacacattgcaatgaagctatgtctacttactcgtgggatgataaagcactttggaaagattatcaagctaccattttttga

SEQ ID NO: 91047 - DNA, 453 bp, Glycine max
  Peptide Sequence Number=SeqID_207825
atgatccaaaagtctcaaagtggtgctattcctatatctagccctcgtactgggtctgggtcatcttcgccactaaccagtggtggcggtgctattccatttcatcagacaaatcaaccactattctcacatgaagttgtgggtatgatccaaaagcctccgaatgttttttattcaaatggaaatactgcttatcaggggtctaagcatgagcagtttgggagaaacttgcaaactacacatccttgctgggatgtagtttcatctgataatgatgctcttccaaaccattccaggagggctgtccagggagacccaataaaatttcgtgatgagaagtcatgcttggctgattgtgtgtcacagcaactgttgagggattatgttcgcctaaatgcatgccttgataataagctcaataccccaaatcctgattgcattaatggcttgtga

SEQ ID NO: 91048 - DNA, 2283 bp, Glycine max
  Peptide Sequence Number=SeqID_207826
atgcggttgtggtggggaaagtcttcttccaaagagtcgaagaggaaggcaaacaaggaaactattattgatacaatacagcggaaattaaagaatacttctgaagagaagtgcaacaataaatcaggaaggtcaaggagacatcatgatgatgccatatctaagaagggttctagatctctcacaccttcaacatcagcatcaccctcaacacatgtgtctcgcgttccaagttttacagaaaggcctctttctcaaccactcccattaccagggtcacatcttccagctgccattgatgtaagttctggagttattttaacatcaaaactggaaagagccataggctctaagctatctctgaattttcctcttcaaaaacctggctatgtatcaaacaaggaagatcctacagatgcagcaggagatatagcctctgcatctgtttctagtgacagctcaattgatagtggcaactcatttgattcgccacatcttgttagtccactggcatctgactgtgaaaatggaaacccagccaccattaatagttctttaaggaatcagtcacttattactatccaaagaaactcaagagcatcctcaaaatcatctcctcagttgtgcaataataaaacttcatcaacctcaccaagaggggctccattacatctgcaaaatctgaaaatagctcaaccaggtggtttgtgtagtgctccagatagttcagtgtcaagtccttctagaaatcaaatgggagcatttggacctgagcaaatgttgaactctgaattacacacaggaaagccttatccagatataccttctgggcgctgctataatccagtttcgggtcgtgattctggtcataattcagttgggggggatatttcaggacagatgattttgccacagaacaagcgtagccctgagtgttcttcaatacctagtcccagaattacaagccctggtcccagttccaggacacagagtggtactgtgacccctctgcatcctaaagctggaggcgctgcagcagaagcacctacaagacgtcctgatgatgtgaaacaaaaaaatcatcagttagcaattcctccaataacagccactaaatcttgtccattttctccaacctattctgcattgacaactccttcagcccctcgtagtcctggcagatcagaaaattcatcaagcccaggttcacgctggaaaaaggggcagttgcttggaaggggaacatttggacatgtatatcttggttttaacagagaatgtggtgagatgtgtgcaatgaaggaggtaacccttttttctgatgatgctaaatcaagggaaagtgcgcagcaacttggccaagaaattgcaatgcttagtcagttgcggcatccaaatattgttcagtattatggatctgagacggtagatgacagactttatgtatacttggagtatgtctctggtgggtcaatctataagctggttaaagaatatggccagttaggtgaaattgctattcgtaattatactcggcaaattctattaggacttgcgtatttgcacaccaagaacactgttcacagggacattaaaggagcaaacatattggtggaccctagtgggcggataaaattggcagattttgggatggcaaagcatataagcgggtcctcttgtccattttctttcaaaggaagtccttactggatggcacctgaggttataaaaaattcaaatggttgtaatcttgcggttgatatatggagtctaggatgcactgttttggagatggcaacaacaaaacctccttggagccaatatgaaggggttgctgctttgtttaagattgggaatagcaaggaacttcctacaattccagatcatctatcagaagatggaaaagattttgtcaggctttgtttgcaaaggaatcctctaaatcgtccctcagctgctcaacttctagatcatccatttgttaaaaatgctatgctggaaagatccattttaactgccgttccttcagaagatccaactgccataataaatgcagtgagatctctggccgttggacctgtaaaacataatttatgcttagactcagaagtggctgggatctatccactcagaagcttgagaactggttctggatcaaggtttctctcaaactcaaatgcacacttaaacatgagaaagatcgcaatgaaaaaatacaatggtctacatgtgcatatgaatatttttagtactgacatgtacatatcacatgtgaatatttaa

SEQ ID NO: 91049 - DNA, 147 bp, Glycine max
  Peptide Sequence Number=SeqID_207827
atggtaaaaggagttgagtattggtgggagaacactttccaatgcttggaggagaactactttccggaaggtgttaggaacgagaaggagatggagttcctaaagctcaagcaagggaacatgattgtgactaaatatgtagcctag

SEQ ID NO: 91050 - DNA, 192 bp, Glycine max
  Peptide Sequence Number=SeqID_207828
atgaacatgaacatgaaagacctccaagcgatgcagagaggagctgacaaagagatatcaatagggaccatgttggatatccctagagggggaaatagaatggttaaagagttggaaataaagtggttaaagagttttaagcatccttggagagagagaataggatggcttagaatctttaattatgcatag

SEQ ID NO: 91051 - DNA, 684 bp, Glycine max
  Peptide Sequence Number=SeqID_207829
atggatgctagagctagagtaatgggtgaagtagacgaggtgcaagagcagataaaggccgacttggaggccatgatgagcatgaagaaggtaatggaggtcaatggggctatagttgttgctaccagtgtcgttgctgaggtggacctgactcccccatctagcctcaaccaaataaatcatgccatcttgaatattgtagggcagagaggcaaagaattgggaagtacgggcggcccctattttgtgcaagttcaaaacaagcattccttcccactatatgacttagctcccaactatgcaccatccaatatggtgcacactcttaataagaatgtcaataactccactcccatactcatcaagaaccaacaacctcaatttgatcatgcatttgtccctcaactcatgggggagacacatgaaatacaccaccacaatctagccaactttgagcctcgcctcgaatatgcaactgaagggaaagcagttggtggtgtgcccctgccaaacaccttggagggccctcagttcctcccacaaccacaacccttgtattttgtggcgggaagaatccctcttgctatggtggggaagggaaagttggatcatatagaggaaaggcttacagccgttgaaggaggtggaggttatgctttcgctaacacgacggattgtgcttag

SEQ ID NO: 91052 - DNA, 1308 bp, Glycine max
  Peptide Sequence Number=SeqID_207830
atgcgaggaactaatgtaaatgatggaagagctgataacaacaacactttagatactataaacgctgctgcttttgccatagcctctgcccagaaccgcgtttcccagccttctacccagaagaaaagatgggggagctggttgggcaaaattgggtgttttggatatcaaaaaagccgaaagcgcattgggcatgctgtcctagttccagaaccaacctgcaatggagctgatcctgctgctagttcaaatcaagcacctagtataacgcttccctttgtggcacctccctcatctcctgcatctttctttcaatcagaacctccctcaactggtgtgtctcctggtggccctgcctcaatctttgccattggcccttatgcccatgaaacccaattagtctcaccgccggttttctcggcttcatccactgctcctttcactccacctttcaccactccttcttcccccgaggttccttttgctcagctacttgaccccaataataagaacgctgaaacctttcagaggttccaaatatctcactatgacttccaatcctatcagtttcatcctggaagtccagttgctcaactcatatcaccaagatccaccatctcatcgccactccctgactctgaatttaatgccactttctcccatatccttgatttcccgatagcagaccctcccaagcttctcaacttagatagtaaactttctgcttgtgaaaaccggaagtcaaaccatggttccgggtctctgacacccgatgctgcgaggtccacaactcaatccgcttttctttcaaatcattgggtttctgagatcaaaatgtccccacatccaagcaataatcgcctcaatgagattagtataaatcatagagtttcctttgagttatcagcccaaaaagtgctaaaatctctggaaaacaagccagcagcatcagtgtggactaatgtggtgtcaaaattgaaaaatgatgctccaacaactgacaaagaagaaaaatccgtagaagctgtgctcgatgaaaaacaagtagttaaagaagctcacaatgatcaaccactggaagaaatcactttgggtggagaaaaggcaacaacaacagttcatgagaaggatcagtccttaacactttcttctgctaaagaattcaattttgataatgcagatggaggagattcgcttgctcccaatatagttgctgactggtgggctaatgagaaagttgcagggaaggagagagaggcatccaaggattggtcctttttcccattgattcaacctggtgtcagctaa

SEQ ID NO: 91053 - DNA, 2541 bp, Glycine max
  Peptide Sequence Number=SeqID_207831
atggagacaccaagggaaatattcttaaaggattacaagatgcctgattactactttgacactgtagatctgaaatttaccttgggagaggagaagaccatagttagttctaaaattgctgtgtatcctcgcattgaaggttctactcccccactagttttagatggacaggacttatctttagtttcaattcacctgaatggcaaggctttgaaggaggaagattatcatttggatgcacgccatctcacaatccaatcacctcctagtggtaaatatgatcttgaaattgttacagatatttgtccacagaaaaacacatcattagagggactttacaaatcatctgggaatttctgtactcaatgtgaggctgaaggcttccgtaaaattacattttttcaggatcgacctgatataatggcaaaatatacagttcgcatcgaggcagataaatcactgtatccagtgttattgtctaatggaaacctagctgaacaaggtgacttagaggatggcaggcattatgctgtttgggaggaccccttcaagaaaccttcttatctgtttgccttggttgccgggcaattgcagagcagagatgacacatttgttacccgttcagggaggaaggtgtcccttaggatatggacacctgcagatgatgtacctaagactgcacatgctatgtattctctgaaagcagctatgaagtgggatgaagatgtttttggacttgaatatgacctggatctcttcaatgttgttgctgtcccagattttaacatgggagccatggaaaacaagagcttgaatattttcaattcaaagcttgtattggcctctccagaaactgctactgatgcagactatgctgcaatattgggagttattggccatgagagcttatttcttgtctgttatgcagtatttccacaactggactggcaacaggaattttcatctgacatgggaagttgtactgtaaagcggattgctgatgtttcaaaacttagaaattaccagtttccacaggatgcaggtcctatggcccatccagtgcgaccacactcttacatcaaggtctacgaaaagggggctgaagttgtgagaatgtacaaaaccttgctaggaagtcaagggattcaatcttacaaactccctggatttcagggcatggatctttattttaagagacatgatggccaagctgtaacatgtgaagatttttttgccgccatgcgagatgcaaatgatgcagattttgcaaatttcttgctatgtcaagatataccaccaaccccagggcaatcagttaaggaacccacattcattcctgttgcagtgggtttgcttgattccatgggaaaggacattcctctttcaactgtttaccataatggtactatgcaatctgtttcaagcaatgatcaatcagtctgcactacagtccttagagtgaccaagaaagaggaagagtttgtattcaccgatatatttgaaaggcctgttccttctttgttaagaggatacagtgctcctattcgtctggaatctgatctcactgatagcgacctgtttttcttactagccaatgattccgatgaattcaaccgttgggaggctggacaagttttggcacggaagttgatgcttaacttagtggatgatttgcaacgtaacaaaccattggttttaaattccaattttgttcaagggttcaaacgtattttatgtgactcaagtctggacaaagagtttgtggcaaaggcaataactttgcctggtgagggagaaataatggatatgatgggggttgcagatcctgatgctgttcatactgttcggactttcatcaggaagcagcttgcaagtgaactgagatcagagttcctcagcacagtggaaaataacaggagctcagaagaatatgtcttcaatcactcaaacttggccaggcgtgctctgaagaatgttgctcttgcttatcttggatgccttgaggaaaaagaattcaccgatcttgtgttgcatgagtataaaactgctacaaatatgactgagcagtttgctgccttggctgccatagctcagaaccctggtaaaacccgtgatgatgttcttgatgacttttatggcaagtggcagcatgatttcttggtggtgaacaaatggtttgctcttcaagcaatgtctgacattcctggtaatgttgagaatgtgcggaaactgttaagccacccagcatttgatctgcgcaatcccaacaaagtgtactctctcattggaggtttctgtgggtctccggtgaactttcatgcaaaggatgggtcaggctacaagtttttgggagagattgtgctgcaacttgacaagctaaatcctcaggtagcctcgagaatggtgtcagccttctcaagatggaggcgttatgatgaagacagacaaaagcttgcaaaggcgcagttggagaggatcatgtctactaatggactatcggagaatgtgtttgagatagcttcgaaaagcttagctgcctaa

SEQ ID NO: 91054 - DNA, 201 bp, Glycine max
  Peptide Sequence Number=SeqID_207832
atgtcaaaagcaggaacagaacatgagtttctatggcaaaaaatccatttctctcaagattttgtgttaaatccagaaacatgcaacgcacatggaggcatggtggtggagcaggggagatcaaacccagaagagtgttcctcgaaaaggtcagtgtcttcgatggaagaacgaaccgagccatttatcgcgaacccctaa

SEQ ID NO: 91055 - DNA, 162 bp, Glycine max
  Peptide Sequence Number=SeqID_207833
ggccatcccgctaagcacactgcttcaacccattcggtgagcgagaaaagccgcgctaagccgaaattcactaatgcgcacttagcggttcagaagtgggctacgcgcacgagcacgaacaaagtgtttgcttccggcaagtgcaccagatcgcacaagtaa

SEQ ID NO: 91056 - DNA, 195 bp, Glycine max
  Peptide Sequence Number=SeqID_207834
atggaagcaaaagcgcaaaaatggtggcctaggggcgaaaatctgcaaaacccgtgggtgctgcattttttgaatgagggaggggagttttgggtggagagaaactccccctcccctcgcttttgtgtttccagctgcgcctcccacttgtctggagctaggcatgggatgatgatccatcgatcatgggcctag

SEQ ID NO: 91057 - DNA, 1077 bp, Glycine max
  Peptide Sequence Number=SeqID_207835
atggatattcaagaagagagctccaccacacttggacccttgacagcaaagagttcaaggaacatgtcatcctcgtcttcagcctttttttcagccaatcagtcacccttcttctctccaagatcatcatcatgtcagttatcagagtctttgcgacccgatgctcccagtgacagaattcattcagatgctgctgcccccagcaccatttcagggattccagaaccaaagtctattgtgaatgttggatgctccttctctgaggtggctgcatctccagctggctgtaatgcaggtgatttgcagaaccttgatcgcatatcttcctcagtcggcatctctagtagcactgtgtctggttattgccatccttatgatgatggttattctgggctgaaagagaagagaagcaagagaggcagaaacaaaagaacatcatcaacaccagatagggctggatgtagaaactcttgcaagcttggcattgcagagaaagctatggatgttgcttcttttgggatagtaattataacaaggaagtctttcaagaacccatacacaattgaggagctgcagtttttctctggcaagaagaacttggtccctatatactttgatttgagtccagccgattgtcttgtgagggatatatttgagaagaggggtgagctgtgggaaaaacatggaggggagctttggcttttgtatggagggttggagcaggagtggaaagatgctgttcatggcctctcacgtgttgaagaatggaagttggaagctcatgatggaaactggagagattgcatactgagggctgtaacattattagcaatgaagttaggcagaagaggtgcggctgagcatttgacaaaatggagggagaaagtgaaagaagaagagctgcctttcactcgtaatgagaacttcattggtaggaagaaagagctttctcaactggagtttatgctttttggtggagttactggagattcaaggcaagactatatcgatcttaaggccagaccgaaacttttagcatttgtctattggtcggggaaagagtattggttgagatga

SEQ ID NO: 91058 - DNA, 978 bp, Glycine max
  Peptide Sequence Number=SeqID_207836
atggaagaatggtcaacattctcaaatgggtcttccttagattgcattggaggagttgaacttgaaactgttggtgcatttcctggaaatggctgtggccttggaaagcaccatgttgataatggtgctgacaatggcaaacttaaacagaagtacttgttctaccaactgtttcctgcttacctgaaggatagttgttccaaaggtggtgttcggcctttgccagttttagtcgacggtcaatggctggatttgtacaaactgttcttcctggtaaaggaaagaggtgggtacgcccgagtgtcgaagaaaagattgtggggttctgtgaccaaggaattgggcttgaaccttgtggtttgctggtctgtaaaattagtctatgacaagtatctgaatgatttcgataggtggctcaagaaaacttttgaagagaagaatttaaaaagcgggaaccatgggtgtgattggggtttaaagtggttgccattcgatattgagaaagagtttagagccctgttatgtccaaatctaaaggacaaagatgatcacaaacttgtcaagtcaaaatcaattaataaaaagaaaaacactgatttggttaaccacaagaatggtaataatctgttggacaccaaagatcaaaataataaatccgaggatgttcaacgcattgaaggtgataatgatgaaaaatcaactaatggtgttaaggacaatcctgctaccttgggtgcagaaggtgccaagaaagaatttaacccacacaaacgcaagcgggatgcattgtctggcatgctaaactggatgaagcatgttgcaaagcatgctcttgatcctttaactcaaccaatacctaaaccatcaaagtggaaggaatataaaggccaggacttttttggtcaatttctgagggcaagagaggttctgtcaccgagacagcatgaagaaccaagcagtgaattgtcttctttgcag

SEQ ID NO: 91059 - DNA, 372 bp, Glycine max
  Peptide Sequence Number=SeqID_207837
atggccagggtaactactagtgggaggactctcgaagccgagattaaggactttctgataaggatggattcacatcatgactcaatcttgagtccttacttgtttaacctagtactggatgtgcttgctagggacacaaaagattatctaaatgcatgctttttgcaaatgatagttttgattaaggaatcacggaaagaggttaactccaaacatgagctttggagacagatgttggaatctttgcttaataggagtaagttagagtatatgcatcacaattttagcaagaaacacgaggaaaacaacttggagatgaacagatggacatttgaccacaaaccacataaaaagggacaagatatggaatga

SEQ ID NO: 91060 - DNA, 480 bp, Glycine max
  Peptide Sequence Number=SeqID_207838
atggtcgacgagttggctcagttcttcgacccggacgccgcgcgtcgaaccgggtttggtatcagaaaagccattggggttcccgagttcgaccggttttttaataaataccctccctcgatgggccaggggggcgatgatcctctgcgggagcgtgcgtacgaggaggcggtgaaggcgattaaggataacacgtgtgagttggcggagcgtcagatagggaagatcgaacgattgaagcgcgccggctgggacctacggaggatagacgcgacggaggcgtttcggatggtgctgacgtcagggtcgagcaatgggtccggtgtatgggaaagacaggtgttggaaccaagcgtgaagattgtgaaacgcttcttgatggaggaaacggaaaaatgtacaaaatggggaatggaaggttccaatttggatcacctcacctcactgggtgagtttgagtttgtgctatcggaggaatga

SEQ ID NO: 91061 - DNA, 1170 bp, Glycine max
  Peptide Sequence Number=SeqID_207839
atgtcaaagaacattctggtttggcatcttgatgtccatcaatatgaacatttgaatggggtgggcgacaactcaattgatattcctgaagcaaacgtaataattcagatctcttcacatgctggttcaaggcgacaagaagcccagcgtctgggtcgtattcttagggcaaagggaaagcttgaggataggatggcagggggcaaggaggagtataatgcatttttttattcccttgtttcaattgatacccaggagatgtattactccactaagaggcagcaatttttaattgatcagggttacagctttaaggtgggaaagtgggatggcatgatttgctgtcttacttggaataagtgggaacacgagctgaatttccttgtgataataagagaaaagaatggaagagaaatgagaagaaatattttagttaaagtagagaaagaggtaattactagcttgcctcctcctgatgaagggcctaatttgagctatcatcgtcttgaggatcaattggcacttcttggaaaggtgttgagtgctggtgatgatcaagttggattagagcaactagatgaagatgcagatgaaattgcccttcagagtgcccgtcgctctcaaggatccatgagtgcaatgtcaggtgcaaaagggatgatctttggtcatgattgctttcttccccgtgcagtactgtgcgtaaaggccaacaaggacagatcaagagcaagccgaaagatccagcgaagagacatttcttgtttaaaagaagatatggggcaacctaaatgtgccgtctttgtaatgaaatcattcgatgcttcgaaaagcaggcataatggtttttctactgttcactttatggagatgtggacaaacagatgtttgactttttcttcttcaaagaatcaattactgaaaagtgaaaatgtccatcagactgacaaacatagaatgttaaaggaagaaaattatagcgttgcacgacaaatagacaacaggcacatgctcaaactagtgctgcgtaatagaacttgcatagagataaagatccgagggtggagacgcaaaggaaggtgccatagacaaaatagagagaaactgaaagttagaaaaaggatggtgatgaaggtggtagttggaaaaggaggtaaaggcagtggctag

SEQ ID NO: 91062 - DNA, 774 bp, Glycine max
  Peptide Sequence Number=SeqID_207840
atgaagactgaggttggtaaaactaagcaacttagcctagaattgactaagagtatgggaacggtgaaaaatttgcaagaggatcttgacaaacatgttgcctatctgtccagtaaggtcgaagaaaacaaggccttaagtgtccaagttgctgacccagagcagcaaatgaatgacataggcaagaagatgaaggatctaacctcagagaaaaagacaactaaggcagagttagggaccgtgagggacgagatggctgagatgaaggaagctcttgcaaaaatggagatcgagttgcgggagaaggaagaagttgagtctactttgaaggctgaattgaacgaggccaaaagggatgacctttcttgcgacgtcttcaagcctatacaccccattttgcaaggactcgatgatgtcgaatgggcctttccagtttggtgcaagttttccttccaagttgtccttccaggcatctcctcggagcctccaaaccaattcgttgggcttgaagccatgtccaattctactaccaaggattatgagttgttggccatgttgaccatgcttctgcgaagtgaagtggtacccccaaagcacgctcgggagctcatccacccacagtcccttggggactttggacagtcttttgcgcaacatgacaaggatgatcttgtttgcgacttcttgttgcccattggtcaagggatgctcaaccaaggatgtgagatgcttgataccaagctgcttaaggaactcttcatagcccttttttga

SEQ ID NO: 91063 - DNA, 195 bp, Glycine max
  Peptide Sequence Number=SeqID_207841
atggcgggacccaacacgtggacaacaactcgccaactccactggcgagtccatcaggtgtcgtcacgtgtccaactcgccatcttcattgacgagtcccctccagaaacagaccccccaggaaaaaatttcttgacggaagagagggaaataaaaatcgttatcgatatgatcgtcttacagagactcgagtaa

SEQ ID NO: 91064 - DNA, 915 bp, Glycine max
  Peptide Sequence Number=SeqID_207842
atgtcttctgatctctatgcttttgacactaccttatactcacattcaaactcagacttggtttcctctgatggagttagagaccttcctttaatctcagaatcttttcctttctttgccaattctcaagagaattgcaataataatgctctttctaacgctctcgacccattttccccttcttttttctctttctcccctccaagttcccacttggaaagccttagtctttatcatgctaaccgcttgcagtctctgtcaaatggccaaaacttggcaaatgaatttgggagtttctcagcttttgatgggtcagaaatgaaaactgaggaatgccaaatgggtggtgattatgcatacagtcagcaactccttcctcacagttatagtggtgctgagaatttttccaagtacatgcagaggagcttcagcagcaactcatacgaagggaaaccagcttacagtgaccctcgcgaggattctccaaaatttcaaaggcatgagatgagttcccctgaagacaacactgtctttggtggacaaatgagaagggtttgcagcacaggcgatttgcaggaatcgaacttcaaagtagggcgttacagtgcggaggaaagaaaagaaagaatttctaaatacagagccaagagaaaccagaggaacttcaacaaaaccattaagtatgcatgccgaaaaacactagcagataatcgaccacgcattcgtggcagatttgcccgcaacgacgagtccagcgagactctcaaggtttcatgttctacccgagatgaagatgatgtcgatttctggattgaagagttgcgattgcatgaagagcaagacgatgtaacagtgggagcagaacagtacttgagaaattatggagctagccagtttcaatacggtggcttttga

SEQ ID NO: 91065 - DNA, 360 bp, Glycine max
  Peptide Sequence Number=SeqID_207843
atggcgccaaaaacttgtttgcagtcggcaagtgtacttgatcacacaatacaacaacttagccccgtactatcaaggactttagaatcagaccagtttccattgttgaatgaccctaacaaagcatgcatctacgtgatcaagtccgaaagcctcctttacaacacagagaagaacaagatgaaagattgcaaaaatacaagtggtgaggatgtctcctccacctctaggatctcacaatcactcacaaactcatctcaagctctcagaatggcttccgcttcgagctctcatctctgcagatcttcacatagaaaaatctctcaaaactctttggaacttggacctttctctctctag

SEQ ID NO: 91066 - DNA, 378 bp, Glycine max
  Peptide Sequence Number=SeqID_207844
atgggctctgatatgggaggtgaaactgcaaaggaggatttaaatgaaagatatgaaaacctggaaagagatactttgctacagaagttctctgaatcagcagagaaactattaatggtttccatccataaggaaaatgctttgaaagatttaaatactgaagtgctgagaaggaaaaatatagaaggggaagttataagcagattgctgcagctttcactaatcgtcagaaatcactcatttccttccatactgatcttaagaccaaaattgagaattggaatgtttgagtcttcagtagctcatcaaccaaggactgatatcatagcacacctacaacaaagatttccatttatcttctgcaagagataccgatag

SEQ ID NO: 91067 - DNA, 1038 bp, Glycine max
  Peptide Sequence Number=SeqID_207845
atggcgtcgcaggagagtatcgaaaagatgcaggcacggcagaattaccggaatttatggcacaccgatctcatgagatccattcaggccgatactccttgtaacgacactctctcacacactttttcaattttcgctttctatttttacactgacatcgtttctgattttgcgcagattgttgcctcgcgttgtggtgatctgatgattgttctttttagtctgaaattttgttcgtttggacgaggaatcgaatctttcattttcagtttcgatgtttatcgttttcgagttatagatctcggattaacgaaatctgaggaagaaaaggtgaaaaacatgcatattcatattgtagtgtatagacaagttatgcttattccgggtggtttaagtgcaccatgtgtgtcttaccttcttcgcaaacgagctctctatgatgatatgtcaaggtacacatgttgtgctggctacatgccttgcagtggtaggtgtggagaaagtaaatgtcctgaattttgcctttgcactgaggaaatagcatttgagcaaattataaattgttatttgttttcctctgctttggaaattcagtcgcctcaactcgctttctattgcaagatgaatttaacattcaaactacgcaatggtttcatgttttgccttcaacaaattgcatgtatattctctattgttgccatgattgtgggaagcgatgaaattcaagaggcttctcagttgctgtcttgtttggctgactttgtgtactgcacggtctgtgcatgcatgcagactcagcacaagattgagatggacaagcgagacgggaaatttggaccccaaccagcaatggcagtgcctcctatgcagcagatgtcacgcattgatcaacaagttcctccttcggttgggtatgcaccacaaccagcttatggacagcctgctcaaggatatcctgctccgggttatcctcctactggttacccccctgctgcttatcctccaccaggatatcccccttctggctaccctaagtga

SEQ ID NO: 91068 - DNA, 861 bp, Glycine max
  Peptide Sequence Number=SeqID_207846
atggaggcatctgcgacactcagattcgtcacacacaccctctccctcttcccacatacacccatctcttctatttcagtttcaccaaaattcagttcaaacactacgctgtcggtggcgaagaaaaagtcaagcatcgaaggtgtgagcgaagagttgaacgccatgacctctcagaaccttgacttcgcaccctcccggagacgggttcgtgcagctttcaccgaggtgcaccagcagctcgaccatttcttgttcaagactgctcctgccgggatcagaactgaggaatggtatgaaaggaattctaggggattggaaattttctgcaaaaactggatgcctgaaccgggcgttccactcaaggctgctttgtgtttctgccatgggtatggcagcacttgcactttcttctttgatggtattgccaaacgaatagatgcttctgggtatggtgtttatgctatggactatcctggttttggtctatctgaaggattacatggttacataccaaaatttgatgatttggttgatgatgttatagaacattatacaaaaatcaaagctaggcctgaggtgagagggttgccacgattcatattggggcagtcaatgggcagagcaattgctcttaagttccatttgaaggaaccaaacacttgggatggagtaatccttgttgcaccaatgtgtaaagttgcagagggcatgctaccaccaatggcagttttgaaggtattaaatcttttgtctaaagtgatgccaaaggcaaaactgtttccgcacagagatctatctgcactgactttccgagaacctggcaagagaaaagtggttggtaattttgtcaacccctaa

SEQ ID NO: 91069 - DNA, 207 bp, Glycine max
  Peptide Sequence Number=SeqID_207847
atgccgaaatatccaaagggagtgacagaagaagaaggaagcagtaacatatcgtccaaggcacttttctccgtcgtcggaatgacttgctccgcctgtgctgcctccgtcgagaaagccgtcaagcgtcttcccggaattcgccaagccgtcgttgatgttctcaacaaccgtgcccaagtcctcttctatccatcctttgttaac

SEQ ID NO: 91070 - DNA, 1947 bp, Glycine max
  Peptide Sequence Number=SeqID_207848
atggcccgacaattgtgtgaagacaaatccaaggacatggcttcatcaactcatcatgggttgttctactcagatgtgtcatcccataaccaaactattcaatcccatctgatgaaccacatccaaggctttgtgaccgagaccgacccagagatgttcaacctcaccacaggcatggagatgatagggttttccaagaaccttgagcaaaacagtgaaagcaacggtgtcatgtggaaaagtttcttctgcaaaccaggtcaacacgcgggtccttcctcttccaaaacgatgaacgagtcttgtagcaatttttataaccaccagcatgatcataagtataataagcaagacttcacatcagggattaattctgagacaagtaccgataacttagttgtcggtggtgcccatgattctgccccgtggcaagagaacaggctaatggttgatgattcttctttaaggtgcgtgttcccttgtgaaggtaacgaaaggccgagtcaaggcctttcactctctcttagttcaaccaatccttcaggtattggcttgcaatcttttgagctaagacaaacaacaagccatcatcatcatcagcagcatctttctgattttgtttcaagagagggtttttttggaaagccagtcaatgctcaacaacaacaagaaatgttgcaagatgggtatttgagtcctaacaaagctgcgaatatttatcagcagggacattttctaatcaagaactccaagttcttggtgccttcacaggtccttctgaacgagttttgtagcctagggacaaaggaaaatgatgtgccaaagcaaaagaacaagcagtgggaagaaggtaataataacggtggtggttcctccaagaaccattctcttagctctctagagtttgtggaattgcagaagagaaagacaaggctgctcgcgatgctggaagaggttgatagaagatacaaacactaccgtgaccaaatgaaggcagtgatgtcctcctttgaagcagtggcgggtaatggtgcagccactgtttactcggctttggctttgaaagccatgtcaaggcattttaggtgtttgaaggatggaattatggatcaaattcgagccacaagaaaaggcatgggagagaaagaactcgctgcagtacccggcacaacaaggggcgaaacacctaggcttaaaatcattgaccaatcactgagacaacaaagggcctttcagcaaattagcatcatggaaactcatccttggagaccccaacgtggccttcccgaacgatccgtttcagttcttcgagcttggcttttcgagcactttctgcatccgtacccaagcgatgttgataaacatatcctagcccgccaaaccggtctctccaaaagtcaggcacgtgtttcgaattggtttattaacgcgagggtgaggctatggaagccaatggtggaggaaatgtatttggaagaagagaaggagcatcaaaacgacgtagcatcgtcggagggaggaggcatcaatattctcggggatcagaagccaacacaggctcgactcgttcgaattgactcagagtgcatgtcgtctatcgtcaacaacccagatgacaaaaacgacacaaagagcggcaaaaccatccaaaacgacaaccaaatggacgcattcgggtcggtggagcttgacttttggtcctacacgcaccagtactcctccggacacagtggcggcgtgtcgttgacgctggggttacagcagcacggtgaaagcggggtgagtttagcattcccgccagcggcaacacagagctccatgttttacccacgggatcagattgaagattgccaaacagttcagtactctcttgtggatggcaaaggacaaaacatgccttataggaatctcatggggacacacttgcttcatgatcatttggtatga

SEQ ID NO: 91071 - DNA, 148 bp, Glycine max
  Peptide Sequence Number=SeqID_207849
atgacggtggatgggtcatgtccacttgagacttcaggacagatctgctttcttgaattccttgatagagagagagcgagcgccatgtctatgaattgctcttgtaaagatgatcgcaccaaaaataaacgcctatgcacttgtaatg

SEQ ID NO: 91072 - DNA, 1497 bp, Glycine max
  Peptide Sequence Number=SeqID_207850
atgggtgagaaagagtcagagaagctgctattttgggaacatatgagaactcccattgcaccacagcacccaacattaccaaaacttcttgtccttctcatcctcttcgtctccctcacctacctcgtctacacgctcaagcttgtctccacctcacgcgcctgcaaagacgccccattctccaaaaccatcatcgccgtcaatgccaccgcctccgccgccgcagttctccgacgaggctcccgcgagactaatcccgaggaccggacggacctccgccatttggtgttcggaatcgcggcgtcggccaagctatgggaccagaggaagagctacatcaagctctggtacagagcgagggacatgcgcggcgtggtgtggctcgacgagaaggtgaaatcggaggaaaacaacagcgacacgctcccgccggtgagaatctccggcgacacggcgaggttcaagtacacgaacaggcaagggcaccggtctgcgattaggatctcgcggatcgtgtcggagacgctgcggctggggatgaaggacgtgcggtggttcgtgatgggagacgacgacaccgttttcgtcaccgaaaacctaattcgcgttttgagaaaatacgatcacaatgagttgtattacatagggagcttgtcggagagtcacttgcagaacattttcttctcttacaacatggcctatggcggaggaggttttgcaattagttatcctctggcgaaggctcttcagaaaatgcaggaccgttgcattcagcgttacccggctctctatggttctgatgatagaatgcaagcgtgtatggccgaactcggtgttccactcaccaaggaaatcggttttcaccagtatgatgtgtatggaaacctgttcggccttcttgcgtctcatcccgtgactccattggtgtcactgcaccacctcgatgtggttgagcctatcttccccaacgtgactcaagtagaagcccttcaacggctcactataccaatgaagcttgactcagcaggactcatgcagcaatccatatgctacgacaaatcaaagagctggaccgtttctgtttcgtggggttttgctgttgagatatttcgcggcgtgttttcaccacgtgagatggaaatgccttcaagaacattcttgaattggtatagaagagctgattacactgcatatgcattcaacacacgtccagttagccgaaatccatgccagaagccttttgtgttttacttctcaaaggctaaatacaattctacaatgcaacaaatagtgagtgaatatgaaaggcaccgcgtccctcatcctgattgcaggtggaagatggctaatcctgctgcttttgacaaagtggaggtatacaagaagccagatccgcatctatgggacagagctccgaggagaaactgttgcagagtgaggaagtcaaaggagaaagggaccatggtgatagatgtggatatgtgtagggatggtgag

SEQ ID NO: 91073 - DNA, 354 bp, Glycine max
  Peptide Sequence Number=SeqID_207851
atgaactcaaccatgagtgaatcaggagcaggtggtttcaaaactttgagttctcccattccttacctctttggtggcttagctatcatgcttgcagtcatagcagttgcattactcatcttagcttggtcttatcgtaaacaatactatacttcttctaactcggccagtgatgaagagaaaccaccacccatcaagatggtggaaaaggaggagaatgtttcagagccaaagattgttgtgatcatggctggagagagcaaccccacttacttggccaagccagttccatccacaagccataatgaacaaccccttttcaaagtagcagtatgtagatcagagtcagagtaa

SEQ ID NO: 91074 - DNA, 339 bp, Glycine max
  Peptide Sequence Number=SeqID_207852
atgccaactgagcaatgttatatctctattcccttgcagatctctgctcatcataatgagtcggacaaattacctagaggtggccttgataaaatgacattgattgaggttggtccgcgattctgcttgaacccaattaaaatatttggtggcagttttggaggcccaactttatatgagaatccgctctatgtgtcaccaaatcagattcgagctttggagaaaaagaagaagtctggaaagtttgcaaagaaggtcaaagcaaagacaaggaggaaaatgcacgagatgtccaatcctctggagcctgatgagtttgcagatatgtggaaagattga

SEQ ID NO: 91075 - DNA, 140 bp, Glycine max
  Peptide Sequence Number=SeqID_207853
atgcctagtgttactaggaaccctcttgttgttgggcgtgttataggggttgaaagttctatttcaggatcacctattgcaatagagaagtgggcaatggttgtgagcttaacccttctcaagttcccaaccaacctaga

SEQ ID NO: 91076 - DNA, 897 bp, Glycine max
  Peptide Sequence Number=SeqID_207854
atggccattattgggcctagcttaattggaagcacactgcttgaccagctatgccatcagtttttaataataaagtactttcatatgttgttaaccgactccatcattgcaagcaattacgaggactggctgcgcaaaggaatacatgtgatcacccccaataagaaggcaaattcaggaccactttatgagtatttgagattaagagctcttcagaggcaatcatacacacattacttctatgaagctactgttggggctggtcttccaattatcagcactttacgtggccttcttgagactggtgacagaatattggaaattgaaggtatcttcagtgggactttgagttacatctttaataacttcaaagatggtcgggcttttagtgaggtggtagctgaagcaagggatgaagggtataccgagcccgatccaagggataacttgtctggaattgatgttgctagaaaggtgataattcttgcaagggaatcaggtttgaagctagagctttctgatattcccgttgaaaatcttgtgccagaaccattaagaggtagttcatcagctgaagagtttatgcaacaactgccaaaatttgacgaggaattaacagagatattaaaagatgcagagagttctggagaagtcttgagatacttgggagtggtggatgtgagtaatgaaaaaggagtggtagaactgagaagatacaagaaggatcatccctttgcacaattatctggatcagataatattattgcattcacaacaagaaggtatagaaaccagcctctgatagttcgtggacctggagctggtgcccaagtcacagctggtggaaaattcaacgacattttacgacttgcctcttatcttggtgctccatcatag

SEQ ID NO: 91077 - DNA, 309 bp, Glycine max
  Peptide Sequence Number=SeqID_207855
atgtacttaaatcaaccctcaaagagcaaggttatgaggagagcactgagcatcacgtactacatatcagagcaattaaaactaaatgatttggtgttattaacaacaacaatatttcagcggcataattattaccagaatcactcaaatatactgcagctatttggtgctattaacggcaagcaatggtgtagtgcacactggtcggtggcggtggcggtggcgttcactgtaaaagaagaactctccaccagattcgcccaaattgaaacaatctacccaaaacccccaaacgcatatccagcttaa

SEQ ID NO: 91078 - DNA, 789 bp, Glycine max
  Peptide Sequence Number=SeqID_207856
atggtcttcgtgaagaaactgtcctatgagatagcatgcaatgtattgtatgacattaaggatgagcacactagggaggctatgtttgtagattttactttagcatttaaagcaattcattctcttcccatcaatctccctggtaccacattttggagaggccagagagccagagcaagaattgttgacaggatgattcctattatgaacaaaagaagggaggaacttcatggcacatctgccactcttatgagcttgatgatatggaagttatccagagataaagaggtccacaataaagttttagaagcaaagggaaggaacagaagagttacatgggcagagatacaaaagatgaaatacacatggagagttgctcaggaattgatgaggatgatccctcctttgtttggaagctttaggaaagcacttaaagaaactaactacgaaggctatgacataccaaaagggtggcaggtgtattgggcaacatatggaacacatatgaatgatgatatatttgaaaatccacacaagtttgatccatcatgttttgagaatccacccaagataattccaccttattcttaccttccatttggtacagggcttcattattacgtaggaaacgagttcgccagcattgagaccttgactattattcacaactttgtaaaaatgtatgaatggtctcaagtaaacccagaggaagtaatcactcgtcaaccaatgccatatccatccatgggtctcccaattaagatgaaacccagatgtattattccttaa

SEQ ID NO: 91079 - DNA, 330 bp, Glycine max
  Peptide Sequence Number=SeqID_207857
gagttggtttgtggaagtcgtggtagctcgaaggagttggtttgtcgtcgttgccctgggctgtttggggtgctgactttgcattccgtttggggtgctcactcgtgctcgcaaggtgtcattttcagtgagggcttgtatttcctagaagggtttatagggttcatgtatggggttgtgggtgtggtttgtcctgttgagccaggaactgcatccaacttggtatcaaattcatatgagatttgttgttgctcttctctgaatgttgtggctttactttggcctgcaaaagaaaacaaggatctttcaactcttcaacaggacaaatga

SEQ ID NO: 91080 - DNA, 352 bp, Glycine max
  Peptide Sequence Number=SeqID_207858
gaagaggcacatcccctcctactatgaaagggagcttatggacaagctccaaaggcttagacaagggagtatgagtgttaaagagtataggcaacaaatggaactactccttttgagagctgggcttagggaggaggaaagaacaagtattgttagattccttaatgagcttaatatggaagtgagggacaaggttgagctccttccacatagggacctagatgacctagtccaactttgcataaggcttctcgctaagccaatctgcaggcttagcgagccatccgctgagcgcaccactcttgcggctgagcgcaacactcctgcggctgagcgtgaggaagaatcttga

SEQ ID NO: 91081 - DNA, 919 bp, Glycine max
  Peptide Sequence Number=SeqID_207859
atggtggtgcaagtgcaacacaatctcctcttagtcataactttcttgatgttgttgtggtcatggtggagccttttgggtgcactaggagaccctcaaacccatttaatcaacaaggggtgtagccaatacaacgcaaccgacttgtccaacttcaaccaaaacctaaacgcaactttggatgaccttagagcacaggttagcaaccaaagcaagcactttgccacggctcaagaagctagaggagcagaccctgtctatgccatgtttcagtgtaggaactacctctccaccgccgactgcgccgcctgcttcgtggttgccaccgcccaaatccgcaattgctcagccggagccaacggtgcccgggtcatctatgatggctgcttccttaggtatgagagcaatggcttctttgaccagaccacactggctggcaacagtatgatttgtggaaatcagacagcagtaggagccaccacatcttttaatacaactgcacagcaagtgctaatggaactgcaaattgcaacaccaaaaattactggtttctttgcagctaccaagacacaattggctggtggtggtgcaatctatgccattgcacaatgtgctgaaactgccacagagagtgcttgtttggattgcctcacagttggatacaacaacatacatatttgtttacccaacacagatggcagagcatttgatgcaggatgctttatgagatactcagagacagcattttttgctgataaccagaccattgatatcacacccttcttgaaacaaggaggttcaagcaacaagaagggagccattataggcggtgttgttggaggtgtaggtcttgttgtaatcctccttgcactatttggcttgcttagacggtataagaaacccaagagggttcctagag

SEQ ID NO: 91082 - DNA, 660 bp, Glycine max
  Peptide Sequence Number=SeqID_207860
atggaaactgaaggatgggttaggcagttgacaatggatattcagggacaaaaattgtcgattcctatatatttgctacctgtttcgagagcttaccttattttgggatcaccttggttagccactctcggtccccatattgttgattatgtagccttgacactcaaatttttccaccataggaaatttcttacattacaaggagagggttctagtactcctactcaagctcgccttcaccgactccaacgattacatgctactagtgccattttttccaattttgttgttcacctgatgcaacatgatggtcctgatgacaatctcatcgagtttccagtggatattgctcctgagatagcgaccttgctacatacttatagtgtggtttttcaatcgcctacgagtttacctctgctagggatcaaaaccatgtcattcccctccaccccaatgcaaagcctattaaagtcaagccatatcgatacccacatagtcaaaatgagcacattgaaaaaatggtacatgagatgttataccaaggcatcattcagcctagtgaaataccttggtcataaagtctccagagctggagtaacaatggatgttgggaaggtgcaagtggtgttagattggccaaagcctgccaatgtcaaatag

SEQ ID NO: 91083 - DNA, 207 bp, Glycine max
  Peptide Sequence Number=SeqID_207861
atggagaaggaagcgagtagcaccgacgacacttcttcgttcacgcttctagtgtcatgtacttctggactttcactttcacaggtttctgtggcatgcagcgaagcctacgaccggatcccccactctgagatatgggagcagaggagccagaagaacaattcgtttttcaatggaaagaagttcagggtatgcgcgccttgttaa

SEQ ID NO: 91084 - DNA, 507 bp, Glycine max
  Peptide Sequence Number=SeqID_207862
atgacagtatggagggacttttgtggggacaaatttaagtcctatgtgggaaaggttcctgtttccatcagaagtaataatgttggtgaatttcctggacattttgttttccctggaggccaccctgagcctcaagaaattggtataacatctcatcaatatgacaaggagttaacagaatctgttaacattaaggtttcacaggagatttttgacagcattgttcatgaagtagttgaagaaattggagtgccagcttcatcccttagtatcccggctttcattggtatatctcgcaggaatttgaatgtgagaccagctgcatttttctctatcaaatgcaatcttgactcaaaggaagttcagcagttttattctagcacacaagatggctatgaatcaactcagctatatgatgttccaatgattgaagtagaaaacatgacttctaggatgcctggatttgctctctataaattgatggttgacaccaggaagattacttga

SEQ ID NO: 91085 - DNA, 222 bp, Glycine max
  Peptide Sequence Number=SeqID_207863
atgattgagatgctagacgcttctactgaggatgctcttgaccgtggtagctggagtgattctctttccttattgccttcatcatttacaccccaagatgcatcaaaaatgttgtccctatgtcaatctgttcaaaatgctcttaagtctaacaaagcacatatttttggggatttttatgtgttgagcagcagctttataaagttgtggcatttgatgtag

SEQ ID NO: 91086 - DNA, 237 bp, Glycine max
  Peptide Sequence Number=SeqID_207864
atgatggaaaatattttgtaccttgctaatacccctgtcaccaattcagttagaagatatcaacctatttcataccttgtacatgacggtgctcaaggtggcattgtcgatccttttcagggtgaagaagattcatcctcagatcaaaagccatctcatcatcagaagaaacattaccacaataaggaaattaacattgaaagcatcaggactatgaatatgactcgattttgctag

SEQ ID NO: 91087 - DNA, 387 bp, Glycine max
  Peptide Sequence Number=SeqID_207865
atggccgccaagcttacgcgccagttgatcgcacagccagaaggtcagggcattggccttaccgtagcgatcgctttgggtatcgttcaggaacgggaagtgcagattatcaatctcactggttgtgacgccttcaccggtatcgaggatacggaacgtcagacgatcctccgcggactcgtcggtattgacctcaagcgtgattttgccaatttgcgtggtggtgacggcgtactgaataatcatcagcagaattcgacgcagcgcctcacgatcgccgtgacgttcgtcgttggccggcagatggttgttgatcagcagctgcagacctttgcgcttaatcacccggcagaactttccggcaccacttcgtcaatcagatcctga

SEQ ID NO: 91088 - DNA, 288 bp, Glycine max
  Peptide Sequence Number=SeqID_207866
atggcaaccaaaaaaaatgacaaaaagaagaaaggaattgcactcaaagcctcatcgtctattcatgaggaaaatgacaaagaagacttgaaagaaaataacttagaagaagatgatgatttcagtctctttgtaaagagattcaataaatttctgaggaacaaaggaaatcaaaggagatcaaacttccatccaaagaggaaaggagaagattcctccttagttccaaaatactatgaacgcgatcaacctgggtacctgagagttgattgtcctatctataaatga

SEQ ID NO: 91089 - DNA, 267 bp, Glycine max
  Peptide Sequence Number=SeqID_207867
atgatttacagatcatggccagaacatgagatgactacggagggacgtgatatggctgaggacgtcgctgacatgactgacgatgtccctgagcagcctacggaggcacctgagatgcgtgcggacgcacaaggtgctgatagtggtgaggggtcagatggtgatgatgctgctgagggattccctggtggtccacgtgacccatcagtgctcacatcatttgccgagcatgttgcacatgccgtttggagtggacatgtattttaa

SEQ ID NO: 91090 - DNA, 105 bp, Glycine max
  Peptide Sequence Number=SeqID_207868
atggagatcccgtttagttgtcttggtctccctatcaatgtaaatcctagggtggaaactacttggagaccgatcattgacaaactcaaaagagaagttttataa

SEQ ID NO: 91091 - DNA, 171 bp, Glycine max
  Peptide Sequence Number=SeqID_207869
atggcaaggattgggtgtgggaagttgccggtgggtatggttctgattttcaaagcatatcgttgtcgtttagtccttcagcgcatgctttgtttggtagatggtggtcctcttaagccattggggagtgttttcaacattgtctgcatcaacttgcgtgtgagggtgtag

SEQ ID NO: 91092 - DNA, 1869 bp, Glycine max
  Peptide Sequence Number=SeqID_207870
atgggtggtccaaccgtctcctctggcagtgacacgcttcaacgaacttggcttcctgataaaaaattccttatacaacctaatttggcccgtaattttacaaatataggtgctgtgaaatatgtagatggcgggccaacagcaaatactgccccacctattgtttatggtactctaacacagatgaattcagccgatgatccccgaagtaatttcaatgtgacttggcagtttgatgttgagcctcagtttcagtaccttgttcgacttcacttctgtgatataatcagcaaaagtctcaatgagctgtacttcaatgtttacattaactcctggtttgttgccaaggatcttgatcttagtacgagaaataatattttgggtgctccgtttttcaaagatatgattacagccccatctgccagcaccaaaattctcgtaagcataggcccttctaccgtgagtaacgattatcctaatgctattttgaatgggctggaaataatgaaaatgaacaactctgtgagtagtctcagctcatcaacggctgtgcctttgtctagtacttctggttcaggttctaagaaagttggcttgatagtgggcgtgagtgttggggcatttcttgcagtgttcattgttggagttttcttttttctactatgcaggaaaagaaaacgttctggaaaagaagggcattcgaagacatggattcccttatcaatcaatgatggaacttctcacaccatgggaagtaaatattctaatgccacaacaggaagtgctgcttcaaacttggggtatcgcttcccttttgtgacagttcaggaggctacaaataatttcgatgagagttgggttattggcattggtggttttggtaaagtatacaagggagagttaaatgatggtactaaagttgcagttaagaggggtaatcctcggtcccagcaggggcttgcggagttccgaactgaaattgagatgctgtctcagttccgccaccgccatctagtatcattgattggatattgtgatgaaaagaatgaaatgatattgatatatgaatatatggagaaaggaactctcaaaagccatctttatggttcaggtttcccaagcttaagttggaaggagagacttgagatatgcattggagcagctagaggactgcattaccttcacaccgggtatgctaaggccgttattcaccgtgatgtgaagtctgcaaatatcctgcttgatgagaacctcatggccaaagttgctgattttgggctatcgaagactgggcctgaaattgatcagacacatgtgagcacagctgtcaaagggagttttgggtaccttgatcccgagtatttcaggaggcaacagcttacagaaaagtcagatgtgtattcatttggggtggttctgtttgaggctctttgcgctagacctgttattgatccaacccttcctagagaaatggtgaacttggctgaatggagtatgaaatggcagaaaagagggcaattggagcaaataatagatccaactcttgcggggaaaatcagaccagattctcttaggaagttcggagaaaccgctgaaaaatgtttggctgactttggcgttgacaggccttctatgggagatgtcttgtggaacttggagtatgctctccaacttcaagaggctgttgttcaaggtgatcctgaagaaaatagtacaaacatgattggtgaactctctccacaggtcaacaatttcgaccatgaagtaagtgtttctgcggcacaatttgaagcaacaagtctcgatgatctgtctggtgtttctatgagtagagtattctcacagctggtgaagtctgaagggaggtga

SEQ ID NO: 91093 - DNA, 942 bp, Glycine max
  Peptide Sequence Number=SeqID_207871
atgcattcattctttttattcctcaacctctctactaagcttacttcttcccgatccaccttcccacgcgccatgtacacacaccgcaacgcctcgctctcacgcgccgccgccgactccctcggccatttcctctctccaccggacgcatccacggcgtcgccaatgcagtactccgccgccgctcaccaccaactcgggctgggcgagtttgacaactcggttcacgaactcaattactcggagatgagttcgagtaacacgtacaacagctgcagcagcgggtgcacgagctacatggggtcgccgagttcgctggcgagtaattacgagagtcggcgagtagtgcagaggagcgttagcagccactcgctgcagaagaatggtagggcccaccaccaacccttttctgagttctctcctcttttcgttgagttcattgactcggaaaacggtcccgtacggagagcttgcagtaccggtgaccttcagagattcaatggaatgcaacattttcagcattctgatagctcattgtcaagtgaaagtagtttgatcattgaagaaatgagcagaaccagtccttatagcccagaggagaagaaggtgaggattgagagatataggaacaagagaaaccagaggaacttcggcaagaaaattaagctagctagtaccctcattactgtaacgtctaggagaggaaagaaacaatatgcttgcagaaagactttggcagatagcaggccacgtatcagagggcgatttgcaaggaatgatgaaactgctaagaaccctccagctcagtggagtcacatgggaaatggagaggaagaggatgaagaggaagagaattgggctgatttctttgattccttagttcctgcaaatattgctcaggagcctcaaggcagtagttcctcctttggtgtgttctattaa

SEQ ID NO: 91094 - DNA, 966 bp, Glycine max
  Peptide Sequence Number=SeqID_207872
atggaggctcagcagagaagaggaggattagtgccgctgtcgccgtcgcagacgccgcgctccggcgacaagctggcgcgagatctgcgatctgcggattccaattcgagcggtcacagcaaattcgataaggacaaaggcgtcaatgtgcaagttcttgttcgttgcaggccgttgagtgaagacgaagcgaggttgaacacgccgatcgtgatttcgtgtaacgaaggtagaagagaggtttcggctgtgcagaatatagccaacaaacagatcgatcgaaccttcgcattcgacaaggtttttggtcctaattccaagcagaaagaactttttgagcaggcaatgtctcctattgtgaatgaagtgcttgaaggatataactgcaccattttcgcgtatggtcaaacagggacaggaaaaacttacacaatggaaggaggtgcaaggaagaagaatggagagtttccgagtgatgctggtgtcatcccaagagctgtgaaacagatttttgatatattagaagctcagaatgccgagtatagcatgaaagtgacgtttctagagctttacaatgaggagataacagatcttttggcccctgaggagactttaaaatttgtggatgacaaatctaagaaacctatagctcttatggaggatggaaaggggggtgtttttgtcagaggtttagaggaagaggttgtttgcactgcaaatgaaatttataagatattggaaaagggttcagcgaaaaggcgaacggctgagactcttcttaacaaacaaagcagtcgttcccattccatattttctatcactattcacattaaagagtgtactccagagggtgaagaaatgattaaatgtgggaagctaaatcttgtggaccttgcaggttctgagaatatttcacgttccggtgcaagagaggtatcaaatgattttggtgtttattttgggtag

SEQ ID NO: 91095 - DNA, 1026 bp, Glycine max
  Peptide Sequence Number=SeqID_207873
atggtaggaaaaatcaaatattgggaggcgattggccgtgaatggcgcggtcttccactggcaaaagcaacaaagcaagcttccgagttccaaccaacaaagctatggcaaatgagaatggaatttcccactcttaaacttttcttcttcatcttcttactcctcacatcaacccatgcaagatccgcacccccaaccacaaacctattccgagaatacattggagccgagttcaacaacgttaaattctccgatgtccctatcaacccaagtgttcaattccacttcattctctccttcgctatcgactacgacacgtcatcatcctcctctccaaccaatggaaacttcaatatcttttgggacaccggcaacctaagccccacccaagtttccgccatcaaaaccaaacacccaaacgtcaaagttgccctaagtctcggaggagatagcgttgcaaatggctacgcttacttcaacccctcttcaatcgattcatgggtttccaacgcggtttcttcactcacaagcatcatcaaacagtacaacctagacggaatcgacatcgactacgagcatttcaagacggaccccgaaaccttttctgagtgcgtggggaggctaatcaaaaccctaaaatccaatggggtcatcaaatttgcctccattgctccatttgacgatgaacaagttcagagccactacttggctttgtggaagagttatgggaaccttatagattatgttaacttccagttttatgcatatgacaagggcacaagcgtggcacaatttatcgattatttcaacacacagagttcgaagtataacggtgggaaggtgttggtgagtttcatcagtgatgggagtggtgggctggcaccaaatgatgggttcttcacggcatgtcataccctaaagagtgagcaaaaacttcatggcatatttgtgtggagtgctgatgattccatgaaaagcggtttcccatatgagaagcaatcacaagcccttttagctataccctag

SEQ ID NO: 91096 - DNA, 1507 bp, Glycine max
  Peptide Sequence Number=SeqID_207874
atgaggtatagaagaacccatagaatagcagtggaagggtgtttgtgtttgtgtcgctcatggcattcatcatcgaaatggcggaggaggaatacagtgaacagcgagacattgtcgagatgtccatctgatttgattgccttctcccttttcctttggtcagcccaacgtcgccgccacgactcattcgccttcgatcgcatagtgactgtgctccgtcggctcactcaccgctacgacaccgttccagccattctctctcacttggagaccatcggctgtgcctctctcacaaaccctgtatctcagttggtgctgttgaggatttactcgcgtgcaggtatgtatgcgatgctcttggaggcttatcaccacttgcaagcctcttacgcttttgtccccgatacctttgctcgtaatttggtcatggacgctctctttagggtcggccactcccatctcgctctcaccctcactctctctctcttcaaccacactcatccccctaatttcttcaccttccacattttgctcctccatctttccaaactaaacaacaacaatctcaatctcaacctccctcacatcgctcgtatgctcagacttatgctctgggccggttattctccctctcctctcacttttcagatgcttctcaattctctttgcaagattaatgcattcccacaggcttatcagctcctcgctctcatgacggttctcgggatcaatttctctgtcaatatttggaccattctcatccataactattgtaaattcggccgccttcgtcttgctaacaacctcttccacaatatgcttcaaactggttgttctcctaatgttgtgacatataccatcttatttaaggcttttatgcaatccaacatgccaagccctgcttttcgattgtttaatgtcatgttatcttctggccaatctccggatttaattctttgtaatgtattaattgattgtctttcaaaggctggaaggtgccaggatgcaattcaagtttttctcagtttgtcagagcgaaacttaaagcctgattcttatacctttgcttcattgttatctacaatctgtcgttccaaaatgttttatctcttacctaaactagttctagtctctagacatgtagatgctgatttagtgttctgtaatgctcttttaagctctcttactaaggccgaccttccttctcttgctgttggattctatgaccatatgattgatgaaggttttgtgccagataaatatacttttgctggattactaagtgcactctgttgtgcgggaagagttgataaagcagttaatgtgtaccatggtgttgtaatgagttatcatgacattgatgctcacatccatactgtaataatagttggtcttctaaagaccggaaagtttcacaaggctgtcagtgttttaagatttgcagtaatgaataaatatccactggacactgtagcatacacagttggcatctgtgcacttcttagag

SEQ ID NO: 91097 - DNA, 927 bp, Glycine max
  Peptide Sequence Number=SeqID_207875
atgggctaccgcgaagacgaactgcgcggccgccaccacagcatgctggtgctgcccgaggaagtccgcagccccgcctacaaggaattctggcgcaagctgcgcggcggcgaatacgacaccggccaatacctgcgcattggcaagaacgggcgccgcgtctggatcgaggccagctacaacccgatcttcgatgcggagggccggccattcaaggtggtgaagttcgccaccgacatcacccgccgcttcaccgccgcgcagacgctgcgggtggcggtgcagggcctgaccgagaacgccgaacgcgccagccaggccaatacgctggcgcgcgacgcctgccaggtggctgaggaaggcggcaagaccgtggccggcgtggtagccaccatgggcaccatcaccgaaagctcgcggcgcatctcggagatcatcggcgtgatggatggcatcgcgttccagacaaacatcctggcgctcaatgccgcggtcgaggcggcgcgcgcgggcccgcacggcaaaggcttcgcggtggtggcggccgaggtgcgcagcctggcccagaacagcgcatccgcggccaaggagatcaaggacctgatcaccacctcggtccagcagatcggcagcggcgccgaacaggtacagtccgccggcgccaccatggagaacatcgtgacctcgtcgcggcgggtcaccgagatcatgggcgaagtggtggaggtctcgctggcgcaatcggccaagctgggcgaagtcaccgaggacatcacccagatgacggccgaggcggcgcacgaactgcagagcgcctatgaggcccaggaccgacccgaggcggcgcgcgaagcggcatcggcgcgagccgtggcgccccgcgcaccggcgtcctcgcaatcggggctggagtacgtgcgctactga

SEQ ID NO: 91098 - DNA, 1974 bp, Glycine max
  Peptide Sequence Number=SeqID_207876
atgtcccattatatcagggatagcaaattaacaagactgttgagggattccttgggcggtaaaaccaagacatgcatagttgctacgatatcaccttctattcactgtctggaagaaactcttagtaccttggattatgcacaccgtgccaaaaatatcaagaacaaaccagagatcaatcagaagatggtgaaatctgcactcataaaggatctgtattctgaaattgacagactgaagcaagaggtgtatgctgcaagagagaaaaatggaatttatataccgcgggatcgttatcttcatgaagaagcagagaaaaaggccatggttgaaaagatagaacgcatggaactagaagcagagtctaaggataagcaattgatggaacttcaagaactctacaaatgtcagcaacttttgattgtcgagttaagtgataaacttgaaaaaaccgagaaaagtcttgaagaaactgagcagtcattatttgatcttgaggaaaagcacacacaagcaaatgcaacaattaaggaaaaggaatttctaatatcgaatctactgaaatctgaaaaagcacttgtggagcatgcaattgagctacgagctgatctagagaatgctgcatccgatgtgtcaaagctgttttctaaaattgagcggaaggataaaattgaagaaggaaatagaatacttgtccagaaattccagtctcagttagctcaacagctagaagatttgcacaagacggttgcagcatcggtaattcaacaagagcagcaactaaaggaaatggaaaatgatatggattcttttgtatcaacaaaggcagaggctattgaaaatctaagagcgcgggtaggaaaatttaaaaacatgtatggttctggcattaaagctttgggcaatttagctgaggagtttaaaggaaatagtgagttaacttttgaagagttgaattctgaagtagccaagcattcatctgccttggagaatctttttcaaggaattgcattagaagctgattcattactaaatgatcttcaaagtagtctcaaaaagcaagaggccaagttaactgcttatgctcgacaacaggaagaggcacatgccagagcagaggagaatacacgtgcagtatctaaaataactgtgaacttctttgagacattacacatgcatgcatccaatatgatccaaattgtagaagaatcgcaatttaccaatgatcaaaaattgtatgaacttcaaaagaagtttgaggagtgtactgcgcatgaagaaaaacaactactggagaaagtggcagaaatgcttgctagctctagttctagaaagaaaaaactggtagctgtttcttttagacatgctaaactaacctacagtagcttccgttactacctgagtgtccaaatggcagttaatgatcttcgggaaagtgcaaacactaaaatcagtaggctgaggcaagaaacattaaccatgcaagattccacttcttctgttaaatctgaatggaaacttcacatggaaaaaacagagtccaactatcatgaggatacttctgcagtagaatctggaaagaatgaccttgtggaggttattcggcactgccgcaaaaaggcagaagtaggtgcacaacaatggagaaatgctcaagaatccatacttagcctggagaagataaatgctgcttctgtgaatgctattattcggggaggaatggaagctaatcatctcctacgagaccgattctcaagtgctgtgtcaactacacttgaagatgcagaaatcgcaaacaaggatattaattcttccattgaacattcattgcaacttgatcatgacgcttgtgggaatctaaactctatgattatcccatgctgtggtgacttgagagaattgaaggggggtcattaccacagaattgtagagataactgaaaatgcagggaaatgtcttctcagtgaatacacg

SEQ ID NO: 91099 - DNA, 531 bp, Glycine max
  Peptide Sequence Number=SeqID_207877
atgaatagggcgagaactgaaggcataactttcacgaaggagccgttcatggaggatacagggcctcgcaagataaagaacatgaagttctccacgttatcagaatcggaaataagcaaaatcgctgaagttcaagtgtggaaaggttcctactatgactcctttaagaagcctatccacggtggcttgttggatcctcgcatgatgcagtatttcaatattaggttttggaaggtggcttgtggtgttataattttagttactgggtatactatatggatgaagaaattgccaattcaatttgcaattcttattgactggaattaccagggttgttgtttggaccttgagtcaactttatttgtaaaagagaaaggccctgctaataagagtcttgtctgtgcaacatgcgatgggaactttcatgattgtccagggcactatggatacttaaaccttgcccttcctgttttcaatgttggatatttaagtaccattgtggaaatactgaagtgcatttgtaaggtataa

SEQ ID NO: 91100 - DNA, 453 bp, Glycine max
  Peptide Sequence Number=SeqID_207878
atgtggaaaatatggattaccattgttctggtgtttactttgtatgagctatgtgctaacacaggctcaagatttggttcagtaaagaagcttccggcttcgctgacaatcatacatgattgctcaaaatgtagaaattatattgttgaagagcttgattccgcactttctcgtatgaaagactctagggcgaccaccaatgtgtctaatcgaattcttaatcctttccaagttctttccctgtttaaaagaatgcttgatgaggactgtgaattactttatgttgctgaaagaccagagaaactcataatgacaaacgttgttgtgccacctatagctattcgaccttcagttgttatggatgaatcactgagctattcttctaaccggcagcaaggtattggagttgtgggaaatagggatatgaattatttcagatttgtgaatgtatag

SEQ ID NO: 91101 - DNA, 804 bp, Glycine max
  Peptide Sequence Number=SeqID_207879
atgatgcagttgccggaaattgcgactgaaaaaggtgaccaatgtgtcgcaacacatcggaagagcttctggcactgccaatgctgtttggctcgcctaggaaacgcacgtgagagcgcatctgatgtcaaatggggatgctgtcgacagggttgggcagatcagggagagatggcggccgctggaacagtagcggcaatgttcggaaaagttgggaaagaagaaagggtcatcgaaaagcagaagcatgccaccagaataagtgtgacgctgttcccggtgggggatgctttttgttattccctcaacctagagctggttgcaaagagtataaaagttgttatgacttcaagatcagcatcagttgttatcacccttgacatgaaaagaatccaggatgcacatctaaatatagatgctaatattgtaaaagaatcaattttacgaactaaaaagacaaaactgaaaccagagcatatcaagattttagatattaaaaagcttgaagtggttccccaagatgtggatagaagtaaaatccattttcagcttcactatctgaaaaatttgcttccgacagttgtagtgaagggcattaaaactgtggatcgagttgttatcagtaaagacaccaaggctgaaaagttcagattactggtggaagggttagttcatcctatttttcattatgacttgtgttccttcaatccagttcaatacctgcttgcttggatgcatattatatggctttttgaggttggggattttgatacgtattgtatcagagggaagctgcggaattag

SEQ ID NO: 91102 - DNA, 291 bp, Glycine max
  Peptide Sequence Number=SeqID_207880
atggatttcgttgttcctttccttcaacggctcctatccgtttttgggagccactccaatcaactcattgccaaggtcgagatgtgttttaccgttcaaggcacacctccagcgatgtgtcttgagcctgctcagatctccatggaggagaacaagtgccatggaggaggccacatgggaattagctcattcaatcaaaacaaggcccaaaagggcaaatgcatcctaggtgaaaagaagttagttagaggtgagactgtgagtgaggggtctgttatatgggggggttga

SEQ ID NO: 91103 - DNA, 1353 bp, Glycine max
  Peptide Sequence Number=SeqID_207881
atgactactgtgtatgtatgtgataccaccattggtgaagaattacgtgagcctttagtacacgaaggcaaccaaggaagttcaggaaatggcaacaaagatggactgttctctgtgctactgagagactatagagcacatgctgctgcatcttgcatgaatcgtttagctaaattgagggatggatcaatgcaagcccgagctctgctgtctgtgtgcctttgcaaaatcaaactgatgctgcaagggaaagtgaaatgttgtaagagcaaaaatgctaaaaacatgatcattttacttggatgcagtgcacgatggattggcaatcatgggttctcaataggcattgatgatgtccaaccaaaagagattctgattaacaagaaagatgaaacaatttcagaaggttatagggaatgtgataaacacatagaagctttcaataagggaaaactagaactcttagctggttgtgatgctgcgcagacattagagactcggattactggggtattaaatggacttcgtgatacggcagggaaggtctgcatgcaaaccctacactggagaaatagtccattgatcatgtcacaatgtggctccaaaggatcttctattaatatcagtcaaatggttgcctgtgttggtcaacaatcagtcggtggtcgtcgtactcctaatgggttcatagatcggagccttcctcatttccccagaaaatcaaaaacccctgctgcaaaaggttttgttgctaattccttttacagtggattgtcagctactgagtttttcttccatacaatgggagggcgagaagggcttgttgatacagcggttaaaactgcagacacgggatatatgtctcgtcaattaatgaaatccctagaggatttgtttttacattatgattatactgtaagaaatgctggtggctctattgttcaattttgctatggagatgatggcatggatccagcaggcatggaaggaaaaaatggaaaaccattgaattttgagcggttgtttcttaaaagcaaggccatatgtcccaatgatgaagatgatgaaattttatcttcctcagatgtgagtaaagtagttcatgagaagctctcagaatttgatatgtctaggttagcagagaaaggggtttttgaggtgggcttctctgctgacttcgttgaatctctacaatcctttatcaaagataatgcaaaattaacggaagaaggtttcactgatgagcattctcaaaacctgaaaaaatttgggcagaggatatctgggatcactcgtaaacagctagattcaatacagagagatttgagagagaaaacgggattaagtttttag

SEQ ID NO: 91104 - DNA, 492 bp, Glycine max
  Peptide Sequence Number=SeqID_207882
atgtttgtaatgcatctagggaggggggttggttcaggacttcaggggcagtatagaattgaaaattggatgtggagcaaagaaaaataccctcgtatatacaatatatctcagcagcaacagaattcaattcagcacatggggattgcaacagcaggaggatgggaatggtgcctacagtggagaaggctttttagggaagtggaagtggatacagttgcaaaattcatggaggatattcaagctgtgacagtgcaagttaatcagcaggatagttggggatggaggctagaaccttgtggggtttatacagtgacactgggaagtgcttacaaagtgttagcatcccaattatcagaagacaaatttgatgaggtatttaagcaggtttggaagctcaaaattccaagtaagagactaccaacaaaggttaatctgagaaggaggactgtggagctgaatgatcctgagccctttctgcagatcgaatga

SEQ ID NO: 91105 - DNA, 639 bp, Glycine max
  Peptide Sequence Number=SeqID_207883
atggctcgtatattgacttatcctgagcgtgttactcaccacaacatagaaaagttgagacaatgtgtgagaaatggtcccgataagtatcctggtgcgagaatgcttagacgtgatggaggtcactcatggtccttaaaagttctttgtaggaagcgtgctgcagatgaattgaggattggtgatattgttgatcgccatttggaagatggagacattgttcttttcaatagacagccaagcttgcatcggatgtctataatgtgtcacagggcaaggattatgccttggagaactttaagattcaatgaatctgtatgtaacccatataatgctgactttgatggtgatgagatgaacttacatgtcccacagactgaggaggctaggacagaggctattttgttgatgggggtggaaaacaatttgtgcactccaaaaaatggcgagattctggttgcttctactcaagactttttaacatcttcctttctcataaccaggaaagatactttttacgaccgttctaccttttcacttatttgctcgtacataggtgatggcatggatcctattgatctgccaactcccgcaattgttaaggtgagagttggagcttataaatgtgacattcactag

SEQ ID NO: 91106 - DNA, 465 bp, Glycine max
  Peptide Sequence Number=SeqID_207884
atgcagcagagatcttcgagctcaagcttgcgctgttccggcgacgagcacagagccatcaacgtcggtgcagagatgcagcagcagcaacacacaaagcgtagaaggaacctcgacgaagattcgcttccaatttaccaccggagcctcaccggaaggagggacactttccggtcacgctcgccggcgacggagaaaggcatccacgcgatccctgcgcttgttctgctgtgcctctttactctctggtggttctcttttccagtggatgtggagattaaagacggtaggattacggcgatacgacagattcacacatcagtgcctcacaatactcgaattgatcttaccatactcgcagttgctgcgtcatcaccgattcctgcaaataatcctcaaaacctgtcaggcgaggacggaacttacttgcaacctaaattcacgcaggatccgttaaatgtgtga

SEQ ID NO: 91107 - DNA, 1485 bp, Glycine max
  Peptide Sequence Number=SeqID_207885
atgggtggagacagtgctctgaaatccggacaagtatcagcgatgataaagcagggtttcatacccgcccctaacctctctttctcaccttccagaaccttctctcctcctccttcctcaactcgcccgagtcagactcagtcccaccctcacactcagactctcttcaacatgatgtcggaggagcacaaattctccgacgagaagcgccgaaatacgcatgatcgggtctccaggctcctcgacgagcccgccctgcgctccgccagcggcgacgtcaggctcacggtggtcggcagggacggcttcagggtctccatggaggtccgcaagacagtcctcgccgacaagagccgcttcttcgccgacaagcttcgctgctgcggcggcggcctctcccactccgtcgagatcagcgactgcgacgacgtcgaagtctacgtcgaggcggtcgttttgatgcactgcgacgatctcaagccgaggctgcgctccatggctgaaggagttcccaagattttgagcttgctcaaggtttcatcagctatcatgtttgacctaggggttgtctcatgcctggaatatttggaatctattccgtggaccgaggatgaacaggaggaagtcatatctcagctagaacatctgcagattgatgactctgcaactgaagttcttcttagagtatcatctgatccatctactgctgatagagctgacgacatcttcttgaacctgctaagtggcgttctacaagcaaaagatgacaaagctcgcagggaaatgaaagctctgttatctagattgcttaaagagaatgtgtctaacgatagcagcagacttgatgtttccaaagacacactttatcatctttgccacaagtgcatcagttctcttctcctatgcctgtccgaagcaaccagcagcgatgagaagctggatcggggggctataataagcgacataactcgtgaagctgacaatattcagtggattgttgacattttgattggcaaaaagatgagtgatgaatttgtgaaaatatgggcagagcagaaagaacttgctacacttcactcaaagatttcaacagtttaccgccatgagatcagtagaatcacagcacaactgtgcattggcattggaaggggacacatactggtgccaaaagaaattcgattttccttgttgtcaacatggctagaagctctatatgaagattttggatggatgaggagagcttctagagctgttgacaggaaattgattgaggatggactaagccaaactatattgacacttcctttactccaacaacaatccgtgttgctgaattggtttgatagatttcttaataaaggagatgactgtcctaatattcagaaggcatttgagatttggtggagaagggctttcatcaaacagtattcagctgaacctgaaaattcccagttgcaaataactctctctgattaccccagctga

SEQ ID NO: 91108 - DNA, 1239 bp, Glycine max
  Peptide Sequence Number=SeqID_207886
atgggttggttttgttgccaagggaaatcaagcaaaaaatcggttgccgaagaagactaccgcgacagcctcgaccagaaacccaccaatttcaccgcgacagatagcgtaaaagttgatttcaaagtgaatgggaataaggaagatggttctaaaggtgatcaacttgctctggacgtgaagagtttaaatttgaaagaggaggtttctcaggatagaaaagataatggcaatcgggcacagacattcagttttaatgaacttgaagctgcgaccggaaattttagggtggattgctttttgggtgaaggaggctttggcaaggtttacaagggacacttggagagaattaaccaggttgtagctataaagcaacttgaccctaacggacttcaagggattcgtgaatttgttgttgaagtgttgacattgagtttggcagaccacactaatcttgtgaagttgattggattttgtgctgagggagagcagaggctattagtttatgagtacatgccattaggatctttggaggaccatttgcttggtagaaaaccacttgattggaacacaagaatgaaaatagcagctggcgcagctaggggtttggagtatctgcatgataaaatgaagcctcctgtaatatatcgtgacttgaaatgttctaacattttgttaggagagggatatcatcctaaattgtccgattttggcttggcaaaagtaggcccaagtggtgataagacccatgtttcaactagggttatgggcacatatgggtattgtgccccagattatgcaatgacaggtcagttgacattcaagtcagatatttacagcttcggggttgttcttttggagcttattacaggccggaaagccattgaccatacaaaacctgccaaagaacaaaatctaattgcatgggcaagacccttgttcagggacaggaggaaattttcacgaatggttgacccattacttgaaggtcaatatcccgtgagaggcctataccaagctcttgccattgctgctatgtgtgttcaagagcagcctaatatgcggcctgtaatagttgatgtggttacagctctaaattacctagcttctcagaagtatgatccacaacttcatcctgcacaaacctctagaagaagtccaccttctcagataatgaaaagggatgatgatgctcatagacatattttaagcatggagcatgagacagacagatcttaa

SEQ ID NO: 91109 - DNA, 570 bp, Glycine max
  Peptide Sequence Number=SeqID_207887
atgttggaagagaaaagaccaacaaagacaattcataggagagttagtcttgttgggtttatctatagtcactctagtaccttgagtttattgagacatttcacaaacaagagagaattggtaagacatacgattacaagattttggaggttaataaagggctgtatgcttgcatcaagaggttggtgccaactgccaagtaaagaagtgcaacaaaaaattctgattgagttgccaatttatcagagtgctgctcaatggtggaaaatgtatggccaagaaactctaaacttgcagaagctagctgtcaagattttgagcttgacatgtagcacatcgggatgtgaacacaattggaatgtttttgagcaaggaggaaaactagcagcaaaaaaagaaagcagccatcaagtggtggtattattattggagctgcccaagcttccaataaagaatttgagagccgagtctgaggcaattgaagaatctggagaagaggaggagggatatgctccattggatatgaatgaaattgattatgatggaattgaggaagagccagaggattag

SEQ ID NO: 91110 - DNA, 366 bp, Glycine max
  Peptide Sequence Number=SeqID_207888
atggcttctagaaagagaaagagcattggtacaaggcccaaatctcaatatgacacaaggagattcgcttcattagatgcttggaccagatacactgataatgttctgggaagaaacattttacctgaaaggaaagtagagctatatcacactgagctagatgactttaaggccgagctggagaggtgtaatttccataaatgcctcacccttttagccaatgggagcatagacctggctttggtgaaagagtgctatgcaaatttatacaattctgaggactgtccaccaaagcaatccagagtcaaaggtcatttggtgaaaattgatgctaacagtctcaacacattcctggagacacctgtg

SEQ ID NO: 91111 - DNA, 1345 bp, Glycine max
  Peptide Sequence Number=SeqID_207889
gttcacttctcctgaggcctgggaaaggtacactgacattgttgtacctaggaagctacttccagaaagaaatgttgtaatctaccacagtgagtttgatgagttcaaggaagaattggagagaagaaaatgggataaggagttgaccagttttgatgaaggcagcattgatgttgccattgtgaaagagttttatgctagcctctatgatcccgaggataaatcacctaagcaggtgagggtgagaggccatttggtgaagtttgatgaggacacgctgaataccttcttgaagacccttgtaatcatcaaggatagggatacattattagcttactctagatttgcactcttgaggcctgatcctcaggagttggcagccatgctctgcatcccagggaggggatttgagcttaatgttgacggcttgccactgaagatcctcaggaagaacatgaccacactcgttcagacttggagttttctttcttactccaacttggtccctacctcccatacttctgatatcacactagatcgggccaagtttggatttccagccttaatcacagctttgtgtaaagctagaggagtcacatcaaattctagatccttggagagccttagccctgccattaacttggcatatataaagaagaattgttggaatctagatgatccaacagtgacattcagagggccaaggaaggccaggggtaagagatatgaggcttcccctactttagcaacaccagatacttttgctccttcttcatctactttaccagattctttagcaccatccacttcgactccacatcttccacagttaccagcttcagctcccactcccttactagctccatcagttccagctcctcctatagaaccctcctcattcacttcagagacattacttttcatgctccaaagcctgcacagagaccaaatcatcatcatacagaggttgcagagctctggccagcagccagctatgagtgtggaggagttccttgcacaggtggcttggccaagagtccagccttctccttcaggagggggtgaggcctccgcagcccaagagcttgtgccagcagaggagcctatgccagatgcagaggatgagcctgttcctcttgagccatttatatttgagactgatctagtcgctcaggaggaagcagtagctcaagagcttacttctccagttcttatctctccagcacctatatctaaagacaccatgccatcagcaccaaccatggagcaagagcaacccattcttcaggatgcaccagctgctccggtgctagatctaaacgagcatgcagaagatcagcaatag

SEQ ID NO: 91112 - DNA, 646 bp, Glycine max
  Peptide Sequence Number=SeqID_207890
cgttccaaccgtgctagttttaccatttccaggtcaagggcatgtcaatcccataatgagcctctcacaaaagttaattgagcatggatgcagagtcatttttgtgaacacagacttcaaccacaagcgagtggtgagttccatcatggtggatgagcaacaacaatataagcttgatgatgatgaatcactaatgaagttggtctcagtccccgatggtttaggacccgatgatgacagaaaggagcccggaaaacaatatgatgctgttgtaagaaccatgcctaggatgcttgagaagctcatacaggatactcatcatggggatggtgacaatagaattggtttcattgttgcagatttggaggttgggagtaaatttggaatcaaaggagctgcgttctgtcctatagcagcaactatgtttgccttgttatgcaacagccccaagcttattgatgatgggatcataaattctgatgaaaacgccactcgtagtggcgagttgcccagcctacaagttgccaccatgactggcgagttagggcagacttttggtgcaggctgcaaaaggggagttgcaattgcaacttgcgagttgagtgcaagttgcaactcccattggcaactctcattgtataattaa

SEQ ID NO: 91113 - DNA, 303 bp, Glycine max
  Peptide Sequence Number=SeqID_207891
atgtattgcttttctctgaaagagttccgttacacagatttcaaaagagatgaacttgttagactttatggatggatgaaaagagatgcagtggaacagatattggtgccacacttttctggtcgaaatcgtccagccctaccagctctttgtctagcagaagccctagatattggtgccacaatcagattttcaatatcagaaatctgttacaaagcacggaagagaattacacttggagacatcaagaaatctgagttagggagagaagaagagtggagaagggacagactccaaaaataa

SEQ ID NO: 91114 - DNA, 441 bp, Glycine max
  Peptide Sequence Number=SeqID_207892
atgaaatgggatatgcagatggaggaaatcgaagcgattatggagaaaatttgggacctccacgataagctcagcgacgccattcactccgtctccagatcccactttctcacttccgtcaaaaccctcaaactcaacaactctccaccgcaccttcccaacgccgccgtcgccgctgccgatgaccgctcctccggtttcgttttcgtcaaggactttagaccgctcgccgtcgccgataacgacaacgatgacgatgactccgccgtccgcgaagccaagagcctcaacgccatccggaccgccctcgagaacctcgaagaccagctcgagttcttccataagccaatttttggagttcaactggttcaagtaaagatggtgatggagctgagctctctgatcagttgtttccttttattcgatgttaagggaacttag

SEQ ID NO: 91115 - DNA, 255 bp, Glycine max
  Peptide Sequence Number=SeqID_207893
atgagttgggaggaaaacctgcaagaatacggaaggatcctgggagaagaagaggagcaaaccgccattggcaatggcgaattcgctgtgcaacgcccacgtggcagggaaaccgccattcgtgttggcgagttgatgacgtgcaggagagaggcagacctatatggtgcagctaaggtgcagcaggctttgactgggttggaaatcgccactatcactggcgttttgcttgttcaaaaaatttttggactataa

SEQ ID NO: 91116 - DNA, 654 bp, Glycine max
  Peptide Sequence Number=SeqID_207894
atggagaggcagactattcaaacccagcagcgtgttgagagagatgccgcaattgcacgcttagaacagagcagaattgttcttgcaatgaggctggcagaacaccgtggtaaaaagtataaagtcattgaagaagctcttgcttttattggagatgtacatgatgcaggcagccttgttgcgcctgatgttttctatggacaaccaaactgttgttctgctgagaatttagcgactgagaaagtgaagagatctaatattcttatcaatatttttgtctcaagtttcaattttgtgaagagatctcttggattggatcatatgggtggaatagtgggcaatgctgcattggttgcaccatttggacaagaaaatactgttcacagaaacagtaccgtgagaagaacgagattggttggttcttcatccgaagcccattccagtaatttggatgtattgttagctagagagattgtaaccatggacgaggttcacgttgaagaaattcaatctatcagcatcgtacagggtggactccaacaatgttgttggcaggatgacattaccactgttccattccacagcagaggagtcacaggtgaagcatgtttgacgtcgttagtgatgcaagatgttactaaaaatattctttaa

SEQ ID NO: 91117 - DNA, 1584 bp, Glycine max
  Peptide Sequence Number=SeqID_207895
atggccgaggaagccaaagccaaaggcaacgcggcattctccgccggcgacttcgccgccgcggtccgccacttctcggacgccatcgccctttccccctccaaccacgttctctactccaaccgatccgccgcccacgcctccctccagaactacgcggaggccctagccgacgcccagaagaccgtcgacctcaagcccgactggcccaaggcctacagccgcctcggcgccgcccacctcggcctccgccgccaccgcgacgccttctccgcctacaaaaccggcctccaactcgaccccgacaatgccgccctcaaatccggccttgccgatgcccaggccgccgcctcccgccctccccccaccagccccttcgccaccgccttctccggccccgacatgtgggcccgcctcaccgccgaccccaccgcacgtgccaacctccaggaccccgagttcgtcaagatcatgcaggacatccagaaggaccccaacaagttcaacctgcatttgagtgatcagagagtcatgcatgccattggggttttgctcaatgtcaaaattcaaacccctaaccacgacgaaaacgaccacgatgccgatgatgacgtgtccgaggatgaggttgtttcccagcccgaacctgaacacgagcctgaagcggcggtggaagtggcggaggaggaggaggaggaggagaaggagacgagggataggaaagggcaggctcagaaggagaaggaagctggcaatgctgcttacaagaagaaggattttgaaaccgcgattggacattacagcaaggctttggagttggatgatgaggatatttcctaccttactaatcgtgctgcagtttacttggagatgggaaaggatacgttgtgttctttaataatgaaaatgatattcaagtttgaggactgcataaaggattgtgaaaaggctgttgagaggggaaaagaactaagatcagattacaagatgatagcaagagctttgacaaggaaaggtactgcattggctaaaatggctaaatgctctaaggattttgaacctgccattgagattttccaaaaagcacttacagagaaccgcaacccagacaccttgaagaaactgaacgaagctgaaaaggctaagaaagaactagagcaacaagaatattttgatccaaaattagctgatgaggcgagagaaaaaggaaatgaattattcaagcagcagaagtatcctgaggctacgaagcattatacagaagctataaaaaggaacccaaaagatgctaaggcttatagtaacagagctgcatgctatacaaaactgggggcaatgcccgaaggcttaaaagatgcagagaaatgcattgagcttgatccaaccttttcaaagggttatactaggaaaggtgcagtgcagttttccatgaaagaatatgacaaagctttggaaacatacagggagggtttgaaacatgatcctaacaatcaggaattgcttgatggcataagaaggtatggtatcgtgctacattcctgctatttttgggttgaatattgccactttccatatgcaccatga

SEQ ID NO: 91118 - DNA, 321 bp, Glycine max
  Peptide Sequence Number=SeqID_207896
atgcggcatgatcatgcccagcatctggtcgggcacatgaaactctttggtacggtcaaaaaagacatagatgcagtccgctttgccacgcgtatcacgcacgccatacaccagggattgtgcgtgaatgccgctggcatcaaagcgattgacgatataccacttatcctcattctctacccatcgtttgtagagattgcacatcaggtaattgacgatggccgagtcctccagcaggcgttgcgtggtcagctctggaaaagaggaggaaacatcaaaatgcagatcgccattactgaagtcgccccatgcaaccagtaa

SEQ ID NO: 91119 - DNA, 258 bp, Glycine max
  Peptide Sequence Number=SeqID_207897
atgttgcggtcacagacggtagctattgtcgccgccgctgctgccgccatcgctgtcgccgtccgtttgtcgtgcgcgtgcgctggtgcggggtgtcgtcgtcattggtacgtggtgctagtgctgtcgtcgtgctggagtttgccgtcgtcgtcgtcatgttggagttcgcatggtaccgctaatcgtgctggagttcgcgtgttgccgttcgtgctcgcactgctcatccccttttgcatgcgaaaatcgggttaa

SEQ ID NO: 91120 - DNA, 188 bp, Glycine max
  Peptide Sequence Number=SeqID_207898
atgcgtagtgattgcctagtgcaatcctccattctccaatgtgttcttcaccgtcaagtgcggaccctcttgactgggaaatgtgaaaaaaggagtagagacgagagtcgttatagactaatcacggaaagggcaagacagacgaaatcagtgtcttatctttgctttcctcttatctccgataaaag

SEQ ID NO: 91121 - DNA, 192 bp, Glycine max
  Peptide Sequence Number=SeqID_207899
atgacacacttgttggcagactcaattacctcgatttcaccagaccagacatcccctttgcagccattgggatgctgcatggcatcatcagatatatcaagaatgcaccaggtcgaggactccgatatgaagacaaaggcagtgccaaaattggttgttaagatcaccatcagacgggggcatagttattag

SEQ ID NO: 91122 - DNA, 792 bp, Glycine max
  Peptide Sequence Number=SeqID_207900
atgtcgaagatacttgaaagcttgtttccttacccctgcctatgcatttacctcattgtctacattgatgatattgtcatcactagcgacgattcagctaagatccacaatcagtttcagacgaaagacctagtatgcttgattgtcgccctaacaacactccaatggattctactgccaagcttcttctgggtcaaggaggccactagaagacacaagtgtggaaacgttaaaagttgctttaagtgtacaacggaagtcaaagaagagcttctgaatcttgctttagagaaagaaaagagagaaaattctgagatgccaaatgtggcctatgatctctcatctgatgatgaaattcaaattcctgcagcagctagcaatgttaaaggcaaaaagaatgttgctaaaaaagggcccatggatatgttttgtagaaatccaccatctgaaatatcgaagagacagaaggacaaactaaggcaagctaacattaaagagttatgtgacaaaactttgaaggcagatgttcatcagtacattgctcgtttttgtggggcagacacggctgttctattgtcagatgcatggactgactggaagcaacgaagcattattaatattctggtgaattctcctgcagggacaatgtttgtgaagtccattgatggctctaaatttgtgaagacaggtgaaaagctgtttgagttgctttattcccttgtagaggagattggagaacacgatgttgttcaggttatcacggataatggaagcaattgtttaagctggtag

SEQ ID NO: 91123 - DNA, 252 bp, Glycine max
  Peptide Sequence Number=SeqID_207901
atggcaacaactgcatacactccagacaccaagctcatatgtggcaatcaagttgttctccacatcgcatccaattcagtcttccaggaacaaaccaaccacattgagatagactgcgattatgcaagggagaaggtgcactcaggggaaatcaccactgactttgttagctccaaagaccaactggcagacatgtttactaaatccttcaaggtctctcatgttgactacatttgtaacaagctgggttaa

SEQ ID NO: 91124 - DNA, 381 bp, Glycine max
  Peptide Sequence Number=SeqID_207902
atggaacgacaacctgttcctgcatcaaagaaccctcaaagcctctgtctcagcactagaaatagcgaagcgaaaggagagagtgggagagaagatattattgtggagatgctgacgtgtataaaacgaaggcgtgaatggctcggtgctccacgtggaacgctgggcccacgtgatgtggcgcgttcgagacgcgttgatttgcagacgtggacaaaatcaaatgctgcgaggttatgtacaccctttcgaatccaatacgatcttccagatctggatcccaccacgtggctcactcatctctcgtataaaggttctcccttcaaacccacaagcccccaaaacgccctcgttttggttagagatgaccgtgtctactaa

SEQ ID NO: 91125 - DNA, 513 bp, Glycine max
  Peptide Sequence Number=SeqID_207903
atgtcgtcttcatctgatgacgagactaagttggagataaaggtagaggctggcgtgactttcttcattagaaagctaaaccaagaatgcatcggagttgtagccacttggagtggtggggtagtgagagaagttccgttttcttcttctccgttaccgtttcccgcaacgaaagacacaaactccgtgacggacttgacgacacttttgacaaccaagatcgtgacgaggcccctcttcggaggaagcgtttgtttgttgttggatcgggttgctgtgagatccatacttgagacagatggggtacgaggaatcgcaaaaaacgagacccacggtgaacccaccgcacaagattctgaccctgtggcgatcgcggatgatggcgtcgtggtcattcacacgatagaggataaggatcacagtggtgagggcgatttagcgaacaggttcagggaagggtttcatgtgacggggtgtttttggcttgcggtggttacgattggatataagtga

SEQ ID NO: 91126 - DNA, 1030 bp, Glycine max
  Peptide Sequence Number=SeqID_207904
atggaaaacaatggtgctgaatctgagaatccgaaagggattccaattcacggagggaagtacgttcgctacaacatcttaggcagccatttccaagtctattccaagtacgctccccctctccaacccgttggtcgcggcgcatacggcatcacgaaagaaggagtggcgataaagaagattgggaatgcgtttgacaacaggatcgatgccaagagaacgctcagggaaatcaagcttctctgtcacatggaacatgataacataattaaaataaaggacataattcggccagcggagagggagaatttcaacgatgtttatattgtgtacgaattgatggacaccgatctgcatcagattatacagtctaatcagtctctcaccgatgagcattgccagttcgtgatagttagtgtgggtgttagtgcaaaagaaaagaatgtgattgagtggatgggtgtaaagcctggatgcaggggtgatggattgaagtacatccactctgcaaatgttttgcaccgagatctaaaaccaagcaatttacttctcaacgcaaactgtgatctcaagatatgtgactttgggcttgccagaacaacctctgagaccgactttatgacagaatatgttgtcactcgttggtacagagcccctgaattgctactaaactgttcagaatatactgcagctattgatatttggtcggttggttgcattttgatggagatagttagaagggagcctttatttcctggtaaagattatgtccaacagttggcccttataactgagttaaaacaagcttccaaagaacaaattcctcataatcatctctcaaaacagttactaggttcaccaaatgactcggatcttggattcctcagaagtgataatgcaaagaaatatgttaagcagctcccacatgtagaaaagcaatccttcgcagagcggtttcctgaaatgtcccccttagcaattgatcttgctgagaaaatgctggtttttgatccctccaagcgcataactg

SEQ ID NO: 91127 - DNA, 303 bp, Glycine max
  Peptide Sequence Number=SeqID_207905
atgaggatacatcgaaatggagaagctatccaccttccacaatcagcagaaaaaagactagcacaacaaggacagaacgaaactcatcccagacaaatccttcaaaaagtcaagctggcagccgaagacaagatagaggaaggtgtccttgccaacaacaacagaggcggctatcgaggccaaggaaaccaatcccacggcaacaacgtaggcggtttcgctgggggaggtagcaccaagtcagcctggaagagccacttacgcgccatcaaaagcgtgaaccacttttccacagtgagttga

SEQ ID NO: 91128 - DNA, 243 bp, Glycine max
  Peptide Sequence Number=SeqID_207906
atgcctcatttagagcgcaccgttaccagaactaacagcagagctaaaacgcccccacgaaagctcccacccccgagggggctggtcaagattagggttttcaaaactctcttcaagtctgcaagggcatttgcgtctttgaccacctctactactactggagatgctacttctcacactactactcgtacctccccttcttctacctcacccattccaagtggctacaactccgacgactga

SEQ ID NO: 91129 - DNA, 582 bp, Glycine max
  Peptide Sequence Number=SeqID_207907
atgaacacgttttcacatgtaccaccaggctttcgatttcatccgaccgatgaagaacttgtcggttactaccttaggaaaaaggtagcgtctaaaaggattgatctagatgtcatcaaagatgtcgatctctataaaattgaaccatgggatctccaagaattatgcaaaataggaaccgatgaacaaagtgactggtatttctttagtcataaagataagaaatatccaactggaactcgcaccaatagagctacaaaagcaggattctggaaagccacgggaagagacaaggcaatatactctaagcattgcctcattggcatgagaaagactctcgtgttttacaaaggacgagccccaaatggacagaagtctgattggatcatgcatgagtacaggctagaaactaatgaaaatggaacaacttctcagagtgctaagagtattctaaccttccatacaaatatagcagaagaatatcaccgcataatgcattacgcgactatactctccaccggattaatgcacagtactaatatgagaataacgagtgtagctcttgccttagatgaaaaatag

SEQ ID NO: 91130 - DNA, 1470 bp, Glycine max
  Peptide Sequence Number=SeqID_207908
atggagtggccagcatgtaccgatgagtacgagaaactcgtaattcgcatgagcacccccagggttgtcatagacaatgccgtgtgctccactgcgacaatagtcaaggttgatagcgccagaaagcatgggatccttattgatgccgtacaagttctctctgatcttaacctttcaattaagaaggcttacatttcttctgatggcaggtggttcatggatgttttccatgtcacggatcaaaacggaaacaagctcacagatgagagcgtcttaagctatattgaacagtcacttggtagcattcacaatggaaaaaccagtcactcaaacggtctcacgatccttgaattaaccggcactgaccgcgttggtcttctttcggaggtgtttgctgttctggctgaacagcaatgtgatgtggtcgatgctaaggtttggactcacaatggccggattgcctccttaatctacgtgaaagactccaattctgagactcctattgaggactctcagagaatcagtaccattgaagcacgtttgagaaatgttttaaagggtgacaacgatattaggaatgcaaaaacttccgtcactaatgctgttttgcatgccgaaagaaggttgcaccaaatgatgtacactgaccgtgattaccagaggaatcccattttcaaattctcttctgataccccaattgtcaccgtccaaaattgggcagaaaggggttattctgtcgtcaatgttcagtgcaaagatcgagttaagcttttgtttgatgtcgtgtgcaatttgacagaaatggaatatgttgtgttccatgccactatcaagacaacaatcgaccaagcgtatctggagttttatataagacacaaggatggcaccccaattagttcagaaccagagcgacaccgtgtgattcaatgcttgcaagctgcagtggagagaagggcatttgagggtgttaggctagagttatgcaccgaagacagacaaggacttcttgcagaagtgatgagaactttccgagaaaatgggctgaatgtgacaagggcagagatatctaccataggggacatggcatcaaatgttttctatgtaacagatgcgataggataccctgctgatccaaaaatcgtggaatctgtaaggcagaaagtagggttaagcaatttaaaagtcaaggagttgccattggtatgccatgagaaggcagaaagggaggatcaaccagttggggttggtggggcagtgttactgtgtctggggagcctcaaaggggcggaatttagtagtgtgggaagatatttgccactttcagagcacaaatattctttgcttgaggtgaaaactgattcatatacagctggaggggattgtgtccccacccttttaaatgctctgcgtgaagagggggaagtatttaagagagtttggagttgcaaaagaggttgtcggccatggtaa

SEQ ID NO: 91131 - DNA, 531 bp, Glycine max
  Peptide Sequence Number=SeqID_207909
atgggcaccacatggcctcctaggtcctacacctgcaccttctgcagaagggagtttcgctccgcccaagccctcggcggccacatgaacgtccaccgccgcgaccgggcccgcctccaccaagctccaccttcctcctgctccaaccccatgtcctcttctcttcccacttcatccttcatcaatatccctcctcaagagcttgttggaaatgctggcttgtgcctcctctaccacttgcccacgagccctagtagtgcaccacccttcccttcacccacttctaatggggcttctccctccactcttctctctatctcctcctatcctacaaacaactttctgatgcaaacttcctttaattttcccggtgcacccccaactgggatcaatactactactgtttcctctttgtgctataactctagcaaagtggaacaatccgcaacttcttcctctattgataatggccacctcgaagagcttgatctagagctccgcctcgggcacaaaccaacaccaacctcataa

SEQ ID NO: 91132 - DNA, 210 bp, Glycine max
  Peptide Sequence Number=SeqID_207910
atggttgctccttgcctatttcggaatgcaaaatggaaagtgcaagaagcaataaaaggagtacaggaagcaagttgtcgacgtcttattccttgttactggcgacgaggttggcctggcgagttccctcgtagtgcagcgttggcaacaacgacaacttgcagtgagatagtggtcgggtcgagcgtgaagatgaagagaagtgattaa

SEQ ID NO: 91133 - DNA, 318 bp, Glycine max
  Peptide Sequence Number=SeqID_207911
atgaattcaaaggcagaagcagaaaacgaaattttattctacgagaacagtgcgcgtgaacagccacttgatccaacagttacaagtgatgattctgaacatttgagggcaaatgttttccaagaagaaggaaatgataagaatcccgaaactgctgaaatacaaggacctatgatcacgagtaggatcaaacagtcagtggataccctccaacaaatggtagcagacatatttaacaaggtccaagtggagaaggatgaaggcccagaagcagaggcactactaagcatattaatcgttaccaaaggcctagactaa

SEQ ID NO: 91134 - DNA, 375 bp, Glycine max
  Peptide Sequence Number=SeqID_207912
atgtgggtgtcgagggagcggtttccggcagatttcaggtgggaggagaaagagaagagctatttcaggcaggaggagaaagagaagagcgagtgcaaggtagaccctgcaaaaatagctgttatttcacaattgccttacccctcttgcgtgcgagagcaaagtggcccttccactatccaatctgctgcaaaggaggtggagtttgattttgatgaccagtgtaaagaggcttttgattgcctcaagcgtgcgatgactaccacccctatcattcaggcacctgattggaaaaccccatttgagttaatgtgcgatgcatccaattacgcattgggggctgttcttgctcaaaagattgataagctgcctcgg

SEQ ID NO: 91135 - DNA, 1944 bp, Glycine max
  Peptide Sequence Number=SeqID_207913
atggggaacctcatacttatagtgtggagagggagttgtgggtccttgttgataggggttgttaccatgagttggggagcccagttacaagggcacatcgtctatgcacctgtgcgagggctgacgtggaggggtctaaaccaacttgcgggcgaaagagattatccagtgtcgaaggagattgtcctgcgtcaagggagattgtctgatgtcgggggtagtaactttgacaatggtatcctcgaaaggtgtgaaaatgcagctttttcaagcttgtcaagcccccgagcctggacaagtttcgtttggcctacttttgtcgagttgttcggggtagacatgctcttggttttgcaagcgaggtctgacgtgtcagaagacactcgccacggtgcttctgaaaatgaatcttcttcctatgagaggttgaggatttcatgtcgtactggtgaacgcatttctcgcattcgcagaagggcgcagcctcctactgcttccctagccgaggaacctatctcggtcactgtgattcaccctccttctatttctgggggagcaaggagaagtggtagggatgtaagggacgatgttctgaagtacaggtccttcaccacctctacggccagcatcgttgcactgcaacgccaagtaaaattagcaagccctgaggactcatacaagatagttgttcaagcttgtgggagtgatgactttcctttcttgagatgtctgtttgaggtcttggatcttgttttccccttgactgcattccagtgtgctctgcttgagcacttgaatatcgctccttctcaactccatcgtaatagctgggccatgggaaagattggttgggtctccttgaacaacatgtctaagaagttgtttgagtttgacttaaacgtctttcgccatttcaaggatcatttcttcaaggtcctagctattgacgttgtggttgttggtttgccactaatggtcgacaaggctatcttggagcagctgtcggccgcactatacgcacaatccattttgtctcttcccttggcaagcgatcccctcactgccttggatgacattaagggtgattttgcttggaggggtcaacttactattgaggttggccttattatgggtgttgttgaggtctcccctaatgttttttcctcttttttggttaagaagaagtgggaagacagtgttgggacgtcggcatcttttgttgttcctgttgctattgatgttccttctcctccatctcttctttgtgtgtctgttcagaaggttgctcctattgctgaagttgttacgctgcccgtttcggctaatcatgtcgtggttcctccgtccactgtcactacacccttgtttagtgccaatgtgacaaccatgagtgctcctgagatgccgcctcctctttcttcaactccccgagttcctccctcgatcgtgttgacatcggcgtcgccttccacctcttctcacccccatgtctctttggatcacatctacacctccaacaatgctgattcattgtggggtgtaagttacaagcttgagcagaagactctggtcaccaaatggagggctagtgctcacattgtttggagagtgaagcaccctaaggtagttagtgccattgtcgccttccgtgaagttgtgaagttgaaccaccaactattcagtaaggtttgcagtgtgcttgctaaagtggttgttgacttagtggccagggtagctaaggagagggaggtcaacaaggagcttgaaaaggagctaataatgtacaagaaaaaggatgtggagcagcatgaaatgcttctcgatgtcatggagtatgcaactggaagtagatgggaattaggcaaaagggcgcttagcacgcatggttcgcttagcgcccgaccacttactcgtgctaagaacgtttacgcgctcaacgcgtag

SEQ ID NO: 91136 - DNA, 213 bp, Glycine max
  Peptide Sequence Number=SeqID_207914
atggtttatcgacaagtgatggttgtggtggtggtaggtgttgctattaacgacggagtgcaaaatgataaagaagaagaggggtggagacgaatgacttatggcggagacgatggtgaagtcgacatcgacgacaaggcattcactggtgacgcgaacgaagggacaaacgatagcctcttgacaacgcgacaaagcaaaatgcagaagtga

SEQ ID NO: 91137 - DNA, 750 bp, Glycine max
  Peptide Sequence Number=SeqID_207915
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagaggagctaagaaagctaaaagctaacatgaacaattggaggctcatttcagactctcacagggcaaagagcactctgctcatacattgcctaagcgcactcaaggggaatcacacccccgacgcacaatcaacactcaagattatccaagtctttcccacaaacactgtccaatcgagcatacttctcgtcaacacccttttgtcaatcgaaaatctgtacaccaatgacaatgcaatcctttgtcgtgtcttcccaatgtccctcaaagggatgacattgacttggtatggtggatgtcctcaggccaaaccgatatcacagaagaagaggaagatgggagaagaacgacgcaaagtagtcagagaagaagtagacaagctccttaaagccaacttcatctgtgaagtcaagacgtgtcctaaggatacataccctctgcccagcatcgacatgctagtcgatgaagcgtccggattcaagaactaa

SEQ ID NO: 91138 - DNA, 225 bp, Glycine max
  Peptide Sequence Number=SeqID_207916
atggaaagcggcgatgacagttcatgcaactctggagggcgagggaatggttcgaaggttgctgttgtggtggtggttgttggttttggtgttgttgttctgcagtattggtggtttcctcttcccatcgcgaaaaccaattcaaaccctcttccctcgttttgttcaattggaggaattggtgtaacaatgcattgtggtggaggagacaaggattttatttga

SEQ ID NO: 91139 - DNA, 474 bp, Glycine max
  Peptide Sequence Number=SeqID_207917
atggcattgtcgcctttgctaactagtcaattggccaatacagggacttccaggggcatatacatccaccgtaattatgacttacttcttcgccataggctgcacattgttggggaggtgaagttgcgtgttaaccactaccttttaggatggcctaatgtgagaatggagaagacgatcgaagttgttgatgatgatgtgaatgttactcgtttcttggtccttgccagagtctctataatttcaggaactgacaggccccataagcttgttttcagcctaggagaaggtcctggtgtaatgttcaaagccttgtcagcttttcctatgcgagagatttgtcaaagctgtgttattttaattgatattcgacttctgaaattaaaacacacattcattactgttattccttcatatgattcagatgaagggagtgccatgtactttgactatctcttctatgttgatatctaa

SEQ ID NO: 91140 - DNA, 210 bp, Glycine max
  Peptide Sequence Number=SeqID_207918
atggaattgtaccagatacgttgttcttccgaggaaaacaacgtaggagatgatatggagggaggaattggagttgtctgtgctttggatgctccgtggcttcgagttccgggcattacaagatgtacttcaagtacaccgaatatagaatttggcttttcatcaccaatggggatattcccattcccagacctgaagctgaatggatag

SEQ ID NO: 91141 - DNA, 384 bp, Glycine max
  Peptide Sequence Number=SeqID_207919
atggcccctatgctctttttcttgaaaatttctttcttgaaaaatggagtcagcatcaagggaactgttgtcgggactcaagtggtgatctctccaaccatcattgatgttgtgtctagatgtgctttggatggtctgatcatgagcaaagactgggagaagaagataacccaaaagtttgtggacaagctgctatatggaaaagccttgtccagaaggggtgacaagacggctctcaacaccttcttaaggacaacaaacttgaccaactcatataggatgatccacagtgtgtctttcaacatagtcatgcctaaagtaggctcaagggactatgttagtgacagatactgcttcggcatctacaagacccaacctatataa

SEQ ID NO: 91142 - DNA, 174 bp, Glycine max
  Peptide Sequence Number=SeqID_207920
atggcaagaattgcggtgcatcttctcgctaagcctatctgccgacttggcgagccatccgctgagcgcaccactcttgcagctgagcgcaccactcttgcggctgagcctgaggaagaatctggaagaaggatgagctggacacacgtgctaagcgagggctcgtcccgctaa

SEQ ID NO: 91143 - DNA, 240 bp, Glycine max
  Peptide Sequence Number=SeqID_207921
atggcccctatgctcttttccggggaacggctaggcaacatggattattgttgggacttaggtgctagcagtggattggtaggacaaataatactaggtttaagtcaagcttcgggtagagcttgcaatttaatggcagcggaatggacatggaagaaagatgattggagacgccacttcaaggagaagatgagtcaagaagaagctcaccaccataggaagccatggataagagcttga

SEQ ID NO: 91144 - DNA, 207 bp, Glycine max
  Peptide Sequence Number=SeqID_207922
atgcatgatgcgatcaaggaacaagccaaagtaactttgctatgtgcaccccccatgatgcaatcctaccccgcaagggcattggatagaagactccaagaagattgggctagagatgcaagagaaggccctaaggttctcatgagccttaggcccttgtattttagggcacctagactagattttgtattagaggtagttttgtaa

SEQ ID NO: 91145 - DNA, 126 bp, Glycine max
  Peptide Sequence Number=SeqID_207923
atgaacaaggttgctgcgcgtgattgtcaaagttccagttcgctgttgaaggatcataataaggagaagttcattcgctggcagcagcatcccgattcgggagatccaagttgccgtgacaattaa

SEQ ID NO: 91146 - DNA, 753 bp, Glycine max
  Peptide Sequence Number=SeqID_207924
atgtatatctcaggcaaagacaaattgggatatataaatggagatcttcctgaattcctacaaatagaccctgcattcaaaaaatggagaacagaaaatgcaatggtgaagggatggttcatcaattctatggatctaaagttggtgagcaactttattagatttccaacggccaaggttgtttgggatagtattgctacaacatactttgatggcgctgatacatcacaagtatatgatctcaaaagaagagtgactagactcaaacaaggcagtggatctattgaaacgtattataacaacctgcaaggactatggagagaaatcaattttcatcgaccaaatcatatggaatatggtgccgatattcagcaatataatttaattttgcaagaagacaaagtctatacctttttagataggcttgatgattgtcttgacaagattcgagtggattatcaacaatggaaggtgacagctctaataatctatgttgatgatatgataattacaggaaatgttgaaaaagaaatctctacactacaagagcaattggcaactaagtttgagatgaaaaatcttggagggttgaagtattttttggggatagaagtagttcgatcaaaacaaggcatatttccatcacaaaggaagtatgtgcttgacttattatcagaaactagaatgcttgattgtagacatgttgatacaccagtcacacaaaaccatggcttaggagaatttccaaattag

SEQ ID NO: 91147 - DNA, 1326 bp, Glycine max
  Peptide Sequence Number=SeqID_207925
atgtcagcaacatctaaaggagagagcataaccgcaaacgactggtccaaccggcaaccctcatttccttcatcacacacccaaaaatgcccttccaatgccaacaattttgtgaagatggtggtagaagagctaagagtccaacgagggatagcccttccacttgtgcccatgaacttggcttggtttgccaagttagccataacaacagcttttcttggccaccttggggagctgaacttagccggtggcgcgctcgggttcagttttgctaacgtcaccggcttctctgtcttgaacggtctaagcggcgccatggaaccaatctgtggacaagcacatggagccaagaacgcgaggcttctccacaagacccttctcatgacaaccctcttgttgcttttggtaacacttcccttatctttcttgtggcttaaccttggcaagattttgattctttttggccaacaacaagagatctcaaccgttgccaaaacctatgtttccaatctcatacctgacttgtttatcaaggcactcctttgtcccttaaaagcctacctcagctctcattgcgtgactcttcccaccatgtttagttctgcagtggcactagcctttcacatacccgtcaacatagtactctccaaaaccatgggactccgaggagttgcaattgcggtttggataaccgatctcatggttatggttatgctggcgatttatgttgtggttcttgagagaagaatgatgatttctctagccactagtgtttccactcgtgtgtccaatgagcttggtgctaaccgtgccggtcaagcttgtgaatcagcacgtgtgtctttggcactgagtgttgtatctggttgtatcggtggttccacgatggtggctgcaagaggggtttggggggatttgtttagtcatgataaaggggttgtaaagggtgtgaagaaggcaatgttgttgatggctctggtggaagtgtttaattttcctgtgacggtttgtggaggcatagtacgaggaactggacgaccccggctaggcatgtatgctagtcttggtgggttctatttcctgacactgccgttgggtgtggtttttgccttcaagcttcggttaggacttgctggattcactataggactcttgattggtatcgttgcttgcttgattttgttgttgacgtttattgtgagaataaattgggtgcaagaagctaccaaggcacaaacgtttgtatgtatcgcacaggtacaggaacaagttccaagatatgaggtaaatgaacttgttgaaaaccatgagaatgatcaagtgtga

SEQ ID NO: 91148 - DNA, 864 bp, Glycine max
  Peptide Sequence Number=SeqID_207926
atggatccaatctcggcacatggtcattccctcccccctccttttcacacaagagatctccatctgcaccaccagcagcaacaacaacaacaccagttccaaagcttaaaccaagccaccgaggacgagaacagcggcagcagcggcgcgcagaaaagggaacgcgaagaaaacagcaacggcaacaacgaaggtgcaggtgaggctgagataacaagaaggcctcgaggaagaccagctgggtccaaaaacaagcctaagccacccattatcatcacccgcgacagcgccaacgccatgagaacccacatgatggaggtggcagacggctacgacatcgtggaaagcgtgtctgagttcgccaggaaacgccagagagggatttgcatcatgagcggcaccggcaccgtcaccaacgtcaccctccggcaaccggcttcatcgggttcggttgtcactcttcacggaaggttcgagatcttgtccctctcgggatcgttccttccaccacctgcgccaccggccgcgtctggtttgaccatctatctggccggtggtcagggacaggtggtgggaggaagcgttgttggaacactggttgcttcagggcccgtggtgatcatggccgcctcgtttagcaacgctgcttatgagaggcttcctttggaggatgaggaccctaattcgctgcaaatgcaaggaggttcaattgggtcacccggtgcaagtggtgttggccagtcacagcttctaggaggggatgctaccgctccacttttccatggtttgcctcctaatcttctcaattctgttcagatgccatctgagccattctgggcggcatctactcgcccacctttctga

SEQ ID NO: 91149 - DNA, 717 bp, Glycine max
  Peptide Sequence Number=SeqID_207927
atggagagaaggcctcagttgccaagctctttgaacaaggcaaagattctgtcattgcttgaagcagaagttactgatgcacgaatccatgccgtgaaaatagtagcaaatttatcttctgaaggtggacttacgtccttgcttatactgcttaagaactcacaggatgaaaccacacagacagttgcagcaagtgccatagcaaatttggcaatgaatgatctcattgtggctcaaggaggcattcatttactgtcaatgacagcagccaatgccgaagatcctcagacccttcgaatggttgctggagcaattgctaatctttgtggtaatgataaactgcaaataaagctaacggaagaaggtggtatcaaggcactgttgggaatgttcagatgcatgcatcctgatgtaaatacccagattgcccgtggaatagccaactttgccaagtgcgagtctaaagcatctacacaagggacaaaggttggaaggtctttacttattgaggacggtgtgcttccatggatagtgcaaaacgcaaataatgaagtctcgttggttaggcgtcatattgagcttgcactctgtcatttagcacaacatgaagcaaatgcaagagagatgattagtggaggtgcaatacaagagttggttcgtatatcgagagattgctcaagagaagacataaggattcttggacgtatagaactctaa

SEQ ID NO: 91150 - DNA, 1596 bp, Glycine max
  Peptide Sequence Number=SeqID_207928
atgtcagcaacatctaaacaagtagagaacctaagcacaaacgataaggctaaccatcggccctcatctccttcatcacacactaaaaaatgccctttcaatgcaaatttcataaagatggtactagaagagctaagagttcaacgagggatagcccttcctcttgtggccatgaacttggcttggtttgccaagacagccataacaacagcttttcttggccaccttggggagctgaacttagccggtggcgctctcgggttcagttttgctaatatcaccggcttctccgtcttgaacggtctaagcggcgccatggaaccaatctgtgggcaagcgcatggagccaagaacgtgaggctcctccacaagacccttctcatgacaaccctcttgttgcttttggcatcactccccatatctttcatgtggttgaacgttgacaagattttgatttgttttggccaacaacaagagatctcaaccgtggccaaaacctatgtttcctatctcatacctgacttgttggtcacttcactcctttgtcccttaaaaacctacctcagctctcagtgcatgactcttcccaccatgtttagttctgctgtggcactagcctttcacatacccgttaacatagtactctccaaaaccatgggactccgaggagtttcgattgcggtttggataaccgatctcatggttatggttatgctggcggtttatgttgtggttcttgagagaagaaatgagggcatgttgtggaaggaaggagggtggtgggatcagaatgtgatggattggattaggctaatgaagcttagtgggtcatgctgcctcaacacgtgccttgagtggtggtgttacgagattctagttttgctcactggccacttggcaaacgcaaaacaagccctgggggttctggccattgtgttgaactttgactatttgctttactcagtgatgctttctctagccacgtgtgtttccactcgtgtgtccaatgagcttggtgctaatagtgctggtcaagcttataaatcagcacgtgtgtctttggcagtgggtgttatatcgggttgtatcggtggttccatgatggtggcttctagaggggtttgggggaatttgtttagccatgataaaggggttgtaaagggtgtgaagaagacaatgtttttgatggctctggtggaagtgtttaattttcctgtgacggtttgtggaggcatagtgcgagggactgcaagaccatggctaggaatgtatgccaatattggtggattctacttcttggccttaccattgggtgtggtttttgccttcaagcttcgtttaggacttgctggactcattataggattcttgattggtgttgttgcatgcttgattttgttgttaacatttattgtgagaataaattgggtgcaagaagctaccaaggcacaaatgttagtatgtattcccgcacaggtacaggaacaagttccaagaaatcaggtagaacaagacgttggtctacgtactaatgttataattgtgtcaaatgatcataatgcaatcaaggcaaaactattctattcatacatctaa

SEQ ID NO: 91151 - DNA, 183 bp, Glycine max
  Peptide Sequence Number=SeqID_207929
atggctagttcattggagaaggagacaaagagactctcgatggttaaggaggacgatggctttgttttcaatggtggggaggcacataaccagatacttaacctagagagagaggttcgggttcagatcatgaaagctcgaatggtcgagatttggaggccaaagaagggagtcacaatctaa

SEQ ID NO: 91152 - DNA, 213 bp, Glycine max
  Peptide Sequence Number=SeqID_207930
atggttgaaaccacaactcaaggacgtgtcaaatgtaacatagacgccgcaatttttgagtcagaaaaatgttttggagctgggttctgcttaagggatgatctcgggcaatttttaattgcaaaaactgcataccaacacggagtcccgaaacccgcggtagcagccatgtcttttatcaagttccttcttgtattgcctcttctattttga

SEQ ID NO: 91153 - DNA, 390 bp, Glycine max
  Peptide Sequence Number=SeqID_207931
atgggttcttcggagcggaaaccctgcgccaacaactgcggtttcttcggaacttccgagaagctaaacctctgctccaaatgctacaaggacctctgtctcgaagaggagcttgcatcaatgaagtctgtgctctgctcagcaaagccaccctcgccggcggagccgtcgcagggcacggagggtccgtcgaaaccggcgaaccggtgtgggacatgcaacaaaaaagtgggtttaaccggttttgtgtgcaagtgtgggagtaccttctgtggggtgcatcgttacccggagaaacacaagtgcacctatgattttaagggtgaggcccgcgaagcgattgcgaaggcgaatcctgttgttaagggtgacaaaattgataggttttag

SEQ ID NO: 91154 - DNA, 612 bp, Glycine max
  Peptide Sequence Number=SeqID_207932
atgttgtatggaacaacgccgtttaagggctcgaataggaaagagacattttaccgaatcttaatgaaggagccggagttaacgggggagaagacggcgttacgggatttgattgggaaattgttggagaaaaatcctgaccgtcggattcaggttaatgaaatcaagggccacaattttttcaagggggttaagtgggacacggtgttgcacattgcgaggccaccttatattcccgaaaatgaggttgagaacaaagtggggttcagcaaaagcgacgtggaagtgttcgtggacaactgttgttgccgctgtatcacttctaccacaccgtggcactcacgtagcaacaagatgtataggaatggcttttcgggttctactgtcggttctggtgctggtgccgatgctggtactggtgggttttggattcgaattccaactgggttgggtatggcccagcctggatctggctccaagttagttgctgcaattaaggttttgggagatgggtttgtgagaacgaaacaaaaggagatggcgagggagattgagaccatgcagatggaggtggagatgaagcgcactgagattattctagagttgcaatag

SEQ ID NO: 91155 - DNA, 330 bp, Glycine max
  Peptide Sequence Number=SeqID_207933
atgcacgggcattggtattgttgcaagctgaatccagcaacatgcataccagaccaaattaatacatcacaaggttttaggctcgacatgcttgcagctttgagatcattctatatgaattcaagcacaggatgggtgttcataaattcatgttttgctcattgccaaagtgaaccgcaagaaacatggttcggggattattctccgagaataaacaataagtttaagaaagaggaagcaattgcacttggggttcaagccctggatttgagattgccatttggtgaaattgaggttcttaaggaaaacttggacttgatcaagagatag

SEQ ID NO: 91156 - DNA, 339 bp, Glycine max
  Peptide Sequence Number=SeqID_207934
atgcctgattgcatacctacggaaactctgaattgcaactgggggtttaaggaaagcaaatgtaagtgcagcatagattatttgattctcactagccaaatacctaaagctctaaccaacgagggttgttcaactggtaggattggtttgaaaaaatgtggaattttgattcggacattagctgatgcttcatatgaaaagcattctctatctgccccacaaattattctcaatgtggcaggcttctgtataacggtggcgacaaccatctttttcacagcttatgctaggagacggcttgatgagttacaaagggaggaggatccattgttgcagtag

SEQ ID NO: 91157 - DNA, 354 bp, Glycine max
  Peptide Sequence Number=SeqID_207935
atggacacattaaacatttttgcaaatcaaataggcagcaactcatggatgagcccgatatggaactatacggtaaatgatttgttactagaagatgaaaatgaagccaaaaaggatttgagcagattgctagagtattcaaagaaatgcaaagaacacccaagagtttgtcaatcttcaccaagtgccccaaagaaattacacaacatatattcaccatggtcatttgcatgttggggcacagacatacttggtcattttccaattgcaaagggtcaactcaagttcttgttggtcgccattgattacttcaccaaacggaaacttgccaaagtcattgctcagaaggtttaa

SEQ ID NO: 91158 - DNA, 501 bp, Glycine max
  Peptide Sequence Number=SeqID_207936
atgactccatatggccttgatgcaatcctctctaggaagggaccagttaccagagccatgagcaaaaggctccaagaggattgggctagagctaccaaagaaggccctagggttctcatgaaccttagtgatgcaatcctccctaggaagggactagtcactagagccatgagcaagaggctccaagaggattgggctattgctgctgaagaaggccctagggttctcatgagcctcaggggactattgtttgctggcatgcaaccttcgcttgaccgcctcgaggtacttaacacccatcgttgggtaatccgtaaagttccacaacattccggaaggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacagggaaggtattag

SEQ ID NO: 91159 - DNA, 519 bp, Glycine max
  Peptide Sequence Number=SeqID_207937
atggagaccttggttgaaacaaatatgcgatcactagataggaattggatgagtatatggaaaatgaatgctcttccaaaggtcaaacttatctttggcgcatttgcaaagatatcattcttaattggctcagaagtaaaggttgaagaagagatcggtctcaagttaaatgtagaagacatagttgacctcactgctttccttgactctacaactggatgcagtgttttcccctctggaggaggatgtgacgaagaactcagtatttttctctacagagggcgtgttgataaagagataatcacacaaccacaagctggtgataccattggtgacgccgcagcggcgactgagagcgagagcctgatcaacagagacgttgaagctttgaagcaagccggggctgaagaagatgttgcagaggcaatccagttggttttccacggtttgtttgagagggtcacagcaagagcttggtggggtggttgtcccattcagaaagttcacacatggaattag

SEQ ID NO: 91160 - DNA, 1602 bp, Glycine max
  Peptide Sequence Number=SeqID_207938
atgtccatgacgatggtgatggaggaagacgaagaagacgcagaaatagagcacgtgtttattgctcatgaaattgacctcgattacgagttcgacgctgcaaggttcttcgatttcactcgcccggagactcccgcggaagctcacgaagcccaacactggtttcaaaatgccgctagttaccctccttcgccttttgtgagaaggctgctagtggtgagagaggatttgttcttggaagatgttggcgattcgccgaagtccgaacacgtggaatgcgcgagtaatgtggatgatgaaaaatctactgttccgttagggattggattttcggacacggcttttgagaattgtggtccaaaaacacttggtgaaaatatctctggcttgttggctggaattctacaaaatgatggtgcaaggtccctacaagtacctacaggacttacctttggcagtaagacaattagcaacaatttgaactctaaggctaagtctgctgtaccaaagagttcaacactaatgaaacctaccgctagtcaattggccaagcaaaatcaccctgctaaaaacatcggttcaagatttcagaagctacgaactcagaatgaacaaaatttatctatctcttctggggtagaaaatcaagctgccaagcggcaaaaattagagagtggtctcttgtgtaagttccttgtttctgatgtgaagcagcaaaccaattttttccacaaggcaccaatgatgaaagaagctgtcactgttgaacaaaactctgcatgttcgaagctaaggcttactattccaagggagcctgaccttagaacagcacgtagagcacataggataagacccaagaatgttggagaggcagagcatgtgacagtcgctgctcccaaattcaaagctcgcccattaaataggaagattcttgaggctccttcaatgctacctcccaaaaggagcactccgagattgcctgaatttcaagaatttcacttgaagactttcgagagggcaatgcaacacacatctgctatgtcatcttcatttcactatgatgattctgataagggttgggacaagcatactagtgtttctgctttagaaaatagaatcaaggatttaagaagacctgcagctgcagctgcaccaactaatgatggattgggttttactcatatttttaaagctcagcctcttaataagaagatacttccaagtaaaggaaatggtggtgttttccataacagcaaacaggaaacaacagtccccatggaatttgacttacagactgaaaaggaggttcagcatgaccccccagttgaactcttcagcaagctgtctctgacatccgaaggccagccaaataacggatctcatttcaaactgcctcagcattctgggatgtgtagaaagctgacacatgatgcaggagaaggcttttatgttaagggcaaaccgaacgtctcgagggaatggcagttgcatcagtctgatgggtgcaaggaggagcttaggaattcgatgacaaaaaacgagggaaaatgtgcaacctgcttagttatggacatcagacttgaagttttgctgctaacatga

SEQ ID NO: 91161 - DNA, 156 bp, Glycine max
  Peptide Sequence Number=SeqID_207939
atgcgtcaagtcaacgtgcattcacacctggaggtgacaaaggaggagcaggcagagtcacattcaccgggctttctttcctcctcttattttgggtatctatgctgtttaattaggaaggtggttctttatccttcggagcctctactatgttga

SEQ ID NO: 91162 - DNA, 186 bp, Glycine max
  Peptide Sequence Number=SeqID_207940
gttacagcaaatgattttgtcttggcttctgagacatttggatccatcaatgtgcaagataaaggcacatatttggaacctgaagatgtgaaagttggacggttggacgtagttggtgacgtgcagcagcattccgtgttgaccattgaacgatgcaagagagagacagatagcattgcgcgttaa

SEQ ID NO: 91163 - DNA, 477 bp, Glycine max
  Peptide Sequence Number=SeqID_207941
atgtctggggaagaggaagaaaacgccgcagagctcaaaattggagacgcaagcatggctaacatgctcacttgctggtgcatgtggtgtcaaaatggaaggctgaatgagtttttgaaggcaaagtgcttaatgaactgtgaagtttcattgattcttgagcacaagtatgagcagcttcaacagacatccgatgatcccatgaatcaagtttctcaggtatttgaaaagtcactgcagtatgtgaagcgtttcagccgctataaaaatcctgatgctgttagacaagttcgagaaattctcgcaagatatcaattggctgagtttgagttgtgtgtccttggaaacctttgcccggaaactgtggaggaagctattgccatggttccatctatcaagtcaagaggacgggctcaggatgatgaagccatcgagaaaatgttaaatgacctgtcattgattaagaaatttgaataa

SEQ ID NO: 91164 - DNA, 450 bp, Glycine max
  Peptide Sequence Number=SeqID_207942
atgacgcatttgactaaacaaagtaactcaattgtcccattattactaaaggaatatcataagtcccctctcggtggccacatgggtttggccaaaaccttgagtcaccttcatcaaaacttcttatggactggcatgaaacaggatatccgacagtacatcatacaatgttcagattgccaacaaaccaagtacataccacagaggcctgcaggcttgcttcaaccttcgtcgagtccatgggaagatatggccctcgattttatcacaggacttcccaattaccagggcgccatcgtcattctggcaattgtcgatcgtttttcgaggggtgctcattttggcatgctttccactcacttcacagcacataaggtagtcaaactattcattaagatcgtttgcaatcatttgcaagttccatggatttcccaagagtttgatctctga

SEQ ID NO: 91165 - DNA, 1368 bp, Glycine max
  Peptide Sequence Number=SeqID_207943
atggcgtcacgttgcaagaaaggattgtgctacaattacgtcgaacgctatggccctaaccataaatgtcgtgcaaacctccacgctctttcgggccacccggcttcggctactctgcgcatcacgggcactgtcaacggccacgaggtagtaatcctcgtcgatgggggaagtacccacaacttcgtacaggatcgaatggtccgctttctgaatttagcggctcaatccactcctcgcctcacgtttatggttggcaatggaagcgagattaggtgtgaccaggtttgcaagaacgtacccgttttgattcagggccaccaatttcacttggatctgtatgtcatggctcttgggggtgccggcatggtgtttggggtagcttggcttaaacttttaggtctagttactactgactattcacacctcaccatgtccttagtgtggaaagaccagcccatcacactacaaggttgttctggtcctggctcaacagagacacgtctagggtggcaacccttttccaccttcagctccacgacaccaccagctcaatcaccattgacaccactccttttccacctaaacttcatcacctcctttactgatattctccctttttctggcaacccaccctcctaccttcgcctcgaccaaccaaccacaccattcacctcacacccaactcccaactcccaaccggtcaacataaggccataccggtatccttactttaagcaagaaatagagaaacaggtcgaggacatgcttcattgccatctgatttgctcaagtcgcagtccttactcgttgccagtgttgcttgttaaaaagaaagacagcttgtggcggttttgtgtcaactaccgtgctttaaacgcagttactataaaggaccggtttcctctccctaccatcaataagctcttggatggtttgggtcacgccacttggttctcgaagatggacctcgcacaaggtttccatcaaattcgaatggcagagtctgatatccgaaaaaccgcatttcatacttatcagggacactatgagtatgtggctatgctggattggcctgcccccacttcaccaaaatcattgcacgaattcttgggtaagactggcttctatcgtcgtttcatcaagaactatgcccaactcacttttccattgacccaacttttgtgcaaggatcaattttcatggtcccctaatgctcaaacggcctttgacaacctcaaaagggctatgactcagacaccagtactctctctccccgatttcaatattccgttctttctggagactgatgcttctggtatgggaatgggtgctttgttgatgcaaatgggtcatctaattgcttaa

SEQ ID NO: 91166 - DNA, 261 bp, Glycine max
  Peptide Sequence Number=SeqID_207944
atggccttaatcatttcaatgcatacaattgcaatcaatctacaagagattcaatcaaagtctactgtgaatgacataagagtgtctctcaatatatatttgtatcattataaggagcactcacttattgatatgaatggcagcggaatggagaaggaagagagagaggagatgccacttcaagtagaagatgagtctagaagaagctcaccaccatatgaggccttggataagagtttgaaggaagaaggagatgaatga

SEQ ID NO: 91167 - DNA, 627 bp, Glycine max
  Peptide Sequence Number=SeqID_207945
atggcgagaattcagcgagagtcattgaacttgtcttcctgcaacttggcgaaggcggcgacctacactaaggacaatgtccgacgatacggttggccaaggcttgaaactcagaaaggtaggcatcaattgagtcctcctgagagagtttcaaaagagcgtcgtggggatcgtcatagaaggaaggtagaagaaggcgacttggagtcgctcgtcatcgggggtgccatggtagtcaaaaaattggctaatcttgattatccaagacatagtatcagtcccgtcgaagcaaggaacctcaagggtgtgaaggagagagataacctcgtccagtttgaagtggagggagctctgtgtggaggtgagtgcgctttggttctgggtcaagagggtcacgacctcctcgaggcgagacagggaataagaacgagtattatcgatcatggggagggatcaatgaaagcaccaaatgatggctctcactggaaattggcttcctgtattcgaggtcaggagatacctccagaaaaaaaggatgaggacaacaataacataataataaaaaacgaaacaagcataacagaatggctaagcactagggggacagccactaagagataccactaa

SEQ ID NO: 91168 - DNA, 342 bp, Glycine max
  Peptide Sequence Number=SeqID_207946
atggcatctgagtctctctttgatgcatgtgaaatgtataaagctttacttagaagctatactttccacggttactccgattacactcaaatctccgtgtttataaaaggaacaactgatgaatttagaacaatgataaatgtttcaacaggaggatactatgttaatggaaccacgaccaaagtaaagaaaattatagaagatgtagcaactagtgaacgaggttgtgattgcaattgcacctctccaaaggacgtacccaaagaagacatcgaagatgaatccatcaaacaacaaacacaaatgaaagctataatggagaacgtaaccaaaagcaagtaa

SEQ ID NO: 91169 - DNA, 282 bp, Glycine max
  Peptide Sequence Number=SeqID_207947
atgggtccaaacgctgcggcggcgaaacaagcggaaaagctccgaattgacggcaacacttacttcaaaaaagaccgtttcggtgccgccatcgacgcttacaccgaggcgattacgctgtgccctaatgttccggtttattggacgaatcgcgcgctgtgccatctcaagcgcaatgattgggagagagtagaggaagattctcggaaggcaattcagttggacagcaattcagttaaggccagatcaggctttgaaagacctgagcctagcctacgatga

SEQ ID NO: 91170 - DNA, 264 bp, Glycine max
  Peptide Sequence Number=SeqID_207948
atggtgaggctcctaaaaacattaagatgcttatggatgggctcagtgaaagtatgtgatgaagagccactaaagggtgaggagattagcatgaaggaccttagcttgggaggagtcatgattagagcaaggctcaagaaactacaagaagagttcaacaagaagatgacctcacttatgaataggggtgggaataggtcagaccggcctacaggggcctacgacatggcctacataaagtctgacctgaactggcctatttaa

SEQ ID NO: 91171 - DNA, 201 bp, Glycine max
  Peptide Sequence Number=SeqID_207949
atggaaaaattcgacaagagaaatttcaaagaaaagaaagaaaagaaagcatacatcacttgggaagataatgacatatattcttcaagtgattcagaaaatgaaatcataaatctgggtctcatggcaaaagactatgaaagcggagaagagatgcattcaatgacttgcataaagaatctatcaaacttgccaaattag

SEQ ID NO: 91172 - DNA, 294 bp, Glycine max
  Peptide Sequence Number=SeqID_207950
atggaccacttcattggttacctccattttactgcgacttccctagatagatcaggcgatacacctaagttcatagagtatttcatcttgtggactcaacccactccaccatactattgtcatgctacattagtagagatcgtcgaattatcttcatcctcgtcttcatcattttcatccgacatgccgatgtatgcacctccattgacgtatgacattgagatttccaagcatattttgaccactcctctatctctagatccatactcatgctttgaccttagttggggctaa

SEQ ID NO: 91173 - DNA, 1170 bp, Glycine max
  Peptide Sequence Number=SeqID_207951
atggtttttattcccgccggcgcggttcactcctgtaatccattgcctcacaagcactggagctatcagatgttacatatggatgccgcgtggttaaatgctttacttgctgaaatggacgatgtttcaggcggcttcatcagtcagggtgaagttcgggtgacgaataatcaagagcgctatcatcgcttctgtgaactgaataacctcctgttttcgactgccagtacagaagacaaaaatacagcgctaatcgagtttattggcgacagtaaatatggcaccggcccggtgaaagcctttcctgtcatggcgtctgacatcagtcgggcattacacaacgtgattgaagtattgcagcaggctgaaaggcagccgtgggcgctgtcagagctggcaagcctttcaggcatgagtcgttatcagctcatcagagcatttcgcgctgcgactggcatgacaccgcatgcttatcagcttaatttgcgcataaacaaagcacgtcactggcttcagtcaggctgtgacattaccgatatcgcttaccggctgggtttcgctgaccagagtcattttcagcgccaatttcttatcgtggcagcagcgcattttctggcgttgctgtcgcccggcccggatttttttctcgtggcacgcacctcaatcagagccggctggcggcgcgccgccaatgtctgcctggggatagccatagcgaacggcgtgtttatactggctgccttcagcggtatcacgcttttccatcctgagagcatcagttttatcgttattcagctcgcgggctgtgcttatttactcaatgtcggtctgctttttatccgctttgctggcatgagctcattgtctgcctgcagcgtcaaaacagcggaatcagtaactcagcctgctggtgcctcgaatcattaccgtgaactgggcatgggttttctctccggaatactcaatcccaagaatgcgctgttttacgtgagtctggccacgcttattggtggcggcgatgcgatgtgtcgtgctgctatgggatttactggtcgccgctttcattggcaatcgtctggtactccagcacttttcccggttattaccctggctggaacgtatctcaggaatgatgttgattggcctggcattgagtgtcatcgtggttaa

SEQ ID NO: 91174 - DNA, 315 bp, Glycine max
  Peptide Sequence Number=SeqID_207952
atggccagggccactgaaaaacggttgaagcatgctgtcgtgagttgctttcaagagtggaaaagacatggaaatggaagaaatctcggatgcgtgagtgttcagaagagtgagggaagtacttgtaaaagtacttctaatcaagtgattgcggatacgtggtcgaggggtgtgttcggtttgggtgtactaggtgtccctttggcctcagtcgaaaagaaggactttatgatgtaccaaaacaattatcattactcccctgacggttacacgcctttattgccacgaagtaactattacgtcgtagatataaag

SEQ ID NO: 91175 - DNA, 273 bp, Glycine max
  Peptide Sequence Number=SeqID_207953
atggagatgcacgctctgaatggcgaggccttagttaggtatcaggatactgaaattgacaagcctcggtcggccttggctaatgctaataaggaaatagagggggctaatgctggaagaagtggatccaacaaaaggcctttaataatgtgtgcaatacacatgaggccgaattcaaccattgcctttgaagagaaagttgtcccttcacccttaaggtcggaaactccaacagaggagccaaaggtcgagggagccaaggacggagagtag

SEQ ID NO: 91176 - DNA, 474 bp, Glycine max
  Peptide Sequence Number=SeqID_207954
atgacggataaagagatgatcataataatagtagacacattaccagtgttttactatgaaaaaatggtggggtacgcaccttcaagctttacagatttggtcttcgccggcaaaaggatcgaagcgggtctaaaaaaatgcaaatttgatcatcctgcttggatgaatgagaaaactggggcaaatgaagaggatgagaatgaggaaggaacccatgttgaggctgccattcctacatggccaaacttcccaccagctcaacaacatcattactcagtcaatatcagcccttctcattaccctccacccaaatcaaccacaaggcctacctgcttaccacacacccaatgcccaaacaccacctttagcgtaaaccaaaaaggaatttttcagcaaaaagcttgtaggattcaccccaaattccggtgtcatatgctaacttgctcccatatatacttgataatgcaatggtag

SEQ ID NO: 91177 - DNA, 417 bp, Glycine max
  Peptide Sequence Number=SeqID_207955
atgcagaagctcctccatctctcatcttctcacttttatctccttctttatctcaaagttactcttttgtctttggtggcttatgtcttcttccttagagcttctttgactgccatggagtgggaaatccttggtggatctcaagattctatttctccattctctttgtcaaaacttagcttggggaaaaagcttgaaagcttcggtgaatctttggacaaggttgggctgagtagcattaagctcgagggttatttcgaaccagctagaattgtgttctggctgggccagagcttgacagaaaggagaattctctccaggggagttatggctgcttatggttgtagaaatctgattagccaaggcgagctggatgctagcttgggcgaatggacatctaaaatcttggaaaaatga

SEQ ID NO: 91178 - DNA, 291 bp, Glycine max
  Peptide Sequence Number=SeqID_207956
atggtctataaagcggaaatgcacaacatgagggtacccatagccaccaacaactgtgccattaacatggtgatggattctcttgcggcttctccctacatgtcaccactggtgctgccagaccctatcattgcctatcgtaaggggagtatgcagcttgtgtggcatggccaattggctttggggacaatgccaatgttggatagggaggtggccatgcaacacaagaagaagctatggaggaagacgctgcacatgatggtggtagagatgagggccattgagctctag

SEQ ID NO: 91179 - DNA, 369 bp, Glycine max
  Peptide Sequence Number=SeqID_207957
atggatccatcaaaggagaacccaactcctcaaccactatggtccaaggagttacagatctggacttctcacaccagattcactccctaccatccttccagtttaagaccctccaagcaagaactagacgtgataggaggcatcttaaagcaaatgtatgtatcgaaccaagcaacaacatatccccctagactccatatcaacagatatgtagaagcaaagcttcatgatgatgacaaaggtgatgacaaaaagctcaaagatcaatcaaagaacaactcaagtgaatcaagagcaattcaagaattcaagacaagaatcgagatcaagattcaagactcaagatttaagaaccaagagaaggcttaa

SEQ ID NO: 91180 - DNA, 405 bp, Glycine max
  Peptide Sequence Number=SeqID_207958
atgtcaaactccagggaaaacattgcttctgcaaccaccattatcaccactgacacaacctccattcaccctgatggagaacctactattcacaattcacggttatttcaacaaccctcagatgatatacctaaagcttatcatagtgttctcgaggaatgcttagatgaaggactagaagaccattatgtccaaggttcttggaaaagagatccacatcctaaaggcatttatgggaaaaacttcaaggaagcagatgggaagaagaaggctcattaccctattgatcaggataacatccaacaaaggaggcagaagaaactggccagaaccatggctgatgaagacaaagctctagagacctttggacttgctaaaaaggttcaaagcattctcagagaatag

SEQ ID NO: 91181 - DNA, 195 bp, Glycine max
  Peptide Sequence Number=SeqID_207959
atgaggcaaagaagcgtgaacatgagaaggaacgtgcccgctgagatcactgatggagaggtggccttggtccctcatgcaacggcttgggaacctagagggggagtcgaagatagtgcgaccagaacatgggaaaatggaaaactagtgtccattatgcaattaactctacaagcatatggcttcctgatttaa

SEQ ID NO: 91182 - DNA, 461 bp, Glycine max
  Peptide Sequence Number=SeqID_207960
atggtgccttacaaagtctgcccaagacttcccaactatgatgaaaggaagaagaaaggcttcaagctctacttcaatgaggacataaagcttgacacagatgatgatagaacctcgtggaaccaaacaatgtggtatgacaccaagggcgctagcccttccaactctgtacatgtgcctgcttcccaacaaagggactccattcaggaattgtgccaaaccaaagtttacctctttgatgatgcaaatgcctacttcacgaagaaccgtgaggatggctttctgaaatgcctgttgcttctacaaaccatcttctgccattgcatcttcgacatccgtaagacaacaattgaaatgctggaaaatgaagccaaacaaaaagatgatgcaatagccagatgcacaactgctatcaaaaggaaagctaatgttgaagctaacagactagacccagcaagatg

SEQ ID NO: 91183 - DNA, 549 bp, Glycine max
  Peptide Sequence Number=SeqID_207961
atggacccatccaaaaaccactttagcaagaaggaggtaggacaactcactgagcaagctacaaaagctcaaaagctgagggatataagcgaaatagaggatgaaggtcctctgatctttccaagggagcgaaaagaagaacctgttgtacaaaagaagcctaaccaacctatgatcccttctttttttccaaagaaaagaaagacaagagttggacgcaagtccttcacacctaaggaacccattaagatcccatcctctaacggctctagtttgtctaataacgaggcaacaccaactcccactccacaaccatccagtccaccaccactacagtccagggaacctatctctccaatcaccacatccagtttctcagtaattggattaacatggagaagaaactggacaccttgggttcaacaaacaagggaagagaatgcttgtaggaagctcgctattgcattcctcactaggaatcaacaaaactgctactctgaagaagacatcatccaccagccacatatggaaccaattcatagacaataa

SEQ ID NO: 91184 - DNA, 129 bp, Glycine max
  Peptide Sequence Number=SeqID_207962
ggagagaaaaaggaattgcacgaagatagtaaaaatggaggcttcaaccccttctccgtctctttgacgtttgggaactctatcgaagcagtcggaggaaaaactggagaaatctcggggaaccgctag

SEQ ID NO: 91185 - DNA, 576 bp, Glycine max
  Peptide Sequence Number=SeqID_207963
atgcccttcagattctgtgtgcccgtgatcctctgcctccgtgcaggttcaatgcacaaacccacccttgatgaaccgcacgggctcggcgtccatgcgtgcaatcagcgcgcccaggccgtcggccaaggcgccagcgccaacgccggaggtggccttggccgccgtgtccgtgcggcagaccagctgctccgagccgctgagcagggccatggcctgccaggcgcgcgggtcgttgacggtgcagtccagggcgctggcggcgcggttgccgccatcgggcgacagctgcaggctgaccaggcgcgggtcttcctgcaccgggccgctgcctgccaccaccctcagccgctgctggcggctttgccaggtgctcaggcggcgtgcgggctggcctgcgcactgcacggccatgtcgggaaggcccacgggatagggccagctgccggcgatctgcagcatctggcctgcggcgcgggccttcatgaagtcgatcagggcccaggcgtcgtcgctggacagccggtcggcctggccgtgtgcccgtgcgccatcgccagactccacggggcggcg

SEQ ID NO: 91186 - DNA, 240 bp, Glycine max
  Peptide Sequence Number=SeqID_207964
atgtatacttatgtactagagacttccagtaaaatatttgagtcgatccaacggttaacgaattggaacgaaggaaatgttactgggtccatgatgattggatgtggaattacctggatgttgtggaagcttgggaggattgatggggacccgacgttgagaggaacgaggataagggctacgtgggagtacatgagctcagttggaggtgggcaacaggggatggtgggttatacgtga

SEQ ID NO: 91187 - DNA, 828 bp, Glycine max
  Peptide Sequence Number=SeqID_207965
atggcgcgggccagggcgctgctgcggacggcgcagcccgagagctatgccgttgcccgcggctacctcgctgactggggcgcgctggatgctgaagtctggtcgcactgggccggcgtcgccgacggaccgcagccgcggcgcctgcatggggagcggccgctgcacatccgcttcggccgcgagcagcatcgcgcgcagcaggcggacgaaccgagctggcgcaagcgcatctggcgcctgcacccgacctggaatggcgggcaggtacagtacgccgggcagatgggagggccgctggaatcgttgtgtggcagctgccatgcaccgctgcagcgcctgctgcgaaccgacgctgccgcgctgcagccgggcgcggcgggtgagatcacgctgggcctgtgcctggactgctgcggctgggaagatccgcctgtgcgtttctatcgccacgatgccgccggcctgcccagctgccaccccagccagcatcgggaggtgccggccacgccgaccgacagtggtgatctgatgcaggccgaggtcggcctggtcgccatggacaccaggcggtgggaacagcaggactggggacagtccaatcatcggcagaacctgtcgcgcgtgggcggcgcaccgagctgggtgcagagtgcctggtatccggcgtgcatcgattgcggtgaggagatgcccttcgtgatgcagctggattcgacgctgccgactaccggtggagggacgctgctatggggcagcggcggcatgctctacacgttctggtgcgcgaagtgccgggtgagtgggcatttctggcagtgcacctga

SEQ ID NO: 91188 - DNA, 135 bp, Glycine max
  Peptide Sequence Number=SeqID_207966
atggtctcgcttgtcaacaacgctcacggcgccgtcaatggttttcctggtatatcccagacgctcattatcgatacagaccctgggatcgactctgctcttaatccatttcgatatttactaccttttccctga

SEQ ID NO: 91189 - DNA, 267 bp, Glycine max
  Peptide Sequence Number=SeqID_207967
atgcaacgatgcttgtttttccttctggaatgttgtgggactttacggattgtgcaaaaatgcttcctttcgacttctagaacgttgcagaacttcacagattacctaacgatgggtgtagagtacctcgaggcagtcaagcgaagattgcatgccacaaaacaatggtccccggatgaaattagggtgcggatgaccatgcagtacccccgcatgtcatcggacttgctgtctctagatgacgaaaggtacagaagacggcgttag

SEQ ID NO: 91190 - DNA, 478 bp, Glycine max
  Peptide Sequence Number=SeqID_207968
atgacatgcggggtaccgtatggttattcgcacctttcttcatcccgaggcggcaagcccaatgacatgtgggggtaccatctggttatcggcacctttcgtcatcctgaggcggcaagcctgatgagatgcggggagacttacatcgtcttctgcaccttttgtcatcccgaggcgacgagcccgatgacatgcggaggtaccgtatggttatccgcaccttggtcattccgaggcggcaagcccgatgacatgcgggggtatcgggtgaacgagtccgttgacgcgcagagactaacgtcgtctcctgcatctttcgtcaacaaggggcaaacgagtccgttgacgtgcagagacttacatcatcttctgcaccttttgtcatcccgaggcgacgagcctgatgacatgcgggggtaccgtatggttatccgcaccttttgtcatcccgagatggcaagtccgatgacatgcgggg

SEQ ID NO: 91191 - DNA, 244 bp, Glycine max
  Peptide Sequence Number=SeqID_207969
agcttccgttctgaatttcgagcatctcgatatacttcgggacacaatcagacattcgagtaaaaagttattgtcgttagattttggtcagagcttccgttctgaatttcgagcgtctgatacacaacgggagagaatcggaaagccgagtaaaaagttattgtcgattgattttgctcagagcttctgttctgaatttggagcgtctcgatacactacgggacacaatcggacattcgagtaa

SEQ ID NO: 91192 - DNA, 704 bp, Glycine max
  Peptide Sequence Number=SeqID_207970
atggcctcagaatcacacgatgattctaaagtagacctccaaaaacaaatccaaaagacaaaacaaaccaaaacagtttgtaaccagaaagaaaaacgaatgttggctcaacaagacccaacaccacaacccaccaacaactatatttcaaaaaacaaattctttaatgtcctacaaatggagccagaatattgggacaagaatcctttcaaagcaaccgccaaagtcttcccccaagggtttcattatagaccaacagccctcaataaaactagaaaattctatgagttcattctagtggatacaaattcagtatccatcaaacatttcaaggactcaaaagatccaagcctaaacacccactccaaaatccaaattctgaaagtaatgcagccacggcattacggaaccaatcttaaccaacccaagaagttttctgcaccttttgacctagcaggatacacttattgggattacattgatgcctggaccaatgtattttggcaccagaataataaattcaagcatccatcgttgatttacttcaaaaatagtattgtttaccattttccaaactggtttctccaatggtggaattattttggaccaataccacaaatattcccagaagaagtccaacagggatttcaacagttcaataaattattcaacagccaggaattaagaattctagccgatttaaa

SEQ ID NO: 91193 - DNA, 962 bp, Glycine max
  Peptide Sequence Number=SeqID_207971
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatactgttccagcaaattgtagctcaactcaaactcaggaagcccctaatagataatagccctagctctccatacgataggcacagaatgctccacggcaccccaattttctttgatcacaaagctgtctgtacggacacgagccctttttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 91194 - DNA, 326 bp, Glycine max
  Peptide Sequence Number=SeqID_207972
ggatcgcacccacaaagacacctagtggacccgaaaaagtcaaacagggccctggggtttccagctctggttacgggcctctatcagtcctacagggtgcccgtacccccccggcaaggtcacgtcatcatagttctacggagtacctgtcacctccagcaagggcatcaggccccctactaatcgagctttcatcaagaagtactgcgcccccaggcaggcgcagggcgaaacaccacagcagcattgggatggccggtagcgggcaaatagacataccgccaccacctctagagttcacctcagctcatccgcaaaaagcttag

SEQ ID NO: 91195 - DNA, 246 bp, Glycine max
  Peptide Sequence Number=SeqID_207973
gttaatgaggcaaattggcaacaatgctattttcaccttctcgctaagccatggctaagcacgaggaagaatccagaagaagatgagctatcaggttcgctgagtgcaccgctccaggtcatcaagcgcaccgcttcagctcatccactaagcaagagaagcgcgctaagacacaatccacctatgcacgctaagcgatccagatttgcgctaagtgcgcaagcacggaccaacccacctatttaa

SEQ ID NO: 91196 - DNA, 723 bp, Glycine max
  Peptide Sequence Number=SeqID_207974
atgtacaccgccaataccagcgatatcgccattcttaaacgcgcgcaccagaaaatggtcgctgcggtagcgaaagcctgggaagggcgggcggataatctaccctataaagatcaaaaccagttactgaccatggcctctatcgttgagaaagagaccgcggttcctgccgagcgcgatcgcgtggcgtcggtttttatcaaccgtctacgcattggcatgcgtttgcagaccgaccctaccgtaatttacggcatgggagagcgctataatggtaaactgtcgcgtaaagatctggagacgccgaccgcttataacacctatgtgattagcggtatgccgccagggccaatcgccgtgccgggcgaagcgtctctcaatgcggcatcccatccggcgaaaacgccgtacctctattttgttgccgacggcaaaggcggccatactaactatatcgttatcgaaggcctggaaggggcggggaaaaccaccgcacgcaatctggtcgttgaggctctggaacagttgggtatccgcgatatggtgtttacccgtgaaccgggcggtaccatcctggctgaaaagctgcgcagcctggtgctggatatccagtctaccggcgatgaagtcattaacgataaagctgaagtgctgatgttttacgccgcccgcgtacagctggtggaaacggtgattaagcctgctctggctcgcggtcaatgg

SEQ ID NO: 91197 - DNA, 429 bp, Glycine max
  Peptide Sequence Number=SeqID_207975
atggagatcatggttagaacacgaggtttaggtcatgctttagctagggttataggtagaggtagacaggatgagcatgatgcagtcgatgctccccagaggcgtagacctactgcatcagcccgtaggcgacgagtatatattacggttgatgagggtattcctcaggtgactgaggatgttcctcatatggcggaggatgttcctcaggtgactgaggatgtccctcatatggctgacgatgttgctcagaggagtgaagatgtgcctcagatgaccgcagacgtagatgcgactgttgcagaggacttaagtcgtgatggtgctgaggggtcatatactgatgagggattccctggtgggccccgtgacccatcagttctgacttcatttgcgaagcatgtcacacatgccatttggactggacag

SEQ ID NO: 91198 - DNA, 681 bp, Glycine max
  Peptide Sequence Number=SeqID_207976
atgacatctgcagcagctcaagaaatcgcagacaaaattgatgaattacaagaacaagctaaacagggagcttttgtcccacatggtcgtcaagacatcctaaacactgccattggtcgtccagagcatcctgaacgtgttcgtgtcgatggacatggtgtgaccataaccagctactttggacatgcttcctgtgggtcccacagttcatcgcctgtgatcaccgccgaaagattggttgaaatcatacaaactataaagcaagaggtgaagaaagaggtagaagacgagaacaaagaccgtatggacaagatgaaaatggagttggatgcgatcaagagtgaattatcccaaattcatacgcaacagtcagctcccccaagaccgtctaaccctgacgtatttgttgcacgtgttagcacgaaagagagttgtgttgaagttgccaataatgttgttggtaacgagcggtctacatttgatacatggggaaaggtctttggagtaggtggcacgatacacactgttgcttatggagatgatgtagtaagggtgtgtgttgaaactgtatacgatgctgaagccattgtcccgttacccacttcagagattcagtatgtcagggacgccatgaactcattcattggatggcccatacatctagtgaaacctttatcttat

SEQ ID NO: 91199 - DNA, 107 bp, Glycine max
  Peptide Sequence Number=SeqID_207977
atgccctttttgacttccggaatgttgcggaactttacggattgcgcaacaatgcttcctttcgacttccagaatgttgcgaaacttcacggattacctaacgatgg

SEQ ID NO: 91200 - DNA, 519 bp, Glycine max
  Peptide Sequence Number=SeqID_207978
atgtgggaagctacaacttgttacctgaagatttcttatggtgtggctcatgtgagcttaaagagtgacaacacgactcacacatcccaagaaatgtcgaacatttgggatgaagtggagcctgaaattgcatcaaggagtatcgtgttgatgaggatcagggatacacttacactccatcgcttccctaggatgatttgtgatgatgatggaccctatgatagtggacataggagtggagttcatcccagaggggcattggactccatcattttgagccagatagagaaggagcttaaggcggaccctgaggaggaaccaatagaggggtcagaggctaagggagactttgttgcaacagaggtagcagaggctagagttggtgagatagagatcttaaaatggtatacaaagaatctacactgtccagaagcatccgttgttgaaaggtacgttgcagaagaagctattgcaaaacctgttggcttcccgagtctcaacatgatgaaagagtggaag

SEQ ID NO: 91201 - DNA, 306 bp, Glycine max
  Peptide Sequence Number=SeqID_207979
atgatgttgtcacttgagggcaaaagtgctaaacttgatgtctcactaagcgagctcaatgcgcttagcaagtgtcatccgctaagtaaggcatcaacgcgcctagcggataggaggaatctggaagggaatctgtcacgcaggcatgcactgaacgcgtcatcagctcgctcagcgagtcgtttgtcaccttctaggcttagcgcgagtttggcgctgagcgaaacttcacttactcgcgctaagttcgagaatggcactaagcacgacgatgaggtcaatgagccctttttaagcctggaatag

SEQ ID NO: 91202 - DNA, 231 bp, Glycine max
  Peptide Sequence Number=SeqID_207980
atgccaagatgtgcacatgtgcaatttttggtaccccaaaatgctttgagtatgcatgtatgtgaatttagccaaggagatgtgtgtgatgtaagtaacaaatacaccttggaagtacgtgtaaataatctaggaatggcaccgaggaagcttgcctcaaagaggtccaggaaggacaaggcggccgaaggaactagtttccgccccggagtacgacagtcaccgctttag

SEQ ID NO: 91203 - DNA, 468 bp, Glycine max
  Peptide Sequence Number=SeqID_207981
atgaatctaagattttaccattataccatagaagattttaccattaagcaaagaggaagaactcattcatttggtgcagctacaccaaatgagtgtgcgcttcctttttgttctcaacttaaaaggctagagaatgatagaaatggaatttcacctaagaaagcccatgatgtagaagcaagatattttgatgttttgatgatgccaaaggatcaagtgcttctcaagttttattcaagacaagaatccaagaatccaagaaaatcaagatatatgaccaagttgatctctagaatcttaggaagaagtttccaaattgaaaaagcaaaagggattaagagaccaagggtctcttgttctaaaggattcctgaacacaagggaagggttttccttgtgtggttcagactttgtaaaaggagttttacaaagagagtggaaaatcgcaagtgggttgcttgaggactaa

SEQ ID NO: 91204 - DNA, 366 bp, Glycine max
  Peptide Sequence Number=SeqID_207982
atgggagaaaagagagaacaagagaaagaaaatagtgaggcaccacaaaggaatatgaaaaagaagagtgatacacccgaggaaaagagtgatacacatgagagaaaatttaattattttgcagaggcgagtgaagaatttaaaaatgtctttcctaaggagattcctcatggactaccaccttcaagaggcatagaacatcaagttgatctcctccccggagcttcattgcctaacagaccaacttacaaaagcaatccccaagagactcaacgtaaggatgcacatgccaaagttgagtatgtgaaaagattgtatgaccaagtgaaggtgcaaattgcaaagaagaatgaaaactatgcctag

SEQ ID NO: 91205 - DNA, 279 bp, Glycine max
  Peptide Sequence Number=SeqID_207983
atgactccacctaaagaaattgtgaccatcatttaccacaatggtcacattgtagatgatccaacacgtgttatttcagctcaactattcgacaatgatgatcttagaggtgcgatggaaacaattctccaaaatccacaattgaattctaccgaattctatgttgttactgagcttattcctcaaccacaatcatcgtctccacaaccctcatgtccacaactacaactatcgcctccacaacagttaccgtacaacaacatagacctcaataatcca

SEQ ID NO: 91206 - DNA, 765 bp, Glycine max
  Peptide Sequence Number=SeqID_207984
atggcggacagaggtagaggtggtggtcgtagaacatttaatcgtggtagaagatgtggttttagtttgggagctccaattaccaccaacccttcctcttcatccattcacatatcaacctcagagtcgatgatacatgtcgttgcacagactccaaacacacttcctacatctcaagaccaaccaaatcctacctttgtaagggagtcaattcccactacccctgttagagatgcttcaccttcagcaccagatgattctcttacacctgagtacccactggatccaaattgtgaacatattgttgatcagaggcctttcattcgtgcatataaaggagagtttcaaccaacatatgggtgttctaatttcatatcaaatatcattagggaaaaatttgatgaactagctgcaagttggttgaaggtgtcagttgaccttcgcgataggtggtttggagagtttaagaaagagtataggtggcacccacaagaaaagcgagccattagagctgtttttgagacaaaagccttggacgaacattggggttctacagatttcctaaacaagagctctactgccaaggtgaatcgatctgttgatagaggagcctcaacatactatggtggttccgtatctattgaaactcactttgaaaagttgtcaaaggagtttcaaagaccaccaactacttggaaggtgatggagaaaactaagaaattgaagtcgggagaatgggtcaatgacaagtcccgcgaatttgct

SEQ ID NO: 91207 - DNA, 369 bp, Glycine max
  Peptide Sequence Number=SeqID_207985
atgtacccagttgagcaatacatgaagatattaaaagggtatacaaaggatctacactatcctaaagcattcattgttgaaaggtacattgcagaaggagctattgaattttgttcagagtacattgaaaaggcaaaaccagttgggcttcttgagtctcggcatgatgagaaagtgggaggttgtcaaaagaggctaaattgtgaagtgtcaaacttcagcgcgcttagcatgaccaaggaatctggaagagcacaggaatcaaggccgcgggctaagtgtgagagcaactcactaagcgcgatgtttgtctcttaccaggctcagcacaacaatggtgctaagctcaaaatcactaactcgtgctaa

SEQ ID NO: 91208 - DNA, 240 bp, Glycine max
  Peptide Sequence Number=SeqID_207986
atgtcattgcagtcacagaagcgtagcccagtttgcgacaaagacgaactcaggcagaaggagaaagaagaagaacgccctaggagtcttaaggcgaaccacaatggacttccaaaatcgattcccaccctttctgggactctttcctttcctagttttcttcgacctgcgaaatcacagaagcgcaagccaatttgcgacaaagacgaactcaggcagaaggagaaagaagaagaatga

SEQ ID NO: 91209 - DNA, 177 bp, Glycine max
  Peptide Sequence Number=SeqID_207987
atgaaggatgtgtgcaatgtgataacatttgcaggggtcaatgtcttctacaagctcgccgtaaacgatggcatgagcttgagggtcgttgttgcctaccgctttgtattcgccacagttttcatagctccacttgctctcatcgttgaaaggttcattaattcattagctggctag

SEQ ID NO: 91210 - DNA, 685 bp, Glycine max
  Peptide Sequence Number=SeqID_207988
atgcgaagtgaccgtgtaagactcataatttcattagcactactggtcgcagccgttgtggcattgttattaccagggggaagacaagcaacaggtattgctaagcttttcagtagaatcaaactcggtttggacctcagcggtggtgtaaggcttgagtacagagttgatattgaaaaaggtgtagaaaatccaagtgctgtagttgacgatgtgtggacagttctcagaaataggcttgactcggctggatatacggaagcagtagtaaagaaaagtttcagggaaaataattcatttatcatagttgaaattcctgatgcaactgacacatcatttgctgaaaaattggttggttcaaccggtcttttgtggtttggtcaggcaatcgacgaaagagattacgatccaactactaatcctgatgatgtgaaccttgctactagggaaggagcacaatggtattcagataaagacggaaaaaaatggtacttaataaagaaagaaatcaataacagaaaagatcttgtcctttctggtccaagaatttccgaagcagttcctactgttgaccaaaaaggtgttgcaaattatgttgtatcgttcaccttggcaagagaatacgttgaagtatttaaaaatataacaaaagagctttatgtaccagaacaagtcctcaatagtg

SEQ ID NO: 91211 - DNA, 546 bp, Glycine max
  Peptide Sequence Number=SeqID_207989
atgaccaaaagtcgatccaatccccaacttattcttctatggaaccttatgatgttatctgaaaactttagcattgataaggaaacccttaggaaagacttttattctctggaaaatgaacttcaaaggagatggtttttccaacattacaagggtgcaaacagaagacagatccaagacacgttctatgaatttgtcgaaagagtcaaaattaatgtccttttctttgattggtttcatgcttataccatcagaaaggatatagattacccttggaaacaagacatcataggtgatccaacaacaaatgtcataacaaactggaaaatgaaggacggtgagttaatccaatcagaattacctcccgtaacacaatatcaaccaccgaatgtcaaagatagtaacaataaacctgtcatggccgttccattcaaaacaaaagatgttaacgaggaagtaacctctaaagacattaagagcctaatggaacaagcaaattacaccaacaaatatttgcaagttttaggagaaaccattaaaactaag

SEQ ID NO: 91212 - DNA, 1077 bp, Glycine max
  Peptide Sequence Number=SeqID_207990
atggcctcagaatcagacgatgattctgaaacagatctttttaaacaaatccaaaaagccaagcaaaccaaaacagttgttaacctaaaagaaaaattggttcaaaaagacccaataccaaaatccacaaatagttacattccaaagaacaaatttttcaacgtcctccaaatggaacctgaatattgggacaaaaatcccttcaaagccactgctatagctttttcctcgggattccattacaaaccaacatccctcaacaagacaagaacgttttatgaatttattttagtggatacatactcagtatccattaaacacttcaaagatccaaaagaccaaagcctaaatacccattctacaatccaactcttaaaagtaatgcaaccaaggcattacagatcaaatctcaaccaacccaaaaagttttctgcaccttttgacccaacaggatatacttattgggactatattgatgcctggactaatgtgttctggcaccaaaacaataaatacaaacattcatggctaatatacttcaaaaattatatcgtttacaattttccgaattggtttacccaatggtggacttatttcagtccgattccacaaattttccctgaggaggtccaacaaggattccaacaattctgcaaattgttcaatagccaggaatcaagaatcccgtatggaaaaactgaaaataataaacaatatccacctttgcaaaggcatgcatttgtcaaatggtggactcagtttgatacttcaaaagcggctcctgaccaagtcaagaactggtttcagagtcaccctgaattgctcaaaccagctgacccaaaaacatcactatttttgaaccaaaaatcacaacttgcagcatttctggcaagctccaaatctaaggaaagtcttgcaaagaatctcaaagaagttttccaaatacttcaacaagaagaagaggaagaatcttcaaagatagaagctgaatcttctgaagattttgatgaccaagatgatgatcccttttatcagaatgaggatgattgtttcggcatctcacttgaagaagattaa

SEQ ID NO: 91213 - DNA, 411 bp, Glycine max
  Peptide Sequence Number=SeqID_207991
atgtcggctgaggttgtcaagaattcttggaaaaaaatagcaaaggaatcagtcgtgataagcaaaggggagggctctgattttgtggcaaaagctgtggatttagcagccagagaattaataacaagtgcatcactaggacaagttacacaggtacagcttgaccgtgccaaggtatccacgaagtctgcagttctaatgaatttagagtccatagatattagaagagagcttggaatggaaataattgaggaacatacggtgatggaatattctaaggtcagcaagaaatgtgaaaaatgtggccatggggaagctacctattatactatacagatgagatcagcagacaaagggcaaactactttctacacatgtaccagctatggtcatccgtctcaggagaattag

SEQ ID NO: 91214 - DNA, 233 bp, Glycine max
  Peptide Sequence Number=SeqID_207992
atggcattgaacgagaaattagaagaacatttaggggcaaggggtaacgagaaagaacaactcaccagtgacgacggcgttggggtgatactccggcgaaaggcgacgagggagctgaggctagggttccgcggcagcggcgggggagcgcaaaaggacaagagggcaagaggttcgaaagggttacaagcgagactagggttagagagagttcagcgtgaaaggggaaagag

SEQ ID NO: 91215 - DNA, 462 bp, Glycine max
  Peptide Sequence Number=SeqID_207993
atggttagaattagaggattgcgtcgggctttaggtagacttttaggaagagccttagggagacatgttagttgtgatgcagaagaagcccctaagcttcgaaggccgacaacatctgcatgtagacagcaagcaactgtagctattgctgaggatgttaaccatgtggatcatgttgttgacgaggttcatgagcagcctcaggaaccagttacgaatcatgttggtgttgatatagagggttttccaggcggaccccatgatacatcaatgttgacgtcatatgttgatcatgaatgtactgagttgaagttggtctctcatgggaggaaagtagagaaatttgaatggcatgaacctgagattgaaggcatagtggctgctacaagattaagttctctgattacatgttcgttgaacattggtgacaagggacttttatctgcttttgcagagaggtga

SEQ ID NO: 91216 - DNA, 2028 bp, Glycine max
  Peptide Sequence Number=SeqID_207994
atggagtgcattgaagaagcaattgccaaattagcttccaatcaacttcacatcactactaatcttgacgaaatcatccaatgcatcacagttctagagactagccaacaacaatctccctcaccttcatcctcctctacaaacccacaccctatcagcccttcatcccatcttcctcgcatgatgctcaaagccccaagatttgatggatccgatccttcgggctggatcttcaaaatcaatcaattctttaagtaccacactacccctgaacctgaatgcctcgttatcgcctccttctccatgaagggtcttgcactagcctggttcctgttggtcctgaacatttgttgtgaagtccaagcccttcaacccttgaccttggttcaagcggctgggttggcaagacttcaggaggagaaaatagcagaacatcgacattccttccatggtcgaatgcactccggacctgaaccttcatcttctttcaccgccatctttaactctattaccttcatcgacgaaactgcctcccccacctgtcaagcgcttatctcccgaggagatggcgatttgatggtcgtggtgggtaatggaaatgaggtttcttgtcaccacctttatgttggagttgcgataaacatccaaggacagttgtatacgttcaatctccatgatttaccactatgtggggcagatttggtcctcagattcagtgctctaaacgccatcactgtcaaggaccagtttcctattccgacgattgatgaattattggacgaattaggaggtgtgtgttggttcttaaagcttgaccttttgcagggataccaccaaatactgatgaaagaagaagatatgagcaaaatgaattttcgaactcaccacaaccattatgagttttgtgttatgccatttggtctgtgcaatgccctatcatctttccaggcgaccatgaatagcatattcggtccttacttgcgcaagttcatcatcatcattttctttgatgacattctgatctacaatcagtcattcacagaacatctcgcacacctagaaaaagcctttgaggttttggttgtaggacaattcttcctcaagctttcgaagtgtatgtttgctcagaagcaggtcgagtaccaaggattctatagaagatttataaaggggtacgcttccatagtagccccattgactcgcctcttggtcaaagaccagttttattggttgctggaagcacatcaggctttcgacaaccttaagagtgcgatttgccaagcccctattcttggactgttggatttttctctgccttttgtcgttgaaatagatgccttaggggtaggccacacagttatcttggtggtagtcgatcgtttctccaaagggattcatctgggtatactccacccaccttcattatacagcctctacggtggcacatctctttatggatattgttggcaaaattcatggaatgtcgcgcagcttggtgtcgaatcaagactcgttattcataattgtgagacgatatttgctgagttaaagaagaagctcgttaaggcacaacagacaatgaagtactttgctgataactatagacgtgaggttcaattccataaaggtgattgggtgtttgtcaaactctggccttgctgccaaatgtccattataggagctacacattctaaattagccaaacgttatcacgacccattcaaggtattgcaaaagattggctcagttgcttaccaactgaaactaccaccagattcccgcatacacccagtgttcactgctcccttctcaaaccttaccatcagtccaccaatctggcatgtggatgttatgaagcagccaaggtcgactcaacaatcaaataacactaaaacagaaaagttgcaaatagacacaggggagacaagcactaaccagaggcccaaaaggaaaatcaacaaacctcaccacctcaaggatttcatagaactgtctatgaagaagaatgatgagctggcaaaagattag

SEQ ID NO: 91217 - DNA, 174 bp, Glycine max
  Peptide Sequence Number=SeqID_207995
atgaaagcaccaaggtgttatgatcagaactatgaaaaggatgatcctagcattcaatgtctaggtccctctagagaaaagatgaacggagggatgaaggagaggagactcgcagtgcaaacgaagggattaggagaagggaaacatgagagggaggggaggggatgggtgtag

SEQ ID NO: 91218 - DNA, 306 bp, Glycine max
  Peptide Sequence Number=SeqID_207996
atgaggattaccatgagaggaaaccacatgcttatcgctgaaagtctgggaaggcattaccaatggggttcatctattgttagacaccaaccagagaggatagtgcgacaatttggttatgttcagaccattcctccactccctgttgctccatccttatccatagaggagattgacgatagatggcttcaatttttagaataccttgcaccagttggacaaatttgtagtgctcctggacagtgtgcagcggactacatggagtggttctataggatatctcaccccttcatgagtttgacatag

SEQ ID NO: 91219 - DNA, 1910 bp, Glycine max
  Peptide Sequence Number=SeqID_207997
atgactagactggcaactcgaagaaaaaataaaaggcagagacagggggatgatggtggtggtggcacttctgacatatggaggaaaattcacaacacgggtgcggtgactgaagatgatataaatcaactgtatatgatttggaagccagtctgttcaggctgtcgtgttaatactaaagacaaccctaattgcttctgtgcattggttccgccaacaaatggtacccggaagactggtctatggcagaaggtgtctgactttgttgaaagtcttggtcctgacccaaatatggatcttcgtgcttctgatagttcacctgcaggtctgacaaatcttggtgcaacatgctatgccaacagtatactacagtgcttgttcatgaataaatctttccgagaaggcatattttctgtagaaccagatgttttacaacaacaaccagtgttagatcaactgactcggctttttgtacagttgcatgctagtaaaatggctttcatagattcttctccatttgtaaaaacactggagttagacaatgcagttcagcaggatagccacgagttcctgacattgcttctgtcattacttgagcattgtttgagccattccataattgccaaggcaagaacaatagttcaagatcttttccgaggaagtgtgtctcatgtgacaacgtgttcgcaatgtggaagagactctgaggcttcttccaaaatggaggacttctatgggttagagttgaatatcaagggactgaaaggtttagatgagagcctagatgattatcttgctattgaagagcttcatggtgacaatcaatatttctgtgagtcatgtaaaacgagagttgatgctactcgcagcatcaagctgcgtacattgcctgataatacaatgaagaagaaagttacttctgcattttcatttcccgctgaacttcatatgcaccatagattgtctgagccatctcagtttgaattgatgtatgacttgtcagctgtactgattcacaaaggaactgctgttaatagtggtcattacattgcccatatcaaggatgtaaacactgggcaatggtgggaatttgatgacgagaatgttactaacttgggttgtcatccagttggggaaggaagttcttctacttctaaatctgttaagacagatgtacttcattctaattgctctggagcaatgctagctgacagtaatggtttagatgccactcattcacgatcttcgcctctggagacattttcatctagtgatgcttacatgttgatgtaccatcttaagcatagcaaaaatgttggtgaaaagggtggaattgtttatggtgctaaccttgaagaagtagcgggcaatgcagttactgcacaagacagtgcttgtcttccttctcatctttgtgaagagattcaaagtttcaatgcctcatatcttgattcttgcgagcagtacaagcataggaaagtgttagaattgagccgtatcaatgagaggagacaggaagttcggtccattttagctgaagctcctactcaatcactgcagcaaccgtatttttggatttgtagtgactggcttcgtcagtgggctgacaaccttattccaattgctcttgacaatacatctatccaatgttcacatgggaaagtcccagtgtcaaaggttacctcaatgaagcgattatcttctaaagcatgggataaattattgtctaagtatggtgggggaccaactctttctcatgaagactgctgttgggattgtctgattgatggggctcagaatgtggtgtcagctgacacctatcgggatcaaagagaatcattgaagcgacttgcacgggatattcttgatggaaattgtgaagacggaatgtactatgtgtctagaccatg

SEQ ID NO: 91220 - DNA, 1089 bp, Glycine max
  Peptide Sequence Number=SeqID_207998
atgcctgagcaagctgttggtgctaagcggttgcttgttcctgaggattctggcttttcttatataaagatgccatttctattagtaaaacaaatgcagcgccaaaatcatgagaaattatttgttggtaaaagtatgccgcttactctaaattgcaagtatttcttagttccttcttcgtggatttcgaaatggagaaattacattaatttggctgtcaagacttcagataaacctgaaactttagatggggtaattgattcactgatctgtgaaaagcactcagggctcattgaaaggcttcctgaactggttatcacacgcggtgctataatcccaagggaatcttctgtaagtggcttaaccatcatatctgagagtgattggaaatgcttctgtgaagaatggagtggtattgagaccaaaggagtatctgcaagaattgagaatgttaatgattcagaaaatgcttttactggatcctgcagagagatgccaatatgtgaggatcaacttaacacttgggataaagtgaataatgaaagtaggaatggacaaattgtgattaagacttgtcctgaggtttgtgaaagttgcattggagaaaaggaaagctgtgagttaatgcagaaacttagctattgcaatcaggacattagtgtaattcttgtccgtggaagggaggtccccagatcaatcttacaggcttcaaagggctttgttgaaacagacagacgagtttccaaacgttcccggaagactaaaaatgagagttccattagtctgaaagtttctgcttcaacatcaatttatcagctgaaaatgatgatatgggaatcgtttggggttgtaaaagaaaaccagatactacaaaaaggtgatagaacaattgatcttgataatgaatatgctacgcttgtggatgtaaacatatttgctggagatcagattattgtgagggactctgagatccatgaaaatcgagatattgcagatgagctttgtgacgaggaaatggaaacacaacgtatcgaggcaggatttcgtggaacactcttaacgtcgaatggtttatctcaggtggtttag

SEQ ID NO: 91221 - DNA, 231 bp, Glycine max
  Peptide Sequence Number=SeqID_207999
atggcagatcctaatgatggtggaatcttgatgcaatatgcaaagttggtatgggagaaccatcatgacaaggatagaaaaatggtctattttgaatgtgcagttcaacctactcctcaagacagcttacctgagtgtccgcacgtgtccgtttctcaattttttgaaagagcaaaggttcactcacttggttttggaagatgttgcgggatgccgcattgtttaccatga

SEQ ID NO: 91222 - DNA, 183 bp, Glycine max
  Peptide Sequence Number=SeqID_208000
atgaaggttgcaatgagtaatgatggtagcaatgaaggttgcgataggtttcaaggaaggcacaggtgggttgaatgtgtagagatgactttatcaacattgaggaagaagaagaaattgatcaagctaagacaggtgaaacagatttttgtgtttactttctatgtccttaaaaagacataa

SEQ ID NO: 91223 - DNA, 222 bp, Glycine max
  Peptide Sequence Number=SeqID_208001
atgcttcgcgtgacactaaagttgaaccacatagttaccaccatagttaccaagaggagggtgtgcatattgtattctatagcaagaggtagcaaagtgattgaatcaatggccaccaataacatgtcccagaagccaatactgctatcaaacctcgcttccagtgtgaaacaagttccctctaatttcatcaagcccttcgatgaccgttcaactctttaa

SEQ ID NO: 91224 - DNA, 267 bp, Glycine max
  Peptide Sequence Number=SeqID_208002
atggctccgagaaagctttccacaaagcgatctaggaaggacgccgcggccgaaggaactagtgccgctcccgagttcgatagccatcgtttcaggagcacggaacatcagcagcctttcgaagccatcaagggatggtccttccaccgagagagacgcgtccagctcagggacgactattctagagttttatgccaatgcttggcccacggaggagggcgtgtgggacctgcggtcatgggtaaggggtcagtggattccttttga

SEQ ID NO: 91225 - DNA, 222 bp, Glycine max
  Peptide Sequence Number=SeqID_208003
atgtctaatgaagaattgaagttgaaggatccacgatgtcggatacaatgtcctgacatcctgctcgaaaatactggaagtgctgtacaatgcaagataaaaattttcaggaagaagatagatctcctccagcatcaagaacttgcagcccagaatcgtacacggctatataatcatggaggctgcacgagttctgcaccaagtccgggattgaagagttag

SEQ ID NO: 91226 - DNA, 259 bp, Glycine max
  Peptide Sequence Number=SeqID_208004
atgactgttgcagacagtattaagacaactctccctaaaatcgaaagtgataaaaagtttatgggattagtgggagagtattctcaaacagctgataagtttgttgttgggacattaatgagtacattgaccaccatgaagtttgatggttcacccaccaagggaatcaaggagcttaaaaagaaatttatgaagaagcatgataaagacaaatggtcattaaagaacaatgacaactctttgcaaatccagaagaaag

SEQ ID NO: 91227 - DNA, 480 bp, Glycine max
  Peptide Sequence Number=SeqID_208005
atgggcggcgccagccaggggcgaacgaggcggtcgagccgtgcggacgcggtgtccgatcgccattgggacgggtatgtgggtgtccaggtccagataccgatcggggacctgagcgcacgacaggctgaagtccatgcaaaagccgacgcggacaaccaggcgctgctgctcgaagacgccgaacagcagttggcgctggacgtgaacaacgcggtgcgggaactggcctcgcgatggcgccagtacgaaatcgcggggcgcgtccgcgatctttcacgcaagaagctcgagatcgaacaccagaagctgcaggcaggacgatcgagcaattttcaggtgctggcctttgaaaccgatctacgcggggcggagaacgcccgactcaatgccttgatcggctatctggatgcacaggcgcagctggacctgaagcttggcatgacattgcaaagttggggtatctcgctgaatgactaa

SEQ ID NO: 91228 - DNA, 282 bp, Glycine max
  Peptide Sequence Number=SeqID_208006
atggctaagtcagaccctgaggtagtcctggagttttatgctaatgcttggcccacagaggagggagtgcgagacatgcgttcatgggtcaggggtcagtggattccttttgacgcagatgccctcagccaattcctgggtgacccgctagtgttagaggaaggccaggagtgtgagttcagtcagaggaggaacatggccgacgagttcgacgaggaggccattgcccaactattatgcacaccggggcaggatttcacccggaccgctgcagggaggcgg

SEQ ID NO: 91229 - DNA, 258 bp, Glycine max
  Peptide Sequence Number=SeqID_208007
atgagtggaaagggattgcagcatgttcggaaatcactttctcaatatcagcgtcttagagcatgtttggaaatcaaatgggataccaattgggaaagaggaactcaaaaacttcgacatccttaccttcaggaacacttgaaaggtggcaacgccactcaaaaaggcacgacttcggctacatggcggtggtgggagcagcaggtccacttcggcttcaagtacttcacggcgggaaacaaaacgtcagggtggtag

SEQ ID NO: 91230 - DNA, 348 bp, Glycine max
  Peptide Sequence Number=SeqID_208008
atgtacggtctaatagaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgatgctacatagttggttctcatccttcagagactacgagtataataggagcatccgtcaacaaaaggatcaccctaagatga

SEQ ID NO: 91231 - DNA, 600 bp, Glycine max
  Peptide Sequence Number=SeqID_208009
atggcgattggcgtgatggggattgtcgcggcagtgctgtgcctggtcgccccgatgctgacgcgccggatgcagaagcggaagctgtttatgatcctctgcgggctggacgtggcggtgcgcgtggtgatgtggtttgtcgggtatcagcaggtgacgatgctgtttatcctgctcggcctgagcaccctgtttgtgatgatgaccaacatcctcacctcgtcgatgattgccgacaccatcgagtacgcggagtaccacacccacaagcgctgcgcggcgatcaccttctccgggcagacctttaccggcaagatgtcggtggcggtgggcggcgggttaatcggcgtgtttctgacgatgattggctacgtgccgcaggcgcagatccagagcgagggcgtgttgtcggggctgttcttcgggatctgcctgctgccggcgatggggtcgctgatccgaatgggctttatgtcgcgctttacctttaccgaggagaagcatgcggagatttgtcggctgctggcagagcgtcggcatcatttaaaaaatagccgtgcggaaaatgagcggctggagcgcccggcacctgcgaactaa

SEQ ID NO: 91232 - DNA, 474 bp, Glycine max
  Peptide Sequence Number=SeqID_208010
atggcgggtttctatcacgtccaccttcccaaaaaagactggacagtcgctgccggaaaagagttgaaatggagattaacgtctcaaagtgcagggagcgaaagtattttcccaaccatgaactcagacatcattcttgagcacaggcaacctgcacagcgcatcatcatcgacactaaattcaataacattctgattaaaggctggtatcgtgatcggagcttgcgcagcggttatatctaccagatgtatacctatctgcgcacgcaggagaatcgaacagacccgctatctctccgttcggctggattattacttcatccagccgtcaacgtaatgctctccgaattcgttgaggtacaggggcataaaatccactttgccaccgttgatttagcagcagatgccgtcacaatgactcagcaattattgaaattagcccatgattgctgtgggatagctgacgtgaattaa

SEQ ID NO: 91233 - DNA, 459 bp, Glycine max
  Peptide Sequence Number=SeqID_208011
atggaaaccatatcaaaacgctttgagaagctcgatgtttgtggcaaagtacatttgaagacaaagttgcgagaaattgcttatcctgatctgaactccatgtgtgctcctccagaaaaggtgaagaccacgggtgctccaaaaaaaccgttgaccaaacaacaaaagtcaagaaaatgtgatccgtcttattgggagtatgttgatgcgttaaactctgtgcaaaatagtaattctttagtgaaacgtagtgcatcatcatctgaggaacctatacagagacaaaatattccaatgttggatcaatttcatcagtgcatccatgattctattgaaaacattattgatatcaaagcggatggtaactatagttatcgggcaatagctgccttattgggtatgggtgaagaattatggtcattggtgcgcaaccatctgcataaagaattgacaagctga

SEQ ID NO: 91234 - DNA, 474 bp, Glycine max
  Peptide Sequence Number=SeqID_208012
atggtcattctacgtcttttttcatccagaggcggcgggcccgaggacatgcggagacaaattatgagactaacgttgtcttctgcacctttgtcatctagaggcggcgagcccaatgacatgcgaagacaaattatgagactaacgtcgtcttctgcacctttgtcatccaaaggcggcaggcccgatgacatgcaggaaccatttggtcccgcaccttttcaccttttgtcatccagaggtggcgggctcgatgacatgcaagaaccatttggtcctgcaccttttcaccttttgtcatccagaggcggcaggcccgatgacatgcgggaaccatttggtcccggagcttttcaccttttgtcatccagaggtggcgggctcgatgacatgcgggaaccatttggtcccgcaccttttcaccttttgtcatccagaggcggcaggcccgatggcatgcggggaaccatttga

SEQ ID NO: 91235 - DNA, 339 bp, Glycine max
  Peptide Sequence Number=SeqID_208013
atgtcgctgcaggttctttatcttcgtgcgttttctagatctccccccggggatttccggtccgttgtatctcttgttacgatctttcaaagaaatgaacatagatttgaggcttttagtcctcacgggcaggatcaccttgggctaccttctggagtgaagacaaaacatgaatggcagaaaccagtcaaggtacttaaggatgaacgcaagcggggatggggtcacgaccgaccgatcgttgctcttctctgtgcgaaacaaacagggaatgtcgctgcaaggcagctccgtatcctttgtattttgcagctttcttttactatttgtttgttttaa

SEQ ID NO: 91236 - DNA, 150 bp, Glycine max
  Peptide Sequence Number=SeqID_208014
atgaggcaatggatccatgcacatggggattcctctgtggcggtggatctgatgactggcaggatgagtccatgcaaggatgaccatgaagcgtgtcctgtggtagagcgacaatgcaaggtactagggcttgctgacagtaatggctag

SEQ ID NO: 91237 - DNA, 99 bp, Glycine max
  Peptide Sequence Number=SeqID_208015
atggtcctcgtcattgctggtcctccgtcgtcatcgctgcctcgctggtcctcactcgcactccaagctttgcttcacgtcaccatgctaaggtgttag

SEQ ID NO: 91238 - DNA, 552 bp, Glycine max
  Peptide Sequence Number=SeqID_208016
atgggtaggcttaacacaaataaggtgtgcatggttgggttgaaaccgcgtcaggacaattcggccaacctgcatttaagtatcagggttgaagaaaacctagatgacctagcctccaaacgatgcgacaactggggaaccaccaaggaaggtggtgcgccctcctctcgatgccactggctggcaattagagagagccataggggcagtgacgacgcgatggtggcggaggtgttgttggaggaatggtggcgcacacgaaacaagaagaaaagaagaaacataggtgaggggccctcggtgtgtttcacagtgccagaagatttttgcatgaaaggaatggctttgtgtgttgttcatgtatcaacccctgaaatcgtggcaactaaatgtcttactagtgtcgtaattgttaattgcacaaagtgcactatccagatatacaagcgagacacagtcatttcctttaacgatgaagattggcgggacataatatcacatttgggagctggagacaaggtggagattgttgtgacttttgaacatagattg

SEQ ID NO: 91239 - DNA, 147 bp, Glycine max
  Peptide Sequence Number=SeqID_208017
atgaagttcttaagtgatggtgacgtaattctcccaagaaggggacccatcaccagagccatggctaggagactccaagaagattgggtcagaggtgtaggagaaagccctagggttcttatgagtcttaggggctccatagtgtag

SEQ ID NO: 91240 - DNA, 405 bp, Glycine max
  Peptide Sequence Number=SeqID_208018
atggagggtaacttgaaattgtcaaagctcgatggtggcaataaggaagatcatacttcattcgaaattgttgtaggaaacttgaggaacattaataagcaagtcattgttacactttctacttgtgaagttgagtacatagttgcaacttcttgcatatgtctaagacggttgaaggagtttaacatggaccaagagaaaagtataaagattcatattgataacaaatctgctcaagttcttgctaataatctgatgttttatgaacaaagcaagcacataggcacaatatatcatttcattagagaatgtgttgcacgaaaagaagtagagttagttcatgtgagaacacaagatcaagttgcagatatttcacgaaactcctcaaatttgaaaattttataa

SEQ ID NO: 91241 - DNA, 177 bp, Glycine max
  Peptide Sequence Number=SeqID_208019
atgtcaaatgagaggtggaaagatacaaaggaaggcttgttgctaaaggccataagcaataacatggagttgattatgatgaagtgtttgcattggttgctcggaaaaagagaaggtattgaaattgaaaaaggcattgtatggccagctaaagcaagcaccaagggcatggaataa

SEQ ID NO: 91242 - DNA, 171 bp, Glycine max
  Peptide Sequence Number=SeqID_208020
atggggccaggacacaatcatggatgcctcggtgcgacacggcgatggggtggggaggtagattcacatcatagatcacaaatgctagttaaagcagatgagccaaaaaccaagaccatcttaaacaagttccaaatcaagttccaaacaaagatcttaaacaagaaataa

SEQ ID NO: 91243 - DNA, 117 bp, Glycine max
  Peptide Sequence Number=SeqID_208021
atgactgttaaaaagaggctaagtcatgaagtgctaaaagtgacagttgagctcagctcatcagttgggctaagcgtgcatccatcgctaagcgcagcttcagcgcgcttagcgtga

SEQ ID NO: 91244 - DNA, 174 bp, Glycine max
  Peptide Sequence Number=SeqID_208022
atgagtttaggcctgcttaggcttaagcgaggacttccaatggctccaagtcttactatcttagctcacatagcgcttagcatgccacgcttaagcgagctggtcttcatcacccatcctttgagttcctcttgctcatgcgtagaggttcacttgagcgaggcatgccattag

SEQ ID NO: 91245 - DNA, 618 bp, Glycine max
  Peptide Sequence Number=SeqID_208023
atggacgaagaacagtggatgtatgatagtattatatatgaagaagttgatatgaatgttgaaaatgaggaagatgctggcatgaaattgtttgctagttgtgatgaagttttacattggactcgaccgatgactcatgacattggatttgttgtcgtgataatgacgtcagacaccaatactggtgttagaggcagagccttatttctgttaatagcttgcgaaaggagtggtgagtataggcctaagaagaatgatttggtaagaacatgtactgatagtggaaaatgtggatgcccatttaagttgcgtgtgaaaccagttttgggaggagaaggatgtatggtgaagttaatttgtggggttcacaatcatgaaatgccaaagttattagttggacatccatatgcaggtcgactaactaaagataagaagattgttgttgttgatatgatgaagtccatggtgaagccaagaaatattcttttgacgttgaaggagcataatgccaacagttatgcaacaatcaaacaaatttacaatgccagacatgcttaccgttcttccataagaaggagtaacactgaaatgcaacaactcatgatcctgcttgattga

SEQ ID NO: 91246 - DNA, 300 bp, Glycine max
  Peptide Sequence Number=SeqID_208024
atgggtagagtgacaaaagcttcacttcactgctttaggtggtgtaggatatgcttccagaggaaaacacgttgccaaaaatatcaggcaaagaagatactgtgtccgatgggtatggagtataagaagattcatgcatgccttaatgattgcatactgtacatacatgagtttgaagaaatgcagaagttccccaggtgtggggtatcacggtacaaagtgaaggatgatgataagtgtagctgtgatgaaggcactaagaaaggtgatgcaatcctaccccccaagggcattggatag

SEQ ID NO: 91247 - DNA, 455 bp, Glycine max
  Peptide Sequence Number=SeqID_208025
gaggatccttgacaacacgcgtctattgtcgttgcctactggcagatgcggtaggccttcgccgttggaggcatcattatcatcgtcactcacctttctcctccccaagggaacaaagaataacttacctcgaagaagatcacgcaacgaagaacaagaagaagaactgtgacccaggaacaaccacgaaccaccaacaacaacaacaagcagaaagaagcaatgtgcatgagaagcagaggaacaagaagcaaagaagtagaggacggagaagaagcagagaagcaaaggacgaggaagaagcagatgcagcgcttgaggaagtgacttgtgaagggcattttagcccttttacctatgttgctgggtgtcctaacaaaaatgctgggtgtccaaagcaacaccctttagtgatttattttcttgtttttggccactttgttaatgtgttttaa

SEQ ID NO: 91248 - DNA, 297 bp, Glycine max
  Peptide Sequence Number=SeqID_208026
atgcattctttgaatgacaaactttcccctcatgcattgcgtaattacacaatccccaccatggatggtacctctggaaatgctatcttggctacaatcataaatatccgaaacagggatgctatcatggctaccacaaatagccaaaacagggatgctatcacggtagctggaaatgcgactatatgggctactatcacaaatatacaaagccctcatcaggggctatatataaacatatataaacaaacaacgagagactccaagggctgcgctaacacaaacaatgaatcatag

SEQ ID NO: 91249 - DNA, 327 bp, Glycine max
  Peptide Sequence Number=SeqID_208027
atgattacatttggtcaagtttctacactagtactaaacaaggctatggaagatgcatggagaaagaaaaactctcacattgttcttgagttcaatcgatgtgacacacagttcttagtccaggagacaattaacccgagagaggtttggcctgttggaaatttcacggttaggctggatgaaaaatggtgtgactatggcaaattccaaaaagtgaacatgccttgttctcatgttgttgttgcttgtaagcatgttcaccatgagtatgagaattacaaatatcatgtgtatacattggaaagtatctccaacatgtacaaatga

SEQ ID NO: 91250 - DNA, 363 bp, Glycine max
  Peptide Sequence Number=SeqID_208028
atgggggagacatgtgaaattccccaccacaatctagccgacttcgagtcttgcctcggatatgccactgaagggcaagcagttggtggtatacccctgcaaaacactttggagggccctcagtatcacccacaaccacacccattgcattccacagtgggtaaaaaccctcatgctatggcagaaattggaaagttggatcatctagaagaaaggctcagggccattgaaggaggtgaagattatgcctttgctaacctagaggagttattcctagtacccaatatcatcacccctcccaagttcaatgtgtcggactttgacaagtacaaggggactacttgcaaccaagaaccaggctaa

SEQ ID NO: 91251 - DNA, 366 bp, Glycine max
  Peptide Sequence Number=SeqID_208029
atgtggaccaccacgggggaggagcttgccacccagctcgcccaggcgaccaaggttgcttcctccagaagcaacagccttctggaggaaggatatggaaggcccaagtgggccagattgctatttgcaaccccccttttaactaagtgcacccccttctattctcctgctttcgaagaagttacgaaaactcacggattgcgcaaaaacacctcttttcgacttccgccacattacggaatttcacggatcgcgcaagcctgcttccttttgatttccgagacgtctcaggacttcatttattgtgcaacaaaggacaccaagtacctcaaagcggctaaccaaaggtttcatgtcatcaagtaa

SEQ ID NO: 91252 - DNA, 276 bp, Glycine max
  Peptide Sequence Number=SeqID_208030
atggtgggctacacaccttcaagctttgctaatttagttttcgccagtgaaaggatcaaagtgggtctgaaaagaggcaaatttgatcatcttgctttgatgaatgagaaaattggggcaaatgaagaggatgagaatgagggagaaacccttgctgtgactgccattcctacacggccaaatttcccatcagccaaacaatgtcattactcagccagtatcagcccttctcattacccaccacctaatcatccacaaaggttgtccctaaattag

SEQ ID NO: 91253 - DNA, 282 bp, Glycine max
  Peptide Sequence Number=SeqID_208031
atgtccacctcatgctaccttaatccggatgaaaagggtaaacatgtagatgaatcaaaatatagaggtatgattgactcactattatatctaactactagtcatcccgatattatgcatagtgtttgtgtatgtgctagatttcaagctaatcctaaggaatctcatttagtggctattaagaggattcttaagtacattaagggttgtaaagttcataggaagagttctagtggtacttgtcatttgcttgggagtgctttggtttcttggcactcttag

SEQ ID NO: 91254 - DNA, 333 bp, Glycine max
  Peptide Sequence Number=SeqID_208032
atggtgacaataacgatggaggaggcgatgaaatggtgtgaaatagtgataacgacaacaacaacacgatggagacaacaaaatagtggtgatggtggcactagaggcaatggtgagggcagggcggggaaagtggtggtggtgatggtgataatgatggttaaaatgcttagcatgatggattcaaactcaccgtttctgcctcattgcaattctgatacaaaaaatgcatttcgcaagccttctggtgatgcagctaataggaattatcggcgtcggtcacctgttgaaggatcaccctcacctgatggttgggatcttttaagctgttga

SEQ ID NO: 91255 - DNA, 966 bp, Glycine max
  Peptide Sequence Number=SeqID_208033
atgaatagtggtgaatgttggcatgcccatgaccgtgatcgcacaattaccttgctgtcagcactgacgccaacagaaggctttaccctgactgcgctggatggcgtcaagctgatgcgttggaatcgcgcgattccgcgtagtcctgtgttttatgagcccagtattgtctttgtatgccagggccgcaaaatcggctacctggggggcgaagtctaccaatacaatccgcagcagttcctaattctttccgtgccactgccgtttgaaagcgagacaatcgcttcggcagaagagcctttgctggcgatttccatccgcatcaacctatcgatggtgtctgagttacttttgagtctgacgcatgatgcccccgtcaatatcaatggcaaaagcggtattagctcgaccccgctggatatgcgcttgtcgaatgcggtggtcaggttgctggagtgcctgcaatccagaaccgaggcggccgtactggggcaatcaattatccgtgagattcattaccgtatcctgcaatcgccacaagcatctgccattctggcggcccatagtactcacaacaatatgggcaaaatcagcaaggctctcaggttgattcatgccgaatatgccaatgagctcaatgtggacaaactggcagctgagtctgccatgagtgtgccttcgtttcatgcggcgttcagggatgtgacggctacttcgccgattcagtatttgaaaaaaacacgcttgcataaggctcgcctgctcatggtgcaagacgggattaatgcaaccttggcagcgaccaaagttggctacgagagcgcctcacagtttagtcgtgagttcaagcgcatgtttggtaaaagtccgatggaggaggtgagtgctgttcgcagcgcattgatcacatcgcccggcgaatttgtggctaatcagggggttgaccagtatgtgactgttcagcag

SEQ ID NO: 91256 - DNA, 396 bp, Glycine max
  Peptide Sequence Number=SeqID_208034
atgttccctgttgcatttgcagtggttgagattgaaattcaacagaagggtctttcccgaactgtagcaaaatctttttcatatgcaagacaaaggtctttggttgtgaaatatgctggaaatgataagtttcaattgaaagttgagtacataaatactatggttaaattaaatgataagatgtttgggtttaatcaatggaacctcaccagatttccaggcaaacatattatccatcctatgcccaaaattgatgctaattcaaatagtggagattatcctgatattggtcctccaaatttaaccaagttggccatgaaaggtcatgtgggaagcatgctttttccttctattaaaacattaacggagttaatgggtcaggggaaacatgtgtaa

SEQ ID NO: 91257 - DNA, 624 bp, Glycine max
  Peptide Sequence Number=SeqID_208035
atgattatgaggggtcaagacatttatagtagccaagatgaggctactactcttccttcctctagtgaaagtgaagaagcaaaaggggaagaatctagcgaagagatctacccacaagaagaaggacaacctttaatggttaaggaggagtgtaaggaggcaagtgtcttctccaagaggttagctacgaaggaaagacattttgaaataaaaacaaatattaaagttatttcccctcttagacaacctccacattttctcctttgtgaaaagacacttgttagcattgccacacctcttaggcttgaagtttattcctcaagtattattaggcatcaaatccctgaaataggtggtatgatgaatgttttgagtggtgcaaccctcttttgtaaaatcactcgtgctcccaacatcttcatgatttgtgtacataggaactcattaggtagtgatcaaggggttcccatgaaccctaagagaataaaggtcattcctgagtggcccactccaccaagtgttgagaaaaaaagcccagagtttcaaaaaccccaggatttgaggtcaaatccttttcaagggggagggaatgatgcaatcctaccccacaagggcattggatag

SEQ ID NO: 91258 - DNA, 366 bp, Glycine max
  Peptide Sequence Number=SeqID_208036
atggggatagtggtatgggtttactttcaccgaagaggtattagggagcaagggtatttggttgtaatggggctgaggaaggggaaggttatggggtgtttgggaaatagtggattaggatgtaaggagatggaaagatgctatggagtccgtgtaggaggtgacaaaggttttggtaggaaaccacaaaggggaacttgtgggcaaaggccagtgcaaagaagatggtttccatcccctactgtaacaaaaaattgggaaataagagcaataaaaagctataggtgggaagcaagtcgtggttgcataatattatgggagcttctggtagtgtggcttggcatccttaaccttaacctcaactag

SEQ ID NO: 91259 - DNA, 336 bp, Glycine max
  Peptide Sequence Number=SeqID_208037
atggaacctgaagaaaccaccacaacattgcacattccttcatgcatcgtgaacccaaccaaactaccacaagccacaatcatgaacccgcctaaaactatagtgacaccaaatcaacaaaaattagagtgcattcaagaaaattcttgggttattgaattggacacggtggtgttcaccactagagattctatagtagctatcgtcgccaatgtcagtggtggtagcgaagtggaggcctaccttatgatggggattttggcaagagtgtcaaatcgtgcaagtaacaaagtaataagtgtcgtctccatagagacttgtgccctaattgggtaa

SEQ ID NO: 91260 - DNA, 381 bp, Glycine max
  Peptide Sequence Number=SeqID_208038
atgagccagatttcgaatccgagagaaaatagtggaggtaatgttgttgaccttgatctcatatcacaattccaagaggtgttgatggacatagaaatagaaggctatgagtttacttggacaaataagagaaagggtgcagatttgattgaggaaaagctgaacaaggcctttgtgaacaatatgcaaagagatcaatatccaattattcttaatatgttggtttctcaacaacaaaggctacaaaagaggttgggagaagtgcaaaagatgacccaaaatgatgttgtgatggagatggaggcaaatatagagagagatatggatgagtgtttgaaaatggacgaagtgtattggagtcaaaggtcaagggcagaatag

SEQ ID NO: 91261 - DNA, 822 bp, Glycine max
  Peptide Sequence Number=SeqID_208039
atgatgacccgttcgtacatgctggcgtttatgggcaggtcgtggtcaaaccatttagaaaaaccttgccataaatgttacgctcagaaattgaacaacgtttacaggcactggcccctgaagctctggaaattcaagatgacagtgagcttcaccgcggacacgcaggaaacacaggcggcgggcactacaccatcaagcgcgctgccacatgtgtatgcggcggatgccgatgcggttgccaccgtcaacggcaagccaattaaaaaatcctgggtagatttcattttgaaagatgctgaagcacgtaccggacagaaagctaatgacggcatgaaagctgccgtggtcaatgaactggtgggctcagagctcgcttaccaggaagcgcaaaaagcaggtatcgataaacaaccagactttatcgccagtgaagaactggcccgccgcaagttgctggtcaacgctttcctcgctgacttcatcaggaaaaatcctgtcaccgatgccgagaaaaaagaaggctacgagcaatacaaaaaagagctgggtgacaaagaatacaatgcacgtcacatcctggtaaaaacagaagctgaagccaaagccattattgctgacctgaaaaaaggcactgactttgccaagattgccaaagaaaaatctcaggatccaggctctaaggacaaaggtggcgatctgggctggttctctcctgccggcatggtcaaaccattcgcggaagcactggttggcctgaaaaaaggcgaaaccacgcctgagcccgtacagtcccagttcggctggcatgtgatcaagctg

SEQ ID NO: 91262 - DNA, 297 bp, Glycine max
  Peptide Sequence Number=SeqID_208040
atggaggagttgattaacaaaacacaactctttcccaaaatcatcacaacgtcatcacgtcggctcggcggctccacaaaagaatctcatttctcgtactctattgttgtcattctgctcccacaaacaaaggttcacgattatcacagcctgtgtctcaagggagttccaaaccgagtgacatgcccccaagtacaagcattcctcttgatgagaaactacaagtacttactgacaatgtttatactatttccatgtcatatgaagtatgaaacatgggcaccatcaatgcactga

SEQ ID NO: 91263 - DNA, 363 bp, Glycine max
  Peptide Sequence Number=SeqID_208041
atggtagcaggaagtacaaccatagaaaaacctagggaacaatgggatgtggaggaaaagaaaatgaatcctaatgaaactatacaggacatgcaaaagagattcacacacatagtaaatcatcttgcatccttaggaaagatatttccaaatgaagatcttattaataaagttttgagatgtttaagcagggaatggcaaccaaaggaacatgaaatggaattaatgagattgaatcaacatgaggagaatgataagaaaaagaaaggaattgctcttaaagcttcatcatcaatccaagaaggaagtgataaagaggattcaaatgaaatagatgatgatctcagtctttttgtaaaatga

SEQ ID NO: 91264 - DNA, 262 bp, Glycine max
  Peptide Sequence Number=SeqID_208042
atggcacgcagagacaaattatggtcattctgcacccttttgtcatccagaggcggcgagcccgatgacatgcagagacaaattatggtaattgcacgcaccttttcgccatctggagacgatcgtgtccgatggcacgcagagacaaattatggtcattctgcgccttttcgccatccggagacgatcgtgtccgatggcacacagagacaaattatggtcattctgcgccttgtgtcaaccgagaggaacgaattcggaa

SEQ ID NO: 91265 - DNA, 225 bp, Glycine max
  Peptide Sequence Number=SeqID_208043
atgcatacctcagagccctacactggggcaatgaaaggaaccatgcataaacctcaagcgaacctagggcagattagaagttctcacctaataggttccctactacaaggatttgatggcctaattgtagaagcaagcttcatgatgatgaacctagcaattttgacgatgccaaaagaccaagtgattgattcaagacttcaagatcaagcatcaagaatctaa

SEQ ID NO: 91266 - DNA, 309 bp, Glycine max
  Peptide Sequence Number=SeqID_208044
atggtataccataatttattaaatatcttgaacttctctgcctctttctctctcagaaagtatgaatatccaaagaagaggccaccaagtttttatcaagtaactaatcattcaaaagaaagacctgacgtgtgggttgatagccctgagaaatcaattattctgtctataaccagtgatattcgaactatagaatctgaggtattttctgcaccttacagtctcagatttcctaggattgacagggtgagatatgacaaagcttggtatgaatgccttgatgttcaatgtaagggatttgcaaaatag

SEQ ID NO: 91267 - DNA, 1311 bp, Glycine max
  Peptide Sequence Number=SeqID_208045
atgattacgccaagcttgaaattaaccctcactaaagggaacaaaagctggtaccgggccccccctcgagcattccgagtaactcctcaaccaggagttccgcctgaagaagcaggtgccgcggtagccgccgaatcttctactggtacatggacaactgtgtggaccgatgggcttaccagtcttgatcgttacaaagggcgatgctacggccttgaacctgttgctggggaagaaaatcaatatattgcttatgtagcttatcccttagacctttttgaagaaggttctgttactaacatgtttacttccattgtcggtaatgtatttgggttcaaggccctgcgtgctctacgtctggaggatttgcgaatccctactgcttatattaaaactttccaaggtccgcctcatggcatccaagttgagagagataaattgaacaagtatggtcgtcccctattaggatgtactattaaacctaaattggggttatccgctaagaattatggtagagctgtttatgaatgtcttcgtgggggacttgattttaccaaagatgatgaaaatgctgaaacaggtgaaatcaaagggcattacttgaatgcaactgcgggtacatgcgaagaaatgatgaaaagagctgtatttgccagagaattaggcgttcctatcgtaatgcatgattatttaacggggggattcactgcaaatactagcttggctcattattgccgagataatggtctacttcttcatatacaccgtgcaatgcatgcagttatcgacagacaaaagaatcatggtatgcactttcgtgtactagctaaagcattacgtttgtctggtggagatcatgttcacgccggtaccgtagtaggtaaacttgaaggggaaagagaaatcactttaggttttgttgatttactacgtgatgattttgttgaaaaagatcgaagtcgcggtatttatttcactcaggattgggtttctctaccaggtgttttgcctgtagcttcgggaggtattcacgtttggcatatgcctgctctgaccgagatctttggggatgattctgtactccaatttggcggaggaactttaggacacccttggggaaatgcaccaggtgctgtagctaatcgagtagctcttgaagcatgtgtgcaggctcgaaatgaaggacgcgatcttgctcgtgaaggtaatgaaattatccgtgaggctagcaaatggagtcctgaattagctgctgcttgtgaagtatggaaggagatcaaatttgaattcgaagcaatggatactttgtaa

SEQ ID NO: 91268 - DNA, 768 bp, Glycine max
  Peptide Sequence Number=SeqID_208046
gagttcgatattagtccaaagaaacttcctgaaacagatgaaagggggacgaatgattttgatcatgatccattgcgtcaactgattaagagcctatatttcatgtacggcacacctgttgagttgaagtgggatggcagcaaatttgggctatcaaatgttgatgcttcattcttcttgacattctctgatgtaaatgaaatagtagcaggatacaaatgtttgaacatatctatactacagttatggatgctgtttttggatgagtggagctcaactttgggtcatgcttccgtgtatggattccttgagccacaatcgatacaccatgcaaaggatcgacgtgctgaatgtgagcattacttacaagcatggctcaaggaatcgcaacgagaggtgtacctaggagcttacttaaatcagcaagggtcattggcaactggtagtactgtgtcctgcgaccaatgttgttgcatggttttgtttgttactgcaatgaagtcagcaaacacaactgcggatggtacaaataatccagcaactcctaagtggattgaagtcaagagccatgttcaaagcggagggtatgagtgtggctactacgtgatgcattggatgtggaacatcgtcagtgggggtttaaagaattattggagcatgtggtttcttgatggaacggcgttagacaacgaaacaattacaacgattcgccagaaatgggcagcatattttcttaaagttcaaagcaatcaatgtacaaagtcttag

SEQ ID NO: 91269 - DNA, 1956 bp, Glycine max
  Peptide Sequence Number=SeqID_208047
atggctaaggtaccacatattcaagaatttccatacttggaaactgatacgagaaagaaacttgatggttttactgtgttcagcaatgggaaaactgaggacatgagtgaagaaaacatagggaaaagggacctgaaatctttagaatctgagcaaaagtatgattttcgaaagagtttggcatgggatagtgccttttccacaagttctggaattctagaagtggaggacttgtttgattcttcaaattcatggcacattcagaatggttgtgacatgttgggacctgagcaggatcagcatttgtctgttaactatctgaaacctgaaattaaaactgtaactgatgaattcaatttaagaaaaagtttagcttgggatagtgcatttttcaccagtgaaggaattttgaatcatgaggagttatctcttctaaacaaagggcctaagaaatctgaaatcgatatgtttcctcgaatagaagaactatggatctcatctgactcaaattgtactattgatagtgatggatcctcattagcaagccttgaggtttctatgcatcagtcaagggtagcacctagcacagttgctttaagctccagaaacattcaaaaagtttattcaacaaaaaggatgaatggggatggtgtctccaaattgaaggtaaaatccaggccaacttccacaatgcaaactataaaaaacaatcaaccagagaggactactaaggaacaatctgtccccccatcatcgatgttctctgctgcaagtggaatacctaatctcgcatcacatctaaagccaccaaagatatcaagacgagttagaagaagtgtcccaatagctcccaccaaaagagttcctctgttttcaaatgaagttaatggggaaagcaaaactttcaaaccaagtggaaaatgtttgacagaaaaacctaatctgttcaagacttgcagcagtgataacaatagcagttgtactagtctctcttgggaattttcatcattgagctctcagtcttgtatgaatggttccaatggtttgtgttcaccctaccgcaagctttctactcgccaatcatctcccgagttttcaatagtgaaaaatgatacccctaatagcaactcatctaaacacagaacaacaaacaaaatcaccccagaagattgttgtcaccaaacttgttcatctgtcaaaaagaactgttgttgcatatcacctttagtatccattgaagggttctctccagcatcatcaatgagtgaaagcaatagtttccatgatgacaagggaatcatgtgctcaaatccttgtagtgaggtaaagggaacgcattctgtttcatttgatgcttcaagaaatttaaagccttctggcctccgaatgccatcacccaagattggattttttgatgtggataatttgctgatgtcaatagagaatggaggcaataagtcacattcaaaggctttctccaagcttcaaagtggacagaagttgaaagatgtaggaattacaaggacttgtgcttggaaaactagaaactccacaatctcaaagaccataaagtttagccgtggtgcagtttcaaaagctgaggagggcaaggactgcttgagaaatgatgagaaaatagtcaatgtgatgcgggcacatgaacccgaattagaaaggcaaacttgtgcaaaaatagataagagaggagtggggagtaaaattttgagagaaagagaagaacaatcttgtctaaagggcaagaagcttttgctgaaagaacagactagagccaacactatccacacaggaaatgatcaacatccacatactcttcacgaaagtgagaaggaaaatttgattggttttgagaatgaacttgaacaagttagaaaacatgatgtacgaggtgatgtagtgatagagtttgtagacaaaaattgtcaatctgaaaagtag

SEQ ID NO: 91270 - DNA, 802 bp, Glycine max
  Peptide Sequence Number=SeqID_208048
ggtagaagtctccatggaaccaattgcctccctcgcccagtattatggtcagccgttgaggtgcttcatctttggggacttccagctatcaccaatggtggaagaatttgaagagatcctaggatgtcctctagggggaaggaaaccatacctcttctcagggcaagtcgaaaatggggtggtcggaataccgagaaaatatttggagggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggaaggaagaatcaagattctatcttcatgcaaaggatgtccaaatgttcccttgatgggaacaaggggttgtattaattataatcccgttctcgccataagacagcttggctaccccatgagaggagcgccattagacgaaagcatcacgcctttcatcgcacggggttttagtgaccacaatgcgagggacagagagcttaggggaagcagtaatgggatcatcggcggctatcataagtggctgagagtccgaacacaaggattggattggctcccaaatctaaagactgtgagggacgatgaggttaaagcttcggaagaaagtgatgaggtacaagccctaaaggcaaagcttgaaagagcccgggtagtcgaagagaagttcaagtccatagccatcaaa

SEQ ID NO: 91271 - DNA, 366 bp, Glycine max
  Peptide Sequence Number=SeqID_208049
atgggttccaaaaagagaaagagtattggtacaaggcccacattgcagtatgatacaaggaggttccactcctttgaggcctggacccgatacacagataatgttctaggaagacatatactgcctgagaggaaggtagaaatttaccacactgagcaggacgagtttaaggctgaattggagaggcgtaacttccataaatgcctcaccaatttagttgacaacaacatagatctagctttggtgaaggagttttatgccaatctttacagttccgaaggaccttcaccaaatcaagtcagggtcagaggccacgtggtgaagattgatgcagacagcctcaacacctttctggaaacacctatg

SEQ ID NO: 91272 - DNA, 216 bp, Glycine max
  Peptide Sequence Number=SeqID_208050
atggaaatagattctcaaacggatgaaatcactcttgttacaattaaaaataaagtatcacatgcagtaactaaggatgatttacaaaagactgtgatgcaatcctaccccgcaagggcattggatagaaaactccaagtagattgggtcagagatgcaagagaaggccctagcgttcttatgagccttagggtagatttcgggcccatgggctaa

SEQ ID NO: 91273 - DNA, 306 bp, Glycine max
  Peptide Sequence Number=SeqID_208051
atgagaattgtcgaaactggaaatgcaaggttcattgaaaatggtgaaatcaataagagtacaattccacaagatgtagaaattaaaaaagttaaagtgaaagtccctttaacttgtgtctctagcaaattgccaaagggttgtaatagagttggttgtaagtggatctttaagactaaatgtgactctcatggcaaccttgagcgttacaaggttagacttgttgctaagggatttactcagaaagatgacattgagagacgtttttatcggttttacaaaaggattctttcaggattatcatga

SEQ ID NO: 91274 - DNA, 465 bp, Glycine max
  Peptide Sequence Number=SeqID_208052
atggcttctaggaaatgtaaaagtattggttcaagacccacaacacaatatgacacaaggagattctcttccttagatgcttggaccagatacacagataatattctggggagaaacattttacttgagaggaaggtagagctctatcacactgagctagatgactttaaggctgaattggagaggcataatttccataaacgcctcaccaatttagtcgatgggagcatagacctggctttggtgaaagagttctatgcaaatttatacagttctgaggaccgtccaccaaagcagtccagagtcagaggtcatttggtgaagattgatgctgacagtctcaacacattcctggagatacctgtggtattagctgagggagagactctacccgcatactccagatactgcaggttacctacagacttcagagagatagaggctgccttatgcatacctggctga

SEQ ID NO: 91275 - DNA, 207 bp, Glycine max
  Peptide Sequence Number=SeqID_208053
atggctgctctggaattctgtgccctggccattctgtgcaagtgtgtagaagcagtcataaaagcgctagtctcgcgcttagcctggctgaaggcacctgttgcgcttagcctgatgctaatgctctgccagattctcctttgcgccaagtgcgctgaagttgcgcttagcggtggttatgcgcttagccgaactgctactttttga

SEQ ID NO: 91276 - DNA, 225 bp, Glycine max
  Peptide Sequence Number=SeqID_208054
atggcttgcacccacattccgctttcaaaattgccccatgtgtggcatctcttgtcaatgtcaggatttacacgtgattctcctcaaatttcagccagcctgcatcaattagaccttgcaccttacgcttcaggcccctacaatgctcaatggaatgccccggggcttctccatgacaagcaccacgttgcgttcgagtcgtattctcggagaaatggaggttga

SEQ ID NO: 91277 - DNA, 462 bp, Glycine max
  Peptide Sequence Number=SeqID_208055
atggcatgcggagaccatcgtaatcatccgctttcattgttttcgagactattacagtctccttcccatctagagacaatcaagtctgatggcatgcggagagcatcatggtcacccgctttcattgtttttgagactattaaagtctcctttgccttccagagacaatcaagtctgttggcacacggagacaaaacatgctcattcgcaccttttccatctagagacaatcaagtctcatggcatgtggagaccatcatgagacaatcaagtccattggcatgtagagacaaattatggtcatatgccccttttcgaagacttcaatgtctttcaaccgagactattaatgatcaaatcctccctaggaaggggccagtcactagagccatgagcaagaggctccaagaggatttagctagagatgctgaagaaggccctagggttctcatgaacctcagg

SEQ ID NO: 91278 - DNA, 648 bp, Glycine max
  Peptide Sequence Number=SeqID_208056
atgttgagtttcaagaagaaattgtctggaggcaatggtcccagctgggcgagcgctgcgagttcagccagctgttgtgcgtttcgggtgcgaatcatgcacaccagcatgaccaccctcacgcaaatctggatgacattgctgcttagcaacattctccctagtgaccataattcaaacctccccctgccgaagtgtcagctggtctatgccatcatgactcaggtgagtgtccatgtcacccagctgatttcagatgctatctatcagtttgcagggattacgccctcaagacacccagtggacccaaagaagtccaacagggctttgggatttcctgctctaatcacaggcctctgccagttctatggagtgtttgtcgcccccgccaagctcacccgacctcccatcagaagagccttctttgagaagtactgcattcccaggcatgcgcaaggtcaggcaccgcaacagccagttgtagatgcgccaccactgcctctagaggagagtcaggacccctgtcctttcccttggcctacccccgagcagttcagagccacagtggcctggcctggagacgagaccaattttgaaggagctcagggggatgacgatatggccgatgtgctggatttattcacttga

SEQ ID NO: 91279 - DNA, 1005 bp, Glycine max
  Peptide Sequence Number=SeqID_208057
atgtgcctcaacccgaaaaagtacactttcaaggtgagccgtggaaatttcttgggtttcatgattacccatcggggaatagaaaccaaccttgacaaatgcacgaccatactagagatgcataagctaaccaatgtcagagaagtccaaaagctgaacggcagattgacatttatgtctaggttcctcttaaaactggcagaaaaggcaagaccattctacaagtcacttaggaagactaggccattcttgtggggtgaagcttataagcaagctttcttagccttcaagaaaatgattgcttcactgctagtcctaagtcaacctaagttaaggaagctaccagatggtaaagaaggtggcattagtgctcataatctcggcccgatgcctcaggccatattttcagagccaccaagtcattgtcaagacagatcatcccatcaaacatgtgttgcgaaagcctggacttgctggaaggatgactttgttggaaatgcccaagccaccccagagtggtggaatctgtatgtgaatggtgcgtccaacgttaaaggaagtagggcaggcatcatccttgaagggtctgacaatgttactttggagcaagctcttaagttcaatttcaaagcatcaaacaatcatgcggaatatgaagcacttatagcaggcttaaagctagcaaaaagttggagccaagaagctaaggtaaggccattacaagaaatttcagctagtgaggtagaaaagttcacctggaaacacataatatgcaaatacaatctcctttatgccatcgtcaccaacaatggtactcaattcaaacctcaagcttatgaagaattcttaaggaggctaagtgtcaagcaccttgtgactttcttcaaacacccccataccaatgctcaggcggaggcagccactaaagttatccttaaagccctgcacacaagacttgacaagtctaagggtttgtggaaagaagagctccctagcatactctag

SEQ ID NO: 91280 - DNA, 207 bp, Glycine max
  Peptide Sequence Number=SeqID_208058
atgtttaggtgctataaggacttgctaagagtgaaaaatgacttggctgacaacgtggagaacactactgtagagaaggaagagcttactgtgatagtggctaagtctactaaggatgtgaaggacacagaactgcttgataaagaagaaataactgccacagaggaggacgtcggcgaggagcgagatgatagaactagtgtttag

SEQ ID NO: 91281 - DNA, 240 bp, Glycine max
  Peptide Sequence Number=SeqID_208059
atgggtgtgtccctagtcgattctccaaaagctcgtcaaacccaaggtccctccttggtgagccttgccaaaacccaggacgggataggtgcatccctggttgattctccaaaggctcgtcaaacccaaggtctgcctttggggagtctcgccaaaatccaggatgaacatgccccttgtcgaatctccaagaggcttgacaaaccaaaggtcgcccttagtgagcctccttattgctaa

SEQ ID NO: 91282 - DNA, 486 bp, Glycine max
  Peptide Sequence Number=SeqID_208060
atgaacaaacgtcgtacgaccctcacggtgttggcgctgatcgcgtcgctggggttgtcatccgccccggccctggctgacaaaggcggcaatggtaacggcaacggtaatggccatggcaacagcggcaatcacggtaatagtggtaaccatggcaacaacggcaacaaaggcaataaagataaaggcggctatagaaacgacgataatctggtttccgtcagcctctcgcgcgaccgcgcccgttcgctggcgcgcaactacggcctgaccggctacagctcgctgccaccgggcatcgccaagaatctggcgcgcggtaaaccgctgccgccgggcatcgccaaaaaagtggtgccttactcgatgctgcgcgatctgccgcagtacccgggttatgagtggcgtatcgccggcgacgatctggtgctggtcgcactcagcaccgcgattgtggcttccgtcatcaacggcgtgttcgactaa

SEQ ID NO: 91283 - DNA, 397 bp, Glycine max
  Peptide Sequence Number=SeqID_208061
ataccacaaagagagggatgggtcttgggtgaagaaagacgctccagtacaggctgtagaagaccgctctccatcaccacctcctcagagaaatgattcttcatctcttatgcacaacatacttgacaggttggatggacttcacactttcgtcggagagcgctttgactcattggatagccgtattgatgccatggatgcacgatttgcagggattgacacatgtatcaccaaacttaaggaagatgattgccatcatcaaaaagagggagattgtggaagcaatgcctttcaagattattttgatgatgccaaaagaatcaagagtcaagcaagtttcaagaatcaagatcaagattcaagattcaagaatcaagagaagtctcaatcaagataa

SEQ ID NO: 91284 - DNA, 1656 bp, Glycine max
  Peptide Sequence Number=SeqID_208062
atgaggtctcaaagggttatgcaaccctcacaaatgttgaaagattatgaagtcatgaaagacagccaaattacatatgaaggtgatattgtacactttgccctttatgcagatgatgaacctatgagtttcgaagaagccttgaagaatgacaagtgggtcaatgctatgaaagaggagctgaaattaattgagacaaatcatacctggcagctaatggagttacctaaacttaaaagacctattgctgtaaaatgggtttttaaagtgaagagaaatcctgctggtgaagtagttaaacacaaagccagattggtggcaaaaggattcctacaaaaaaaaggtgtagactatggtgagatctttgcccctgtggcaaggattgaaacagtgagacttgtagttgcaatagcaagcatgaaaggctggtcaatgtatcagcttgatgtaaaatccgcatttctgaatggtcctcttgaagaagaagtgcttgtcaaacaaacacctggatttgaagttgttggacatgaaggaaaggtatacaaactgaagaaagcattatatggcctgaagcaagctccaagagcttggaataagaagattgatagtgtcctaattcaaattggctttagcaagtgcatatctgaacatggagtatatgtaaaaggagaatatgagtcagacttagtaatactgtgcctctatgttgatgatttactcatcacaggaaacaacaaaatagagattgacaagattaagcaactgctgaagaatcagtttgaaatgactgacttaggatctctttcatacttccttggaattgagttcaaggaaactgaagctggaattgtgatgcatcaaagcaaatatgctacagacctgttgaagaagtttcgaatgactaactgtaatgcaacagccaccccaactgaaacaggattggcattgagtttgagagatgaaggagaacctgttgatgaaactcagtacagacagattgtgggttcattaaggtacttgtgcaatacaagacctgatttggcattcagtgttggactgatcagtaggtttatgcaagctccaaaaactcctcacatgatggcagcaaagagaattctaaggtatattagaggtacaattaactatggtattctacttccaaataccatcacaaattcaaacatggaactggttggctatactgactcagactggagaagagataatgatgatagaaagagcactgctggatatattttcctacttggagatgcactggtgtcatggagttcaaagaagcaagatccggttgccttatcaacttatgaagttgaatacatagcagcatcaatgtgctcgtgtcaaggcttatggctaagaaaactattgaaagaaatgaagatccagaagactgaagctataaacatactggtggacaacaaatctgcaatcagctttgctaaaaatccaattgatcatggtggaagcaaacacatagaaacaaggtaccattttattcgggacaaggtgagcaaagggaaggtaaaactgctatactgcaagttagaagataatcttgcagacttactgaccaaacctttgaagaagaacaaatttgaagacttgagaaacaagatgatgatcatgattgaataa

SEQ ID NO: 91285 - DNA, 192 bp, Glycine max
  Peptide Sequence Number=SeqID_208063
atgcatagcaggcaacaaaaccagaacatcagttggaatcctaccacaggaaatcagaccaagtggtatcaagagctaggtgaaaggcaacagtccaagggactgagagagacagtagtccaaaagtatggtgtggcaacaccaagtgatgacgtagctcttatagaggcacaacaaaaagagtatgagtga

SEQ ID NO: 91286 - DNA, 492 bp, Glycine max
  Peptide Sequence Number=SeqID_208064
atgaagaaaaaatatcaaggctcctcacgagtgaaacgtgctcaacttcaagcattgagaagagactttgaagtccttcaaatgaaaaaagagtcaaatgatattaatgatctttctcttgatgagcttcaaagttctttattagtgcatgaacaaaagatcaacaaaaaatcaacaatggagaagcacgcattaaaggcttctaccaatagtactcattccaacaactctagaggaaggggtagaggtagaggtagaggaagagggagtggagaacgaggaaatagagatttcaacaataattttaaagacaataatgatcaatctcaaggcaatggtagaggaagagatcattataaatcaaaggtacaatgttatagatgtcataaatttggtcattatgcctctaattgttatacaagattgcctaatcttaaggaaaaggggaaagctcaaattttatcaaggagaaagaagtggaaaccttattaa

SEQ ID NO: 91287 - DNA, 117 bp, Glycine max
  Peptide Sequence Number=SeqID_208065
atgaggaatttacctattacttctgcaaaaagtcgggacacatgcacgaaagagtgtcccaagtatgccgcatggcgtgtgaagaaagggtttcctgtggagccgactaccaagtga

SEQ ID NO: 91288 - DNA, 588 bp, Glycine max
  Peptide Sequence Number=SeqID_208066
atggagaatcctacaaaaatgcatttgcttgttgctaaaagaatccttcgctacttgcaaggaacaagagaatttgagttgttttataaaagaggtgaaaagtttaatctattgggattcactgatagtgattatgctgaagattcagatgatagaaaaagtacttttggatatgtttttatgatggcgtcaacaacgatctgtttgtcatcacggaagcaacctattatcactttatccacaacagaagcagaatttgtagcaacctcaacatgtgcttgccaagaaatttggctaaggaatattcttgaagaagttcacttcaagcaacaaggtccaactctcatctattgggataatagttccaccataaagttgtcaaagaatcctattatgcatggaagaagcaagcacatagatgtgagatttcattttttaagggacctatcaaatgaaggaattattgatcttatctactgcaagagtgaagagcaaattgttgacatcatgaccaaaccattgaagttgtctgcatttcagaagctaaggaatttgcttggagtctgcatgcttaatgaatctcattaa

SEQ ID NO: 91289 - DNA, 363 bp, Glycine max
  Peptide Sequence Number=SeqID_208067
atgaagcttgcctatgagataaacctcctcgtgaagcattggagggaggcacattgtgaggttcctggcatctcagggggtgtagtcttaaattccattgttgaagaggagatcagaaaagattttgaggtccttctaattcattggaaggaagcacttcataaggctgctagcatcttgagtcttccaaaatggccttctggcaacaatctgaatgtgaataatcccccttctactctgaatcctgtacaagatcctatgagccttttctatgccaatccaaatgaaaatcccacaacatcaatcgtttcttctccattgattggtacgaatcaccacaaatgggctcaagcgatgcagtaa

SEQ ID NO: 91290 - DNA, 300 bp, Glycine max
  Peptide Sequence Number=SeqID_208068
atggagattgttgttccaagatatgtcaataaccgacaatgttccaatgttgaagatcttatgtggaaatgttccagtcaacccgcaattattaagactaaggatggtgagatttttgtaatgggaaaatgtttcgggcactgggatgataatttgttccaatcaagaacaatgattgatatattatcaactcttttcaaggaaggatccaagggtcatgagagaccgcaccatgacatgctcaattcttacagggggacaccaggaggaggacaacgacaacggttaagacacaaataa

SEQ ID NO: 91291 - DNA, 222 bp, Glycine max
  Peptide Sequence Number=SeqID_208069
atgaaaacaagctggagacctctaggactcaagaaaataggcacacaccggacaaaaggttgtcagtgggccagaagaagtatcttagctgacccattctatatatcaggcattcgaactgagctggcatttgaaaatgttgcgtatttcttatgttgggtggtgtggggtttccttgaatacgcgtctgcgaacgaatctaatttgtcacggttagtttga

SEQ ID NO: 91292 - DNA, 1126 bp, Glycine max
  Peptide Sequence Number=SeqID_208070
cgcctgctcaaaccaacgccgattctccgccaggtagtcgagcagctcatcaagccaggcagcgccccgttgataggccgcggtcgccgccgtcatcgacagcgcgttgaatacatccagcccgtgggcgttcagccgatcgacaaacgcctgccgaagccgggcattggggatcaggaaattcgaaatgcgcagcgaggaaaggccgaacgttttgctggcggacgtcgccgcaatcacccgatcgcgatattcctcgcccagatgcaacaccgacgtaaacgtctcgccgggcagcagcaggtcggcccaaatttcatcggagatcaccgtgacgtcatgggcgtggcagagcgccatgagccgctccagttcatcgcggcgccagcaacggccggttggattgtgcgggttgcacagcaacaacagcggcggtttacgctgcgccaggcaggcggccagctggtcgaaatcgatccgttggatcagcatcgccagccccggcaccaccccttcaatcgacgtgaaccactcgcgccgcagcggcaagccgtgccgcttggcaaaccagtcgattgccgcttggtagtaggcgtcgtcgcgttcgctgtagccaaagacgccgtggtccacccgctgatgcagcgcctgctgcacctctggcgggcacggaaagtcgaaatcggacacccacatcggcaacagttcgctgccgtccagttgcagatagcggtcgatgaagtcccacttcacggagccggtgttgtggcgatcgatgatggcgttgaaatgactcgtcatgtcaggcttccttacgctgcaagtcgttctgagatcgagggtgctgacccccagcgtggtggccatgtaaatgccggcggccgtccacgggatcagcggttcgatgacggtgcccgcatcttcgacggtgcgcgacagatttttgttgtccagccccatgcgccgataggcccctttgaacagctccgccgggatcagcagcgccagcttgccgtcgctggtcgcgccggtcaccaggatagtggtggcaacggtggcggcgatcagctggccggtggtgtgcaccacgttcagcagccggctgatgatcaccgtcagcgcgccg

SEQ ID NO: 91293 - DNA, 301 bp, Glycine max
  Peptide Sequence Number=SeqID_208071
gcacaggtgttggatatgcatcaacaccacactcaagaagtcatggccctgcaccaagagagtgcacaactatgagaagttaatcgatcctggcgacctagaaacgaaacgctcactggagcagaggacacattacttctcaatgcccaccacaaaaaccatgattatgaggggccaagataaggctactacttcacctttctctagtgaaaatgaagaagcaaaaggggaagaatctagtgaagaaatctacccccaagaagaaggacaaccattagtggttaaggaggagtgtaatgag

SEQ ID NO: 91294 - DNA, 774 bp, Glycine max
  Peptide Sequence Number=SeqID_208072
atgtgtaaactgatttgggtctgggttgggttagaagcatctggtggttcggttagtgggtctatgttagggtcagactctagaaaaccctcatcatcatcgaagccacgttcacgacacaaggttaactcctcatgggataagcgtttaatggatactgaaggggttggtttcgaaggggtgggcacaaagggtgagggtggtgacagaaggggcgttgagtgtctaggaacttttattcctgaagttaggccagaccagtttcttgcaccaacgttaatggatgaagagcctgtacctcacgacaaatttctgcgtaccaatgggatcttcgtactgagaaggggtgaagcaagtttgaggggcctgaaggaaaccaggccaagaggtgagttgcccattgctggtcatccattggaaccaagcaagggcacgaccatccatataaaaagacgcaatggtgagacactcatgtttaggggtgggtttgtaccatcaaacctcaaaacctcgagcttcatatggtgtgatgaagatagggacacaggagagggaatggcagaggaagaagagggtcatgtgctggattgtttcactgagggaaatttggtgtgtagtgagcttggtaatggattcctcaagcctgtcggaattggctttggacctagtggattcatccatggaaacaggacaacgagagcaccaaatttgttaagagtagagaagatagagctggcttcgagggccaatgacctccttgaggaaaaagaatag

SEQ ID NO: 91295 - DNA, 777 bp, Glycine max
  Peptide Sequence Number=SeqID_208073
atggaaactggaaacaacaaaccggaaaaaggctcccttctggtctccttcaacttggcatcagagcaggttgccgccgtccgccgccgcgccgcccgccgccgccaactccggcggttttctccggcgagaccagggttcggatcgcctcgaaaagcgcgatccacccctggaactcgcgccgccgtaggccgccgcacgcgcccacacgcgcctcctttcctccgcgcgatttccggcgcgtgctgctcacgcgccgccgtaccggcgtcgggagctgtcccttccggtcccggcagcctcgccgtcacctcctggacctgtttcaggcttcaaatcccgcttccggcaagtcgtttgttgtggttccttggtcaaggacaccatgaccacttggagaaaacttccgattttgtttcagatgataaaagagctgaatgggagaagcttgactatcaattatgtgtcgtgttatggcaatcagttgagccggatatcttggagattctccgatcttttaaatcatgccgttctttttggaagaaagcccaggaaatctttgccaatgatatccaaagcttgtttgatgcaactatgaaagttacagccctcaagcaaaccggtcatgacatgatcgctcatgtgggtaaggctcgggctgccgtggaagaactaagaaagttccttgtagctgattcattggaggaagtgaataggaaacttgacaagttctacatggttcttattttgaggagcttacattcagacttcgatcat

SEQ ID NO: 91296 - DNA, 558 bp, Glycine max
  Peptide Sequence Number=SeqID_208074
atggtcgaatggtattcatcacttgtatatgtggaaggtcgagacgagttgtatgaaatatgtgggtatatggctaagagggtactcgacttcatagggtatattgcatcaggtgtctctcatcttgatcgaatacttatcccgtatattggccctccaagcccttttttggcctcgaccaaaaagaaggcctttactctttgtgctagagcagttaggatcttcttctccgatggttcattgtcaggggagtcggttgataatgagtctgaggttcatgggtacaataacgaagtttttgaggtgttgtttgattcttactccttggggtcaaatttttcaagttcaattgaccatttggccattgaggggtctagtgactttttggcatttttgagccttttgttagaaaaggtgagtgagaatattgtagctcccatgctggtgcctgctgtcgagaaggggacttccatgaaagttgcaccttggcctaagaagtgccctatgctgaaggataagtgttcacctccccctattacgcttctcaagtacaattag

SEQ ID NO: 91297 - DNA, 1950 bp, Glycine max
  Peptide Sequence Number=SeqID_208075
atggcgctatcggcttccgacgttgcagcgatgtactcgctgctttcgaattccatgagtaccgatcaccgtctccgcggtccggcggaggacgcgctcgcccaatcggagtccaggcctggcttctgctcctgcctcctcgaagtgattaccgcgaaggatttggggtcgcagacggatgtgcgcatgatggccaccgtgtatttcaagaacagcgtcaaccgctactggcgccaccgccgcaattcctctggaattagcaatgaggagaaaatgcacctgaggcagaagttgttgatgtacttgagagaagagaatgatcagatagctctgatgctggcggtgctcatctccagaatcgcccgcagtgattatcccaaagaatggccagacatctttttggttttatcacaacaacttcaatcagcagatgttcttgcctcccatcgaatctttttgattctatttaggaccttaaaggagttgtccacaaaacgccttacatcagaccaacgcaactttgcagagggtagcaaggaggttctatcagtgagttgttggaaacttggatgtagctggcgcctttggcaaagtgatatgcagacaatactgcatggtttctcatctctttctcaaagctgtaatctaaatgctgaagatcagcctcatgaactttatcttacatgtgagcgatggctgttatgttcgaagattgttcggcaattaattatttctggatttcaaagtgattcaaagtgttttcaggaggttcggccagtcaaggaagtctcacctgtgctcttgagtgccattcaatcactccttccatactattcgtcttttcaaaaacaatatcctaaattttgggactttgtaaagagggcatgtaccaaattgatgaaaattttagttgcctttcagggcagacatccatactcatttggtgataaatttgttctttcatcggtcttggacttctgtttgaataggataacagatcctgatccatatctgttgtcatttgagcaatttctcattcagtgtatggtgatgattaaaaatattctggaatgtaaggagtacaagccaagtcttactggtagggtgatggatgaaaatggagttacactggagctgatgaagaaaaacatttccagtgcggttggtggtgttttaacttcccttcttcccactgaacggatagtccacttgtgtaatgtgttgatatcgaggtattttgttctgacagcaagtgatttggaagagtggtatcgtaaccctgagtcttttcaccatgagcaggatatggttcagtggacagaaaaattgaggccatgtgctgaagctttgtacattgtattatttgaaactaatagccaattgctaggtcctgttgtggtctctcttcttcaagagtctatgaataattgtccaacttcagtggcggaaattactcctgcattgcttcttaaagatgctgcttatggtgctactgcttatgtttattatgaactctcaaactacttgagttttaaagactggtttaatggtgctttatcactcgaactctcaaatgaacatccaaatttgcgtatcattcatcgtaaagttgctataattttggggcagtgggtttctgagatcaaagatgatacaaaaaggcctgtatactgtgcattaatcagattgttacaggacaaagatttatctgtccggctggcagcatgtcgatccctatgcttgcatattgaagatgcaaacttttcagagagggagtttgttgatcttcttcctatttgttgggattcatgttttaagttgtttgaggatgttcgggaatttgattcaaaggttcagattttgaatttgatctctatccttatcggacatgttagtgaagttattccatttgcaaacaagttggtgcaattttttcagaaggttcagtga

SEQ ID NO: 91298 - DNA, 393 bp, Glycine max
  Peptide Sequence Number=SeqID_208076
atgtggtgcctcctcctaacaaagatcccaaggcgaagcaacaacacaaaaaaaggagtcactgcaaacaccaaagcaatttgggagcatcgggatagtaactcttgcgataaaatactcaagcaacaaatgcttaaattccatcgcaccagtgctgggaccttggccaacttgtcagccttgaccaaccaagctaacatgaagttggctgggaataacaagaacttggaggatcaagtgcttgtgctgaccatcgaggcaaacgggttggagaagctcagtgttaatgcggaggccttggttaggtcttgggatagcgagattgccaagcttcggtcagccttggcaattgctaaaaaggagaaaatgaggttgttgttgataaagagatga

SEQ ID NO: 91299 - DNA, 177 bp, Glycine max
  Peptide Sequence Number=SeqID_208077
atggaatggataaggagagaaaaagtgacaagtttatggagggttgattggaagggatttgtttcaaagtctgaatatgtttggatggagaatgaagatgataatgatgatgttcaagtgggattaaagaatgaagtaactacggagattcaccctcacactttagaagatgattaa

SEQ ID NO: 91300 - DNA, 801 bp, Glycine max
  Peptide Sequence Number=SeqID_208078
atggatggtgcgtctcttcacactggtggatcaattcctcatcgtttgcattggaagagaatgaaggaggaaaaaggcacagatccatcattggctgagttttattttcgtactcatcgaagaaaaaaggatcaaagttgggtgggtcctcatgcagaatctgcttatgataaatttgaacagaggaagactgagttatcttctaagagttcaaaatttacttcgggggaaggtggaactgatagtcaagctgatagtcaaccatctatgaatcatatgccatcagactttgatatttgggcagattcggttggaaagaaaaaagggaggatctttggccttggatccatagccaaaacattatttacatcctcaagtcaaccaacgaaactttctgcaaattcagaggaggttgatgctttaagaaatcaaattcaggaattaaatgaatcactacaaagacaagaacaagagcaacaaaagacgagacaagagttgactcagaccaaaaatcaaggatccacaagcattgcatcctcaagtcaaccaatgaagctttctgcaaatccagaggaaattgatgctctaagaaatcagattaatgcattgaatgaatcactacaaagacatgtgcaagagaaactagagatgaagcaggagttgactcagaccaaagaacaagtaatagctttaatgcaacactttggatttgttggttctttgcgtccatcttcatcacctcaacacaatagtgtaaatgacgatgactatagtgacactattagtgatcatattgattag

SEQ ID NO: 91301 - DNA, 705 bp, Glycine max
  Peptide Sequence Number=SeqID_208079
atggaaaagcctacacaccgaacatggatgtataataggcttcttcctggtcaaaagggttatacaacagaatttttgaaaggtgtcaaggattttattgattttgcttgtcagcaaccaaagtatttgaatgaaggtgtaataagatgtccttgtaagttatgtaaaaatgcaaagcatttaaccccagaagaagtaaatgttcacattattaaaaaagggtttacacccagatattggttttggacatcccatggagagaaacttcctcatattaataatgatgttgaagtgcattcagtgtcaccaaggcttgcttcaatgaccgacctcgaacccgatctcaaactcgacctcgaactcaattcactcaatctcaacctccacctcaactcactcaatctcaacctcaaacccgccctcgaacccgatctcgacctactcaaccttcacctcaatttcaatctcataccacccaatccactcaatctcaacctcgacctactcaaccttcacctcaatctcaatctcataccacccaatctactcaatctcaacctcgacctcctcctctacctcaatcacaatctcataccacccaatctcaacatatccccactcaagtcctacgtatggaagaatatccaatggccaataaagccccatcttcttcatctagtcatgttagtgaaggcaataacatga

SEQ ID NO: 91302 - DNA, 186 bp, Glycine max
  Peptide Sequence Number=SeqID_208080
atgaagaacggtggaaaacctttgcgaaatcacccacgaaaacgtctcgggaaaagagggaggtggttgccgcccagctcacccaggcgagctgggttgcttccaccacaaggcaccgccttctgttgtaacatcctggaaggcctaagtgggcttgatttctatttgcacacccctgtttactaa

SEQ ID NO: 91303 - DNA, 198 bp, Glycine max
  Peptide Sequence Number=SeqID_208081
atggacaacggtggagttgtttgggggcacaaggaaggtgaaggggaagagggaggggcatggtttgaactgagagcccatacaaatttgactgatgacccaactaaagaattaaaagagacaaaaactcacttactcaaaagaagtgaaccacttgactatacacttttgcttaggcgagtttcaaaccgaaagtaa

SEQ ID NO: 91304 - DNA, 246 bp, Glycine max
  Peptide Sequence Number=SeqID_208082
atgacgatctacccaacaccattgacggactcgttggcagcggtcgcacatagatcaagcttgggtgatggtgtttggttcatggctgttgtgtttgcttccattggtgacaagattggggacgttgatgttggtggtatgattgtggtcgtagtgggatggcatgcacacaatgatgtggtgttggcggtgacccgacaacgacaaggtgacatgaagtggcgcaacgcgacattggcatggtga

SEQ ID NO: 91305 - DNA, 228 bp, Glycine max
  Peptide Sequence Number=SeqID_208083
atggctgttataaaacgtatttggccactggtaatcgattacatcctctgtattgttttgaatttaatcttgaaaagcccatttgcatcaattgcaacacatcatcatgatcatcatcaaaacatcaaaggcaattgcatctacatagaatgtgaagacgctcttagcgcgagtcacgcgctaaacgtgagtttaccgccatactcgctaagcgcaaaggttgcgtga

SEQ ID NO: 91306 - DNA, 309 bp, Glycine max
  Peptide Sequence Number=SeqID_208084
atggacactatggtttgcgttgagaagaagaatgggatgaggaaggcacactccctagctaggacttcaacatcaacgcccttctggatgaagatctgggcgatgacttggagaaggtggtgttcatgcacagacatgacagagagggccatcctgtttgttacaacgtctacggcgagttccagaacaaggatctctatcacaagcccttgtcctctcaggataatcgaaacaagtttctccaatggcgtattcagttgttggagcgcagtattcggcaccttgaggataatgaagaagaagctatag

SEQ ID NO: 91307 - DNA, 1332 bp, Glycine max
  Peptide Sequence Number=SeqID_208085
atggaggaccgccaacctattgcctatttcaacaaggccctatctgcaagaactttgtccaaatttgtgtatgagaaggagatcatggccttggctttgtccattcaacactggcaacactaccttttgggtagaagtttcaaggtatatacagatcataggagttcgaagcatctccttcaacaacgtctcaccaccacagatcagcaatgctggttggcaaaactcatggggttccaatatgaggttgtctacaagcctggtacagagaataaggttgttgatgccctatcccgtcagcttccttccactgagttcaacaccatctccattagtccttattgggtggatttccctgctatcaagaacgaagtgcaaaatgaccttgagttggtcaagttgagctcccaattgcaatctgattctgattctctgccacactatactctgcacgatggtggccattcgggattcacgaagacgtataagcggttgtcttccagcttcttttggaagagaatgaaagctattataatggagtacatccgccaatgtgacgtttatcaacataacaagtaccaggtgttgtctccagcggggttgctgcaacctattccgatcctagaagtccacccttacacagcgcatacagtagcagaggtattcatcaatgaggtcgccaagttacacgattttcccaagtctattatcagtgaccgtgaacccttgttccttagcaaattttggagcgaactatttcgccttcaaggaactgtgctacggatgagtactaattaccatccccaaaccaacgaccaaacggaggtgagcagagttttgatacaatacttcatcccattctgcaacagccttacgtcaattgaagtaccacctgcactgtgctcagtaaacgatgaagtaagggatgctcattgtcgtcatgtcacttatgaagttggcgattgggtgcttttccatgtcagtgaggtggcgtacatgttgcagttaccagacgctgctagtattcatccaatctttcatgtttctcaactcaaacgctctgcaaagagtgagtggcttatcctcgggaaatctgaacctgtggaagaagcaacatgggagaaggcagcatcaatcaaggacagattttccaatttctgccttgaggacaaggcagctgttttagagggttgtattgataggaaattagcttctcaatgggataagccctttaaggtgaggaatatctctgttataattgggattgtggttttggttgtggggtatgatggatttggaatagaaagtggagctcagagaacctttctctga

SEQ ID NO: 91308 - DNA, 207 bp, Glycine max
  Peptide Sequence Number=SeqID_208086
atggattgtcgtccagtgatgtataaaacttattacgaagaatcaaacaaggttacttcaaaggataagcattgcttcaagattaatacaaggttgcttcaacaaacaaaaccttgcttcaagattaactcaagatcaagccttgcctcaaaacaaagtgtttccaagacatccaaggctctagcaatcgattaccaggcaatgtaa

SEQ ID NO: 91309 - DNA, 257 bp, Glycine max
  Peptide Sequence Number=SeqID_208087
atgggtgtgccagtgcgtgataataaccgccaagattcaaaggcggtttggcggttttttactttcctttatggtgtgtttggttggaaggcggtttggcggtttggcagaagtgacagtaaccgccaaaatagattcaaagcggtttggcggttttttactttcctcttctccggaagtccctacgcaactgtgttgaagtgcatgggccacgccgttcacgtgctcagagttccctctgccgagatcgtatactg

SEQ ID NO: 91310 - DNA, 762 bp, Glycine max
  Peptide Sequence Number=SeqID_208088
ttatctcaagatgatagtagcggacaaactttgtatgtcaaacttgcagcatctgagtttcatgatgataatagcagaattgggatgattgttagtgtggttgtgggcgtgattgttggcattggtgttctcttggcccttcttctgtatgtcaagattaggaaaagaaagagaatggttagagcagtggagggttcattggtggcattcaggtaccgagatttgcaaaatgcaacgaagaatttctctgagaaattgggagaaggaggatttggttctgttttcaaaggaacattgggtgacaccggtgtggtagcagtgaagaagttggaaagtactagccatgtagagaaacatttccaaacagaaattactacaatagggaaagtacaacatgttaatctcgttaggctccgtggattctgctccgaaggtagcaaaaagctgctagtttatgattatatgccaaatggctccttggatttccatctgttccagaacaagaactcaaaggtgttggactggaaaacaagataccaaattgcgttgggaacagcaagaggattagcttaccttcatgagaagtgcagagagtgtattatacactgtgatgtaaagcctggaaacattctcctagatgctgatttttgtcccaagcttgcagactttggcctagctaagctggttggaagggatttgagcagggtcgtcacagcagctagaggaacaacaaactatattgctccagaatggatttctggg

SEQ ID NO: 91311 - DNA, 144 bp, Glycine max
  Peptide Sequence Number=SeqID_208089
atgtcattgaaaaacctcatcgggcgcctaagagtacatgacaagacaaaccacacactgggagaccagtcagggtcacgctattttgtcagaatgttccaaccacgtgggatcaacacaggcttaaaggagcacttaaattag

SEQ ID NO: 91312 - DNA, 144 bp, Glycine max
  Peptide Sequence Number=SeqID_208090
atgaacccgttaagcctttctgtgcgtcttctgaataaggctaagcagtgctgctgtgctaagcccttgttgtgtgtcaaggaggttgagctaagcgcgccctactgcgctaagctcaactctctcactgttttgagcttttga

SEQ ID NO: 91313 - DNA, 213 bp, Glycine max
  Peptide Sequence Number=SeqID_208091
atgacatgccaatctacattaggatcaaggataggcctagggccatccattgcagcccctaatcaaacattcaagtcatggattcatcatgcaatcctccctaggaagggaccagtcactagaaccatgagcaagaggctccaagaagattgggctagagctgctgaagaaggccctagggttctcatgaacctcaggggctccatattgtag

SEQ ID NO: 91314 - DNA, 360 bp, Glycine max
  Peptide Sequence Number=SeqID_208092
atgatcacaattgagaatgaaaatgcttgggatgaacaatgcacttcgcataaatcggctaaaccgtttcgattcaaggtgcttcaaaactgggatgatatagtggatttgtgtgctaaagatagagccattggtcatggagctgaaatggctatggatgctgatgaagcgatgagtagagaaacaaataaaaaaaaatggatggatgaagatattcgagaagtgttacgtgagacgactttgatacatggtcttaatagacaacaatgggctaaagctattaaatggttagctgacgatccaaagtcgttagctaccgtgaaagtcctcccaattcaccagaaagacattatgttttaa

SEQ ID NO: 91315 - DNA, 321 bp, Glycine max
  Peptide Sequence Number=SeqID_208093
atgggtttgctggaggaagacggtcctagtggtgtggtcacattggcgaaaagagatcaaaatagcgatgaggaagggcttgccacagttgcgcgccaccacgagtggcggcaacagcagcatgtaggtgattctatacttctctatggccttgagcatcccttcgaagtcgaacctctgcaggaagacgagcgtctccctgatggtaatggctctaaccagcatgaagaacccgaacactgtcggggtgaggcggttggagaggatatagagggcgtagcgaaattctggggagttaggattttggggaaagaaatttag

SEQ ID NO: 91316 - DNA, 1362 bp, Glycine max
  Peptide Sequence Number=SeqID_208094
atggatatgcaaatctaccttggtaagcttgaaagtgtaattgctgattataacactctcatgccttttatgagtgatgtagaaatgttttataagcagcgcaaccaattctttatggttcttgcccttgttgggcttacaattgaacttgaggcagtgcgcaatcagattttgtcaggttctgttgttctttcctatgacacggtcaatgaacaacttcttcgcctctctactccgcatgcctttggatcatcctctacaccaactggagatttctttgctcttgtctcccattcttctaatcacgatattcctttggatgttcacactggtattccacctattgtgccaaccccaattgttgcatctactacacctccgctaatggtctatctcagatgtctacaacctccaccaatggtgccttctcctaatcctccaacatcatcacctactccaaccctccatccaccaacattgcttgtacctaacctccctattgctcttagaaaaggtattcagtcttctcgcaaccctaatgcaatgttggaggaaatggctgctttagacgccaacaacacttgggaacttgtccctttacctactggcaagaccattctgggatacactcaaatttccagtcttgactacaaggacaccttttcccctgtggccaaaattgcatttatgcatctctttcttgctatggttgccattcaacattggcctcttcaccaactggacataaaaaatgccttcttgcatggtgagttctttgccctgctccagtttggaatgacccattatgaggctgatcactcagtgtttttcattcattctccatctggacgttgcatctaccttgttatctatgttgatgacattttcataactggcaatgattctaatggtattcttcaccttagatctcatctccataagaagtatgctctagatatcttaaccaagattggtatgcttgattgtcgctctagtgatacttctatgaatcctaatgtgaagcttctccaaagatcaccatcagacaaaaggttcacctctagatattatgtccttaatgaaggaaacttgacctcatggagaagcaagaagcagaaaaccattgctagatctagtgttgaagctaagtatcgtgctatggcagcagctgcatttgagatcacatggcttaaacaacttctccaacaaataaaatttggaggagaaatcaccattgagtttgtcagctccaaagatcaactggtagacttgctcacaaaatccctcaagggctttcctattgatgatatttgtaacaagcttgattcaaatgacatctgctctaacttgacgggggtgtga

SEQ ID NO: 91317 - DNA, 1224 bp, Glycine max
  Peptide Sequence Number=SeqID_208095
atggttcgtaacgaaagcagcaacaaagagaaggataaagacctcgatcagtttttgtttgatcggaacgacgatgatttggtcgatgaagaacaacaggagattgaaggtgtgaagtacgagagtgagagtagtagtgatggtgacgacgcaaatcggagagcacagcctgactctttctcttctcagcaatggcctcagagttacaaggtgagccctggcacaccattaaagccttggcgaccagttggtcatgggcttgcctctttgcatatgcaaggatataaggttgaatacaatgactctccccaatacctttgcatagcgaggagccttctgacacgagagggtagagagactacagattcttacacgatagctgctgctccaaattttgagtcagttctacgggggccaagtttcatatattcaagttttgacaatcgttcaaagagtaacttagacatcgatggaaagacaccttttctatctgctgcagaaggcattagacaatcaacttggtgggagaaagcctcggtacaacggcttgtttctggagaattgcccattggatatggatgcagcttcactcaaacaattttcaatggcattaatgtgatggctggagttggtcttctatctacgccatacacagtaaatcaagctgggtggatgagcatggcagtgatgcttctttttgcagttatgtgttgttatacagccacccttttgagatactgttttgaaaatagggaagaaatcattacctacccagatataggagaagccgcatttgggagatatggtcgaattgctgtctcgtcatattgtgtggaattcatcaccttggaaggagataatctcactagtctgtttcctggtacatccttagatttgggtggtttccagttagactcgatgcatttgtttggagttttgacagcacttattattctcccaactgtttggttgaaggatcttcgtataatctcttatctatcagctggaggggttattgcaacagttttgattattatttgcgtgttttgtgttggaacaatagacggtgtcggattccatcacacgggcactgcaatcatgggatatctcatgtttggtgatggcactttgtctcagataacattgaatatgccaccaggcacatttgcttccaaagttgcattgtggacaacagtgagttttgagattttttgggtctcttag

SEQ ID NO: 91318 - DNA, 657 bp, Glycine max
  Peptide Sequence Number=SeqID_208096
atgttagaggaggagctactagaggcgacagatgagcctcttgatcttatcatggaggatggtgcaacggtagtaatgatagtcagtggggagcttccccagggaggagtagggtggcttgtaaaggaatgcagcaaggaggatcctaaggaggattccaatgaggataggtggggtcctccttcctgtcctcctaataaaggtacctctcagacaattcgtttgggactctcaatggataactcttgcacggtttgcaataatgcggtggagacattgtttcatacttttagagattgtaaagatgtgttgctggtttgttcatggtgtctcatggaactccctcattggcgcaatcatgagttatatttggtggaggaggaatcttatagtttttcagcaagagaattggtctcctatgcaggttttgagcattccattaagctggctactgcttacacaatgtcctgggagatagtctcaattgtgatgggggtgtttgcaatgctggaagcaatgcggcttgcagtggaattcttagagactatactggccgagcttagggttattcttctgggtcctaaacttgcatggtcaagaggatataggcggataagcgtggactctggttccctcaatatgcttaaaatgttatga

SEQ ID NO: 91319 - DNA, 192 bp, Glycine max
  Peptide Sequence Number=SeqID_208097
atgagagaggctaagcgcgcatccaccgctaagtgcagctttagtgtgcttagcgtgacagaagaatctgacagagcatcaatatcaaggtcgcgagctaagtgtgaaatcagtgtgctaagcgcaacagttgtcctcagccaagctcagcgcatgaatggtgctaagctcaaatccacttactcgcgctaa

SEQ ID NO: 91320 - DNA, 198 bp, Glycine max
  Peptide Sequence Number=SeqID_208098
atggcatctaagaaaaggaaggcaccttctacacctacccaggccagatatgacagatccaggtttgcactcctgaggcctgatcctcaggagttggctactaagatttgtatcccaaggaggggattcgagctaaatgctgatgagcagccattgaagatattgaggaagaacatgaccactctagctcaaacatag

SEQ ID NO: 91321 - DNA, 573 bp, Glycine max
  Peptide Sequence Number=SeqID_208099
atgggttttaaatcgggttttaagcctcatagttacatgcatgaaagacatgggttatccaaggagaacgcaggagctacttatcaacaggctatcgatgctattttccatgaatgggtaggcaaatcgatgaaggtttacattgatgatgtggttgtgaagtcaaccgattttgaggaacacttgggcgatttgcctttaaagttatacatatcaactgctgaggaatctattggttgccttttagctcaggatgttgatgacgacaccgaaaggccttgggtgttaatgtttgacggatctaagacaaaggaaggtgctagtgtgggagttaaagttataaatcctaaaggaaatagtgttgattaccatgggagctcaatatgtacacatactggagattctcaattggtgatcaaacaattgaaaggaatatataaatgtcagcatgatcaaaatgaagaagccaacgagttagcccaaggagcttcggggtataaatcgttggatgtagatattcagctagaggaatatcccttagtcggttgtctggtgttgaatgttgagaattag

SEQ ID NO: 91322 - DNA, 243 bp, Glycine max
  Peptide Sequence Number=SeqID_208100
atgttgaatgaggagaaagcggagagacctcatgaaatagaggttgaggttgaggttgaacatgaggcagtgacggtggtggtggcaatggcgctgtcgatgagagtgagagtgaaatacgagagaagaaggttattagtagctttttcatcgataaagagttctctctcttgccttgatgccctatgtatgtgtatgtctactcaaagtgatggccaattggtaaacattgtgttccaatga

SEQ ID NO: 91323 - DNA, 1038 bp, Glycine max
  Peptide Sequence Number=SeqID_208101
atggctgaatcatcaaagaaacaaaagggatattcctccaccaccaccgctactggccaccgccgccatggaacctccagagacccaccagatccagttcctccctctctttcatctcttcggtcatccacattattttcctccaatgatcagcatcagaggtactactctcaattctggaatagagtcattctagaacctaagtaccttgaccttgaattttttgatggagaaatatttgattgttaccaagtgtttcaaaactctactttggttgatttcatgtctctcaaacttccctactttcctaaattagttaaatccttgttttattcattgactaaactgcccagtcaaggtgttccttttgagggcactcttgtggatgactggaaatttgattattcaagccatgatgcttgcagaatggtttgccatgatcaggctgacatgatcggcagattacttgctaggtcatttactttcgattgttgcatcatgcactatatcattgtttgtattttgcttcctcggtcttcaaatcttgcccaagcctctgaggaggatttgattttgttgtgggccattcaaattggtcgtcagatcgactgggcccatctaatttggtaccggatgcatacgacattacgggccaatgcacctctctcatatccccaccttgctactctttttcttcatcatttcaatgttcttttggatgatgaaccatatgtcaaggtcaaaaggtctttctccattggtgccggtgttgttacctcctttggttaccggaaggatgttgatggtcagtgggttagcaaacaagacttgccaccgcctattcctgatgaacgtaccccatctcctccaccacaacgggatgcttcttcttctctactgactgaagtcctcacagagctccacgatcttcgagcatttgtggatgagcgttttgatgccatggatacaaggatcactcgactcgaagatgatataagattcatcaggcgttgcttcgatcccccggctgactcttag

SEQ ID NO: 91324 - DNA, 417 bp, Glycine max
  Peptide Sequence Number=SeqID_208102
atggctgactctacttgctccaagtccaatatggaccacattgaagaagccatcacgaaactcacctccaatcaactcaacctcatcgctactcaaaacaccatacaactctcaaaggttacctatggcttctgcaatgataatgacaccgatggagcaacacaacacataaaccatgccctcgatgtctccagggaagaagttggtggcaaaactcattctaatgaagtcacaactgctatcggagcaggagattctgacggaggggatggtgtcgatggtgtggaagaggtggttcttctggtcggagtccttgatgtaggtttcgaggaggaggctgtacatctcgaagtggatgttctcgatggcgatttggatagaaggtgtgggcctcggggagatggatctcctgtgtga

SEQ ID NO: 91325 - DNA, 411 bp, Glycine max
  Peptide Sequence Number=SeqID_208103
atgaggcagcaacttgatccctcggctcacacaatcaagtcctatggatcaacacttgcaagaaaacacattcgtgattggcttatattgttgcttctcatagtaatagagattgtcctttttgtcattcatccatttaaacgctttgtgggaagggacatgatggaggacattagaatatttgtcaaaaagcagtgcaataagtatgatgccgtggttggggacgtgacaattgtggctaagtgctcagagtatgttgattttacaatgccatttttagaatcagagcgtggtgttcccgtgtcctctagcatgaggttcttcatagtcatccacctattcatctgctcccccgaacacaaagttcaagatcatcacaggatccaaacacaaacagcaaaccgggagtga

SEQ ID NO: 91326 - DNA, 558 bp, Glycine max
  Peptide Sequence Number=SeqID_208104
atggtacaactgaatttgacagtaggaggaccctcgatgggaaatcaaaccagtccaattcaggcattagcatcttctttgggaaaaggtgggccaattcaagctctgttggtagcaatggctcaaaagaatccttttattgggcaggtaaacttggtgaggaggccacctagtgccataggtcatatcggcatgttgccactagggaaaccaagtgtgccggctgtcaatatgttgaccaatggtgatgcgacccggaaccatctattaccaggaagtccttatagaggggtgcacacatctagtcaactgatagggggaccccagttgatcgatcttgaagtaatagctgaaaccatgaggaagtactttgggatacacctgaaaccaatggagggtcctaggtataggaaaccataccctgaatgggttgacaaaatggttcattttcccaaaggatacaagatgcttgatttcactactttttcgggagaaaatggaaagtctaccttagaacatgtggcacaattcatgaacctgcatggagagggaagctag

SEQ ID NO: 91327 - DNA, 468 bp, Glycine max
  Peptide Sequence Number=SeqID_208105
atgagacgtcatacgaaggcgtttaaccctggggcaaggatgctgataattgatgacaaacctaatcctgataggggtaaactaatggcaaaatttaaagtggaaaacaacatgagaactttgaagattaccatggaaaacaatgataatccaagtggtcgaataatcaaactttgtgctagtgttaaaaaaggagaatggacagttaatcagcaaaaggaaaggttgataccacttaaaatgtttgccaagacacataaaaggagatttcaaaggaagaaggtaattagtaagatgaagcaagccttttctttgactgctaaagtaaaagataaaggttctaatgaggtgtcttcttatgaggtaatggaggctttacaaaaagctttcatttcagaagaaggtagtctagtggcttctgtaattgaagagcaacagacatgggaaaagcttagtaaaatgtattag

SEQ ID NO: 91328 - DNA, 312 bp, Glycine max
  Peptide Sequence Number=SeqID_208106
atgccgatttggttctttggagtgaccctgaactccgagtttatgcggtgttcgaaaaaccaaactatgaagcctgtgaagatgaaagctacaccagtcgtcaaccaaagcccaccaaacctgtctcagaaaaacgacgatctcggactcattcaccgttggatcatcgtgaaatttgagtaccatgttcgcaacccaatttcaaacattctcaccgttgggaattttcgagataatattcgtggagggagaaaaaggaatcacatgaagacagtacaagtggaggtttcaatctcttctccgtctctctga

SEQ ID NO: 91329 - DNA, 309 bp, Glycine max
  Peptide Sequence Number=SeqID_208107
atggtcttgaggaattatgttgggggtaaaacctttctgatgggtaaatgtgatccaaatgattggtcattgcaagaggtaacctttgatcttaaacaacacgattataaaggttctgttcagattttctatcgccaacttggaataaggttggataaagatcttattaaagttttaaatgatgatggaacaaggaaaattgttaagactgctatggatttgattcaaaaacatgttgaagtatatattaatcatacttcacacatgacagagggttccatagtgtatggagggtacctagtaatgtag

SEQ ID NO: 91330 - DNA, 474 bp, Glycine max
  Peptide Sequence Number=SeqID_208108
atgaagaagatccaaggcctacaagctcttcatggagctacatcaggaaaagccatggttgaaggagatttggggaatgatgtcattgatggaatagacagtgatgcggaggttgacatggttgacttggatgatagggataaggaaactgatgatgataagggagataatgataattatgaggaaaatgatagtgatgatagggatgacttggatgctgaatatgatattgataaattagaatatgatatagcaagtgaagaagatgatgactgttatgcactttctatggcacaaattaatggagaagatatatcaatagaaccagtttccaagagatttcaacctcatgaaatgggaagagattttaattttgaggttggtatggagtttgattcaattagtcagttcaaggaagccatcaaagaatatgcaaacctacatggttttgggggtgaaattcaagaaaaatga

SEQ ID NO: 91331 - DNA, 414 bp, Glycine max
  Peptide Sequence Number=SeqID_208109
atgcatgatacttctaaagatgttttccagaaccttgttcttggatcatatttttatcttttgaactccgccctatcaacattttttcattgtaaagcaggtgacaataggctttgtcaaaacttgagggcgagccctggtgcagcggtaaagttgtgccttggtgacttgttggtcatgggttcgaatccggaaacagcctctttgcatatgcaagggtattggttctctccctcagatcaaaatagagttcggagaggtagcattgttactggcaatgaaaaatcttctgtaacttctattccacacttgaaattgcattgtgacatggaggctcaaattcatctacttgaacaggaagcttactctgctgtcttgcgtgctttcaaagctcagtctgatgctcttacttgg

SEQ ID NO: 91332 - DNA, 477 bp, Glycine max
  Peptide Sequence Number=SeqID_208110
gatgtgccacatggtcgatcccatcttcgtgcttggcgatcaggatttcttctgccccgatgcctccccgcttcttcttcgtcagcctccgcagaaaatgcgtgccgcaaatcaacaccgaataagtcacccgtgttggaattgggccatgatattgctgtgaaggggtcattgtgggccatgaaaaatgagcttgtgtttccgcaacaccaccgaacgattgctggcttgcagaagtatcagtgtgatgaccctgaaaaggatattgatacatctgggtcggatactcagcaaatgtttgtggcgtgtaatacattccatggccacgctccgccatttgttgggaatattcttccgcttcaacaatgtcccttcttctgtctatcccctgagtttcaatacttgactgaagcatgtgaaactgttgtgcaggaaattgacgctctgatgcgggaccatgtgacactggctcagtga

SEQ ID NO: 91333 - DNA, 564 bp, Glycine max
  Peptide Sequence Number=SeqID_208111
atgggaaatgcaagattcattgaaaatggtgaaatcagtggcagtacaattccacaagatgtggaaattaaagaagttaaagtcggttgttccaaaaataatgaagaggagcaacacaataatgagcccatgatacataatgaacgtattgtggaagaaccacaagaagtaggattaaggaggtttgaaagagaaaggagaccaactatttcgaatgacagtgtggtatacctacgtgaaatagaaacaaaaacaaacttaagcattaatgaaaatgatccagtttcattttcacaagttgtaaactgtgaattgccaaagggttgtaataagagagttggttgtaagtgggtcttcaagactaaacataactctcatggaaaccttgaacgttacaaggaaaatactgttgatcggtgtataaatctgaaggtcagtgggagtatggttatttttctaattctatatgttgatgatatcttgcttgcaactaatgatcttggtcttcttcatgaaactaagaagtttctctctagtaactttgaaatgaaagatatgggtgag

SEQ ID NO: 91334 - DNA, 261 bp, Glycine max
  Peptide Sequence Number=SeqID_208112
atgagtcgggtcgaaccaaattggctacaaaacggggcgggttttttccaacccacttcgagtgtgcaactagtttgttttagggtggttaaaaaggtggtgaaaaggcaaaaagaccttttgtgggagtgtaagaaagctgcattgaggagatgggtgggtggttggaagatgagtggagaggggaagatttcgatgggagagagaccaagtgcaacaattggatacattattgagggcagttattcttacgaagggtga

SEQ ID NO: 91335 - DNA, 147 bp, Glycine max
  Peptide Sequence Number=SeqID_208113
catgttgtccgcttaacagtgaatggctcttctttcttgggagatcccattgttccttcttccaagggcaaggatggaaattctcatcctgggtcaagggataaaggaatgtctcacattatttccatgaaacacatgcaacaatga

SEQ ID NO: 91336 - DNA, 917 bp, Glycine max
  Peptide Sequence Number=SeqID_208114
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatatcttcggccactcactgatcggggggaacaggtcagggttcgtggagatgggggactcagggcgaatgacgatcgccccgaggggagtgttcgacgggacgggctcccccttatccaggcgcagcacgcgggggaagacagccaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 91337 - DNA, 243 bp, Glycine max
  Peptide Sequence Number=SeqID_208115
atggctccaaaacagattttcgcaaagagatctaggaaggacgccgcggctgaagggaccagtgccgcccccgagtttgatagccaccatttcagtgcgccgagcaccaatagcgcttcgaggccatcaaaggatggtcgttccaccgagagagacgcgtccagctcagggacgatgagtacaccgattttcagagaagatagctcgcagacattggatgccgctggctactcccatggctaa

SEQ ID NO: 91338 - DNA, 306 bp, Glycine max
  Peptide Sequence Number=SeqID_208116
atgaggagcctcctggcgacgagatcgtcgacaatctgcccctgcagtccggaaagggatatggcgaaggcgtccggaattcatgaagcaaaaggcttccatgtctggttgcaaaaagttctagtcattcaagaaccactttgccacatgtccctaggccattggatgcccagtcaaccaattttgaagatgatacttctaaccaacttaattaagaaggcactcgataagtttgaattccctgattttgatgggaatgatctcattggtctgttggctagagctgagaaactttttgaaatttaa

SEQ ID NO: 91339 - DNA, 219 bp, Glycine max
  Peptide Sequence Number=SeqID_208117
atggtgttcgtgattgttgcattgttcaacaacccgtcatatcactggcttttgttgtcggaggacatgcaaaacaacttcgccaacgaagaagacgcacagtctccaccggtttccggtggtggtacagagagcgggtatgttccagctgagtcatgtatgtacagctatcaccttccttcggatgtgatttgggctccaacccctaaagatatttaa

SEQ ID NO: 91340 - DNA, 195 bp, Glycine max
  Peptide Sequence Number=SeqID_208118
atggaggaagaggaatgggtgaagattgcacgtggaatggaagtcattgatgtgtggagtttgagctccatgctttctgctctgctagtgttccatgatcctatggctgccatcgcggagcttgctttctggtgcgttgcgatggataaggacaaccaaccgaacgtgagggaggtggtggaggagttgaagtga

SEQ ID NO: 91341 - DNA, 853 bp, Glycine max
  Peptide Sequence Number=SeqID_208119
atgatgggccaaaagaaggtgcttattgttcttgatgatgtgaatgattcagagcagcttgaagaattatttggaactccagattggtatgggtcaggtagtagaattattataacaactagagatataaaagttcttatagccaacaaagttcctgaaatataccatgttggtggattgagttcctgtgaagcatttcagcttttcaagttgaatgcctttaaccaaggtgatcttgaaatggagttttacgagctatcaaagagggtggttgattatgccaagggcattccattagttcttaaaatattggctcatcttctttgtggaaaagataaggaggtatggaaaagtcaactagaaaagcttaaaggaatcaagagtaacaatgttcatgattttgtgaaacttagttttgacgatctacaccatgaagaacaagagattcttttagatcttgcatgtttctgccgtagagcaaatatgatagagaattttaatatgaaagtggattctataaacatattattgggtgattgtggaagtcataatgcagtggttgttgggttagaaaggctgaaagaaaaatctcttataactatttctgaagataatgttgtatctatgcttgatactatacaagaaatggcatgggagattgtttgccaagaatctaatgaccttggaaatcgcagtcgattatgggatcctattgagatctatgatgttttgaaaaatgacaaggggactaaggcaattagaagcataacaacacctttgtcaacattgaagaatctgaagttacgtcctgatgcatttgttaggatgagcaatctacaatttttggattttg

SEQ ID NO: 91342 - DNA, 114 bp, Glycine max
  Peptide Sequence Number=SeqID_208120
atgtttacgaagccaaagacttcctaccaagatacggctaatgagacgaccgtctggcaagatcacagtaatacaaattactcgttcaacattcctataatcctgcaatcatga

SEQ ID NO: 91343 - DNA, 1300 bp, Glycine max
  Peptide Sequence Number=SeqID_208121
atggcgaaacgggggcgagggcggccaccgaatacggtgcctccgccaccggtgaatcatcctcaaccggcgactaatctggtagtggagactgagaatcacgagttacagaagcacgaagaaactattgagaaatttgaagcaacaacgaagagtcccgaaaccctaattgaagaaccgaaggaggtcactgatcgaaaactgtgggtagatgttctaaacaacaatcgtaatctgtccaatggcgtaacaatggagtttgtagcacccaaactgatcaatggtgaagtggaagtggaaattgaagcggaggacattgcgtcagaacttcaattttgggaaaacgcgatgatactgtatgtgctgggaggtagtttgagcatgactatgttgaagaactacatggtgaagatgtggaatttcgttactcttccagatatgttgtatcacgatgacggttacttccttctccgtttcaagaatcgcgaagacagggaaactgtgatgatgagaggaccctacaccatccgcaacatgccaatcatactgaaggaatggacgccagatttcaatctaagcaaagacctggagagaactatgccgatttgggtaaagttatcacaattgcctctatgcctttggggattgaaaagcttgaacaagataggcagtgcaataagcaatcctttgatgactgatgaatgcacagctcagaaacttagagtttcttatgctcgcatattggttgaggttgatattacccaaaaattggtagaggaaatcaccatatctgacagaactggaggaaagataaagcagattgtggaatacgagtggaagccagaattttgtgagaaatgtcaaaaggctggtcatcaatgtggaaagaagaaagttgtcaagaaatggatacctaggaacaagcaagcagatgaggtaaaggcagatccccttccaaagacacctgtgcagaatactgaaactgaaggagaggtcaaaccagaaggttggattacagtgggcaaagctgcaagacatacaggcaaagctatagagggggagttcaaattctggcttactgtagtgtatgccttaaatcagttggatagaaggaaagttctgtggaaagatttggaggctatccataaacatcaacagggtccttggtgtgtgattggtgacttcaataatgttactaaggctcaagatagaattggaggaaaagctgtgacagaaagtgagtacattgatttgctgaacatgatggagacaacaggcctggctgagatggataccacag

SEQ ID NO: 91344 - DNA, 327 bp, Glycine max
  Peptide Sequence Number=SeqID_208122
atggcgaaagggtgtgcggatgaccataatttgtctctgcctgtcatcgggctcgccgcctctgcatcacaaaaggtgcacaaggaccataatttatctctgcgtgacatcggactcgattgtctctggatggccaaaaggtgtgcggatgacaataatttgtctccgcatgtcatcgggctcgcagcctctggattacaaaaagtgcagagtgaccataattggtctttgcgtggcactggactcgagcgtctcaggatggcgaaaaggtttgcggatgacaataatttatctccgcatgtcatcgggctcgccgcctttggatga

SEQ ID NO: 91345 - DNA, 342 bp, Glycine max
  Peptide Sequence Number=SeqID_208123
atggcgaaaaggtttgcggatgacaataatttatctctacatgtcatcgggctcgccgcttctgcattacaaaaggtgcagaatgatcataatttgtctctgcgtgccaccggactcgatcgtctctggatgacaaaagactcgatcgtctctggatggcaaaaaggtgtgcgaatgaccaaaatttgtctctgcgtgtcatcgggctcgccgcctctggatgacaaaagactagatcgtctctgtttggcgaaaagactcgatcgtcactggatggcgaaaaggtatgtggattaccataatttgtctccgcatgtcatcgggctcgccgcctctggatga

SEQ ID NO: 91346 - DNA, 234 bp, Glycine max
  Peptide Sequence Number=SeqID_208124
atggtccagcaacaacatcaatttgcggcacaagagtttcatattctcccgtcaagtgttgaaactcaaggcataggtactcaatggaatgtacccggagcaatacctaatatggatgacttattaggtgttgatttacatcaccaattttctgctgaggctgaccaagttgaagcagtgagaaatcggggtagaaaaaatcctaatagagcagcacaaagaacaactatgtga

SEQ ID NO: 91347 - DNA, 986 bp, Glycine max
  Peptide Sequence Number=SeqID_208125
gagaaaccattaaaactaaggtagttcctaagcaaaaatcggttgaagaagcctctccaagtattgccattgaaaaaccactgttcaaacctttcaaagttagtgagaaagctaagcgaaagattagagatcttaggaaaactaaatccttagttgaaggagtagaaaccattaaaactaaggtagtttctaagcaaaaatcggttgaagaagcctctccaagtattcccattgaaaaaccactgttcaaacctttcaaagttagtgagaaagctaagcgaaagattagagatcttaggaaaactaaatccttagttgaaggagtaggtgacaatcatagtgaaatactaaacaagattggtagtttacttaaggtcattccggaaactccccaaacctcggaaaatacttccaaaatggtaacaagaagtacctccaaattaattaatgtcattaatgaagatagtgaccaaaacttaaataacacaaatgagacaggatcagtgtcagaaaagaatataaatccaattaattccaaacattggaaaacaccttccaaattatattatcaacgtccaactgcccctgaccttctattagaagaaagaggagaaaacaatttcaagagttttagtgcaaacaacatctatgaatggaacatagatgcacaaacggagtataatatcatgaatacactccaacatatgaccatggtagccaaggcttaccaaacctcccacgaatattcagaagagactattatagacatcttagtggcaggattttctggacaactgaaaggatggtgggataatgacgatgataaagagattcctgacgccatcaataccttaattttaacaatagctcaacattttattggagacccatccttatggaaagataggtctgcagaattattatcaaaccttaagtgtagaaccttagcagattttaggtggtacagagatactttcctaactagg

SEQ ID NO: 91348 - DNA, 231 bp, Glycine max
  Peptide Sequence Number=SeqID_208126
atggcatctttctcgtcatgctcatcaaatatacaaattaagtctgaccaattgatggtgacattttatggatgcaagataagcatgtttcagaacatatttgaaatgggaaagaagacagaaaattacacattagacgagttatccccacgtatcaagatcaagaagaaataccagaggaaatttctctacttcgataacctggtttccgtgtggatgggtcaccattaa

SEQ ID NO: 91349 - DNA, 429 bp, Glycine max
  Peptide Sequence Number=SeqID_208127
atgcagagtgatttgggccagaaggataggggaaaattcagtatgaagacactgtatctgaagatgcgatgtgaaggctcgaatgaggttgtgtggaatagacttttttgtggtaaccctgctagacctcgcgctttgatgactctatggcaagcctgccacggtaggctacccacaaaagatcgtttgctaagatttggaatgctaggtgataagatttgttgcttctgtgagggaccaaaatcccatgatcaccttttctttggatgtagtgtctttggtgatgtgtggaaacaagtccttgagtggattcaggtaaagcatcatcctcaggaatggaatgaagagctaaaatggattattaggcacgataaaggaaagggacataaggcctctattctgaagttggcggtgactgaaactgtctaa

SEQ ID NO: 91350 - DNA, 465 bp, Glycine max
  Peptide Sequence Number=SeqID_208128
atggtgacacctgaaaagcatgtgcctttgaaaaagcatctgcacctctgcgcgctactctgcaagcctgctcctctacacctacgctccattacaagtaattcgccagtcaaactggcgaaaaacattgcccctaaatcaccagctctagtgtcgatatacttcatgcatggctgggttctacgtaaaaaagagacccccgtggtaatatgttttaaaacagacttagtttgggaattagtttgtaaaactaacctcattaggcataatttccaaaagaaagggggagtatgggagtcttgtatatactatcttgatttcaggagttgccatcgtcaaaaagggagagattgtagaagcaagactacaagagattttgatgatgccaacaatcaagtgttcttcatggataattcaactgaccttcaagcaattcaagaaatacaagttacatctacaagttag

SEQ ID NO: 91351 - DNA, 366 bp, Glycine max
  Peptide Sequence Number=SeqID_208129
atgggattatgtaggaaagaggttcctatagtggaatggtatagaaccaaggttgtgcctgacactgaaatgatcaaggagtttctgtcaaagtacagtaccacatctgggaaattgtggcagcaacaacaagggaccaaacatttcattgggagaggcttgttgatggcaaatggtgaagattggcgccaccaacgtcacatggttgcccctgcattcatgggagacagacttaagctgaagttattgggaatatccattctaaaatttcaacaattagttcaattgagtgtttttgagattaagtggaatattgtgactattagtttggaagtggtgataatttttaagagaaatatcccttag

SEQ ID NO: 91352 - DNA, 213 bp, Glycine max
  Peptide Sequence Number=SeqID_208130
atggtagtctccccctcgagcggaagtctttatcatccacgagtatggtcacctgcggtacttgccctacccgctagtcattctggccacctgcggtacttgtatactcgtctgagccagtcaccaacttcaaccatcgactctgataccaattgttggggagattcgaggggtacacctgtggaccacgagccaccacataaggaagtctga

SEQ ID NO: 91353 - DNA, 171 bp, Glycine max
  Peptide Sequence Number=SeqID_208131
atggagaacaatgatggtttgtggtggctaatggtggatgtgggtgatggagaaaggtgttacacacaagctatcagaagggaaagcaaatatttcatctcctcacacagctacagagtagagttgctcaagcaactcgccatcttttctttcctggaagctggtatgtga

SEQ ID NO: 91354 - DNA, 186 bp, Glycine max
  Peptide Sequence Number=SeqID_208132
atggaggtggagatactcttgatggagatcatagagagtagaaaatattgtgttgaaatggggagaagcaatttttatgggaatgatttgttgggtatactcttggatgagatcaagaaggagggtgctatgttgctagcaagcaatccacattggcaagacaaagttagagctgaagtcaaagag

SEQ ID NO: 91355 - DNA, 147 bp, Glycine max
  Peptide Sequence Number=SeqID_208133
atgccaagaatatatgatgcaattagagaatatgaggggatcaaggaaaacaataggaatgaacttgaaaggcttgataaagagaggcgggatgaccttttaaacatgttgaaagtatttctagttaatcagtggagtaactactag

SEQ ID NO: 91356 - DNA, 393 bp, Glycine max
  Peptide Sequence Number=SeqID_208134
atggccagacttttcttttcggtgttgaagaacaaaaattatttctctttatttgttcaacatcaatggcttcctcatgttgtggctattccaaggcccaaatgtgcttcttcaagattctccgcagctattccctaccctccaaacaacaacaacaacaagaaccctttccaaccaaagggcgtcggcatcgatttgaatctcagattcttttttgtcacagagaccgaagaatccgaatcttctagaagtgactatgacaatgcctctgccactactcaaaccaacaacaacaaagggtttcttgagaacatcgttgaagttttggagaaactcgacaacaacaacaacataaacaatcatgtgacttggaggaactcggtggcgagttga

SEQ ID NO: 91357 - DNA, 417 bp, Glycine max
  Peptide Sequence Number=SeqID_208135
atgcgtcatcgagattcgattgagaatgttgtcttgtgggagcaaggccgttgggcatgccgtggctgtgatggttgtgttgttctcctccgctctcgtgcattcactggctcaacagatactggaaaaattgtacccgaactggctacaagaagcaatcttaagcgagtgacattggagcgtggaaggagattgcctgtaatagggcaatgttgttgttccaggtcacctacctttttacatgagcgtgtctatgatgagttcttggagaaatcaaagaaacaggctttgagacatgttgttggtgatccgttcaagaaaggtgttgaacaaggccatcttgcctgttggatgcgaagcgcctccaatctctttggtttcaatggtctagcatcattgaaatatgacatgatataa

SEQ ID NO: 91358 - DNA, 147 bp, Glycine max
  Peptide Sequence Number=SeqID_208136
atggagctcggacagaactcctgcaagggggtgggaagtgtgagcaaaggagagggagaaagaggtagggatggatggcagctgttatatgctatcatctataaccaattgacacaggaatgggttatggactctcatactatgtaa

SEQ ID NO: 91359 - DNA, 222 bp, Glycine max
  Peptide Sequence Number=SeqID_208137
atgttgtcggagcattacagaggtcaaacgacatcacatgatacttgtaatgtccaccatgagtgtgaaaagttgtttgggattatcttgaggttgaaggcaaatttgatgaaagccaaaggtaaggagaagcacgaaaaggctagtgatgggctgaatccacccattgcagaggagcttggtgtgaatcatgcaggttttgatgatgccaaaaagaattga

SEQ ID NO: 91360 - DNA, 570 bp, Glycine max
  Peptide Sequence Number=SeqID_208138
atggcgggagatgcatcaaagtttattcatatttctcccaaaaatagtgaacatgtgacctatgaagacaacaacaaaggttttgatgatgccaaaagaatttacttgataatggttgtcatcatcaaaaaaggggaaagtgtgaatcatgcagagattggttctctcttggagaatcttgaacacaagggtgagggatcccaaggtaccaatagggttgtatatttatcggagctaagccaggaaaaaagggaatggcatggtcgaaagtacggggcagtggtgattgtgtgggttcctcgaatagggaggagtatagagaaaggagttgctacatctctaggtgaagaggaggcaatgcaggagaagaaggttgggcgaattcaggataaagaacacaaaggaaaaaaaattgggttgcatggtcgccttaacaattttgcacagttgatggaagctaataggagcaagagagattccagtaacgcaaggttggttctagtgtcgacaacaaaggtggcaaggacttcagaagtgatgagtccaactgaggtcgaggaggaacaatga

SEQ ID NO: 91361 - DNA, 255 bp, Glycine max
  Peptide Sequence Number=SeqID_208139
atggtgtcagatgcatgcaaaagggcacaaattttgaggagcgaagaacatggcgcgtggcacgcacgctcaggtgtcacagtgcggtcgaatcgccacatattggggagtaataagggtgcggtttggagaaaaaccgaagaccggtttccgggtttggggttgggactgtgggcgcagctgaagaaactagaagaaccgaagaagagtgaccaatgcgataaagccaatggtttttcacttttttgggtttaa

SEQ ID NO: 91362 - DNA, 315 bp, Glycine max
  Peptide Sequence Number=SeqID_208140
atgtctcacttaaactctatctttcacactgctcttgttgtctccaacatcaagaatcatgtcccaatcattcttgagatggaaaatgtccaatacgtgacatgggctgaacttttcaaacccagctacctcgtcattcaacttgtttcgggtctcacaagtgcatatcgaggtgtagggacattaattcagcagagtgatcatcaaccttcattttatcaggctcggtcgatgctcacacttgaggaagcaggattgacaatgttggctacctcacaatccatttatgactcaaatttctctcattcatactaa

SEQ ID NO: 91363 - DNA, 189 bp, Glycine max
  Peptide Sequence Number=SeqID_208141
atgggtaacagacaaaatgaatccaccaaccatcgaaaagtaaggaagaaagacaatgaaaaatggaaaccatggagaggaaatccaaacgggagagaattcagaggtcacaatggaaatgaaaatcagaaaaatgcaaaggcatcaacactgcagagccaagcccaacttgaaaagacaaaacaataa

SEQ ID NO: 91364 - DNA, 810 bp, Glycine max
  Peptide Sequence Number=SeqID_208142
atgatgtcttcatcgtcgaaggcgaccttaacgaaaccaagctcttggcaaagctttgacatacatgatgcaccttgcaatgcaggccgtgttgatgatgcaagaaagaaggagtttatgatgttgtcagtatcatctatttgggttttatggaggtcccgagggtcagaattgaacaccgagctggtgtttattctgttaaatctccctataaatggcttatgcaaaatttcactacgtaatttgatatgcatgtccctggtaactcgcaccttttatggagcatcaaagttctcattcaggccaaattttttgcttggtgtgcttgttggaactatcttcccacccgcatcaaactccactccaaaggtgaagcctgggatcacctcctggctatacggtggcttcaagggattattgtttcccatggattgcaagattgttgttgacaagctcagggaaaacgtgctaaaattaaaggaatggggtccaaaagatgcaaatgcaagaggatcaaccagactaactaataatcttgttgacattcctaacaaagggagacgattatcaatggatgctagaattgaaaatttccatgttggaagctcaacagtagccactaataagattaggatgagggagaggcaaattttgggtaaaagccataaagaaattgaagagatatggttagaggtacttgagaggatacaagttactagtctgaaagagtttatgtttaaagaagacaagttgatctctgttagttttagggaaggtgagtgtcaaatctgcataatgcttattcaataa

SEQ ID NO: 91365 - DNA, 315 bp, Glycine max
  Peptide Sequence Number=SeqID_208143
atgggaaacaataatcccttgaagccaccgtatagccaggagggatacgtgggagccgacgaagccaactgcgccgatgacgagaacggacatgttgccttgacggtggatatgggcggaggtgtggacctgcttctcccactggatcccgccctaggaggcggagaggtagaggctgccgaaatcaatgaaccattagaagttgagatcaaagccgaggaacttgaaggagaggactttggcggtgacagtgaagcaaaagagggaggcgagggtttggaggaagtgagggtgacagtgagagtgacagagagg

SEQ ID NO: 91366 - DNA, 126 bp, Glycine max
  Peptide Sequence Number=SeqID_208144
ggagatctcaacattaatcactcagacaaactggaggtggtcaagaatgaatttaggtacactatggagcaagatccttttgtaattgacataggcttgtccctagcattttctactgccaactag

SEQ ID NO: 91367 - DNA, 177 bp, Glycine max
  Peptide Sequence Number=SeqID_208145
atggcgtccgagagtgcttctcgattgacttccatggctgattcgtacattgggagcttgataagcttgacctctaagagtgagatcaaatacaaagggagcggtgagtcactgatggcgaaggcagtgatgatgggtggggtcctgtttggaaaaagcactgttgttggtgcttag

SEQ ID NO: 91368 - DNA, 282 bp, Glycine max
  Peptide Sequence Number=SeqID_208146
atgatgatttatgctataaaaaatgtgaggatccctaagtattttgacttggaatggttctctcaacaagggtttaactttcctaatctactgaaagcacaaagattgtcaaagctgaaagtagttggtctggacatgggtggagtccacaagttcgatgaaacgcctgatgggtacagtaagatgcagacatataggggaatgcttcttgaccctactaggaacttgaggaatcacttaagagttggtggaaaaattacagaggatagaatgctagtttaa

SEQ ID NO: 91369 - DNA, 462 bp, Glycine max
  Peptide Sequence Number=SeqID_208147
atggtacttataagacatattctaaagaaaatcccttatgaactttacaaaggaagaaaaccaaatatatctcacttaagggtctttggttgtaaatgttttgttttaaataatgaaaattatttggaagataaagatgcaggttttctagataaggatactactcttgaagatgaaaccaaagttgaagagattgaacaaagcaaagaaatcactgtcatacctcctaaagacctcccaagagaatggataactcagaaagacctctcattggacaacattattggtgaaatatcaaaaggagtttctactcgctttagactcaggattttatgcaataacatgacttttgtttctcaatttgaaccaagaaacatagatgaagctttgtatgatgagcattggttactagctatgcatgaagagttaatcagtttaaaaggaatgaagtgtgagacttag

SEQ ID NO: 91370 - DNA, 597 bp, Glycine max
  Peptide Sequence Number=SeqID_208148
atgtttgaccccgatttcaagcatgagattttgatgtggtcttttgtaaccttgtttaagtataacaacatctttactgaaaaattatgcacttctataagaaaaaattgtaaaaaggcctataaggaacaaactaaatccgaacagtcttctcatggtctaggaaactttgcttctgcagctaaaacaagtgtctgtgctgaaacttcatcatacttggctaggactaatgcatttaagaggcatttagcagagaaagattccattgatatacaaaatgagtttgagaggtatttggctgaaaaatgtgtagatgttgatgatagttttgatgttcttgtttggtggaaacaaaatgcctcaaggtttcctacactttcaagaatggttaaagatattttggccactcctatttcaatagttgcttctgagagtgattttagcattgggggtagggttatagattgttttcgaagctctctaaatcctcaaatggaagaggcactaatttttgcacaaaattggttgaggccaattttagcccaattgaaaggactcaaaattattgaagacattgaaatttcagaggctcaatag

SEQ ID NO: 91371 - DNA, 612 bp, Glycine max
  Peptide Sequence Number=SeqID_208149
atgatgacttgttctatttttgaagcttacttcctttccaagggtgaggttgaggtgaaggttaagaagactggaacaaaagagctagagagggtgaaggatgaggggctggctgaggttgtaaggattcaagaatctcataagcagattctagtggcttgggaggcgagaatcaagaacacttcaagattcaagaggaaagttgaattcaagaatcaagattcaagagatcaaggttcaagactcaagattcaagaatcaagaaaaggctattcaagaatcaagaaaaagcttaatcaagataagtataaaaagtacatctacttgggtttgactgagaacaagagagggtacatctcttgtggatcagttctagtggagggtacatccactaggttcaaagagaacaagggagggtttggggaaaggaggtttgggattagacatatatttttcttgggtttcttagataggactaaaggtttagggtcagaaggtggtgaaggtgggtattttcttttgtttgttgagatgatgctccagattcaagatcaaggggttgatcttgagctaccatcatctgacccgccacaaactatggttccttcttag

SEQ ID NO: 91372 - DNA, 198 bp, Glycine max
  Peptide Sequence Number=SeqID_208150
atggctcgtggtggccaccggtggtcgtgggtggtggaggaggaggtgttagggcttgggtgggcgtttggagagaaaaaaatctcgctatgcaagaatccacttttggtgctaagcgcgataatttgcgttgagcgcaattccaattgcgcactaagcgtgacaattagcgctcagcgcaattccctctcaagttag

SEQ ID NO: 91373 - DNA, 312 bp, Glycine max
  Peptide Sequence Number=SeqID_208151
atggttatgcccatacttgggtcaatagactacgtcagtggtagggacaaattctgcatgtataaggtaatcgtgggtgagaagataaacttaccaaaagttatcttctattattggttgcaagcgttcaaggataggttcaaccccaaggtaaagaagaaccatgtcccttatggtatccttttcaatcaaatcatgagggatgttggtgttgatgtgtttggtatggcaccatctggaggggcaacacaacataaggagataacctttgtgaagatggagattactgataatttccaagaatatgcttag

SEQ ID NO: 91374 - DNA, 390 bp, Glycine max
  Peptide Sequence Number=SeqID_208152
atgggagaatccgtcggccagatcaagaacatgaaaatcaatagggaaaataagttcaccaaccatcaccagtacatcctctatgaacctgcagggaattactctaggtggaaatggaagaggaataggaggctgtcgtacattagaattgctagaagaaggctcttgtcttttggtgaaactgcatattctgtattgtcatttgcctcactaactcctctaaggaaggttgagaaggggcctcagttgattgttgtctctgttgttgttattgtcgttgctgctgtggctgttgctgttgttgcattggaggaggaacgtatggcctgcttggaccagaagcattttggaaggaaggagcaggttgctgttgttgttgttgagggctag

SEQ ID NO: 91375 - DNA, 255 bp, Glycine max
  Peptide Sequence Number=SeqID_208153
atggtggtatttttggtggcgatagcaaatgatactagtggtggtgttggtgttgatagttataatgcagtattgctaataatggtagtgattgatataatagcggtgatgttggttgttggtgtcaataacaatggtgacagtgttgataataatagtgattgtgtcaatgattatgatgatgatcataatgacgacatagatggtggtcctggtgttagtagaggcaatgaaaagtgtcattatcaaatgtag

SEQ ID NO: 91376 - DNA, 225 bp, Glycine max
  Peptide Sequence Number=SeqID_208154
atgccaccatcggcggtgatcacggaggaggaggggcagagcaaagatgtcttcactgatattgaactcgcggaagttgaattgccagatttaggggctctctgtgccccaggtaaggaggttcctgtagttatactcgtccacgatttcacatatcaacgcgaactcctccttgaggttatcattccaaacttccttgatttgaaccgaatcgccttttggtaa

SEQ ID NO: 91377 - DNA, 219 bp, Glycine max
  Peptide Sequence Number=SeqID_208155
atgacccctgctgaagccaggaatttaattgagaagatggcttccaactccaaacaatttagcgccagaaatgatgctatagtcattagaggagtgcatgaggtagccacaaactcatctacatcatctgaaactaagaagcttgaagcaattgaacagcctgaagcatatgctgcaaacatctacaatagacctcctcaagctcagcagcaaaattag

SEQ ID NO: 91378 - DNA, 528 bp, Glycine max
  Peptide Sequence Number=SeqID_208156
atggaaactttcttggttgatggatcatgtgtatctgcagcaatgaatgacctacgcccatgtgccccaataagtctaaaacatgtccttgcccaagaattgattaagggattatgggctgtatctgattcattgttgctgtacaatacaactcgagttctaagatctaacgagtcaggacttttccgctcactctgccgggcatttattgaggttgcttatcctcattgtgcaacttgttttgggcgttgctatccgggtggagcaactcttgttatggatgcaaagaatgtatatgatggaatcagccgcctattagagacctcctcttcaagagaactcccgaaaccagtgaacaatgaagaatccaagagcgtagctgagaatggcgaactgccaaaaatggaaaatggagaaacacctgatgccaaagaatctgaagccgttattggcaaagacgtgaacgaagaaggccctactttgcagatagatcaagaagacactaatcttgagaagtcggttgaataa

SEQ ID NO: 91379 - DNA, 639 bp, Glycine max
  Peptide Sequence Number=SeqID_208157
ttcaatggttgttacaagcaagctactgctttgaagaaaagtggttacacggagaatgatgtgatggaacaatgcaaagaagttccttcaaaaagaacaaagttgaatgaaaattggaattactcattgtcatctaatatggaaacaccgattgatgtttccgaaagtgacattcctacaccactggctcgcccaatgggacaaaaggcaaccaaaaggaaggtcaaagttataggagcatcttcttctacactgcttgtgaacttgtttagcattgaaaaagaaatgaaggaaagaaatgttgtccaaaaacaaataacaaaggtagtggagttagataatgtcgtgaagatgtacgatattcttacgaaagaaaagtctaacatgattgaagatcaacacaagcatcataaaatggctcgaaactctggcttcgatagagtttggcaacaaattgttgatgaagcacttgaagacaacattgttgaagaaatcatgagatatttatgccagttgcaacaacaagcaaatagtagcagtcggcccaaacggacaagaagaaacataaaccagaaccgtgaagacggacatagtctcttaatgaatgactatttctctgaaaattgcatatatgcatag

SEQ ID NO: 91380 - DNA, 1122 bp, Glycine max
  Peptide Sequence Number=SeqID_208158
atgtacccatctttgggagagagacatgaaatattggatggatgcgacaccgtgggggtgggggtgggtgtaattgtagctgataagaaacattgtcaatccagtccaaaaaatgtcttcctggtcagagacaatggtggcgtgaatacctttgtgggaattagtaatatttgcaagtggtctgcaggagataagataaatgagatcccgaagctgacatctggatgcactgagttcatagaatctgctgagcagattttggagaagaggaagatgaaccaaacaatgctaactaatcacagtactttgcttgacttgctagaaattcctcaactcatggacacatgtgtacggaacgggaattatgatgaagccctagatttggaagcatttgttggcaaactttcaaccatgcatccaaagttaccagttattcaagcgttggctgcagaagttaggctgactacccaatcacttctttctcagcttctacagaaacttcgctcaaatattcagttaccagaatgccttcgcattattggatatttacggcgaataggagtatttagtgagtatggaatgcgtttgctgttcttaagatgccgagaggcatggcttactggtatactcgaggatttggaccaggcaaatccatatgagtacttaaaagggatgatcaactgtcacagaatgcatctttttgatgttgttaatcaatatcgagcaatatttgcggatgacacatcaggaagtgaggaaaattatgacggtgggcttctttttagttgggcaatgcaccaaattacctcacacctacaaactctgaaagttatgcttccaaagataactgaaggtggatcactgtcaaatattttggatcagtgcatgtactgtgctatgggacttggctgggttggactggattttcgaggcttgctcccatcactttttgaagaagctgttctcaacttattctccaaaaatatgagtactgcagtagagaattttcagttggtcttggattcacatcgatgggttcccctgcccggagttggcttttctgcacatactgttggtgatgaaaatcatgaagatgtcactccaccctctaatttgatggag

SEQ ID NO: 91381 - DNA, 615 bp, Glycine max
  Peptide Sequence Number=SeqID_208159
atgccatattatatacagagactttataggctatgcaatgcatccttttcacctaatggacctgcgtctgaagaggccatcgagaaagttcgtgagaagttagaaagaatcaaaccatcagatgtaggtcttgaacaagaggcccaagtggttcggaattggtccggttcaatgcttgaacataatgggagccatcaatctttgccacctatcaaatatttgcatttgcatgaatgcgactccttctctataggaattttttgcatgcccccctcgtctatcatccccctccataatcatcctggaatgacagtattgagcaagctgttatatggctcgatgtatgttaaatcctatgattggattgatgcacctggctccaatgatccatctgaaggaacttctgaccttttttgtgtgagaactagtatacaatgtcaaaatgtaaatgtcatcagaaagtgtttatttagctcaagaactactgctagggttgtcttgttggttaaggataaccaagaaatatcaatagctcaactcggtagatacaaggagtttaatattgttctctgtgctctgatcaagagatgcatttttgacagaatgcttacttga

SEQ ID NO: 91382 - DNA, 408 bp, Glycine max
  Peptide Sequence Number=SeqID_208160
catatcgtacattgtgttaaggctcagttggtgaagagcgacagtagggagctccaactcctcattcgcgatgaagaggtgcatacggggttagcagtggagataatcttcgaaaatggagtttgggcaaaagaggggcaaaatgaggatttgattgattggactgtggtgggtaatgttgagtttgatggtggctacgacgacgatcgagcaacttatccttttggagtttgcgggccaagaagtaaggaacccgttcctcgacatccactagaactagaagagggcgggtccttccatgtaaaacaacgcaatggtgagcctctccgcgttgggaatatcttgataggtgggggagaaggtggcggttttggggaaggtagggctgaggttagagaggcaaggtga

SEQ ID NO: 91383 - DNA, 402 bp, Glycine max
  Peptide Sequence Number=SeqID_208161
atggattctgacaatgttggtgatctggatgaggtctacaacaagtccattattcagtcacttgtgacaatatcaacaattcaagcaaagtacatgactgtagcaaaggctagcaaggaacctgtgtggttagcaagggtagtgaaagagctaggcattgggcaaggtggagttcagttgtattgtgatagtcaaagtgctattgatttgacaaagaatcaggtatgcaatgctaaaacaaaacatactgatgtgaggttccacaagatcatggagttcatgacatctggtcagattttgctcaggagggttctcactttagagaatgcagctaatatgttaaccaaggcagtcacaactgacaagttcaagcattatttggacttgttgaatgttgcttag

SEQ ID NO: 91384 - DNA, 267 bp, Glycine max
  Peptide Sequence Number=SeqID_208162
atggagcaggtagattacactgggaaacatgcagggccaggtagattgccctgggaaattcacaggccaagcttgataacactggaaactctgtggggccaggtgcttgtgtatggtggtggtggtagtggcagtggtgccaatatttttggtgttggtagcaatgccggtgatggcagcgacagtattagtggtggtggcggtggtgacaacgggaatggcattgtcaaatgtaggaagagtgcatttgttttaaaactaaactaa

SEQ ID NO: 91385 - DNA, 450 bp, Glycine max
  Peptide Sequence Number=SeqID_208163
atgccttctgtcacaatctttaaaattccaagacttgtacgaaaaatgctgagaagtgaccagtttcccagttgtcacaaggcaaaggatgagttgatggtattatctggtaatgcatttcttcccgaacagtgcaaggccatcagcaaaccaactgctccactgcaagagcctaaggaggccaggttggaggttccaacaccccacagtccaaacgcttctaagattgaagatcatatttaccgtgagggaaatacctgtgcagatttgttagcctctcaaggggaaattggaggtcttatgacaaggtccaagactaaaaggatggaacaaacattgcaaggcctaattctaaagatcaaagaaaaagaaaaccaatgggaattaagggctgcacctaattgggtcattctcctacaaattgatgaagatgctttaaagtcaacttga

SEQ ID NO: 91386 - DNA, 231 bp, Glycine max
  Peptide Sequence Number=SeqID_208164
atggcacatcagtcatccgcaccctttttgcaatcaagagacaatcaagtccgatggcacccggagataaacatggtcatctgcaccgtctttgccatccagagacaatcaaagacaaacatggctatccgcaccatctttgccatccagagacaatcaagttcgatgacacgcggagacaaaacatggtcattgtttgcttccgacaagtgcaccagattgcaaaagtag

SEQ ID NO: 91387 - DNA, 630 bp, Glycine max
  Peptide Sequence Number=SeqID_208165
atggcgaggattcctgacaagattaggtctattgatggatcaaaagaaacgcttaagcttgctgttaggatcaccgatctttggttcgttgggactcctaacaagtctgagcaagcggaaatggtttttgttgattctgagggtgatcaaattcatgctatttgtaaatcggaccacctcaagtcttggaaagttgatttaaaagagaattgcacttatgttatgcataatttcaaagttgttaagaatgatggtcaatttagagtgtgcgaacatgagtacaagttattttttattggagtgacggttgttagagaagctaatttgcatgaactgccttttaaggaatttagatttgttgaatttgcaaatgttgttgctggcaattttgtgtctggcctgttgattgatattattggggtcgttgatatggtggtctttcgtggtgaaattttgtcttgcacactttgggagaattactgtactcagttcctatcctatttgaatgaacgtggggatgatgggccgatggttattatattgacacatgccagaataaaagatgcacagggtaagaagttatccagcttcagtgagcaattccttcaaggcgtcaaaactattgattaa

SEQ ID NO: 91388 - DNA, 312 bp, Glycine max
  Peptide Sequence Number=SeqID_208166
atggtttgcactgctgaaaacaggaaaagccagggcctttttgttaccaatagcaatttcaaagtgcaacaacccttatatgaatccagcaaggatctgaccttgaagcacaatgagtacttaattggcaccgggatgagtgtggtgtgggataacaccactaggaccaaggtccaaccttactgcatatacttcaaggccattgagacctggataatgcaactttcctcacttggtcttggtgaaggggtgggaaacggatttcaatgttccttttcagcaatggtcctcagctatgtctatagcttttaa

SEQ ID NO: 91389 - DNA, 279 bp, Glycine max
  Peptide Sequence Number=SeqID_208167
atggctactctggcaaattttcgtcctccgtattcaataccaaatcctcctccagatgcaataccagaacttgcatgttacaattcaacaatggatctttccaacaatatctggaggggtggtaatgtcattggagaacgtgttcctcttttgtctattcaaattgcctacagtgtcctgctttccagtatttttcaccgcatcttcaagtcattccacctgcctcttatggtttcccagattcttgagtcttctagtgctacatttttgtttaattaa

SEQ ID NO: 91390 - DNA, 339 bp, Glycine max
  Peptide Sequence Number=SeqID_208168
atgtctaccacaaattccatcactaaaccacacaaaggctatagagttaacatatatgtaatactgagtagcctagcagagtatcaaaaccaaagggccaaggagggtagattctgtgagaaactcaagatcaagaataaaccaaagtttgtaggagtgagacaaagggcttcagggaaatgggcagcagatatcaaacacacatcaaagaagattaggctttggcttggaacttatcaaactgctgaggaagctgcgcgagcttatgatgaagatgcatgcccccttcaaggttcaaacacagctactaaaggctttgttctctttttagttatttga

SEQ ID NO: 91391 - DNA, 717 bp, Glycine max
  Peptide Sequence Number=SeqID_208169
atggatggcaaagtagattggtctgaacttcccatagagctatggcccaagattggaaaatatctccagaaccacgtggatggcaaagtagattgtgtttgtgggtcatgtcgatcttccatccctccctctcttccaaattctccttctttccctatgcaaattccccacccatcgaaccattccatagaaaccttgctcaaccaagccacagtctatgttattgagccaactgatgcaaatggagcctctaatttagagcctttggcaatttcaaccaaatggaggctgattaaggttgaggaatcaaagaatcacaatcacaatcacaatcaccccttgactttactgagtccaatatctgatcgcaaaatcttgtaccctcatggctctaattcccctatgttgtggaacttgttggactttcgagtcactgagttgtgcaaatcatatacccccaatatctcatctgccactgtgagcaaagttgtgttctttcccaattccccttggattggtgccgaagattctgtggcttgttgcatctttttggagggcaagttggggttcatgaaacatggggatgagaaatggaaccttgtggataacgagaacttcttctacgatgatgttattgtgttcaagggtcagttttatgtgactgataagtggggtaccatttcatggattgatacctcttctttgaaattggtgtag

SEQ ID NO: 91392 - DNA, 384 bp, Glycine max
  Peptide Sequence Number=SeqID_208170
atgagagatgaaataggactgtgtcataccctaatttcgtccggggacctttgctcgatgacgtgcgaccattctttggtcctcgtgaggtgcttggcacccatcattaggcaatttgtgaaattccaggacatgccgaaaaaccaaaaaaatattgatgcacaatcccacccaggcccacttgggccctccggaatattcctccagaaggcggttgcttctggaggaagcaaccctgctcgcctgggcgagctgggcggcaacctcctcccctattttgctataaataggggaggaaggcaagaaggaaggggttcagcccctttggcacttctctctctttcgaatttgcttagaaaaattgtttccgtgaagaaaatctaa

SEQ ID NO: 91393 - DNA, 888 bp, Glycine max
  Peptide Sequence Number=SeqID_208171
atgccctatgggatgcttcttgatagacaaacctatttgcaaacacattatgaagaaaaggatggtggcgatttcaatagagtgctaaacggaggaccatggtcctttaaaaataatatgatagcactaagtagcatcaaggagagtgagataccaaaggagatgcccttgaactttattctgatatgggttcagatccataacttgttagcgggattcatgtcagccatggttgaccaacatattggcaacttcattggagcatttatgaagtacgacaataaaaacaattccaattatgaagggctatggaatttattccttttatgtggtcacattggccatattgagaacttttgtggcaagctatttatgaaggaaaaggtagaggatgctggaagcttgcttgagaagcttctaaggaggagaagaggtgagaagaggtgccatccactagagaataagccatggaaggagaagcttcaccaccaagagagtgccttggataagaagcttagagaggaaacttcaaagaatgaagagaatgagagagagcatcctagcatattccctttagatgccacaagcatgaaaggtgtaactctagcacatggaagcttccttgagaagcaaggaaggttagctacccacacccctccaatagctaagttcactcccatgccaaaatgggcttggcttcttagcccaatcctcttggagcctcttgctcctggctttggtgactggtcccttcctagggaggattgcatcagaggaggcaagggagtgaggatcgaagctaaccggaagagtggggagattgaggggagtaagtggctgcaggaaaaaagggtcaatagaggtaggactgagtcggaaaacaggtag

SEQ ID NO: 91394 - DNA, 177 bp, Glycine max
  Peptide Sequence Number=SeqID_208172
atggctgctgtagatattactggctcaaacagcaatgacctcaacaaaccttttaggtttaaagggtatcatttcaagcgttggcaacaaaagatgatgttttctttaactatgaggaaagctgcctatgttttgaacactgatattcgagtggtacctgaagatgttgagaaggaa

SEQ ID NO: 91395 - DNA, 1548 bp, Glycine max
  Peptide Sequence Number=SeqID_208173
atggagttagatggaggatggattagagcaacaacctcttttggtgaagtcgtattgaaaatagctagtggtacgaggtctatgctaatcttgggctcttgccccaatgagaatgacaacaaaaaggctacattaaatggtcagaggataagtgctaaggggactgataaggaggatttgttggttgaaactcaacttagctctaagatttacaacatttggggagggggaagtttgatagggctagagaggcctacattaaaagtcaacataagggaagtgggcgaagaagctaagggggtctttaaggagaagttaggtggacctacgaacgttagatgcaaggatcaggaggttgataggctagaaggtgtcttagtgaggaccaataagtcaaacgatgaagaggttgataatactactattaagtttgagccctacaacgagaataaagaaacatatgttgcacatgtacatgacaaagaggaaaagaaaagcactcgtgtaaatatggatatcaatgtgggagtccttgtgtccaacgaatgggtagggaattgggatgcttgctctcaacttgtgtttgatagaagtgtgaaaaatcatttccctcttgtttcaaggaacaaggatcttgattggggccttaaaccctttaggatgctcaattattggttcttaaatccgaaatccaagggttttgtggaagactcacggaagggacttccaagtggaagagaaagtcatttttgtgataaaggaaagctcaacatggaggtggtaaatgaattgaatgaggtcgataagaaggatgaggaaagtggcctcagtgaggaagagatagtgctaagaaggaagcttttggaggaattttggaaagtgtcaactaagtatgaatttcttatgcaccaaaagtctaaaaaaaagtggatcaaggaaggggatgataacaccaaattctttcactccattatcaatgggagaaaggatgtttcttgtataaagggaaggtttagtcagacaacttggagaaggccaacacttgataggatcccattcaaattgatcagcggagaagacaataatatgctttgtgcaaagtttgaaaagatggtgattaatgaggtcgtaagggattatgatatgggaaagtgtctcaggccaaataaatttaactttaatttcctcaaggagttttggcacttgctgaaggaggatttccttagagttctatcagagttttatgagagggaagtgctaccgaaaggtacaaattcacctttcatctccctcatcccaaaaaaggaggatctgcttcacctaggtgagtttcgaccaatatcactcattggttgtattttcaatgttatttcaaaactcttagctaggagaatcagaagggtgttggacaatgatgagaggcaatgtgcctttgtaggggggaatatgctagacggcatccttgtggctagtgaggtggttgatgaagcaagaaaagaaaagtggcttttgactggatcaactgggactttttacatttcatgttga

SEQ ID NO: 91396 - DNA, 426 bp, Glycine max
  Peptide Sequence Number=SeqID_208174
atgggtgtaccccaaaaatggttcagaaatatagttcggggcagattcctcagatcatccaacaaagacatcgttctcgttctccctcgcacaagtatttgcaccaatgaatgcgaagaagccatgcttaggaatgaagagttcagtttcccaacaccaatttcttcaatcaccaaggaagatgcttcggccattaagatccaagcttacttcaggggacatcttgccagacgagcatataaggctttgaagagcctagtgaagctgcaagcattagttcgtggggtgtgggtgaggaaacaatcacgtatagcaatgcagtgtatgcacgcacttgtacgattacaagtcagggttcgtgcgaggcagctcctaggtagctttgataaggaacgacctactaatttacaaagtcaaaatgtatag

SEQ ID NO: 91397 - DNA, 741 bp, Glycine max
  Peptide Sequence Number=SeqID_208175
atgcttttcttgagctggggtcgcccctctccccaagaccaaaagacttgcatcaacaagtcaggtactttcaactatgatgacaaatataaaggagctactgctaaatcagtggcttcccttaaagcagacgagggactctccaaagatggatttttactaaacgaggcgcgagttctggttggttctggtattgagacctttgaaaagggcaagagtgctcttagaagttggaggcattttggattgaattgggcatttgttgatccgaagacaccagtccaacaaggagtgaagttctgtgtttgtgtcaaggagttcttcccgtggctcatgatgcctcttcaggttgtgtatgtaaatgaaactggcactgccaaataccgtactgcctcctttggttttggaagtggaactcttcatggtcacttgctggcaggggaagagcgcttttcaattgagattgatgagaacaatcaagtttggtatgaagttctttctttctcaaagcctgctagcattttatcattagttgggaatttccctgttgcgacttatgcaaaccacaatggttggaggtgggacatcttaaggcttctcttaccccctactctatgtgatcgtattgcgcctattcctcctcctaaggacactgttgatgatgttcctctttggaaaggcttgaatgatggtagcttctctttaaagggaagcctacatttatctcacaaactcgtctga

SEQ ID NO: 91398 - DNA, 729 bp, Glycine max
  Peptide Sequence Number=SeqID_208176
atgataacgagtgacaacaatagctggcaaagccaaagctacaaccaaggccagggccaactactgcttgtcagccatggtgcccaagtgctagcgcccgctactcatccccaagttaagacttatgtggagaagtctaggttatcagctcttgctacgatgtggtatcctgtcacaaacaaggacttgatgaatttcatttttgagaggtggcaccaagagacatcttccttccacctacccgtcggagagatgtccatcactttggatgatatgtcttgtctgctacatttacctctgataggtagatccattgatcatgtctccttacattttgacaaaaaagtggtgaggatcttgcttatgacttatctaggcattttgacagagacagaggctacaatagcgacaaatgcaggtgccaaggtttcccatccctatgtcattccatcggaggagggacatccaccacatggtcctgtatatttaccacccatcagagtacaaccacaacctaggaaaccactagtagactatgtaccaggtggagactactcttgccagcttattggacctcaaagctatgctaaagggcgcgagtcatcatcaggtcatacaacaagctttgcaactattgtaggaggggtaacagttgggtgtagctcagacacacaaagcttgttggacattgttaactcattggcaagtgcaccaaattgtctcaagtag

SEQ ID NO: 91399 - DNA, 363 bp, Glycine max
  Peptide Sequence Number=SeqID_208177
atggaaagagaggcagaaggatacatgtggagtaaacctttcatcaagattcttgaatatgcattttctctcaggcccgagctcttcctggatgaagctccatttaatttctacccattcaaactaaccaagttctccaactttgaaatgcaattcactctattgtcagcaccattccctatggatcctcaatcttttaacccttcagacatggttcttaaggagcattttgaaccgagggctatagctggaacttcactgggacattgccaatctttggaccagcaatcatctgatcgttatctcaatggttcaattttttcaatgaagccatgcacgattatcattaggatcatattttaa

SEQ ID NO: 91400 - DNA, 429 bp, Glycine max
  Peptide Sequence Number=SeqID_208178
atgagcagaagcggcgatgaaactgcggtgactgaagaagcacaacccaaagagtccctaccgaacctcttttctttgtttcctaaaatcaattttcaactccctttcctcccacccaaacctcaagaacccaaccctgaggctcaggctcaacaagagcttccgaagcctagccgtgtacagtttccgaaaactcaagtggcgatggttgcttctttgcctctgctagctgaacctaatgctgaccactctcccgctgctaagacaaccaatcctcttatactgtggcaggatgaagtgcacaatggcaattgggatgaggtggagaaatacctctctggtttcacaaaggtggatgataataggtattctatgaagatattttttgagataaggcagcagaggcatgactggtccaaggctatataa

SEQ ID NO: 91401 - DNA, 360 bp, Glycine max
  Peptide Sequence Number=SeqID_208179
atggagaaagatataagtcttcctatggagaaaagtctaggaaaccctttaagattttacatgatgtggatggaagaagaagagggatggataatggaggagaagaggagaatggatagagatggagggtttcccctatttgagaagcttaggctttggatgtattcaatagagaactctgagtctcgtgagtatgacggtgatcacgtgcttagcatgatattcacgctaagcatgcctttggggttcttcatgggccttcttcacgctaagctggagctagccgctaagcgagaaaacacattgggtctgtcttgtgtgctaagcgaactgtcacaatcttcaactttttcccgctaa

SEQ ID NO: 91402 - DNA, 897 bp, Glycine max
  Peptide Sequence Number=SeqID_208180
atgtggtacggtggtggctcgcgcgctgtggccttctgcactcaaacatactgcgttgagctacatcgagctgctgcactcaaacatattgtggggagaagactacttaggcgcgtcgttcctatgagtccaattgtgttctccagccaccgtcagcctgtgaaaggtatccggtgtcgtttctatcaaatgttggtcgagtttgtgccattttggggtgattctcccgtggagattttcgaggccgtgcttcgagccaatttgaggtttccaactcgtgttttctgctccgtctcacctgcggccaaggatcttcttcgtaggatgttgtgtaaagagctttctagaaggcatggtttagcgttgctgaacagagtgagtgatcttatgtgcgtggaggtggcagttgcacctggaggtcgctggagcaggttcaagacttactcgatgatccagaggacgttggagatttggggatttgttataacatttatcttcaagtcttggtggaataatcacaagttctcatataaaggaggaatgacagaggaaaagaaaacctcaaggcgaaatgcccttgccatgtggctgaaggagagcattatgagattaggtcctacatttatcaaagatcaacttcctccatttccctcagagactgctatagctattttcgaagaagaacttggaagtcttttagctggtgtgtttgatcattttgagtatgaaccaatagctgctacaagtcttgtaaatgttcaatcagagaagggaacccaattaaatgtccttcgatcaatgattcaaatgggtgttcttgtcccaactggagatatgactgcggttaaacgaatagcacaattcttcctcaacatgtactttattaaacccatttag

SEQ ID NO: 91403 - DNA, 1620 bp, Glycine max
  Peptide Sequence Number=SeqID_208181
atgtataagaaggtaggcaagcaggtgtgcatagtgttctcgggatgtgttgagggtttgatggaatctggggttgttatagcttttgcagataattatcggcttgtagataatagccgattgtctgatgtctcgggtagtagccttgacaataagcgtctaggaagcttagcacttggaaccctaatgcttcgtcgactaacctatcaatgttgggcagaagtcagtgcacattcatcatttgtcgttggccattttgaccatgacaatgtcgacaagccagggacagatggtgagcttgtggcagataatgttggggtggattcccggcataacatcagcgatgcgcctgcgctcagggctggtgaggtccctattgagctgcgtacattgcccaggtttgggttcgagctgcagcttgatgagctcttcgatgggctttgggcctctgttagaagtgttgtcgcacagatctatatcaaatttttcgttaatgcttgcttggtagacgttcagggctcagattggaggccttttgtccacgctcatgacttgagtaccttcagctggtgtatgatgaggcttggcaggctccttggtgggaggataagggtggggaacctcatctttagatgcaacgtggagacgatggctctaagctcgttaagtgtcttcttggaaatcaaagcaagatacaatgatgtcagtggagctaccctggttgatgagtaccttggatatcatgaagtttgcaatgatgatggagacaaccatggggtcatcttggttgatggggttaatacccttgaagtctctatatgtgaaattgatgttgatgttccaaatggcgtgaagatggcgtttacgagactggttgtcgtttgcacctttgttgctggtgtctctgtttgcctcgatcttttgttctttctattcttctgtctgcatcgtgattcctatgttgctcctcttggtgtcctccaggtcttgctccttcttggtgtgcctagcagtcctttgtgttatgaccgataccgcgatggtagcctgatgggtacctctaagttgaaagcttcctcaaggatcatagtgcggttggccatcaagggcatcaaaagtcatgcgataagaccaattggttgcatattgcacactgaagtgttcgacgagggcgtcgaagctatctatggatcttggtgggagtccaccgtaccagctttctcaactcctccccatggctttgctccatctccacaatgtggttttggagttgctaaagagtatttgtatctgtcatggctgctggtggaagcccatggtgggcgtcagatatacttaccaaaatctggagttggcacacgtcagggtggacgggttgttataacctttgcagataattatcggcttatagataatagtcgggccgaacgtctatacttctatgacagggctggcatagaacgtagacaggtgtctcgtaatgcaatgtgggctcctggacttcacacgtcggctttgagagttatttttgttaagaggacaagaggggagacatgcaaaacaaagtactccaatgttgaaggttcgacggaacctgatatttataggagtgaagtggag

SEQ ID NO: 91404 - DNA, 1146 bp, Glycine max
  Peptide Sequence Number=SeqID_208182
atggagagaagcaatccggtgaggaagccacacacttcaactgcagatctgcttacgtggcctgaaactcccatttctgattccccagctcctccttcctccgccgttcgttctcaccagccgtcggatgggatcaggaaggtggtgtttggtggtcaggtcaccgatgaagaggtcgagagcttaaataaaagaaagccttgttcggattataagatgaaggagataactggtagtggaatatttgtagccaatggagaagatgacgcctcagaagctggcagtgacaacccaaataagactggagtgcgtatgtatcagcaagcgatttctggaatcagccatatctcctttggcgaggaggagagtgtttctccaaaaaagcccactactttgcctgaggtggccaagcagcgtgagctaagtggaactttggaaagtgaagactctatattgaaaaagcaactctctgatgcgaagtgcaaggagcttagtggtcatgacatatttgctccaccaccagaaatcaaacccaggccaataactcctcgcatactggagttgaaagggagcatagacattgctgacggagatcaaggcgataccaactctgctgggaagacagcaaagaagatctatgacaagaaatttgcagaactttcagggaatgacatattcaaaggggatgcaccgccttcatctgctgagaaatcattgagcggggccaaactacgagagatgagtggcagtaacatctttgctgatgggaaggtagaagctagagactacctaggtggtgtacggaagccacccggtggcgagagcagcattgccttgtgcaacaacaaagactataaccccgatacacttcacgttcccctcattaagcttcctcgtgctctttgtcatgaacggctaggacgcaacagggttcgtaagccgttagatcaaggcttaatgttgtcaatgtcgcaggcggtggagatagccattgttgttggatggagccgtggaggtgccatagaccaaattgggatcatcatgtacaaaggagaatttcagcaagggttgcaaaaatcagaagccaagattgaaggggtttcaggaattttgggtggtgtaatattggacacggattcggaatag

SEQ ID NO: 91405 - DNA, 1937 bp, Glycine max
  Peptide Sequence Number=SeqID_208183
atgaactgtgacacgattataagatcaagcaagaaggctataaccattgctctcgtttgcattctgattccaatgttggggggtgctggttttcttgctctagagcatagggtatcaggaggttcagcaaagcctactgtttccacaaaaggatatttcttttgctgtgcaattcttgctgtcacaggttttccagtcgttgctaggctcctatcagggctcaagatcctctacacaaggcttggcaaagatgccttaactgcagccatgttaattgatgcatatggctggattgtcttcacaatcttgattccttattcccatgatcgcggcggaaaaccactcctctcagcaatatgcacctttttgttcattgtgttctgcttctacgtggttcgtcccatcctgactcgcatcattaaccgcaaaatcaggttggagacatgggactcctcaggtttgctggatgttatggttggacttttcatttgttcgtccatcacagattttcttggtgcacaccatgttgttggggcctttgtgtatggactcattttgcctagtggcaaatttgctgatttgatgatggaaatcttggatgatgttgttactgctcttattgttcctatctactttgctagttttggctttagactacaccttgaggcactttgggctgttcacaattcggttttgtttcctgtcctcatggtcttgttgttaaccatcccaaaggttttaggctctatgttggctactttctactttggtatgtctgctagagatggcttgggccttggattgctcctcaacactaagggcatcatggctgtcattatgctcagcgttgcctgggacaaaaatcttttggacccctatgcattcacaattatgatgctggctatactattcatgactgtgttggtctctcccctgatcaatgtgatatacaagccaaaactccggttcatgcaaacacagcaaagaactgtacagaagctaaggaatgatgcagaacttcgagtggctgtttgtgtccacaatgctcaccaagccactggcatgatccatgtccttgaagccacaaatgccaccagaatttcgcctttacaagtctcagtccttcaccttgttgaactcactagacatggcactggccttcttgttgcccagatggacaatccaagtagtgttcaaggagaaagccattatggatcacaggaagagtttgagagcatatccaaggcgtttgaagagttttcagaggaatacaatgcagtgagatttgagacatcaagtattgtgtcaacgtatgagtcaatccatgaggacatatacactgtgacacaagaaaaacgtgcaaacctagttctccttcccttccacaaacaactaagctccgaaggcgtgttggacacaaccaacaatgcattcagtggcataaaccaaaatgtgatgcaacaaccaccttgttctgttgggatctttgtgaaccggggactcgactcattgttgaaaacaaaaatgagcatcattatgatcttcattggagggcctgacgaccgcgaagccttgtcgatcgcatggagaatggcagggcattcatgcacaatgttgcatgtggtgaggcttcttctgtcaggcactgaggttgcagaagaagaaaaggcattccattctgactctaacgggttgttatctacagtgatggacagtgtgatgcagaaagagttggatgatgagcaaatattgcacttcaggcacaagggggtgcacaataatgactccatttcttactcagaaaaggaagtgaaaatagaaactggtgaggagattcctttgatcctcaatgagatagacaagcctgggtatgacttgtacattttgggacaagggagtggcaagaactacacagctttgcagaagttgttggaatg

SEQ ID NO: 91406 - DNA, 681 bp, Glycine max
  Peptide Sequence Number=SeqID_208184
atggacaacttcgatgacaactattttgtagagattgtcttagaaagtaacatcaacgacggctttgttgctttggagcgtgtggccggagctaaggatggaggttttgatgagcgtagtgttcttcttcgggtgctggaagccaaggacggtgttgttgttgacatcgatgaggttggcgatgaaggtggggttgtaggcgaagaggatcttcttgttaggattcatggcagagacgatgatatcaaagcgggagttcagggtgttggaggacgaggtgaggttcaggtaagagagtttcagggacgtgacgatgaaggtggggtggtgggggcgataggggtccctattgtgtggtccatcaggtccctcagggagacctccaagatcgacaggaaggcggggaggaacctagccaagttgaccctcttcatgcaattctacattattgtcactgggtacttgtacttcacccacattgtggtctttgcgttgaagaccattgccacttacaaataccaatgggttagtaatctcactgaggaggttgctagtctcgcgttttatgttgtcatgttctatatgtttaggcatgtggaaaagaatgggtactttgtgcttgacgagaaggaagaagaggtcgtcgagattgcagttagggatgaagaatttgagctttaa

SEQ ID NO: 91407 - DNA, 510 bp, Glycine max
  Peptide Sequence Number=SeqID_208185
atgacagaggttgaagagcttgcaccccacggtggagctttggaaagagggctccataggggtcgtcctattaagaaagggcaaaacgcaattccagggcctatatcatgggaggccatgaaggatagatggaggaaaaaagtgtggggaggatgggtggtagtaatggttgctggctacaacctcctcgaggcaattggtggtcacctaatgagtgttgtggtcaagcattatgggggcaagtcagaccaagttgataagaaatgctactacactactacaatggttattgacccttataaatctgccagacccgacgttgtgccttgctttgatatagtgggtttggaagtggagggagagaagtcaatcccaagaccaacctttcttatcccttcattaaagtcaacgttgatgggagcttcaatttggagaatcatcgaaactcttggtgctagaatatgggctcatgtgtgcttgggagcaagactttcgatttgtggaatgtga

SEQ ID NO: 91408 - DNA, 552 bp, Glycine max
  Peptide Sequence Number=SeqID_208186
atggcagtgcttgaagcatctgatttgatggtgaatggtagattgaagttcaatggagccaacactagagcttctgtcataacttgttttaaatcatcgaaaacttgttgggcctctacgaacaagaagaatcgattcttctgcagcaatgaattgggagggccattcacacatagcactaaccttggatggattcggagctacgttggcagaagaaacaatatgattgagacattgcaggctatagacaaggatgtcatcgaaaaacaccgccacatattttcaaagaagtggtttgaggacgattttgtgaacatcttcctcggccatgcggatttagtggaacccttatctgagatcaagtttcgagaaccaggaagtattgcccaagttgtcaattgggcaagagatgaatgtggtgggtcatggaacatgggggaggtaactttatcggttcctagaaaagatgggtgtaacaggcaattagctgggcgcttcacctgttgggttgacacaggagctggtcgaacaggaacatccgctcgtagctga

SEQ ID NO: 91409 - DNA, 1437 bp, Glycine max
  Peptide Sequence Number=SeqID_208187
atgtcttgcagtgaagggagaagaaggagatgggtctttcccacgcttgtagaatcccatgggtttgaggtagatgtgaagtcattggacaaaacccatgggatgaagataagtggtttattgccatattggttccacatagcagaaggtgttgtgcgtaatgatgttgatatgcaatcattatttctgttgacaggaccgaatggtggtgggaaatcaagttttcttaggtcaatttgtgctgctgcactacttgggatatgtggactcatggttcctgcagaatcagccctaattccttattttgactccatcacgcttcatatgaagtcatatgatagtccagctgataaaaagagttcctttcagagattgttcaaaattgggactaaaggaaagaatgagatcatcgaaaataactcaaactcaatcaagtacacgaaagtattgaaaaagttgcactacctcagttttatccttgataagaaatatccatgtcacatgagagcaatcatcaatgttgaaatgtcagaacttcgatccatcattggcggaacaaccaacaggagccttgtacttgttgatgaaatatgccgaggaacagaaactgcaaaagggacttgcattgctggtagcatcattgaaacccttgatggaattgggtgtctgggtattgtatccactcacttgcatggaatatttactttgcccctaaacaaaaaaaacactgtgcacaaagcaatgggcacaacatccattgatggacaaataatgcctacatggaagttgacagatggagtttgtaaagaaagtcttgcttttgaaacggctaagagggaaggaattcctgagcatattgttagaagagctgaatatctttatcagttggtttatgctaaggaaatgctttttgcagaaaatttcccaaatgaagaaaagttttctacctgcatcaatgttaataatttgaatggaacacatcttcattcaaaaaggttcctatcaggagctaatcaaatggaagttttacgcgaggaagttgagagagctgtcactgtgatttgccaggatcatataaaggacctaaaatgcaaaaagattgcattggagcttactgagataaaatgtctcataattggtacaagggagctaccacctccatcggttgtaggttcttcaagcgtctatgtgatgttcagaccagataagaaactctatgtaggagagactgatgatctcgagggacgggtccgaagacatcgattaaaggaaggaatgcatgatgcatcattcctttattttcttgtcccaggtaaaagcttggcatgccaatttgaatctctgctcatcaaccaactttctggtcaaggcttccaactgagcaatatagctgatggtaaacataggaattttggcacttccaacctgtatacataa

SEQ ID NO: 91410 - DNA, 407 bp, Glycine max
  Peptide Sequence Number=SeqID_208188
atggtggacgttgcagcgcattccctcccagaagaagttctttttaagatgtcgaagggttttggcaatgcccataggattacgcctatcacgatgccagaagcgtttgtttccgggaaaaaaggaatggtgaagtcaggggtccaatttggagaaccacgaggcagcaccaagctcattaaggagctcgtcaatggtgggcatggggaactagtctttaatggtgatggcattgagaaagggttatggcttagcttgataagaccaaagtcgagcattatgaatgtggtgggaaatcaaacgttctggggggagctgggttggttcgctgaacaagttgcaaaaccaagaaaggaggaaggtgagttctatgggttggggaaggttgttggggatgagggaagagg

SEQ ID NO: 91411 - DNA, 501 bp, Glycine max
  Peptide Sequence Number=SeqID_208189
atggttgaggcttgttgggccgcgtccaatcgcgcgtgtccacttggtgggccacgtccaatcgcgcgcgtccaacatccaactgtgtccgatgacggtggaagcaacgacatcgtgtcacaccagagtcgggcccaaatgcgtgttcggtgcgcttccaacgcgggacacgccgctgaggtgtcgctttatggggctccaagtccaaaaaggccctcgagtcgccccaaaggaattttgaacattggtgcggctataattgacaactccatgcaaagcaagcctcttggatacaatcacaacaatctcattaagccaagccatccagccatgctagagcttcaccacacaaagagtgactctagctcaatgctcagctcggaagccatagctcccaagcaccaagccaaggctaaaaagggaaaaacaagctcccaaattacccaatcgcggtctcctttattttgcagagaccaagatttctcaatagaatttgggtag

SEQ ID NO: 91412 - DNA, 210 bp, Glycine max
  Peptide Sequence Number=SeqID_208190
atggacgttgctttcaaagacgcaaacgccaaatcccctctctgggaacaagtctcaagattcaaacttttgcatcaagaagatatagagtttcaaagatttggtatgcgtaacaatgttgatcagctttgtgtttttgagaggacgtcttattcttttatatgcagtgtggaatcccaggaagtgcttgatgctgaactctcagcttga

SEQ ID NO: 91413 - DNA, 366 bp, Glycine max
  Peptide Sequence Number=SeqID_208191
atgttggcggcggtggcggcgccacggaagaggcgatgggggacggtggcgaaaagcttgagcgccatttcggggtcgtcggaggtggcaataagcgccgccgtggcgccaccgcccacggcggaggccacaagagatagcttggcacctgcgcgccataaccaagccatattattcaatctaaataatgaaaccataattctgaatctcgaatctggaggtaaagaaggttgtggcgacgatgtaaatgcactagagaaggaattagcgactgtggcaagaaggtgcaatgaggtgaagaagaagatggagaggagaagagagtgcgcgaggggtgaaggaaaaagggtaagaggggaatattaa

SEQ ID NO: 91414 - DNA, 954 bp, Glycine max
  Peptide Sequence Number=SeqID_208192
atggtggattcaagtgataatcctccagaattagattttttaactgaggcaaagaacagtgagaggtgtgtggagaacttccacaagttgtctcctcatattgcgaattatgtatatgcaccaaacgtatattggaatttgagtacctcaaagcttctgacaatggaattcatggatggtgcttatgtaaatgatgtaaagaccattcggaaacttgggatcaacctgcatgaactttcaacattggttagtcaaacttttgctgaaatgatgttcaagcatgggtttgtacactgtgatccacatgctgctaacttattggttcgtccattgccttccagcaaagctagcatttggggcaggagaaaaccacagttgatccttttagaccacggactctataaagagcttgacttccaaacaagaactaattatgcttcactatggaaggcattggtatttgctgatgctaatgcaatcaaggaatacagtacaaagttgggagctggggaggatttatatgcactttttgctggagttctgacgatgaggccatggaatagagttgttgatccatctatggatcatttagtaatacagggaaatgagagtgatcgattagaactgcagatgtatgcttctcagtatttccatcaaatctcggagcttctaaggagattaccacgagtgattcttctaatgctgaagacaaatgactgtttacgagcagtcaataattctctgggatcatctttggagacattttttgtaattggaaaggtttcttcggaggctgtcattgaggcaaagatgttgcaaagcaaatcacttttaacttggctaaacattaaattggataagattttgctggaagtacgactttggggaatgcaggtggccttgtggcttttacaactaagaaaatctttgtcttggtataaccaagcattgtag

SEQ ID NO: 91415 - DNA, 1083 bp, Glycine max
  Peptide Sequence Number=SeqID_208193
atgcgggcttatacttctgcacttgttactgatctcctaggggacacaccctgtggttggggctctgttttgctcctctcattcatcccaaagattttaagcactgttatagcgagtcagttttatggcatgtctgttcttgatggtgtctctattggactgcttatgaacaccaagggcatcttaccaatattaatgctcaacaatgcctgggacaagcagattttgagtgtggagtccttctcaattttgaccgtagctgttgttatgatgaccatgacggtgcctctaatcatcaatgccatatacaagctaagaaagttatacaaacaaagcaaactgaagaccatacagaatttgaaggccgaaatagagctgagaatactagcttgtgtccacaaccctcggcaagccacaggaatgatcaacatcctcgatgcatgccacactacaaaactctcccctctgcgcgtgtttgcacttcagcttgttgaactaagtggaaacaccacttcccttttcaaccaacagcgaagtggtggtgcacaagccctcaccaaagcacaagaagacttggagagcatcaccaacattttccaaacatacacaggtgcaaatgagaacactagtgtggagacttttgctgctgcgtcaacttactcaaacattcacgaggacatatacaacgtgtcgcaggagaagcaagcaagcttgatgagggatgcaccatgttctgttggaatcattgtcgaccgtggactagggtcattgttcaaggtgaacctgcgtgtgctcgtgcttttcatcggtggccctgatgaccgcgaagccttggcggttgcgtggaggatgtcaaagcatcaaggggtgcaactatcagtgatgaggatccttatgtatggggacatggtggcatcaaataattttggttcaagctcttcagtgcttgttggacagaaatatgggtatgggggagtggtgtttgataacagtaatgctgccacacagcagcaacctagggaagtaatgcctgcagatgatgataatgatgattctggggcacttgctgtcaagatagaatag

SEQ ID NO: 91416 - DNA, 362 bp, Glycine max
  Peptide Sequence Number=SeqID_208194
ttgatgaactcaatcctgagtctagtcacttgtggcttcagttctctcggtttcctagtcccagatctggacctagaccttgtggcaagaggatgggtacaactgatgaagttgcgaagccttctaagaagggaactatttttgttgaagatcttccagaagaagaacaagtagttgttgctgttcttacccaggcgagctggttactcaaccctaagttatatgggggcccaggcaagccagaggctagcttgggcaagccagggggaagtaaagataaggacactaatttggttcaagccatcttgctatttgaccgggcaactggcgaaaaccaaggaagtgaaaccaagaaaacatga

SEQ ID NO: 91417 - DNA, 349 bp, Glycine max
  Peptide Sequence Number=SeqID_208195
aacaagagagggtatatctcttgtggatcagttcaagtggagggtacatccacttggttgttcaaagagaacaagggagggtacatcccttgtggatctttgcttgtaaaggattttacaaggttgaaagaaatctcaagaaccggtggttgcttggggactggatgccacttgatccaacaacttgaacgctttcgcactctcatttgcaacctctcacgacactgtaactttgtcactgccggcatttcctcctctcatagtgctgcaacatcattatcgccttcactctcatcacgctacaacctaattttcattctcgcggttctgcaactgtcagccatgaaag

SEQ ID NO: 91418 - DNA, 1896 bp, Glycine max
  Peptide Sequence Number=SeqID_208196
atggattcccccatgctgaagatgtcagacgacaacaacaaacgaaacgcagcagaggacgcagaaacaaggttcgttgggattcccacaacaccatcaccattccttcaccctgaccatgtggccgttgggtcccccatcaccagggtccctctcgctccttctcccgcaccaccacctccctctccctgcagattctggttggaccctgcataccccgtttggggccatgatttctccagaatcaacttcttcgatgcaacccaaaccgataacatgcctttcgaaccctacgcttcttatttcaatgaaacaggaaccctcccatatgttaacaacacccaaaccaacatgggtctggacccttacgctttttgtttcaacgaaacaggaaccttcccatcccttccctatcatcagcatgtcaacaatgtgcctttattcgataaaggttacactcttggcaccccagatgatcacgacaacctcgtgtatcatcacctcgtcgatcagaggaggaggcagctagagggtacatctgataataactatcagattctccgtgatcgttacatggcggcttcacagtctctccacgatggaggaggagtcaaaagtcccattaggttttctcagataacgcctcaacatcaatatcctcccaatgccaatattaccccatcacattattacgttgctgcaaaacaaaaagctgaactttccccttttctatctccgaggagaatcgggggagaccctgctacagcgtttaggtatgacaacaatgacgtttttctacaagggagagatgcaaaacactactttgagaatgggtacggttcttacagaaggagtcctcgcgatgatgatgctgctgcaattcatgacgtgggtgggagtgttgttcctaagaacttttattctgctgctgctccttctggtcaaagaagtggtggtggtgatttctcatcactgcccatgctgctggatttttattctgtgcctgatgcgcagtgctacatttacaacctggcaaaggatcagaatggttgtcgttttctgcagcggatggtggatgaggggacctaccaggatatatgtatcgtgtttgagggaatcattgggaatgttgttgaactcatgatagactctttcgggaattatcttgtgcagaagctgctcgatgtttgcaccgacgatcaactcctgcagattgtgctcttgttgaccaatcacccaacccagctcgttagaatctctttaaatactcacggcacacgcgtggtgcagaagttgatcgagaccctcacctccgatgaacaagtttcactggtgaagtctgccattcaaccgggttttcttgatcttattaaggatttgaatggaaatcacgtcattcaacgttgcttgcaatgctttagctgtcaagataatcagctactcatcggcatggatgttgtgtattgcaatgttgcattcatcactcaacaggaaagaatcgggataagctggtcacagaaatatgcaaacatggacttctcctcgctcaggatgcatttggaatcggataccccagctgtctcagtcaaactgcttagccagttcaaaggaagctttgtaattttgtctacacagaaattcagcagtcatgtggtcgaaaaatgccttaagcatatcggaaacagcaggccaaggatagttggagagttaacgtctgttcctcgctttgaacagttgttgcaagacccatatgccaactatgtcattcgatctgctttactttttacaaagggccctctgcatgcatctttggctgaaatcgttcgtgctcacaaagggttgcgcaccagtccatattgcaagaggattttctcgggaagcttgctcaaaaagtga

SEQ ID NO: 91419 - DNA, 835 bp, Glycine max
  Peptide Sequence Number=SeqID_208197
atgcaggaagagatcaacttaattgagagaaaccagacctgggagctagttgatcttcctcaagaaaaaagaccaatagcattgaaatgggtttacaaagtgaaagtcaacccagaaggcagcagtgaaggggagattgaagaatttaagaagaaaataatgcaagagtttgaaatgagtgatctaggacttttgtcatacttccttggaattgaattcaaggactcaaatcatggagtcatcatgcatcaagccaaatatgctagaaacattctaaagaagtttaatatgattgatgatgaagaagactgtgaagaaatggccaatcctacttatttcagacaaataataggctctctcagatacatgtgcaacactagacaagatttgagtttcagtgttggctacattagcatatttatgaaggcaccaatgaggagacatctcttagcagccaaaagaatcatgaggtacatcaagggtactgtagattatggaattctatttcctaaaggaggtggagaatctgaaatagagttacttggctattcaaattcagattggtgtggcgataaaagtaataggaaaagaactgttgtttatgtgttcttgagtggaggagcaccagtctcatggtgttcaaagaaagaagtcgtggtagctttgtccccttgtgaagttgagtatgtagcagcttccatgagtgcttgtcaagttgtgtggcttgacactttgatgcaggagctgcaattgaagcaagttggagttgtgaaactgttggtggataataagtttgtaatagacttagccaaacacccaacagcaaatgggagaa

SEQ ID NO: 91420 - DNA, 159 bp, Glycine max
  Peptide Sequence Number=SeqID_208198
atggccggagggggattagccgtcgttgatgcaccgccctgtggcttcgacggcaagataacactctcagttgtcatcacttgcatcgttgctgcatccagtggactcattttcggatatgacatcggtgtttcagtaattagctacttagcagggtga

SEQ ID NO: 91421 - DNA, 168 bp, Glycine max
  Peptide Sequence Number=SeqID_208199
atgttgtcatttgttcaaaagagacactatcacactaacatagtaatagattcaacaacgacgggaagagggcagcatactagacagcacaacttgcaacatagaagctttacaacaggacagaccgaacatggaactgaggagttaaagctaaaagccgggggctag

SEQ ID NO: 91422 - DNA, 390 bp, Glycine max
  Peptide Sequence Number=SeqID_208200
atgtcacaggcggaacctgtgttctctatctatcttggaaattctacaaaaacttactctaatttcgtcttgggacgatcatttgctaaagtttggattcttgcgagcagaattgagttgcttaacactatttgccgcgcaatccgtaagacccctgggcccactagaaaacttaggactgggcgagcaatgttgcttctggttggagcaacagctcgcctgggcgagctgctgttcaacctcctctcctcctttcctgtaaataggcatgagggggttgaggtaatgagttcagcttcttacattgagagcattatagtgaaattggtgagaagaaggagaaagaagaagaaagaacgtggccgaggtgcttctgaatcgcttccgtga

SEQ ID NO: 91423 - DNA, 354 bp, Glycine max
  Peptide Sequence Number=SeqID_208201
atgggacaaaagacatttttggctctagtcatgtttgttatggcatatggtttggcagcaacaacattcactgtgtctcaaatccctccttcatgcaatggggatgaatcattactcaccttttgtgggccttatatggggaatatccatcccaatccaacttctgattgttgtaaagcagcaacttctgtgtttgacaaagccatggccacgggtcaaggtataagagatctttgcaattgcctgcgggttgctggaccagtcttgaggtttcaaaaagaaaaagtgctaaggcttcccgatgtttgtcagattaagctttctttttctatggagttatgtattgagggctaa

SEQ ID NO: 91424 - DNA, 306 bp, Glycine max
  Peptide Sequence Number=SeqID_208202
atgaatttgaaggaggtagttaggtggcatgatgcggaggcatctgctgcagaggaaaaggtagtggtgcacggtgtcaaggtcaagccaatgaggaaggtggaaggtggccttaatgagggggaattcatcgttggagtcccatattcgaaggaagagtgggaggatgaggggcacaagcaaaaaaggtacaatggagtagaaatggagaaggcgaagggcgaatggagagaaggaagagaggctaggatcgccgacttaaagagaaaaagagaaatggaaagaaaaagtaggacacgtgtctag

SEQ ID NO: 91425 - DNA, 327 bp, Glycine max
  Peptide Sequence Number=SeqID_208203
atgtcggctagtctacgctatcttgacccaggtcagtattcatgtggctcaccaccaccacctctacaacagccaccatctctagagtccatcgcagctcacatgcagcatttggctgaccagcaagcggccaaccataggggccatgtgcagttgaatgagagcttttatcaatataccctgcatcaacagcgccaggaccccagtccttacccatggcctactcctgagcagttcaaggccacagttgcatggcctggagacaggcccagatttcaggtaggggcagggctcacagaggccccaggagatgaagatgaagcttag

SEQ ID NO: 91426 - DNA, 366 bp, Glycine max
  Peptide Sequence Number=SeqID_208204
atgaatgtcgagattcgagcattagaagctaatcatacatggaaacttactgatcctactccacataagactcccattggtttgagactattacttgctctagctgctattagcaaatggaacttaaggcagcttgatgtaaacaatgcatttttacatggagatttaaatgaagaagtttacatggtgattcctcaaggtatgaatccagaaaagccaggtttagtgtgcagacttcaaaggtgtttctataggttgaaacaggttctaaaccagtatccactccctcttattagactaccggattgcattaacattttggttctcctctctcaactaaatatgcctcttcttacaggagattga

SEQ ID NO: 91427 - DNA, 423 bp, Glycine max
  Peptide Sequence Number=SeqID_208205
atggtagaaaaatatggggaagacatattgaatcatccttcggttgactttgatgtatggttaaagatttgtgatgaaaataagaaaggtagaatccacaacatcaatcatagcttcgatcttgccattactaaacatgattcatcttctatagttgtaggtctctcttccacaaattcaaatcctactacacctccaacaaaaggcatcactagaataaataactacacaaatgactcaaatgcaagagaagatgcaaacatagttgcatctatagacataatttggaatgcaattttaaacgcaactacaggcacaagtgcaacatatgtagacacaattaaaggtgcaagagaacatacaaatgaaggtgcaaatgcaggctttagacgaaggcacaagcaaaaatgtagacacttttga

SEQ ID NO: 91428 - DNA, 309 bp, Glycine max
  Peptide Sequence Number=SeqID_208206
atgaagatgtttcaaaataaattgaagcgaaactttatttatctgattctgtatgacatattgtcgcaacctacccttcggcgggagggcgacgcgagtgcatctcctatgggaggaaaatgcacggagtcgccaccaacatttattcaaggaaaacgtcgaaaaaaccggaaaaggtgtggtctacgaactttaatcgtgaaaggttcgggagttgtttttacgcacggggaagggtgtttcctttgctcctacgtattcctcaattgggatgaggaaatcagacctatgaagttcttcgagaactaa

SEQ ID NO: 91429 - DNA, 492 bp, Glycine max
  Peptide Sequence Number=SeqID_208207
atgggatcgagtcaggcgccttcgcttaaaaagaggttctatcaagtcaagatcaagggcctaggagtcgccagtctgaaagagttaggacagttgatgggtcagctccagcgacaagcctttcgcaaagcttatggtaagatctgggacctaaccatggcagaggtctccacggaggccattgcctccctcgcccaatattatgaccagcctttgaggtgcttcacctttggggacttccagttaacacccacggtggaagagtttgaagagatcctgggatgccctctgggaggaaggaaaccatatcttttttcgggattctatccttccttaggtagaatttctaagatagtcaaaatctcgacacaggaattggaccgcgggaagcaagtcgaaaatggggtggttgggggtaccaaggaaatgtttggaagcaaagcgagagtcttggcaagtcaagaggaatgggccccgttcatgacatcctga

SEQ ID NO: 91430 - DNA, 641 bp, Glycine max
  Peptide Sequence Number=SeqID_208208
gattgaaaagaaatgggaagagctgcagattgagatgggtgaattatctgagacctgatctcaagaggggacagataacaccacaagaagagagcataattctagagttgcatgcaaggtggggaaacaggtggtcaacaattgcaaggagcttgccagggagaactgacaatgagataaaaaattattggaggactcatttcaagaaaaaggcaaaaagtccctctgatgcagcagagaaggctagaaatagactcatgaggaagcagcaatttcaccagcaacaacaacaacaacaagaacagttgcagcagcagcatcaggcacaacaacaacaaatgcaattcaactttgacatgaaaggcatcatggccatgcttgaggacaacatccatagaacaccttatatatctcaatcaagacaagaaatgatcaacatgcaccaaaacaccacagaagagcaaggatacttgtactctatgctcaatgacaactcttctgcttcttctgcaccagagacctctgcagaagaagttttgtgggatggtctgtggaacatagatgatgttcatggcaatttcagtgtagctagtgcagcaagcaaagttggtctatacaatttagttgctcccttctgttaa

SEQ ID NO: 91431 - DNA, 516 bp, Glycine max
  Peptide Sequence Number=SeqID_208209
atggaaaagaaattcctctgtttcgtccatctccctctctttctctctctcacctatgaagacgtcgctcgacgtaaccgttttctcaaacagctgctcatgcgcttttgcatcgtagatgccgctcgacacggtaccatcacgacaatgcctaccaccgtgcgtgctatgttagagcttgtcgctgtaggtgtgcttgtggagtctatcgatgatgtcaaacttggaatacgagttgaggaactcggactaagtgttattggtggcaactgcgacggtaggaggcttaaagtttgtgaaagtgtcgtagccacgaaagcgttgcgcgacaatgttttaggctctggcgacttcgtcttcctcattgaaagtgtagagccacacacactggtgcttctcataaatttgtgctcccccgcaaccgtttggtcacggcacaacgcctttgtatttcaacgacgggagtttccaggattcggcctcgccgaaaatgtaacaaccatggggggtcgatga

SEQ ID NO: 91432 - DNA, 653 bp, Glycine max
  Peptide Sequence Number=SeqID_208210
ttgggagtctgatgtatgctatggtttgtaccagaccagatatagcacatgcagtgagtgtcgttaatcgttatatggctaatccaggaaagtctcactggcaagcagtaaaatggattctcagatatctaaggggttcaactaatctgggtctagtgtttggcaaagcaacaaatgaatgcaatggtcatgtcattggatattgtgactcggattatgctggtgatcttgatcgtagaaggtccttgagtggttatatttttacgcttggaagtagtgctataagttggcgtgcgactctacagtccactgttgccttgtcgactacagaagcagaatatatggcagctactgaagcggtgaaagaagctttatggcttaaaggtcttgttggtgatcttggtgtaagtaaaaaggaagttgttgtgcattgtgatagtcaaagcacaattcacttaaccaaaaaccaaatgtaccacgaaaggataaagcacatagatataaggatgcattttattcgtgatgtggtaacacaaggtgatgtgttaatagaaaagatttctacttcagataatcctgctgatatgatgacaaaagctcttccaacaataaagttcaaacagtgtctggactcagtggggattaaaaattga

SEQ ID NO: 91433 - DNA, 351 bp, Glycine max
  Peptide Sequence Number=SeqID_208211
atgggtcactccaaggataggaaaaaagaaaagaaatggagcaaggaggtcaaaggaggaaagcttacccagtccatggcatataaagaagctctaaggaagaagaaaaaggtcaccaaagatatcgaggaggatgacgaggagcttgaagtggtggctcactttgctagctccaacgacgatgataaatcactagatgaagccgtggaagataacgacaaggacaaacattctcctactcgtttggatttcaccgattatttggagcttgcccgcagagcaggacagatgcaacacaggttgccacatacattcacaacccacctgggcataacccccatttttcagtga

SEQ ID NO: 91434 - DNA, 891 bp, Glycine max
  Peptide Sequence Number=SeqID_208212
atgggtcgtgttaaactcgagataaagagaatagagaaccccacaaatcgacaagttacattctcaaaacgtagaaatggcctcatcaagaaagcatatgagctatcaatcctatgtgacattgatattgctgttataatgttttctccatcaggacgtctgaaccacttttccggtaggaggaggattgaggatgttttcactcgttacattaatcttcctgatcaagaaagagataacgctgtaagttttcctgagctaccctatcgcaggagtattcagaataaggaggaactccaacaagaagttaataggttacaacagcaacttcaaatggccgaggagcaaataaggttatatgaacccgacccattaaagatgtcatctatggcggatcttgaaaacagtgaaaaacaccttgtagatgtcttgacacgtgtcatacaaagaaaggaatacttgttgagcaaccatctatcttcgtatgatccatctggtattcaggggataccgacctctttcgagaatgtagggtggttgcaggatgggagtcagaaccaagcccagatttttgatgcatctgctcctttagatcctttgagggacttgtcttccaccatgtatggttcattttcccaagggcgaagttcaaatgctgatccacgaggcatgggggagtgccacgtgtcaaatccaagtgatgggaaccttcaagcatggcctcaagggtacacattgtatcctcatcatattcagcatgacatggtgggacccgacatgccagatatgatgccacatgcgcaagtgaacctcccaatcactgccttggaaccacctaagaataatgaacctgtagaatatgaccagtccaaacaacctcatcatcattga

SEQ ID NO: 91435 - DNA, 540 bp, Glycine max
  Peptide Sequence Number=SeqID_208213
atggctataaacgggagagaggagaaaaggaagggaggcggagagattgtgaacctaaagctaaaaagctttgagaaatggaatgctcctgaggagaattatagagaaggacatcgaggaagattgaagttcttttcggagaaagaaaaccaagaaacacaacaaccacaccctagagaagggaacgctccagagaagaaccctcactgtgtcgctgtggtgttgccagggaaggacgcaaggtgtcgttcttctgaaaagatgtctcgtgtgtatgttggtaacttggattcaggagtcaccgagagagatctcgaagacgaattccgtgttttcggagctttatttgctttcacttttatactttccaatgaaggacttggggaggcctatgatggagatattgcatttgcaagtgccttggaaacttttggtggtgggcataatgacccaatcggtgtggctttgggaggtatgctccctttttacatcaatattatgatggttgatgaaaggttctctgtccctcctggtagttga

SEQ ID NO: 91436 - DNA, 390 bp, Glycine max
  Peptide Sequence Number=SeqID_208214
atgacagagcctcagcctccaagagagtttaggatttttagtactgggaagtgctttaaagccttagaacttgatagagtaggctggagaactattactcccgaacaagtttttggctccgcgaacagctcactggccatcatttcgaagagggttgggctggatcgggtcttgtcgagaggggggaactttgggtttaagaggctcgtggtgagggtggagttaaacttggagaagttggaagggaacggctcatggttatggttcccattcgaggtggggggaagagtgagtgaattccattattggagagaaccgacctggggagaatcggatcctgtagctggagggagattcggccaatgctgttgcgggttcaagttcggctga

SEQ ID NO: 91437 - DNA, 330 bp, Glycine max
  Peptide Sequence Number=SeqID_208215
atggattaccatgagaggaaaccacgtgtttgtcgctggaagtctgggaaggcattactagtggtgacgtatcgtaaacgcttggataggttgacgtcagatgttgtgtgctggataccttatgactacatgaacaagttctataggatatctcatcgattcacgagtctgcttcaacttgtggatcctcctagacatccacccatggtgcatgatgatacatttattgtaccagatccacctgtgttgcccattcagtcagcaactatgccacaaccacttgtacttgtggctgccaatgcagacatgcctcggcatgcagtggtataa

SEQ ID NO: 91438 - DNA, 306 bp, Glycine max
  Peptide Sequence Number=SeqID_208216
atggatcatgctgctgaagaggttcatgagcagcctcaggagccaattacggatcatgttgatgttgatacaaaggaacatactgagttaaagttggcctttcatgggagcaaggtagaaaattttggaaggcctgcagctgagattgaaggcatagtggttgctacaagattaagttctctgattacatgttcgtttgagacagaccaagtcgtggacttgttagttgagttgcttgatgtcagtacacaaaaagcaaaggatgacacatttcaatgcaaaagggcatatgttcgcctaacctag

SEQ ID NO: 91439 - DNA, 255 bp, Glycine max
  Peptide Sequence Number=SeqID_208217
atggattgtgaaatcaaagcaaggcaaagggcaacactaagcaccgtagtgattctcccatcagtgacggtttcgagggagaagaggttgtgttgcatggaggagaatcttttagtattactaaaacgaattagtgggaagcagagagttgcatgggaaggtttgggtgaggaaatgaagaggatcattgacatagaatggcctatggtggttgtgacggctgcttcccaggctaattgtggagtaatatattga

SEQ ID NO: 91440 - DNA, 255 bp, Glycine max
  Peptide Sequence Number=SeqID_208218
atgaagaacagaagggaactcgtgcgtttatgcaaaaatcataatacaataaacatgtacgaacagaagaagaagaagaagaagaagaagaagaagaagaagaagaataagaagaagaagaagaagaaggggaaaaggggagaagaggagaagaaaaaggaactcgtgcgaacctctgaagaacaaaagggaactcgtgaaggcacgacgaaggctacgattttgcgaaggcatgacgaagggacaaagtcgtga

SEQ ID NO: 91441 - DNA, 210 bp, Glycine max
  Peptide Sequence Number=SeqID_208219
atggcaaaacattattctatctccaagaaacgtatccatcaaatatttaaaacaagaaatggtacctttgtaccaaataaagaaaaagttggaacacaggaagtagcaccaagatcaatgctccagcagccaggcggaagaaactactttgatcctgcagaggcaaaaataccaggattgacaaataacagctttattgataggtattaa

SEQ ID NO: 91442 - DNA, 372 bp, Glycine max
  Peptide Sequence Number=SeqID_208220
atgtatgtctatgaaaaagagatattagtgatccgtaaacagctcagcaacttcccgatagcagtttccgccatcgccaacaacaatggtggaagaagcaaaaacgcaaaagagaaacgtacctcgaagaagaagcagaaatgcgaagaagtcttcctcctaatcacgacaacaatggcggcaacaaagatgaagaagcagaaacgcgaagaagaagccttcatttgggaagaagatgcagaatcacggcacgaagaagaagaacgaagaagatgcagaatcttgaagcagaagaatgaagaagcagaagcaaaaccatccgaggaaggaagaagaagcaagcacgggagagaggcgagagttattttttaa

SEQ ID NO: 91443 - DNA, 582 bp, Glycine max
  Peptide Sequence Number=SeqID_208221
cttctcggcgaactccgccgcaaagtcctccagcacaacggcactggcgacgacgttggcaacagcggtggagatggcgaggcgcttctccttgcagttgatcttgatgcaccagtcgtggggcttcgggccgaagatgacgcctccgcagggccggtaggcgcgactggtttttttctgcaggaagggcttccggccgccgcctcggacctcgccgcgggtgagggtggaggcggtgccgcggcgcttgttctggaggtcggtgacgacggcatggtggacgacgacacgagcggtgtcgggaggggtgaagcggaggtcgaggaaggactcgccgaccttctcgccagagaagttgaggacgggaagaggaggggaggccttgcaggaaatggagaggggatggaggatgatgtgaaggaaagagaggttggtgttgttggtgtggagagagagagggaaagtgaagccattgttgattggtatgatgccaacccaaaaggccttgacatctgcatagctagctttggagcttcttttctagccatagcaacatccaaagggttcatggaagccaagtag

SEQ ID NO: 91444 - DNA, 357 bp, Glycine max
  Peptide Sequence Number=SeqID_208222
atggtaattattatagtgagaaacaacccggccggagtagcgtggttacgggggttgccgaggaggtggtggacaccctcaattaggcagccattcttgtcgaggacctcgagggcaaaatcattggtggttgtggcggtagaatcaagcgaaatgattgttgcggcaatcttcagaggtcacaatagactgaaggggatgactcaaagaaaaattccatgcggattcaaagatgaacagagtgaagatgaacaacaattggatgaaggtgaagccaataatggctacaggttgaacgaccagagtgaggacgacggtatgctcaacggcgtgggttgggatcaatggcaatggtag

SEQ ID NO: 91445 - DNA, 324 bp, Glycine max
  Peptide Sequence Number=SeqID_208223
atgcagccattaacggagacacgaagcttacctcgacagtggaagagcaaaatggagctacaggttctcaatgccgacgaagaatcacccaatgcaaggcaaacgaacctccaaggaaagcaaacgactccgggaggagaagaagaagaagctcgaacagcacagccaggaaaaggaaaagcgaagaagcttgtacggaagaagcaatttggcaaagctcgaacagcatccactaagcgcaacactcctaggctaagcgcgaggaagactctggaagaagatgagttgtataggttcgctaagcgcaccacttcatctcactaa

SEQ ID NO: 91446 - DNA, 825 bp, Glycine max
  Peptide Sequence Number=SeqID_208224
atgaagacttcttttagagcaagaagaaaatggagtttcattgacggaacaataaagaaacctgaagaaggatcctttgtaatggagaattggtgggctgtccaagccatgttggagagattttcaattccgaatggtccatgcattcaccaactaaaatcgaacttggcccaatgcaaacaaggaggtttgtccatggtggcttattacgaaaagttgatggcttcgtgggatgacttggccaactatgaacaactatcaatctgtacttgcaaaggctgcatgtgtggtgttgcggcaaaacttgaaaaacacagagaagaggaacaaggtcacattttatttatgggcttagatgatgggctctatggaatgatctgttccaacttgctagccacgaatccaatgtcatatttaaacaatatgaactctattctagtacaggaagaaagattgcagactatcacacgaagtaaagaagaaagaacgaaagtcatggccttgactgctcaaacaagcgcaaggatgaaagggcatgagaacaagaacaaatatgtctgcacgaattgcaacaaatctggtcatgatgaagcaaactgtttgttgctgattggatacccaaaatggtggggtgaccgtcccagaaatgatgacaaggcaggtggacaaggaagaggtcagaatcgcactaaaggtactggatcgaatagtgaacatgcacaaaagggtccaatacatgctcatgttgtccagaacttgggatccaacattagtggagatatggagaattttggcatgacaggattgagcaaggagcatatgtaa

SEQ ID NO: 91447 - DNA, 594 bp, Glycine max
  Peptide Sequence Number=SeqID_208225
atgacgccaaagtataatcaaacaagattgcttcaagaaacattcaaggttaagcaaatagagattgcttcaagattaattcaaggttttgatgatgccaaaaagaattcacttgataatgattgtcatcatcaaaaagaggaagaatgtaaatgtatgaatacagattttgatggtgccaaagccacttgtccaacagagcagtggcaaactttggtagaattgcttaacaattcgaaggccactccaaatgaaagcatggcttgtaagactaaactcaatttatggatccttgatagtaaggcatcttatcacatgactggaaccttgcaacacctatgtgatgcgaggaaagtgcttaggtgccctgttaaacttcctaatggacacaccaccatatctactaaagaaggaacaataaggcttgttggtggtttaagacttgaaaatgtgctttatgtgcctcagttgaattgcaacttaatttctatatcacaattatcaaatgagtccaattctaatgtccagtttaccgctaatctatgtgtgatacatgacctcactttgaagatgttgattggagcgagtgaatga

SEQ ID NO: 91448 - DNA, 1071 bp, Glycine max
  Peptide Sequence Number=SeqID_208226
atgcaacaactaccgcccagaaagaaagctctcgggtgcaaatgggtgtactgcgtaaagtatcactcagatgcttcacaaccggacatggtctgcaagctgcaaaaatcactttacaggttaaaacaagctccacgttgttggtttgccaagctctctattgctctcaaatcctatggatttcagcaatcatatcttcattactctctgttcactttacatcgagaagacactcaacttgtggttcttgtgtacgttgacgatttggtcattgctggcaatactccttctgccatcaagcattttaagctctacctcaatacatgtttttatatgaaagatcttggtgttttaaagtatgttctaggtattgaggttgcgagaaatcctacgggaatttttctttgtcaacgtaaatatgcgcttgatattatatctgaagttggtctccttggtgctaaactcgttgccactccattagagcagaaccatcgcttgtcacttgttgtaggacaccttatttcaaatctcgagcaataccggtgtttatttgggcatttgatttatctgtgtttcgctcggcctgagctttcatacagtgtccaccttttgtttcaattcatgcaagaaccccgaacagaacactgggaagccacactccacatgcttggtgactctcctatttcctggaaaacaaagcaacaacatacaatttctcgatcttctgctgaggctgagtataggtctgtggaaacccctacatgtgagttgaaatggttgaaagggatcctctccaacctatgggttgtccatgacaaacccatgaccattcactatgatagtgaggtcgctttacacattgccaaaaatccagtgtttcatgagcgcaccaaacacatcgagataaactgtcactttgtttgggatgaggttctcaaagacaatatccgccccagctatgttcctactagtgctcaacttgcagatatattcacaaaagcattgggggaactggagtttgaagctttccttggcaagttgggcattcgaaatctccatactccaacttga

SEQ ID NO: 91449 - DNA, 168 bp, Glycine max
  Peptide Sequence Number=SeqID_208227
atggcgccttctatggtgggaatgttggcgagtggtccaccgaatggatgttcaatgaaagtcacttcgtcgcccaaagtcatcgcgtcgtttcagaccccccccccccccgaaaaacaaagtgaaacgagaagttgtgggatgaggggtcatgatcctagtaaataa

SEQ ID NO: 91450 - DNA, 249 bp, Glycine max
  Peptide Sequence Number=SeqID_208228
atgagttgtgaggtgagagaaaaacaagatgatctgaaagcagctctgcagagaaaggcaaaccgaatctcttccttcacagaacacaatgaagtagcgggtaggctccttaatgtctgcattcaagaagcaaaactgaagctcttgattgccatggaacattggctgatcacaaaccaagaagagttgttttactcttctttttttgcctgccaatgctactgcatagaccatctgttaccaggataa

SEQ ID NO: 91451 - DNA, 1831 bp, Glycine max
  Peptide Sequence Number=SeqID_208229
ggcagctgtatgggaatgcggaagcgagaaaagtccaggaccggatggattaaatttcaaatttatcaaacagttttggaaactccttaagcccgatatcagccgcttccttgacgagttccatgcaaatgggatattccctaagggcagcaacgcatccttcattgctctaatccctaaggtgaaagatccacaaagtcttaatgaatacagacccatttcactaattggctgtatttataagatcttggctaaggtcctagcaaacaggctgaagaaggtgatgtcagaaatcatagatgttagacagtccactttcattggaggaagacaattgttgcacagtgtactaatagctaatgaatcagtggaggaagccaagagtggatcgaatggattgagggctgccttcggacagcctcggccttacgggtttgatgagggaagaagtggacaagagattgttttcgagctttatggtggaaaaaagaatgagccaatcaacatcttgcaatacgctgatgacaccatactctttggtgaagccacaatgctgaatgtgaagacaattaaggccttgttgagaagtttcaagcttgtttcaggtctaaagattaattttgccaaaagctgttttggagctattgggaaatcggagctttggcagcaggaggcggctgcttaccttaattgcaaattgttattcatgcctttcatgtatttgggtatccccattggggcaaacccgaggcgtagtgaggtctgggatcccatagttaggaaatgtgagagaaaattagctagatggaagcaaaaacacatatcctttggggggagagtgacactcattaatgcagtcctgacttctattcctatatattttctctcttttttcaggttaccctccaaagtggctgagaaattagtcaccattcaacggaggttcctatggggcggcagactagagcaacgaaagatagcttgggttaaatggaaaacggtgtgcttacctaaggacaaaggaaggcttggcattaaagatatcaagaccttcaatacaactttgttaggaaaatggaggtgggatctgttccagcagcctgatgaaccatgggccaagttattagaatccaaatatggtggctggagatctttggaagaagggaaaacagggaaactgaatggaggctgggatgtggtgacaagtgccggttctgggaggatcatgggaagcaattcaggtgcagtttgggattggcagcttaattggaggagacctttgtttgatagtgagatcgcaatggcggatgactttattgggaagatagctcagaaggaaatccttccacacaaaactgattcctggtggtggaaacctgacccaggaggaaaattctcatcaaaaagcgcctacagaatgttatggggagaattaacggggacaaatcaggaggctgcttttaaggatctatggaagctaaaaattccaccaaaagcagctgtgttcgcatggcggctaatcaaggattgtttaccaacgaagctaaatctcagcaagagacaagtggtgctgagcgacaccatgtgccctttctgttgcaatcatgaggaggatgctgcccacttgttctttaactgcagtaagaccctacctctatggtgggagtcattatcttggattggagtagtgactgcacttccacaaaatccaagggctcactttttgcagcatgggcatcagcttgttgggtgttacatagctgggtgctgtggtgttggcttgggtcctatcagtaaacataggaaccagctggccccaaatatattgtaa

SEQ ID NO: 91452 - DNA, 216 bp, Glycine max
  Peptide Sequence Number=SeqID_208230
atgaaaaagatatggagatttaaagatgtgggtatggaggatgttatcaaggagaaggatgaagaagggttctacgcaaggagagagaaaagtgaaacttttatagacagagacgagttaaaccctcaggggctttgttctatggtaattgattaccaatcgattgcagagagtggtaatcgattaccagaccctaaaacatggattttcaagtga

SEQ ID NO: 91453 - DNA, 1989 bp, Glycine max
  Peptide Sequence Number=SeqID_208231
atgagagagagagagccagggggagggggagtggaccaccgtaaccagagtgaaagccgacagagagaagatgtgcgaatgagagtggatcccagacaacgttacgatgatactaggcgtggacagctacacaaacaccaaaatgcaaactggagggacaggaacgacatcaccaccttctacttcacaaggttccccgaacaaacaacagagaaggagctatggattcatttcaaacaatggggggagggagtgcaagatgaacgccgattagagagaaaccttgacaacatcattcttggtggcctcaaaatgtatgtcaacgccccaaaatatgggagaggaaaggagaggcacattgggcacaacattatacaaaggaccctagcgggtgaggatattaatggaagcaacgcacctggacaagtgtcacagcagtacagggcaaaccccatgacatatgcaaaagcggtgacatccaccattaaggcagcaaacgcatgggtgggacgcttaaaggaaccacggttctttaaaagaattgaggaagagctgccttgggagattggatcgaatgtggtgccaaaatacataggggatgatatgatattactactgggtctctcggacgctaaagcggaagagctcattcttgaagaaaacaaacatggtacgtccctgttttactcggtagagaggtggagcccgacattgaggccgcgaaacagactgatatgggtgcaatgttggggcatccctttagaggcttgggatatcaggcatattcgaaaaattgtggcggcagtaggggacctgattgaagtggacgacgacgtcgaagagcttcgaagacttgacagagccagagtcctcatcaggactccatggatacctctaatccaccacaccgtcacaatgcatgtccaacaagaaacgcacaacgtaactatagttgaagaaagccagaacgatgctggacagcgcttccaccaaaggaggaatgtcatcgggtcgtctaaggagattgactcggatgatagtgatgttgccgaaatgtcgcacgcaactagcgacacccaccccccgcctacccgcttcgctgtccgccacaccggtgacggtgaggacgaccagcacgaacccagctccaagctcagtcccgcaaaagactaccactccgccgacatcgacacccagcacggggagactacgctaaacggccccaaaccccgtcgcaccggcgacgtcgccacccagcccgccgcgactttgtccaatggttctcgacaccacctaaacccatcgggtattacccgcggtcaaggggcacatttccccatagaggaagcatgcacgaggctagaagacagaaaaggaaatatgcacagcgcaggggtggagtctacaacactgttggaagcccattttggtgatcatcgcctgcatgcagcaccaaattggaaagaacaggggtgcagaggtatgtcacccacaacagcagggcggctggacagagaagagggagagatctctgaggatgctgcaaacggtcaaatggaagtagatttaaataatgctaatgggtcttttgtgccaatcacagttgcacgtgatatttctgctggtatatgtgggcttagtaatttagaggcacatgatattgttgttggtacaaccgggcctagcattgctgaagggtgtagaaagcaggtagcccaggaagaaggtaaggaagacaatatgggtgcggccaatatgctagctaatcatcagaactcaataggggaagtgataacagatcctacgtgctccaaaaatgacaccaccacagtgcatgttgaggaggcaacatctcaatgggaaatggcaaaggctctaggggtcacagcagtagcagatccggataaaatcatcaagaaaatagaggaaatggaggacagagaccgcaaggaggcagaagcaatgggaactttaaatattcatccatga

SEQ ID NO: 91454 - DNA, 297 bp, Glycine max
  Peptide Sequence Number=SeqID_208232
atggcttctcttcaattccgttacgttctctctcttctttcgccctcgctgattccgcttccaccaagattttctggcactttcccgccccgttttccgggaaaattgcgcgctttctctctcgcgcggaggaggcgagttctctcaatccgctgctgctcctccaaaaccggttcgcagcttcagcgagttcctgttcccgaagacgatgaccggcatccgtttgatatcaacctcgcggtgattctcgcgggtttcgcgttcgaagcgtacactactccccctatcgttttataa

SEQ ID NO: 91455 - DNA, 366 bp, Glycine max
  Peptide Sequence Number=SeqID_208233
atgggcaggcatgaagttgatgctggtggttgcaagacagtttacctttctgaggaatttgttcgtgaaatttatgatggtcaactcttcataaagttgaaaaaagggttcaattttcctgccatggatccatggggaacaagtgacccatatgtggtcatacaaatggattctcagactgctaaaagcagtatcaaatgggggacaaaggagccaacatggaatgaggagttcatttttaatattaagcagcctccaagccaaactttacaggttaacaagcatgatctctctcgctctcttacatctatgtgcgcatacatatttcagtggaatgcacactcgcaaggatcccttttttcataa

SEQ ID NO: 91456 - DNA, 240 bp, Glycine max
  Peptide Sequence Number=SeqID_208234
atgtggtcttccagaagacctcttaaggttctcaccatttctcttcctatcagattgtggagggaaagggggagtgtggtggcatcgcgcaccgcagaggggggtgggggtggtgccgcccgtcgtggaaggggaggttggtggtgtcgtacgcctcgccaaggtagaggttggtgcactgcgcaaaggtggagggtgagggaggggtggaggggaaagggaagaggattgtgtggttga

SEQ ID NO: 91457 - DNA, 624 bp, Glycine max
  Peptide Sequence Number=SeqID_208235
atgaatcccccgcccaatagggcaaaagtcaacgaagaggaagatgaaggggaaatgagctacaacgtcttcatcgattgtggacttgatgggcatggaagcagcaataagggaaaaaaagtgaagtcgccaaacagacatgctcattttgtacaaactctgcaatattcttcttctttttttctagctctactcacacataaaatagatccaaactctgacttcaatagaatttggaaagaaattgttaatgaaacattcaaagagaacattgaagaagaaatcatgaggtacttacgcaaggtttcgaatgtggaagctgctattcctttgaattgtactcttagtaatcatgatccatttccaaatgagattcgatgcaacaggaatgagtacttgagaagcccgaaaaacaacgacatcaatcgcctgctacaaattggaaaggcatggggtttccaggggcaatgtcccaacaacaatttctacgaagctatatatacaacatgcatgtattttgtcaatggcaatacaacaaggaagaataaagaccttaatccctttcccacgtgcactcttccagacacgcaagttatgaagttaaagatgaattattggagataa

SEQ ID NO: 91458 - DNA, 435 bp, Glycine max
  Peptide Sequence Number=SeqID_208236
atgaaagatcatcttcacctgaacatcagtacccctacattagagtcttcctcatcaactcgaccaaacgagcctaacttcacaacaaagccaaacttacctaatggagaactcagtccctttagtgaggatgaagatgaagttcttcacaatcaaccccaagagaaagatgatgaggaagaagctcagtctgtttcaccaatcacaatcgtaccaccatactacatatcaccccttatgcaaaattttgaagaatcctattttcaagattttgaatacgagcatagcttggattgtaaagaagtccaacatccagtggggactctcttcaaaaggatgtgtttcctgaaaaaacaagatgtacaaaatgctttgttgcagtatcatgtgagcaaatggactaactacaagacacaactatcaaacccaaaaaag

SEQ ID NO: 91459 - DNA, 1602 bp, Glycine max
  Peptide Sequence Number=SeqID_208237
atggagtcttacggtcctctcctagagaagacccaagtcccccaaccggcgctccaaaaactcgccgtcgattccattttctcgaagctccgatcagcacccagccacctcgacccagaatccgaacccggaagacgcgccatttcccaatgcctcgcctccccttcccctcacgtcgtcgaccactccgtccgccacctctgccgcctcgccgccgactccgccgtcgccgtcccccgcgcctccctcgagctcctctccgcgctccaaggatccgacccgaaactcgtccccatcttcgtcaagggactcggtttcctcgctcgccacgatttccgccacaaaaatagcgcctcgcaacaatttacttcttccactctcactcaccctttcgttaggaataaggatgtgggaatggttcgagtttgtgaatttttaaggcccttgttgaatgtctcaatcataagattgtcggtttcggaatcctccttgtcctcgtcgtttgcaatgcaactggtgtcctctatggcggcgttctgttgctcgtttccgcacgagactgtgcctgtttttaagcttctaattgagtgccttaagtttcttccgcatgagagctctgaagactacaggaaattagtgtttgttgtagagcatatggtggaggcatatatagtggtgctgaaatctttggctggaaagaaatcaaatgatcttgggttaccatggctgcctggtttggcatcaactattgcatcattattcacaatcatcgttcaatcagaacttgaacacgaacaaatttctatattgaaactcctcctcttgatcctgaagtggaaatatgataatgttaccaatgcagatgctgctatcagtgaacctaaattctctttatttgaagaaactttgtttcttcttcccgttgttagtctcatgtcatctccttccaaatctgtgaaaggactggctactgatttgcttctcctcttggagaagctccttgtcaagatgtttgttgcaccaaaagataaaccaattgtcaaagggggagatcattatcttagcacgccaggagttatagttttgagacttttgcgacatctgtggtatcaggatggagaatcttctcccagaacttcccttctgaagttgactttaaaaggattgaatcaaagtgaaataatgcatgatagaccaatatcttgggtttctcatttaagagggttctgcttgtcaattgttgaccaacgaaaatcttcactagctatctcacattctcaggaagtatttttgaatgagatgcccttgttactcagtgctgttctcaatgttttattgatacatcaatcaatggcggctgctgctgttgattgtttgtcttccattgccattatggatcccaaactgggagttcctttgttgctaacaattatgttttacagtaatatattcataagaaatgatatcaatcaccatgatatgctgttaaatttttttgaaatgctgccatcacttgcttcacactcggcaatgattccacttgtagttcaaactatcttgccaatgcttaacaaagatgcaaaagtgtgggtactactctag

SEQ ID NO: 91460 - DNA, 713 bp, Glycine max
  Peptide Sequence Number=SeqID_208238
gcgaggagcatggaatgcaatgctaccttggggttaagatttcagatttggacggcagtgcgcccaaatctatccatgaattttttgaggaacccgttgtctacttgtggcagactggccaaggtggccgaggtcatatagtgagacctgctggtggcgtattacggactaaatcattcgatgagggtgtcaaagctatctatggtcctaggtgggagttcaacgtaccagggtcacccaagtcaggaaggcgtccagatgctcgtctagatttgttgtcccatttgtaccactcgaggttgagtggtttccaccccaaggactttgtaaaagacattttacaagatgatggaaatctcaagtgggttgcttggggactggacgtaggcacagggcgtggccgaaccagtcacttgtctaacaaacatgagcctccagctgatcatggtcagcctttagctttcttagttcttccttatggcgtcgctccatctccacaatgcgggcgagaccgagtgctaaccacggatgaaaaagagagagttgatgagaaaccacggggtatgttttactacagccccgcagctctaggactttacatgtcggctttgaggatggcctttgttgagcggacaagaggagggacttgcaaaacaaaggactctgacgctcaaggtttgatggaacctggtatctataggagtggagcgtag

SEQ ID NO: 91461 - DNA, 501 bp, Glycine max
  Peptide Sequence Number=SeqID_208239
atggacgcaaatgttgatcgagcaactaatggcttagtgagattttacgagaaaaatagactcttgcatgggatggtgaccgatgggcgagaagtcacaacaatccttgcatctggccaagtttataaggaagtacaaaacaagatcatcgaagacgcacttagaaaggaaaacactcacaattttattgagtttgatttacacaacacacgattcttggtccaagagacaacaaaccttagagaggttcggctcactggagatttcaaggtcaagttggatgaaaggtggtgtgactgtgacaaatttcagaagttgcacatgccttgttctcatgttgttgctacttgtaagcatactcatcatgggcacaataactacatacatcctatgtataggttggaaagtgtctgcaacatatacaaaacattgtttggagaattacgcagcgaaacctattggtcatcgtgtcacgagccaatgatctcccccaacccatga

SEQ ID NO: 91462 - DNA, 3690 bp, Glycine max
  Peptide Sequence Number=SeqID_208240
atggttttgtgttggaacaaacagtcttgcattgagagccaagatcctgtaattaaagctattggcttgcaaagccttgccttcctttgtgaagcagatgtgattgatttctacactgcatgggatgtcattgcaaagcatgtgcaaggttaccaagatgatcctattcttgctcatagcctatgccttctgcttaggtggggtgcaatggacgcagaagcatatccagaagcatcaaagagtgtgctgcaaattttgtgggatgtagttacctatggtcagggtagacagtggggaaaagcaagaatttcagccctggaggcacttgctcaatatgaagtgccacagcttgagaatagtattccagatttcaagaaaatgaatttggagctgttcttttctgagacaaatcccaaagtactcaaggctatggaggagtttcatgtcaagttaataacatatgagcacataaatcgtcggagagtagtcaaggaaaaaagagttacaggaagcaagatcgaaaaattgatggatgtatttccacaggttatattctcttcaggagtgataaataaagctagagagttacctggtgcttctttattatgtttttctttccctcctaaagatatgaatgaacatctagcatccaaaaggttaagagatgtacatgctgggtatgaaaatgctctagtggaagtagctgcttctcttcagctctcaagaaatatcttgcttgcgctgatggcactgcaatcatggaaaggcttcatgcgacgttggatgaaggcttacactctgtcctatgatgctaaggcacaatcgagtgtcctagataaaacttctaaagctgctagtgatattttaaaggtcaggctgttttgttacatgctttttgtgcagagtatgatagcaatagcggatgaggctatacctagagctgctgaaaatattgcactggctattggtgcactttgtgtggttttgcctccatctgttcacatggttaagtctgctgcttcaaagttccttttggaatggttgttccaacatgagcatgaacaccgccaatggtctgctgcaatttctcttggattaatctctagttgccttcatgtaacagatcataaagagagatatcataacatcacaggacttcttgaggttctttctgatagcaaaagttcccttgtaaaaggtgcatgtggtgttggattgggtttttcatgccaagatcttcttaccagagttgaaacttctgatacctctactgtgatgaaggaaacagagtatgttccagaatctgtattactaggaagaattattagggccttagctacaatgatacaacagagaactcgatgttcttctgatgttttggacagtctatgttcatgctttccactgggttcatatgacatgagcgctaaaggatatgaacagttatctgagaacagtgaagacttggaagaagatatctggggtgttgctggacttgttcttggtctagctaactccattagcgcaatatacagagctggagagttagagactgttatcaagataaagaacttgttaatgtcatggcttccatatttgcattcactagttgaaagcagtactttccagtggaaagaatctgagcatgtcttagctctaggatcctgtattgcacttcctacagtagtggctttttgccagagaatggaattgataaatgatgttgagttggaccgcattgtggttggctttaaagagttaatttctgagttaattgctgtgaaaaagtctggcattttgcaccatagtttgctgatggcatcatgtgttggagctgggacagtactttcttgtatactgaatgaaggtgtttactctattgaggttgaacgtgttaaatgtttactggaactgttcaggaaatgttacttgaatcctttcccttttcttgtccatcttggtggcatgctaggagttgttaatgctgttggagcaggtgcaggaattttggtcaacatgaattttccaaattactctaggcaatctggctatcagaaggagtcttcttctgtcatgggccctctcctctcaagttctgattttgaaccatacttgacatcattggtgcaagagatgtttcttgtggcacagaattcggataatcatcagctacaacagtttgcttcctgggtacttgccttccttcgacatcatttatggtccaaggaacttttgggggttgatagtgataggagcgtggccgcaactaattcaaaatctgtttctcagagtttttcggaggacaatattgttttgaagcttagtttgtggcttacgagtttcaaatatactgagtctcttctcattgttctcatttttggtcttttccaagtccagccaggtactattgtacatattagcagagtcattgctgtattaaggtgcctttctacagctcccaggttgccaagcttggattgggggtcaattattaggcgttgtatgagatatgaggccaaagttgctgagttgttaccaaaagattctgcttctaagaatggaactctaagggaggaatgcataatgtttgcaatggcccatgcaaatcaatttgattcactgctaacatttcttgatgagctatctgacttttccagattcaggacacttgaaataaatttgcagtcatgtctgctaaatcatctagcagaccttgtaaaagtatattcaaactccaggcttgagaaactatttggagatgtgagtaatcacttgtcttcctttacttcatacaaagagtctagcacctaccccaaaagcttgttatgtatttcgtgctggaaaggtctctacgagtgcctagatgaagtttctgtggactcatctggttacatatcccatattgaaaggtgtatggaggttctatttactctattgccagtggttcaatcttctggaagtgtatcatctgcggatgtaagttctgtagaggaatggtctgaagctgtaagatgcttagggaaggctccgcagatttggctattggattttcttaaggtttcacatgaggagtttgttcagagtgctggcaaatctattgaagtccaaaaaaaggtttgtgctaagatcaaactagtgaagactggttctctttcactgactgaacttggaaaaatgaaatcttacatattgaactccaaatcacaaggactctgggatatactctttgaagttgtggcagctttgtaccatgcggagggaagtgtaaaaaaacagtggcttattgatgctgttgaaattagctgtgtatccagttttccttccacggcactgcagtttcttggtctgttgtctgctgcctgctgcaaatatatgccctttatgattgtggaccaacaaatggtactgaatgatctaccagtcacccttgtgtctcttctggcagaccaaaactggaatgctgttgcagaaactgttgtgtcccacttcttctcatcaacagagcgcatatatgactggtctgtacaaatagcagatggttcttatattcctgattctcaacccattgatgggagtgagaatcatatggctgtttttctattgcaagtgatgcatcatacgtgtgtattacttaagagctacttgccattagataagcagcttaggctcgccagcatggttattacttga

SEQ ID NO: 91463 - DNA, 799 bp, Glycine max
  Peptide Sequence Number=SeqID_208241
atggctttgcctttttggcaagcttcgggaggaacctggacaaggatgctagcctatcattcagcttctaaacttcttggacctgaggaacttgcctcagcctaccccgaaagtgcatttttcggggttgcggcgcatgtcatatttacggagttccccaaagacttcttccaggcccgtcacatggtatgcgtctttggggcacaccctgttcagatcaatgtagttgatgcacattttccatttgccgttggcctttttgaccatgacaacattggcgagccaggtagaaaacctgacttctctgatgaacacgttggcgatgtgccggtgctcataactggtgaggtccctactgagccacgtgcattgtccgggtttaggtctgagttgcagcttgacaagcccttcgatgggtttcgggcctcttttggaagtgtcatctcacggatctatgtcaaatccatcgcccaggcttgcttggtagacggtcagggcttggatttgagacccttcgtccatgcttatgacttgagtgcctttagccgttgtggggtgaggcatgccttgacgattacgatttcccttatcaaggtagggaatttcattttcaaatgggctcctggagagcttgccttaactgaaggtggtcatcaagtccacaagcctctggatatcaatggaactgtcttggtcgataaggaccctgtacaccatgaagtttgcaataatgatggagacgaccacgaggccgtcttggttgacggggttgatgcccttgaagtccctatccgtaaag

SEQ ID NO: 91464 - DNA, 318 bp, Glycine max
  Peptide Sequence Number=SeqID_208242
atgaagcgtaataagttggttcagcacaagtggaagaagaagctttttgctttgatattggtggtgttttgtctaggaagcttgttgtttatgcagacacgttaccatcatgttgcggggttggtttcattgcaacaccgttttgtttctgagcctgaggttcaagttgttattgatctctatatctttgggatcagcaaggttttaaatatcggtagcagttgcgttgtggtcgcatttgttgatattgcggcaaattgcggacaaaggtggctaatacggtcccaattgcggtcgttggcacttaaaaaaccttga

SEQ ID NO: 91465 - DNA, 2046 bp, Glycine max
  Peptide Sequence Number=SeqID_208243
atgtcaggtggtggaggcagcatagtgtggttcagaagagatctgaggatagaagacaatccagcactgacagcaggagtgagagctggtgctgtggttgcagttttcgtatgggcacctgaagaagaaggtcaatactaccctggcagggtctctagatggtggctcaagaacagtttggctcatcttcattcctctctgaggaatcttggcactcctctcatcactaagcgatccactgacactctttcttctcttcttgaggttgttaagtccactggagccactcaacttttttttaatcatttgtatgatcccctgtcacttgtcagggatcaccgagcaaaggaggttctgactgctcagggcataacagtacgttccttcaatgcggatttattatatgaaccatgggaagtgaatgatgcacatggccgaccattcacaacttttgctgctttttgggaaagatgccttagcatgccttatgaccctgagtcacctcttctcccacctaaaaggataattccaggtgatgcatccaggtgtcctagtgatacattgctgtttgaagatgaattagagaaggcaagcaatgcacttcttgctcgagcatggtcacctgggtggagcaatgctaacaaggcattgacaaccttcataaatggtccactgattgagtactcaaaaaaccgcaggaaagcagacagtgcaactacctcacttctgtccccccatttgcactttggtgagttgagtgttaagaaggtcttccatcttgtccgcatcaaacaagttttgtgggccaacgaaggaaacaaagccggcgaagagagcgtgaacttgttcctcaaatctataggtcttagagaatattcaaggtacattagtttcaaccacccctacagtcatgaaaggcctcttctaggccaccttaagttctttccttgggttgtaaacgaaggctattttaaggcatggagacaaggcaggactgggtaccctttagtggatgctgggatgagggagttgtgggccactggttggctgcatgatcgaatacgtgttgtagtttccagtttctttgtgaaggttctgcagcttccatggagatggggaatgaaatatttctgggacacccttttggatgcagatcttgagagtgatgctcttggttggcagtacatatctggtagtctccctgatggtcgtgaaattgaccgaatagataatccacagtttgagggatacaaattcgaccctaatggagaatatgtgcgacgctggcttccagaacttgcaagattaccaaccgagtggatacatcatccttggaatgcaccagagtcagtgctacaagctgctggaattgagttaggatcgaactatcctcttccaattgtgggaatagatgcagcaaaaaccagattactagaagcgctatcagaaatgtggcaacaagaggcagcttcaagagctgcaatggagaatggaactgaggaaggacttggagactcttctgaatccgttcctgctgcttttcctcaagacatgcaaatggaggaaactcatgagcctgttaggaacaatccccttcctgttgctcggcgctaccaggatcagatggttccaagcatcacttcttccttgttgagagtggaagaggaagaaacttcttctgatcttcgacactcggcagaagagagcagcagagctgaagtgccagtaactgcaaatgcacaacaaaatgtaggagttacattgaatgaacggatgctgcagaccactaataggaatgcacaaacacaatacaatactacaatggagctgagaaatgtagctgaagattcagcagtagaatcttcaagtggtaccaggagagaaagggatggaggtgtagttccagtatggtctcccccagcttctagttactcagaacaatttgtaggagaggaaaatggtataacaaacagttcatctttcttgcaaaggcatcctcagtctcaccaaatgctgaattggaggcagctacctcagactgggtaa

SEQ ID NO: 91466 - DNA, 471 bp, Glycine max
  Peptide Sequence Number=SeqID_208244
atgcacagtactcttacatatttgtcactcacggagtgggcacatactgaagtctcggttcgtgcttcctcgtcggagggtactcgccgtgatgcttctaacagcgagtcctccttttcagagagggtgagggccttgcaccgtgttggtaggggcacttctcactctcacgggagggcacaacttttcgttgctgtcggggagcttgtcatggttactgtgatcctccccccttatgcttttaggggtgtgaggagaggtagtggtggtggagatgtcaaggcgtctccccgcatgcgacgtagccatagtgctcggtcgctgtcgtccacccctgccgtcattggatatgagggtgtcgctgcgcttcagcgccagatgaagttgacgagtcttgaggactcctgcaagttggccattcaggcttgcgggagtgatgacttctcgttcttgaggacgatgcctaattga

SEQ ID NO: 91467 - DNA, 387 bp, Glycine max
  Peptide Sequence Number=SeqID_208245
atgagttttcttttcataccaaagcaatttttttatgaatatagacttggggctgagcatgggttgagttcggtcggatttgggctcaaaaagtccaatccacaacaaccgaacccttcctattttgatccgtctttgactgtatatctcatcgggttggacgaaagggatgatggccatggagggtctagaacggaaacaagaggcatagaatctagaacgaaaacaagaaatgagaaatgggaaaagaggaaaaccagacaaagaggaaatcaggaaaaccaggggtacaaaaagaaagctgttttagaataccagagatgcaaaaccatattgaagaaagtgctggactggatgagtgatcgtgaaatgacacctatgaactga

SEQ ID NO: 91468 - DNA, 333 bp, Glycine max
  Peptide Sequence Number=SeqID_208246
atggacgatgacccactaagaaataaagaattatcctttgggaaggaaaaatcttacagaacaccttttctggagaaggagtcacttaccttcatggaagaaggaaagaggatgagggagtgcaagaatgagggggtggggcaaggaagagtcgttgcgggagggaggggtgtcgtcaatgtgggtgtgtcatcaaagaaaggatgtcgtcgttgtgggtgtgccgtcgaagaaggaatgtcatcgcatgttgagagaaaggaaaaaggaggtgttaggattgagagatacgaagtgaaaatttcaataaaagtattattatatttttactga

SEQ ID NO: 91469 - DNA, 1020 bp, Glycine max
  Peptide Sequence Number=SeqID_208247
atgcagatggataatgctttgattgatgatcgaaggatacacgtggattttagtcaaagtgtgtcaaaactgtggtcacaatacaggcggaaagaccaaaagggtaaaggtggtggttgtttcaaatgtggttctacagatcatattgctaaggattgcactggagattctacaatgaaacaaccacaagcaaaatacatcttaaaggatgataatgcccaacgtggtggagataatgcgagatatgaaatggtttttgatggagataactcacaaagtccaaggcgagatataaaacaccaatggcatgatggtgacctggttgaaagaaaagatcatagaagtcgtagagaacaggatatggtagactcaaacaacagagataggtatggtgatagaagcagaggacatgggggaaatggagacaacaaagcacggtctgaaagaggtgcaagagatttgggttcccatgctgacacgaaagacagagatagacacatgggaagacatggagatgatgattacaagcggaaagatgagtgtgactccagaaaaagagatgaagacgatggctacaagaggaaagatgagcaagactcaagaaaaagagatgaagacgatggctatagagaaagacgaactagtcgagatgataggagaaacatggattctagccatttggagagaaggaatgacagagattataggaagagacctgaagacagtggaaagcaagaaatgaagatggattctggacgaagaaaaggaagtccagttgatgaagattacaagaatggaagggatgatgaagattacaaacatagaagggaagaacgtgggcataaaagacaagatactaaagctgatgatgattacaagcgtagaagggaggatgtggattacaaacgcagaagggaggacggagattacagacatagaaggcaagaacgtggacataaaagacaagatattgtatctgatgattatcctcataggaggcatcatggtgataggagatga

SEQ ID NO: 91470 - DNA, 537 bp, Glycine max
  Peptide Sequence Number=SeqID_208248
agagtgaattttaaattctcacactccgacggcgttgtggattgcgtctccgtagtcaagaaccaacgcggcaagatctgcgacctcacgcatcaggcagccagcactgcgagttgccgcaccacggcaggcttcggcagagggccgattcagcggtcgcagattccggcaaattcgctgatcttaatcaacagcaccgcccagtccaccacagacggaggactaaagttaacaacaatagcgtttcttccaccgttgggcattgctgaagccgatgaggttgacgaggcgggggctggggatttgggagaggatcttgatctcattttcggtggggctggtgcagttgccgcagtcggtgcatttggtggcgtggtttttagaggtgctggtggcgacaagtttggtcgtttggatggcggcgaggagcttgacggcgtccagggtggctctatagactctgccgtggctgccttggcccaggaaggtgtcggaggagaagccattggcggcggcgatgatgttggaaatggatag

SEQ ID NO: 91471 - DNA, 441 bp, Glycine max
  Peptide Sequence Number=SeqID_208249
atggaagttacttcgttgttttatgagatctgttccttgttacaggtttttggcgaggtagctgaaggatttgagactttaacgagaataaatgaggcttatgtggatgagaagggaagaccctataaaaatataagtagaatcaagcacacatacatcctggaggatccttatgaagatccttctcaactatctgtgttcattcctgatgcttctccagaaggaaaacctaaagatgaggttgatgatgaagtgcgacttgaagatgattgggttcccatggatgaacaattaaatccggcagaacttgaggaggttattagatcaaaggaagcacattctagggcagttgtacttgagagtattggggacattcctgatgctgagattaagcctccagacaatgtattgtttgtctgtaaattgaacccagttactgag

SEQ ID NO: 91472 - DNA, 450 bp, Glycine max
  Peptide Sequence Number=SeqID_208250
atgattagcggaaatgaaattttatatagggcaggaaacaacttcgacacacgaaaaacctttcagtcgttgtgtcccaataagccagtaagggaggagataatactattcatggctttgaaggttgcttacagtcaactctaccgcactaggattgtttggtgtatgccaccagcctttgcggtggacgtcattaatggcactccagtggaaactctgattcaacattatggaaaggattggatgcctccattttccaacttgaacctgaaattgtgtttccaacacaagaattcgttattggctttgatggaatggattgttgggatattgtggaagccagaggaatcccaaattgtggatccagctagaagaaaaggtcgtcagaatgaaggtggcaatgatcgtgctgttagggacacacaaccagtgcaagggagagttgattag

SEQ ID NO: 91473 - DNA, 852 bp, Glycine max
  Peptide Sequence Number=SeqID_208251
atggacaagttatgctgttttaaggattcatactctcagcttgtagcagcacgttcttcgtccagcactggtaaggggaaaaatcatgaaggctcaataaagtatggtttcagccttgtaaaagggaaagctaatcacccaatggaggattatcatgttgccaagtttgcgcagatacaggataatgaattgggtttatttgcaatttatgatggtcacgtgggtgaccgtgtgcctgcctacttacagaaacatttgtttaccaacattttgagggaggaggaattttgggaggaccccactctttctatctcgaaagcatatgagagcacagatcaggaaattctatcacatagttctgatcttgggcgtggtggatcaacggcagtaactgctatattgatcaatgggcgaaggttatggatagctaatgttggagactcacgagctgttctttcaagaaaaggtcaagctgtacaaatgactacagaccatgagcctaacacagaacgaggcagcattgagactagaggtggttttgtgtctaacttgccaggtgatgtgcctagagtaaatggaaaacttgctgtttctcgtgcatttggagacaagagtctcaagtcccatttgcgatcagaccctgatgtacagaatactgatgtagatgttgatactgagattctaatccttgcaagtgatggaatttggaaggtaatgactaatcaagaggcagtggatatcgctagaagaacaacgagagacccgcagaaagcagctaaacaactaacagctgaagcattaaaaagagatagtaaagatgatatatcttgtgttgtggttaaattcagatga

SEQ ID NO: 91474 - DNA, 996 bp, Glycine max
  Peptide Sequence Number=SeqID_208252
atgaggatgagggtttggggatccgagatcgtgttcgccctattgctatgtgggaccctctcatgcactgctcaagctattcataatagggtttctctctccaccaccaccaccaccaccaccatctgtcctgctcgttccctcctcgatttcatcttagggtttccagattccacctgccctcttcccaattctcttggatccattgccgtcaccgagctgtgcattggtgatgtgcagggagatgaggtttctttgcagaaggcgctgaatatggttcacaagaataatcatgaatatgtggctgtgctcttctatgcgtcctggtgccctttctctcgggtgtttagatcagttttctctgttctctctgcgctacacccttccattcctcattttgccattgaagaatcattggttaggccaagcatactgtccaaatatggtgtccatggtttccctacactgttcattttgaattctacgatgcgggttcggtatcatgggtcccggacccttggctcactcattggtttctacaatgatgttactgggattatgattgattcacttgatcagctatcacttgagaaaattggtcgttcatctgccgatgagagtcatggtaacaccgagccagaaagttgtccattttcatgggctagatctccagaaaacttactacgtcaggaaacttatttggctctggccactacatttgtggttttgagattactatacttgtttttccctacgctgcttatatgtattcaatatacttggagaagggtcatccaaaatattagaatatggagcttgcttgaacatcctttggtttatttgaagcgcctaacacagtcatttaactgtttgaaagagccatgcaagagacgtaatctgcaggaaggagcaatgaatgctagagcatgggcttccaagtcccttgccaccgtttcaattggagaggaaagcagcagccgtgggatgcatctgtga

SEQ ID NO: 91475 - DNA, 138 bp, Glycine max
  Peptide Sequence Number=SeqID_208253
atggagaagtcagaaccagaagaagaaaacgttctcgctaacgtcacctacggtgcttgttgcgtcgacgacctcggcaccgccgccctcagcaccaaaatcctctttatgcacatgtattatgtattattatattaa

SEQ ID NO: 91476 - DNA, 2592 bp, Glycine max
  Peptide Sequence Number=SeqID_208254
atggcgacgccggaaccgcaactggaacccacttctgaccaccgcgtcgactctcttccgctcgtcgacctccgcctcctctctcaacccgaactctacaccctctccctctccggcgccactcactgccatcgccgtaacagcgacgacgactccgtgattcccaaaatcgaccgttccaattttaacgaatccgccggcagccgcaaacagacctactccaaactccgcctcaacaagcgcaaacaaaatcccgcggttcccgcctcctcctccttccacattccgctccacatttcggagcccgaggaggaagaaaactcccgaattgtcgctcttctgcagcaactcttcggcgtcgagcctctccgcaacgccccgcgcaacgatgcggcggagcgccgcctcgttcccgtccaggtcgacttcaaacagccgcctccgatgttcgcggcgttccagaacgttccaattgacgtagtcgcagacagcagtcagaggaagcggaagcgcgggcggccgcggaaggacgagaattcggtgacggttttcgtcgaggaaccgaagaaggttaccaaggaggagaattctgtgacggttttcgttgaggaaccgaagaaggttaacggtaacggcgaggtgaacgcggcggtggcgacaacgacgacgactgttaacgagactgttggtttggatgaggatccgtttgaggtggagttgaagaggaggacacaaggattggagacggagccacaagtggtggaatttttggagactttgaatggagaatgggcgagtcagaggaagaagaggaggattgtgccggccagtgaacttggtgacttgttgcctgcgggatggaagatcgtgattattactatgaggagggcaggtcgtgcttccgctgtttgtcgccgttacgtaagtcctgatggacaccagtttgagtcgtgcaaagaagcttctgcatacttgctttctgtttttggtgttcaagatagaagccatttaaaatctagttattctgatggtgctcagcaattgtccagtagtatgaacagggcatctgaaagtagtgttggtcatgtccctactggagacatgaagactgatgccagtgcaagttatttgccctcagctggtgcacctatacactctagtcatgagaaacagccccccatatcatcatcaattgggagtgaaaatttcaatagtgatctggctttgggatgtaaattaggagatgctactggtggagcctttagagactttgactttcaaactgaagataaaaaactatcgaaggctgataaggatgatggaaattcagttcaggaatgttttgtggaggatagagtttgtaatgtacagagtgagaagttggttggtgctgtcgagtctagtgatgctgcatgcaatctttatattcctttggttttctctactcctttctccaataataatagtgacaatggtcaatttttagatgaaataaatgcttccagatgcatgaagggtggcattagtaattttgctagtcacgatatagatactggatgctgtgaaactgtttcttgtggaaatgagcaagcacatgttgacaacaatggacttgggctttctgtgaaattagtggaagagaacattcagaaactaagttttgaaagcagcatgctggctccaaattctgaggggaaaatacatgctggtaaaaatttagaggatggacatcttatcagttcactggaagatatggagattagagatggaaaggccattatgaatgacaaacaacaaattatttgtagcagagaccagactgaaattaaagatgtttctactgatgttaaactgcatagtagttctgagggttgttcactcgtctcatctcatcatgaacttaatacatctacaagtaatatggacaggacacagacttccgagctgaaggactctgctgaggaaaatatttttgatagtgatttatttagctcatctattgatgaaagaacacgtgttcacagtggctacattagtaatgtttcttttagctcttgcacacaggatgcatccgagtatggtggatttgattttgcttctgatcttaaattagataaggatgttagtgataatcatattctttcaaatgaggaggctgtgacaaggagtttacgggaaaggagttccttgaatgaccaaaatagcatgatggacaatctgttgcacagaagttctgaaagtaacttatttgctctaactggtaatcagcactcttgtgcgtttcatgataatgtaaatatctctgatggaacctttgatgcactcaaagttgttgatgctggttgcatggagcctcagttgggcattgtttcttgcagcaatattgctgttgatgcatatactactgctagcattatgcagggaaaaccacaaggatgtgtatctgttcctcttggtggaagtatattaaactttgagaagccaagtgatgatggtgttaataaagcaaataaatcctgcttaccagagaccgctcagaatgaagttgaaatgttccaaactgactctatgggtctgcccaaatttcggtag

SEQ ID NO: 91477 - DNA, 399 bp, Glycine max
  Peptide Sequence Number=SeqID_208255
atgacatcaatcaagcccatcatccaccaaaacccctccactacatctcctatttacatcaaacccagtaccatcaaaagatccattcttcgatcaagtcaaagagagagagagagagagagagagatagatgtagatatacttgtctgggttggaaaggggagtggagcaaagaccagagaggtgcgacgacggagacggcggaaaagccttcggagaccactatgcagcggcacgcgacgtggttctctgtccgtttgtaggctgcaaacggaacaagctccaccggcggtttcggccactgaaattggtgatttgcgtgaagaaccacttcaagcgaaaccactgcccaaagatgtacacgtgcgagcggaactcagccggagtgagatcggataa

SEQ ID NO: 91478 - DNA, 523 bp, Glycine max
  Peptide Sequence Number=SeqID_208256
atgaggattatggtttggggatcggagatcgtgttcgccatattgctctgtgggaccctctcatgcaccgctcaagctcatcataatagggtttctctctcctccaccaccgccatctgtcccgctcgcccccttctcgatttcatcttagggttttcagattccacctgctcccttcccaattctcttggatccattgccgtcaccgagggagatgagttttttttgcataaggcgttgaatatggttcacaagaataatcatgagtatgtggctgtgctcttctatgcatcctggtgccctttctcgcgggtgtttagaccagttttctccatcctttctgcgctgtacccttccattactcatcttgccattgaagaatcatcagtttggccgagcatactgtccaaatatggtgtccatagtgtccctacactgttcattttgaattctaccatgcgtgtccggtatcatgggtctcggagatttggctcgctcattggtttctataatgatgttactg

SEQ ID NO: 91479 - DNA, 1287 bp, Glycine max
  Peptide Sequence Number=SeqID_208257
atgaggactaaagctcatcaacccggcctcaacttgaagctcctcattgtagcggtcttggttgccattaccctcctatttgtgctaattagatcatcaaacacgaaaggagtgaagcagcaagaggcattattagtaaagagtgatgggagttgcaacaagatgaagataccgggatcggtgtcggaagcactgatccactactcaacatcaagcataaccccacagcaaacggtgaaagagatatcagtgacagcaagagttctggagaagaagtcgccgtgcaatttcctggtgttcgggttggggcacgacagcctgatgtggaatgcgctgaatcacgggggaaggacgatattcctggaagaagacgagtcatggattcagcaaatgaggagaagatttccaatgctggaggcgtaccaagtgaattatgagagcaaggtgaatgaggctgagagcatgatggaggttgggagaggaggagaatgcagggcagtgggagatccgaggtactccatatgcccacttgccttgaaagggttgccgagtgtagtgtatgagacgaaatgggatttgataatggtggatgcacccactggctattacgagaatgcccctgggaggatgacagccatatacactgctgggatgatggccaggaacagagagagcggagagacggaggtgtttgtgcatgatgtcaacagagtcgtcgaagaccaattctccagggccttcctttgtcaaaacgattacctgttcaagcttctcctaatcggagactcttccgttggaaaatcctgcttgcttctcagattcgctgatgactcctatgtcgacagctacataagtaccattggagttgatttcaaaatcagaacggtggagctggaagggaaaaccgtcaagctgcagatttgggatacagctggacaggagcgattcaggactataacaagcagttattatagaggagcacatggaattattattgtctatgatgttactgagatggaaagctttaacaatgtcaaacagtggttgaatgagattgacagatatgcaaatgactctgtatgcaagcttcttgtggggaataaatctgatctcgttgataacaaggttgtagactcattaactgccaaggcatttgcggatgagcttggtatccctttccttgagacaagtgctaaagactccatcaatgtggagcaggctttcttgactatgacagctgagattaagaagaagtatctaattctagtttcccctgttctcatttag

SEQ ID NO: 91480 - DNA, 771 bp, Glycine max
  Peptide Sequence Number=SeqID_208258
atggtgaagttccgttgttgtgttgtgtgctgcaacacaatcggtggtctgagaaatcttgtttgtgttgggtttgttatggctcggagagcagaggaagagtacgattacctgttcaaggttgtactgatcggtgattccggtgttggaaaatccaatcttctgtcccgattcactcgcaacgagttttgcctcgaatccaagtccaccattggagtcgaattcgccactcgcactcttcagggtggaaatggaatagctatgcctatggctctggtggtatcggtggagggaagaactgtgaaagctcaaatatgggataccgccggacaggaacgatacagagcaattaccagtgcatactacaggggtgcccttggagctcttctagtctacgatgtaactaaaccaaccacattcgaaaacgtcagccgatggctgaaggagctaagggatcatgccgatgctaacattgtcatcatgttgatagggaacaagaccgatctcaagcatctcagagctgttgccaccgaggatgcccagggttattccgagaaggaaggcctttctttcatcgagacttctgctctcgaagcaactaatgttgagaaggctttccagactattcttgcagagatataccgcattatcagtaagaaatcactctcttccaatgagcctgcatctgccaatattaaagaaggcatgactatcactgttgggggaccccaatccaacgcaagcaagccttcttgctgtacatcatcttga

SEQ ID NO: 91481 - DNA, 393 bp, Glycine max
  Peptide Sequence Number=SeqID_208259
atgttaaactctttattcaatttgatccttgataagaaccttgggagagccacaccacaaaagctagctgttgtagttggagagccccttgtaaaccccacactaaaatcccatacttccaatgcgggactcaagtcccataccttgcaattgcatcctaacgttccaccatgctttccagtcccagtgcctatgcagactggctatgcactagcctgctttgatcagtctcaggtggccccatacagattggtattggcagcagtgctaaataggcttgctttctggtgccttcatggccttgaggacttggatgctgctgcgtgcctctataccaccattaggccaagcttcttaacattaacacccaagcaacataatcagtctaattaa

SEQ ID NO: 91482 - DNA, 225 bp, Glycine max
  Peptide Sequence Number=SeqID_208260
atggggtttctgttgttggtgaggctggttttgttaagagatgaggcattgaggcagtggcacagtcaatggtttcgatggtgtagagtaggagatgacatcaatgcctccaattcagtgggtgattcaattgtttatgcggttccagcaacgagccgtgaaacaaagggaaggcagtggtcgaagttccaagtagaagatgacagagtgatgaagatgatttag

SEQ ID NO: 91483 - DNA, 723 bp, Glycine max
  Peptide Sequence Number=SeqID_208261
atgaagggtgcgttggatcggacgaaggtggtgctccgccacttgccgccttctatttctgaggccgcccttttggcccaaattgatgccgccttcgctggccgctacaactggctctctttccgtcctggcaaaatcagccagaagcatatctcatattctagagcctacattgacttcaaaaggccagaggacgttatattgtttgccgagttctttaacggacatgtctttgtgaatgaaaagggatctcagttcaaagtcattgttgaatatgctccttcacaacgtgttccaagacagtggtctaaaaaggatggtcgtgatggaaccatatataaagagtcttttcttcttgataaatataagcatttacatggtgaacttctagattctgagtatctggagtttcttgaactacttgccaagcctgttgagaatcttcccagtgctgagatacaattggagaagagggaagcagaacgatctggtgctgcaaaagatattcctataattacaccactgatggactttgtgcgccagaaaagagctgccaagggacctaggaggttactgtcaaatggaaaagtgagtcaaagagctggcacttcatcaaatgggagtcctagttccgtcacatcaagacgtggttctggaaagaagagggtttctgctacaatggtattatgcatttttttgaagaggaaagttaaatatggctaa

SEQ ID NO: 91484 - DNA, 711 bp, Glycine max
  Peptide Sequence Number=SeqID_208262
atggctgagagttttttccagttccctccagatcgccataggtatttggcccaactactcgctgagaggcaaaacttggttccctttctccaagtcctcccacattgcactaaactccttacacaagaaatcaggcgcatgtccgttgctggctttaatcatgctttcatttcgatggatggccaattgagctcatccccaaaggatggcattgggacacaaggacttcctactactcctgtagtcaagagagttatcaggcttgatgtccctgtagacaaatttccaaatcttttactctccttcaactctcagcagtttaattttgttggccgaattctcggacctcgtgggaactccttgaaaagagtcgaagccatgactgaatgcagggtttacattagaggctgtggctctgtcaaggattctattaagaaaaacttaaagataaacccggatatgagcaccttaaagaaccattgcatgtgtgagtttccagaggatataatcaatgctcgtttggatcatgcagtggcaatactagaaaatcttttgaagcctgtggatgaatcccttgatcattataagaagcagcaattgagggaattggctatgctcaatggtactttgagagaggaaagtccaagcatgagcccaagcatgtccccttttaacagtactggaatgaaacgagccaagacaggaagatga

SEQ ID NO: 91485 - DNA, 552 bp, Glycine max
  Peptide Sequence Number=SeqID_208263
atgactggcccgtatgttgcaagggacccagggaaaaattctactatcaaagacaaatcaactttggttcctaagcaaggtgatcagcatctttcagataaagcttcaaacatggcttcttcagatgcaaatctaacccttgatgagaatggagtttctggaaatcatgatgctgggaagaaaaaagtactgcttcttaaagggaaagaaagagaaataattactgtatctgatttagatagcatgtcacagcatcacaatgtaacttcttcagctaaaatgattgttggttcaacagttttgaaacagagtcagcggcatgaaggtagtggaaggattatcagaagcatactctcaaaaaaggagttgcgtcaaagccagtattccagggccctctctgagcagcaaatccaaacatccaatttagaaaaagaaaaacagcctcctcgccccttacatgtccaactaattttgaagggctctaatgggacaccagagaataagattggtgtgcatgattcacatgtttctagtgagaggcaggagagacat

SEQ ID NO: 91486 - DNA, 231 bp, Glycine max
  Peptide Sequence Number=SeqID_208264
atggttggtttctacttaaattttacttgtgtctatttaggtttcaataagcattttggtcgtcgtggaccatcacatggggtaaaggatgttgatggctattcagtttcaagtgaagggaagcatcctagaagatctagtacatctgcttatggttccaacgaggtccctaaatttgatttctccatggcagtacacggcatattcttttctggttcaataattgattaa

SEQ ID NO: 91487 - DNA, 285 bp, Glycine max
  Peptide Sequence Number=SeqID_208265
atgccttcttcccttttatgcaaattctatttggactttagtccaacctatgttggatgtggtcttatctgtactcacctagtcaattgttctgttttccttggagctattatatcatggggctttctgtggccttttgtctgtgagcatgctggcaactggtatccagttgaccttggtagcaatgatttcaaaggtctttatggatacaagagagatcctaaaattggtgaacttgaagccctgtcttttgattttaatctatgtcaagctgtggctacatag

SEQ ID NO: 91488 - DNA, 360 bp, Glycine max
  Peptide Sequence Number=SeqID_208266
atggcatgtctatggcttcaacactataaaagttccaagaaggatgtgaggaaactctatgactctcaagtagttgtcgtggaggaagaaaatcataagataaaaatgtgtgttatttggaacttcttgatgttaaagtcattttctcaagttctgaaattcaatgtcactgaaaatttctatgaccttgtttccaatgcttttaagctaagccatgtgaaaacacttgtcgtggcagtactatgcatggtttgcagtcagggatctgatgcattctcacaatctggtatatattccaatcaccaagacattggaccacgctatgtgatcgaggccatacccaaatcaaataaacattaa

SEQ ID NO: 91489 - DNA, 393 bp, Glycine max
  Peptide Sequence Number=SeqID_208267
atgaatgggtattcgaggattagcggcgatgatgacagcagcagccggagatccatggatcatgagggagagagatttggagtcatactgggaaggagtgcttcagtgtcttcttcatctcagtttcagagggctttctcaatgacaagatcttcatcggtttcagaaagataccgcaggatccacgaccaggaggacacgccaataacaacatcaccttctattgcctctaagaagaagcagagaggaggcgccaataagatcctcaaagcctcaagatctgtcgtattcaaggtgtctcacgactcatatatacatggaatcaccataacaatcattactggtagagatgtacatctctggttggatagtggtgaaatcactaatgagtaa

SEQ ID NO: 91490 - DNA, 2070 bp, Glycine max
  Peptide Sequence Number=SeqID_208268
atggcttgctcaagcgcccaaatacacggcctcggaaccccttccttttcccgaaccctatttttaggtcagaggctaaataccaaggccgcctttatcaaggtcaagtccgcacccactcccaggaggctccgccctctcagagtcgttaatgagaaagtcgtcggtatcgatttgggaaccaccaactccgccgtggccgccatggaaggcggtaagcccaccatcatcaccaacgccgagggccagagaaccactccctccgtcgtggcctacaccaagaacggcgacaggctcgtgggccaaatcgccaagcgtcaggccgtcgtcaaccccgagaacactttcttctccgtcaagaggttcatcggccgcaagatgtctgaggtcgacgaagagtccaagcaggtctcttacagagtcatccgagacgacaacggcaacgtcaaactcgactgccccgccattggcaaacagttcgctgctgaggaaatttctgcccaggttcttaggaagcttgtggatgatgcttccaagtttttgaacgataaggttaccaaggctgttgttactgtgcctgcttacttcaatgactcccaaaggactgccaccaaggatgccggtcggattgctggtcttgaggttcttcgtattatcaatgaaccaaccgctgcatccttggcctatggctttgaaaagaaaaacaatgaaacaatccttgtttttgaccttggaggcggcacctttgatgtctctgtgctcgaggttggtgatggagtgtttgaggtcctctctacttctggtgacacccacttgggtggtgatgactttgataagagaattgttgattggctggcttccaacttcaagagagatgaaggcatagaccttttgaaagacaaacaagctcttcagcgtctcactgagacagccgagaaagcaaagatggagctctcaacattgactcaaactaacatcagtttgccattcataactgccacggctgatggacccaaacatattgagaccaccatcacaagggctaaatttgaggaattgtgttcagatcttcttgacaggctcaggacacccgttgaaaactcattgagggatgcaaaactctcgtttaaggatcttgacgaagtcatccttgttggtggatcaacacgtatcccagctgttcaggagcttgtaaagaagttgactggcaaggacccaaatgtcactgtcaatccagatgaagtggttgcccttggagctgctgttcaggctggtgtcttggctggagatgtcagcgacattgtgctgttggatgtcactccattatctttgggtctggaaactctaggtggtgtgatgacaaaaattatccccagaaacactacccttcccacctcaaagtctgaggttttctcaactgctgctgatggacagaccagtgtagagatcaacgtccttcagggtgagagagaatttgttagggacaataaatcacttggtagcttccgcctggacggtatccctcctgcacctcgtggtgttccccagattgaggtgaaatttgacattgatgccaatggcattctctccgtcgctgctattgacaaaggcacagggaagaagcaagatattaccattactggtgctagcaccttgccttcagatgaggtggagagaatggtaaacgaagctgagaaattttcaaaggaagacaaagaaaagagggatgccattgacacaaagaaccaggcagattctgtggtgtaccagacagaaaagcaattgaaagagcttggagataaggttcctggccctgtaaaagagaaggttgaagcaaaactaggggagcttaaagatgcaatttctgggggttcaacccaagctattaaggatgccatggctgcactgaaccaggaagtcatgcagcttggtcagtccctttacaaccagccgggagctgcaggtgcaggagggccaacaccacctggtgccgactctggcccctcagaatcctcaggtaagggacccgacggagatgtcatcgatgcagatttcaccgactctaaatga

SEQ ID NO: 91491 - DNA, 1815 bp, Glycine max
  Peptide Sequence Number=SeqID_208269
atggcacttaaagttcctgctcgtaaggctgccgagattgcaattgggtccatcggccgtggttatgatatatcacttgatataaggcttaagtattgtaaaggagattccataaattcacgtttaattgagatagatgaaaatgatgtaagagaggtggtactacctggtggagtttcaataccaaatgtttccaaatcaataaaatgtgataaaggggaacgcacacggttcaggtctgatgttctgtcttttcaacagatgtcagagcaattcaatcaggagttatctttgactggcaagattccctcaggtcttttcaatacaatgtttgaattttctgggagttggcaaagagatgcagcccatacgaagtcccttgcttttgatggggtgttaattacactttacactgttgcattagagaagtctcagatggtcctcagtgaccacgttaaaaaagctgtaccatcatcatgggacccacctgcattagcaaggtttattgatacctttggtacccatataattgttggtatgaaaatgggtggaaaagatgtaatatatttgaagcagcagcactcatcaactctccaacctgctgatgttcagaaaaaattgaaagagatagcagataggaggtttctagatgccaatggccactatagcattgcttctgatcaagttttccctgatgacaagttcagaatcagggagcagaggctaacatttgctaatattagtccatcaagttcttattcacataaggaggatattgtaagcatttgcaagaggaggggtgggagggaggacagaaatatatcccataatgagtggttgcaaactgttcagtcagagcctgatgtgatctcaatgtccttcattccaattacgtctctattgaatggagtgccagggagtggattcttgagccatgccataaacctttatttacgatataaaccaccgattgaagagctccaccaattcttggaattccagctgccaaggcagtgggcacctgtattcagtgaccttcctcttggtccacaacggaagcaaaggagttctgcatctttacagtttagcttcatgggcccaaagctttatgttaacaccacacaggttgatgtaggtaagaggccagtgactggtctccgtctttatcttgaaggtaagaaaagcaatcggctagctgtccatttgcaacacctttcatcacttccaaaaatcttccagcttgaagatgatccaaatgaaaatgttcggcggaagtcttatgataggagattttatgagaaggttcaatggaagaatttctctcatgtgtgcactgctccggtggaatctgaggaggatctttcaatagtaaccggagcacaattgcaagttgagaattatggcataaaaaatatactcttcttaagacttcgattctcaactgtgttgggagctaaagcagtgaagcatcctgagtgggaggggtcgcccaagttgggagccaagtcaggactcatatccactttaatcagccaacatttcacgacaacatttcagaagccacctccgcgaccagcagatgttaatataaattctgctgtctatccgggtggccctcctgttcctgtgcaagctcctaagcttctcaaatttgttgacacaactgagatgaccagaggaccacaagagtctcctggctattgggttgtctctggagcaaagcttgttgttgataagggcaagatttctctccgggttaagtattctttgttgaccatggtattaccagatgaagagatgttggatgatcaatag

SEQ ID NO: 91492 - DNA, 807 bp, Glycine max
  Peptide Sequence Number=SeqID_208270
atgggggacgagtcgcccagaaacaaagtgaagttcctatgcagctacggcgggaaggtccttccaagaccctccgatggactcctaaggtatgttggaggcgagactcgtgtggtttctgtccctcgtgagatcacatttcccgagctaatgaagaaggtgagtagcatggtggagggagtcggagatatggttctaaaataccagctgataccagaagatctggacgcattggtgtcggtgagaacagaggaagatgtgaagcacatgatcgaggagcacgatcggcaccatactggagccttactccgtgcattcctctttcccccttccaagcaaacaggtttggttgcgtgcgaaccgtatctgttggagcagcgctacatcgacgccataaatgggatcatccgagcaagccccaggaagggctctgcctgctcttccccaaaatcaaactcccccgatgcatcccctcgcttttccaattcaaattcattgcatagagtccaaagctctcctaccctcaccgaccttggtgtgtttttggatcatcagcatcaaggccaacaacagcaatatcatcaccctaattttcatttttctagacccccccaggatcctcaacggcttggtgcaggaagggttccctcttttaactatcattactcaaacatcaccagacaactcacccacagaggagacagaggaggaggttacgcctactatgatgactctccgccatcctatgcccatgatagaattcatagtgtgtccaggagtcctagaagaaaatctatctgggaatga

SEQ ID NO: 91493 - DNA, 180 bp, Glycine max
  Peptide Sequence Number=SeqID_208271
atgaatgctagagtgtgggcttccaagtcccttgccaccgtttcaattggagaggaaagcagcagcagccgtgggacgcatcagatcatcttcacaccctctggcctcgtgcttagtgaggaatggaaagtctttgcagtaacgtgctttagagagactaggaagacagcatcaaactaa

SEQ ID NO: 91494 - DNA, 1417 bp, Glycine max
  Peptide Sequence Number=SeqID_208272
gatgatgatgcttgatgaagagcaaatttcctttcgttcagcctctcttatgtttgatggtgttgaagactactcacatcaaatcgcagaaatgattggactcagaaatgaatctagcttcatacaagctggggttagaaccatactggacattggctgtggttacggtagctttggagcacacctctttcagagtcagcttttaactatgtgcattgcaagctatgagccttctggcagtcaagttcagcttacacttgagaggggtcttcctgctatggttgcttctttcacttctaaacaattgccatatccatctctctcctttgacatgttgcattgtgcaagatgtggcattgattgggaccgaaaagatggcattctcatgattgaagctgatagacttttaagaccggggggctactttgtctggacttcaccacttacaaatgctcgtgacaaagacagtcagaaaagatggaagttcatacaaagttttgctgaaaacctttgctgggatatgctgtcacagcaagatgaaactgtcgtatggaagaaaactagtaaaaggaattgctatagttcaagaaagaatagttctccccctcctttatgtggcagaggctatgatgtggagtctccgtattatcgagaactgcaaaactgcataggaggaacacatagcagccgctggatttctgtccaagagagggaaacttggccttccagagatcacttgaacaaaaaggagcttgcaatctttgggttgcaatctgatgaatttgctgaggactctgaaagctggaaagcagcagttcgaaattattggtctcttctgtcacctttaatattttctgatcatccaaagagacctggtgatgaggaccctccaccaccttataacatgctaagaaatgtgctagacatgaatgctcatgttggtggttttaattctgcaatgttgcaagctggaaaatccatatgggtaatgaatgtggtccctctgagtggactcaactatcttcccttgatccaggatcgaggttatgttggtgttttgcacgattggtgtgaggccttcccaacgtaccctagaacctatgacttggtccatgcagcaggacttttatcccttgaatttgctcagcagcgcagctgtaccatgcttgacatgttcattgaaattgacaggttacttcgtccagagatagcagttgcagagttgatctttgctgtcaacattgagatcctgccgaaaggttggattataattcgtgacacagttcctttaatagagtcagcaagagctctaacaacaaggctaaagtgggatgcgcgagttgtagaaattgaaagtgacagcgatcagagactcctgatctgtcaaaaacctttctttaagagacaggcaaattaa

SEQ ID NO: 91495 - DNA, 678 bp, Glycine max
  Peptide Sequence Number=SeqID_208273
atgtccaggcctctgcaccgaggggtatctattcggatccctgatagcaacaataatgacttgtgggactctcaatccaaagataaaacagaaaaagaaggtttggatagaagaggttcctttggtcacccctcacccttgaggtctccctttaagttgcttttttcggataattctaattccaaatatggcatcggtgagaatggtttctcatctgatcccttcattattggcactccaagaagtaggcacaagttggttcttcttttcttgaagtttagtttagtgtttatagttattcttgctcttgctggatctttttggtggacaatctcaatttcaactgcatcaagaggtcacatttaccatggttatagaagactccaagagaatcttgtatcagacctgttggatattggggagatttcttatgctccctcaagactgaaagaattggaattctgttctgaggagtttgaaaattatgttccttgctttaatgtttctgacaatctagctcttggtttttctgatggaaatgagtttgaccggcaatgtcaccatgagctcaggcctaattgtttagttctctctccaccaaattacaaaattcctcttaggtggcctactggaagggatattatctggattgctaatgctaaaataactgcacaggag

SEQ ID NO: 91496 - DNA, 330 bp, Glycine max
  Peptide Sequence Number=SeqID_208274
atgttgcttcttttagttcttccggttcttgtttcctcttcttcgtcagcgacaccgcgagccaagcttcttcttcttcttctccgcgagcgagccttcgagaagacgagggtagaagacgctggaagaaatggggaaatggggcttatggcggcggctttcagaagatctgttaagggatcttccggaacttccggaagaagctgttccggaaaaattccggaagaagtgttcttccgaaagaaaccaaaggtcttccggaagtcttccgaaaagtttccgaaagaagtagttcttccaaaagaattctggaagaagggttcttcctga

SEQ ID NO: 91497 - DNA, 252 bp, Glycine max
  Peptide Sequence Number=SeqID_208275
atgagttcaccacctcaacgcaggaacgattatgagaaagagcatgatagcacatgcaatcatttgggctacaaaaacaaatgtccttcccaaaatggttcgcgctctagccctccccaaaatgttgatataggaggtagtttgggctataggcaagatcctgcagggaaaacgggttctaagggtttattcatagggggaacttatgtgcatgttggaagaaatttcacaaaaagttctactattggttaa

SEQ ID NO: 91498 - DNA, 507 bp, Glycine max
  Peptide Sequence Number=SeqID_208276
atgaataccttaggcgacgacatgcgttactcaggagattctgaaaacaaaaggggttcccagtctacacaagttactgggataaagtctcctcccacactagctggtgacatgagctacgccgatagttcaaaagacaaaaaaggtcccaagtcttctggaaatggtactcagacacatgaagatgtttccatgcgtgacaaactcagccatacggatgattctaggaaaaaaaatgttgattgtgctttttctggttttcaagcttgcgagagttacacaccgagcaaagtttccatccgtgccgttgatggttttcacaacttgaaggagattaagaccgtggaactcgtgaaggcaattgggtgggtttatctatccttgtctggagctgatcctaggcctggatttttgttgtttgttggtaagtacagtgttctttctgtatctagttttttcagtagtgttgttcttttttggttatgtgctttggaaagtgtgaactaa

SEQ ID NO: 91499 - DNA, 171 bp, Glycine max
  Peptide Sequence Number=SeqID_208277
atgggtttacccgaagagccgtcgttctacacagagcatcttctccgacaaagaccatcgtctccgacaaccaccatctcgtgtccgttgcgtctcgttccgtttgaagccgccgccgacaaagtggggtttatgtggggctcgttgatgaagctgacttgcgggcagtga

SEQ ID NO: 91500 - DNA, 730 bp, Glycine max
  Peptide Sequence Number=SeqID_208278
aggagccacgaaccacgaaccagtgtccaccgtcgagggagcatcgtcagcatcggccgtcgaggtaagcaccactgtcctttccaccattgatgtcggagtagggaagcttggaggagcttatggatcaggtgatctgtgggttgcgacgaagaagaccgtaaagagcattcgcacgccgtcgtacggggagcgcctggaccgactccggattccggatgtctgttggatcccttatggggagcatcgggaggtccgggacttccacctcagattatgctattccggtctcttgcgctgggggcctgttgctgtttattaccgaccggagagggtcgtgcggcaatttggctacacgcagaccatttctgctcctcctgtcgattcatgggtctcgtatgatgatattcacgacaggtggatgcactacaaggatcatatcgtaccagcaagtgagccccgagtcgtccctcaggccccgcagacggatatccctcacgtgccggagtcaggagcattgtcgacatctgcggaggagcccagacatgcagtggaagtttatgatgccattgttgagaggttggagcgccatctgagtctaggggtggtcacgcctggctcatcgacacatgaggtgatcaaagaatgcctcaggttggccagaagtgtgacacaggaccatcttgtatatgttaggtctagacgcaggcggcgcacggatcagacgtag

SEQ ID NO: 91501 - DNA, 223 bp, Glycine max
  Peptide Sequence Number=SeqID_208279
agattcggtggtcccgtgttcggtatttgaagttttgttagtggctgttcttcctattttgtcggagtgttgccggaaaacacatccggaagaccttcttccggaagttactgaggcctattccggaagaagtgcttccggaagacacttccggaaccacttcttccggaataggcctcagaaacttccggaagacggtcttccggaagtgttaaattattag

SEQ ID NO: 91502 - DNA, 576 bp, Glycine max
  Peptide Sequence Number=SeqID_208280
atgcatctaggaaacacaacaactaacagggttgactctgctcattggaccttaaagagactactgcaaaatagtcttggagacctatgtagtgtttgggaagccatgaacaacatgatcacattgcaacacactgcaattaagacatcttttgagacaaaccaaggtttacctgagcccgaagtcagcataatcgaaaagatggaaaccatatccaaacggtttaaagagcttgatgtgaaaacaaaaagtgctcaaaagaaacagatgaccaaacatcaaagatcaacgaaatgtgatccatcttactatgagtatgtggatacattatattttgtgcaaaataataattcttcaatgaaacgggctacatcatcatgtgaacaaccaaaaccacaaagaaacatgcctatgttggatcaatttcatccatgcattcatgatttcattgaaaacattgttgatgtcaaacctgatgatagttgtggatatcgtgcaattgataccttattaggtatgtgtgaaggttcatggtctttggttcgtaatcatttgcttaaagaacttataaaatag

SEQ ID NO: 91503 - DNA, 372 bp, Glycine max
  Peptide Sequence Number=SeqID_208281
atgcaaccggaagaaacaaagcaaccggaagaaacaaagcagaagaaagcgaaaggcagtaaaaagaagcgaagaaagcgaaagcgcagtagaaagaagcgtttacgcttccggaagaaggttcttccggaaacttccggaagaaggttcttccggaaacttccggatgaaggtcttccggacgaagtttgtgagtacttccggaattcccaaattctttttccggaagaagtctttttccggaaactttccggaaaaacttgttccgaaaagtttacggaaatacttcttccggaagaagaattattgaagggcaattttgccacttcactgtttgctgggtgcaccaacaataatgctgggtgcacgtag

SEQ ID NO: 91504 - DNA, 483 bp, Glycine max
  Peptide Sequence Number=SeqID_208282
atggcgagtgatcaattgattgagtttgcgcggggacttgctaacagtggcaaaacctttttgtgggtcattagacctgatcttgtggatggagaaaacatggttcttccttacgaattgtgtcagagactaaagatagagagtttgtgcaatggagtgccaatgatatgctggcctttctttgcggagcaaccgactaattgtcgattctgctgcaaggaatggggtgctgggatgcagatagaaggtgatgttacgagggatagagttgagaggtttgtgagggagttgatggaggggcagaagggggaagagttgaccaagaaagccttggagtggaagaaactggcagaagatgccaccattcacaaagatggatcttcatttcttaattatcataatatgtttcgtcaagttcttttgagtgacaacaatcgaaatcaacttaaaacaagttcagtatggggtttggatttcatttaa

SEQ ID NO: 91505 - DNA, 312 bp, Glycine max
  Peptide Sequence Number=SeqID_208283
atgggtgggtgttgtgatgtggatgaaggggataggaagagaggtatatataggtccaaggaaatgtgtgtttttaactgtggagagagattaaagagtgacttttgtgcgtggggagtggttagcccctctggcatttacgagccacggcttgctgatgttggaggcgtgagagggaaggcagtggaacgcggattgaaaaagagagaaggcattatggaaataagtgaagaaggctttggggtgacaaaagcgatacagcttgggccagttgttgttgttgttgtcgaaattgaccctgggaatggataa

SEQ ID NO: 91506 - DNA, 552 bp, Glycine max
  Peptide Sequence Number=SeqID_208284
atgcaggagatgataatgaagcataagactaagagtaatgagaggtttaaatccttagaatcaatagtatcaaacctcatcactcttatgtctcaaagagctctttgcactcttccttctcaaactgaggctaatcctaagaaagaggggggtgaatgttgtgagcaccaagagtggaaagtctatggcagaaccgaagaagaaagagaaagtcactttaacactagaaaaaggctctcaataaggagagtaatgagacaacaaaaagtgggtgaaaagaggtattggcgcctcctcagagcattgtgtgatttaggtgctagcattattctaatgtcttattctgtttataagaagttggggttgcaagaacctcaacctattaacatttctattcagctcagtaagaaaaacagagatggcatcaccattcaagctcttggctatggagtgaatgattgtactagaggatcaatgcaaaaagggaaaatcaccttgttttgggatggtagattttcttccctttttcatacgtcagactcgagatgttaa

SEQ ID NO: 91507 - DNA, 345 bp, Glycine max
  Peptide Sequence Number=SeqID_208285
atgaagatgaagacgaagacgccattgaagcagctgaagctcgcggttcctgctcaggaaacccccatcacgtctttcctgactgcaagtggaacattccatgatggagatctactcttgaatcagaaagggttgcgtcttatctctgaagaaaaagaatcacggattcttggacctggtgtttttggtgccagtgcctttgatatacttagagcccttcccaactccttaattcttgttgttactaaactttcaagtgacaaggagagagtatgcttccactggagttggtttgttgtttggattgaccatgttgcttctgacagtagtgtgggatatgagtaa

SEQ ID NO: 91508 - DNA, 171 bp, Glycine max
  Peptide Sequence Number=SeqID_208286
atggccaagaatgttaatggaacatggcaagaagccatacatttgcttacactaattctcagaggaagaagatccaactctttggaaccgcgagcttcagctgcttcaatggcgtcttcgtcttcatcttcatcttcgtggttcactgatttcgctgctcttctgctttag

SEQ ID NO: 91509 - DNA, 144 bp, Glycine max
  Peptide Sequence Number=SeqID_208287
atggttactgaagaacccataataaaagataatgttagtgacttcagtgatgacgagcaacaacatgattttgatgaacatggtgaaccaaccaatcaaaggcgagagtatcgttcagcaaaatacgcaaaaggtgggagttga

SEQ ID NO: 91510 - DNA, 287 bp, Glycine max
  Peptide Sequence Number=SeqID_208288
gcagcaagccagcaagcagtcctacagatcctggcatgcgactagctgaagcagatagtccaccatttcctgatgttcattcgaaaaagcaagggacagttgctcgatcttcatctgaagctgagtatcaagctcttgcttctgccacttgtgagctgcagtggctagtatttttgctggaggacttgggagtcacttgtactaaattgccagttttgtattgtgagaattgcagcgcattacacatagccgccaatccatttggagatcaattgccacatagttag

SEQ ID NO: 91511 - DNA, 427 bp, Glycine max
  Peptide Sequence Number=SeqID_208289
atggcaaagctcactacagttcgcttgtggttagctcttgcttccaccaagaattggtatgttcatcaattggactttaacaacgcttttctccatggagagttacttgaagatgtctacatgacaatccctcaagggattgcatctcctggccccaataaggcttgcaaactcttaaagtcattatatggcctcaaacaagccagtaggaaatggtatgagcgtttatccactctcctccttcagctaggcttcactcaagctcatggagatcactctttatttgtccgatgcactcacagttcattttctgccttacttgtttacgtggatggcattgttctggttggtgattccatgcacgttttctttgagattaaggctgcacttcatcaacagtttggtattaaggaccttgcctccttaa

SEQ ID NO: 91512 - DNA, 612 bp, Glycine max
  Peptide Sequence Number=SeqID_208290
atggtttgtaaaaatcagaacaacgatgctggctcaagcaatcatggtgcagtgataaacgctcaaatggatccctttcagaaccaaaatagcccctattatgtggatccaggagagaatcccgctacagtactcgtttatactcctcttaatggttccaattatcattcatgggcctgtgtgatgcgaagagccattagcggtaagaacaagattcacttcattgatggaagcattcctatgcctgatagcttttacccatattttgatttgtgggagtgtaacaataatcttgttcattcttggttgatggattctgtttctagttctattgcacaaagtatagtatatatggattcagcggcagatgtgtggagagacctcaaagagaggttctcacaaggggatcttaagatgaatttgcagaatacttctacagaggcagatcatagcgtgaatcaaattcatgtggccagagaaagaggagatggtcacactacaaattcaggaacagaaggcttcatccatgactttttcggggatgaagagctggttattgaagaccacgctgtttctgagattccaaatagtcaaggacagtgctctccataa

SEQ ID NO: 91513 - DNA, 861 bp, Glycine max
  Peptide Sequence Number=SeqID_208291
atgccttcagatggtaaggaactggaatttgacttcttgctggacgatcttgagaccatcaaagtaattggaaaaggcagtggtggtgtggttattcagatgaatatacaagaggatattcgaaaacagattgttcaggaactgaaaataaatcaagcgtcacagtgtccacatgttgtagtttgctatcactcattctatcataatggagtaatatctcttgtgttagaatacatggatcgtggttctctagcagatgtaatcaaacaagttaaaacaattctggaaccatatcttgctgtggtttgtaagcaggtattgcaaggccttgtttacctgcacaatgaaaggcatgtaatacacagggacattaaaccatccaatctgttagttaatcacaaaggggaggtgaagattactgattttggtgttagtgctatgctggcaagctcaatgggccaaagagatacatttgttggaacttacaattacatgtcgccagaaagaatcagtgggagtacttatgattatagcagtgacatctggagtttgggtatggtagtgcttgagtgtgccataggacggtttccttatatacagtctgaagatcagcaaagctggcctagtttttatgagcttctggcagcaattgtggaaagccccccaccttctgctccacccgatcagttctcccctgagttctgtacattcgtgtcatcctgcatccaaaaggatcctcgggatagattaacatcattggagctactggatcatcctttcataaaaaagtttgaagataaagatctagatcttgggattttggtaggtggcttggaacctcctgtaaactttccgagataa

SEQ ID NO: 91514 - DNA, 141 bp, Glycine max
  Peptide Sequence Number=SeqID_208292
atggcggaaagggcgaaaccgatcgacttcgaactcaccttaaagcctttctatcagagagcctcagaagcagagaaggggtttgaaattggagtgccatttgtgtttgctcagccttacaattgtgcccccctcctatga

SEQ ID NO: 91515 - DNA, 948 bp, Glycine max
  Peptide Sequence Number=SeqID_208293
atgttaattttaaggttggcaatttttgtggcctcccttgtagtagtcgtccaatcccatgttccaaacatttgggaagccaagcccttccaccacatgttgtctttggttcagccagaccctgttgtcctcaactaccacaggggtccactccttaagggaaacgtcaccgttcatatcaactggtacggcaacttcacacccattcaccgttccatcatcgttgatttcatccaatcccttggttccattccccactctcgtcaccacccatcacccttttcgtggtggcgaatcaccgcgaggtacagaggaggcccccgcaccctcaccgtagggaatcaaacccttgacaacacctactccctcggtaaatcacttaaaacaagccacctcctcgcactcgcttccaaaaattcaccaccaacaactcgcagtaacgctaacgccatccacgtgctgctaacctctgctgacgtggcggtggatggtttctgcatgagccgatgtgggacccacgggtcgggtcgggttgcaaagagaaggatcgcgttcgcgtgggtgggtaacccggttacgcagtgtcctggggagtgcgcgtggccgttccaccagccggtgtacggaccgcagacgccgccgctggttccgccgaacggcgacgttggcgtggacgggatgctgataagtttggcgacggtgctcgccggagcggtgacgaacccgttcgggaacgggtactaccaagggtcggtgacggcgccgctggaggcggtgtcggcttgcgccggaatattcggaaaaggggcgtatccgggttacacgggtaacgttttggtggataacgtaacgggagctagctacaacgcgttgggtttgcacggtcgcaagtttctgttaccggcgatgtgggaccccgtcacgtctacatgcaaaacgctcgtttga

SEQ ID NO: 91516 - DNA, 318 bp, Glycine max
  Peptide Sequence Number=SeqID_208294
atgcaagtgtatcgtcaacatgaatggcgagatacacaagcccttaacacgtggcttgatactgccaatggagctggcgagttcggtgtggatatcgccagtggagctggcgagtttggtgtggcaagttctcgctactctcattggcgacttggcttgagcaacgtgcttgacgagacaggtgaggcaggctatgcatggcaggaggcaggctatgcatgcttcagagtagcagtgcagggtgcaggtgagcaggatggtctcgccaacactgcttgcgagacgagcttatatccgccaatggtattggcgatatag

SEQ ID NO: 91517 - DNA, 194 bp, Glycine max
  Peptide Sequence Number=SeqID_208295
atggttaggaggtttcggagaaataagaggaaaatggagccttatttagaggtccttgataggcattgggattcacagcttcacaaagatctatatgcaactggttattggttaaatccggcttgtagattcaatgctaaagaatttgagaagcataggaacacacaatctggaattttggaactcattgacag

SEQ ID NO: 91518 - DNA, 348 bp, Glycine max
  Peptide Sequence Number=SeqID_208296
atgtataccataacatcattcaacctagattatgcaaaactaaactgtgtatggcttgaggagcgcttatcaagactagaagcagccttgaatagtaaaaaaggtaggtgctatgctaaggtactcagcaaaaccattagtattttcagattgaagtctatccttgagatcgtgggcctaaattacatatatatgagacttgctcaggctcaaatgcttgttgcagaaaatgcaaaacttcaataccgaattattcatcttctgagagcactcaaggaagctgatctgaagttagaaaaagctacagtgcatgagcagctacagagcatgaaattgcagggttcttga

SEQ ID NO: 91519 - DNA, 1602 bp, Glycine max
  Peptide Sequence Number=SeqID_208297
atgttcaaacgttgcggtgcgcccagaagaaaatccaaatggaagaaggtgctagtagcacgtaaccgctacacgataatcgcatctcacacacatgggtcgggtcgggttgaaccgcaccagaacccaggcgctacacaagccgttgatctgtatccgttaaaaataaaaatccacggccacaaatgcaaccatgcaaaccaaaatagggaagctagcggtgaaccaaacttcgaaaccactgcacagagtggtggaagacaagttcatttccctgttacggacatgcggaacctgcgtgcggctgcaccagatccaagcccagatagtgacccacggactcgagggaaacgattacgtcaccccgagtttcatcacagcatgcgcgcgcctcggtggaattcgccgcgcgcgaagagtgttcgacaaaacggcgcaaccaaacggcgccacgtggaacgccatgttccgagggtacgcccaagccaattgccacctcgacgtcgtcgttttgttcgcgcgaatgcaccgcgctggcgcgtcccccaactgcttcacgttccccatgggggagtgtttgttgctgatgcttacaaggtgtttgctgaaatgcgcgacaagaacgtgttcgcttggacagctattgttgcagcacacgtggcgtgccgcgacatggtttccgcgcggaggctcttcgacctcgcgccgcagcgtgacgtggtgctgtggaacgtggtcgtttcggggtatatcgagttgggggacatggtggctgcgagggagctgtttgatagaatgccggaccgcgacgtgatgtcgtggaacaccgtgttgagcggttacgcgacaaatggcgaggttgaatcgttcgtgaagttgttcgaggaaatgcctgtgaggaatgtttattcttggaatgggttgattggagggtacgttcggaatggactatttaaggaggctttggagtgttttaaacggatgttggtgctggttgaaggtgaaggtaaagaaggtagtgatggtgtggttgttcctaatgattacaccgttgtggcggttttgacagcgtgttcgagattgggggaccttgagatgggtaagtgggtgcatgtttatgcggagagtattgggtataaggggaacttgtttgttggaaatgctttgattgacatgtatgcgaaatgtggggttatagagaaagctcttgatgtgtttgatggcttggatgtgaaggatataataacttggaacactataattaacggccttgccatgcacggccacgtggccgatgctttgagtttgtttgagcggatgaagagggcgggagagaggccggacggtgttacttttgttgggattttgtcggcctgcacgcatatggggttggtgagaaacgggcttttgcatttccaatcgatggttgatgattactcgattgtgcctcagattgagcattatggatgcatggtggatttgttgggaagagctggtcttatagacaaggctgtggatatcgtgaggaagatgcctatggagccagatgcggatgtacaagaatgtggaaatggcagagctggcacttcagcggctcattga

SEQ ID NO: 91520 - DNA, 984 bp, Glycine max
  Peptide Sequence Number=SeqID_208298
atgcagcgcacggcggcggcgacagaggaaccacggcggagctccggcgacgcgtcggcggcggagggggagaaggtgttcaagggaagtgaggtgttcggtgatacgtcaccaaattatttaaagacgattttggccctggcgctgtggctcggaaccattcatttcaacgccgcgttggtgctcttcgcaatcttcttcctctctctccacaaagcattcttagaaggttgttatgccagacttttcggtttgcttttcgtgctgatggtgattcctgttgatgaaaagagcaaattcggtagaaaattatccaggtacatatgcaagcacgtttgcgcttactttcccatcacgcttcatgtggaggatatgaaggcttttcatcccagtcgtgcttatgtttttggttatgaaccacattcagttttgccaattggagttgttgcattagctgacaacacatgttttatgcctcttcctaaaataaaagttcttgctagcagtgcggtaaggcttttatcgactctgttttgttgtgaagtgacaaagaaaaggtttacctcgctgttggatgctggctatagttgtatcttgatacctggtggagtgcaagaagcatttctcattgagcatggttctgaggatccgttcctcccttttatccttgctcctactgtcccatacccgtttccacgtaggcaaacgatagacgggaaagtagatggggaaaggtgtatgttagaaaatacccttggaagagttagggagcttccagttcgtagaattgttaatggtggtgaaggtgaacgcaagaatggagacatgcatggaagctatggagaaagcgatggaggagaatcgcgaagcagtggaatcgcggctgagctcgatcgaagggatgatccaaaggttgacagtggcgtgggagaaaaaatctccagcgacaaatgtgcatacagtttaggcgagcggaggggatga

SEQ ID NO: 91521 - DNA, 222 bp, Glycine max
  Peptide Sequence Number=SeqID_208299
atgtcagatggtgaccatgacaagaaaaagccgaagaaaggtctaggcgatggtggtggctggacgtttgaagcaagagatgatgttggaggatcattgggtggttttagtggaggtggagtaagacatggtagagtaggagtaatgattgtcactgaaacaacaagtggaacctccaaaggaacattttcaactatgaaagaaaagaaagaagtagtataa

SEQ ID NO: 91522 - DNA, 603 bp, Glycine max
  Peptide Sequence Number=SeqID_208300
atgggtactcctttgacaacgtccatttgtctctttgaactcaataatactaaatcaaaatcaaaaaaggaaaacatgtctcatgttccttatgctagtgtagttggaagtcttatgtatgccattgtatgcacaaggcaagatctagcacaagcaatcaatatgatggctaaatacatgggtaaacctaggaaggaacataggaaaatagtcaagaaaatattcaggtaccttaagggtacaactgatattggactcatccaccaaggtgacacatcttttgcacttgcaagacattcagattttgactatgctatagatttagatgtaagacaatttgtgataggttatgctttcacaattggaaattcccttgttagtttgaaggctacacttcatcctatagtttttttgtcatcaacagaggcagaatacatgactttggtagaagcaacgaaggaaggtggagattgttggacaaaaagaagtgtttggacaacactacttgaaccatccaatctagttctcttctgtatggtcgccaatgtctatttggtggcgctcatccaattgtgctgcaagaagagcgtccaatcctcttag

SEQ ID NO: 91523 - DNA, 402 bp, Glycine max
  Peptide Sequence Number=SeqID_208301
atggagctacatcataaagtttctgaagaaaaaacaacttttgcgttatggctcaagttagagaagctctttataacaaaatcaatctataacaagttgctattgaaacaatgtctatttggcctttgcatgaaggaagggacgcctctgaaagatcacctggatgagttaaactctatcttgttggaactccgtgacattgatgttaaattagaagatgaaaatcttgcaatgattctgttagcctctctccctccttcatacgagaattttataagttctctaagtgttggaaaggattgtatcacacttgaagaagtcaagtctagtttttttcaagagagctttgacacaaagcatctaaaaatggtgatgaagcctctgcctttgaattatcaatga

SEQ ID NO: 91524 - DNA, 480 bp, Glycine max
  Peptide Sequence Number=SeqID_208302
atgggctttgatgacatagacaacattttccaaggatttgatgtcaaagaaatgcacaacgtggaatcttggtgcattgtccttcatcgtaactttggcagtgtgaatggggaaccttccttagatgatgtagaaggaggattgattttgaagtctagtacggcttggacaacttggggttggttttggttcttggccattgttagggttaggagatttctaggtaacttagaggaagagagcttagggtgcaaagaggtttctaagagagaatgtgagggggtgaagagagagaaagagatcatgggggaaagtgaaaagatatgggcattttcaaaaaggatcctacccgctttaggtgactcagcacaagtacacttaaaacgatgcgttctactaaatttgcatccagggtctcaatccatatattgggcgcatgtgtgtggtgcacaaataccgactaagctcattgggcgataa

SEQ ID NO: 91525 - DNA, 324 bp, Glycine max
  Peptide Sequence Number=SeqID_208303
atgggacgattagctagacacagtttgggaaaagcctctactttcattgcccctaaagcaacaggtgtcatggcaaatgtttcaaagagggctacatctaagaagcaaccagaaaagcctatgtccactactcaacgccgaaggacactcagcgagactgagagtaaggatgatagatacttaatctttaggaaacaaaaggttgcactaccttcgaatgagacctctatgcctcaagcgaagaaggttaaacaaacacaacaggctccttctcctagtactacccaacctccttcgagcaaactagaaatggaaggagcttag

SEQ ID NO: 91526 - DNA, 402 bp, Glycine max
  Peptide Sequence Number=SeqID_208304
atggtgatagccattcaggaggaggatgttgcatgtatagagatgcaatcaaacctatggtcaaagcaagtctctgagggtacaaaaaaggtgatgaggaaaagtaataagggaaaaagagtgtgcaaagggaaagccagaggatctaagtcctccaagtcttctaggtcatcttgtggagctagtaagaaagttattagaccaggtctaggccgttgggacaagcccaaatatgactacaaactgggtgctgatgaaacaaaaatagggctagtttctaagcagttgtgtgcaactatgtggggaggtagtgaggttgaattgaagaaacttccagtagttaattcagttggaggtgcagtgttctttggtgtaggtttcatgggtatggaaagggtctag

SEQ ID NO: 91527 - DNA, 267 bp, Glycine max
  Peptide Sequence Number=SeqID_208305
atgtatgtcaggatagagggtgtcacagttgttgcagagggcttttctggtatgatgaggattattcttaggattattcaagatcaacaaggactatggaggaaagtgttggtagctaggtatggcgtaagtataggtgagggtgggaataggaactctagtttggattcgatgtggtggagagagacttggtgggagtgtgtggagaaaagaatgaggttctatacaattgataaaaatttgacagtttttatcataaaagtttaa

SEQ ID NO: 91528 - DNA, 183 bp, Glycine max
  Peptide Sequence Number=SeqID_208306
atgggcctaccccttgttccagttttctgctttggccagacaaaagcctacaagtggtggaagcctccaggaaggttaatgcaaaatcttgcaagatctcctataccattcaaaaatccattgtatatcgtcgtgggtagaccaattgagctagagaaaaatccagaaccaacaatggagcag

SEQ ID NO: 91529 - DNA, 705 bp, Glycine max
  Peptide Sequence Number=SeqID_208307
atgctgagagccttaaagaatcttgattctatgtatcttgaggaacttcttgctatccttaagtttcatgaacaagagctccaacaagatgaaggtctcaaaagagaaaagtctattactctcaatagtcagaagaatgagaaaacatcaatgtccagagagcaagtcttgagaagttcatccaaagcacttaatgtcaatgattcttctgatgatgaatctaaagaagactcagatgaagatgaactcgtcttcatctttcataaaaacttaaagaggttgagaaataaaaatctagagaaaagtcatgataggaagaaattctttaagactaaagaaaaggaggggattgtgagcacgtgggaagacttggatgacaattcgtctgatgaagacaatgaagaagccaacatatgcctgatggcggacacaactttgaatcagaccaagaagatgagatcacaaaaatctgtgagtttcttgaataatgagtttctgaagaatgaagaacttgaaggtcaacctcaagatgttgtcaatggaacagataatcttaacaaactgttaggatactgtagaagttcttcagataaatctggaaatggatatgatgggaaggtgtatgttcatgatgaagacacaattatatgttacttctgtggaaaaactagactcataacgtccaaatgtagggatcatccttag

SEQ ID NO: 91530 - DNA, 480 bp, Glycine max
  Peptide Sequence Number=SeqID_208308
atgccctccatgcagtttttgggtatgaaccacactcggtttttccaattggcattgttgcacttggtgacagcactggcttcatgcctcttgcaaaaacaaaatttcttgctagcagcgcccacttcttcagcaacccttctccttcaagcccttgcaccgttcttcttcggccccattgattctgcgcacatggtggtgtcttcttcttcttcttcagtccccttgcttttgcgcgtttcgtcggcattgtcgagatcaactttatccgtacaaattacagaccaccctcacgcacacccagcacaaatgcgtacctcgtatgtcgccgacgaagaaccaaccaccgcaacaatgaacaccagcacctccaccttcaccaatcgcaagaaaacaaagaaaatacggcgaagcactgcgcacccaagagagaaaacgaagaagaagcattgcgcaaaaatggctggggaaattttttaa

SEQ ID NO: 91531 - DNA, 285 bp, Glycine max
  Peptide Sequence Number=SeqID_208309
atggactttcttataggtatgtatctagtctgtcaaagcccacaaataagcgaacaagcccgcaagcccaaatactcatctaaaaaaatcttaaaaacacaacaacttaaaataggatcaagagagagaaaggacaacgacgcgacgaatggagaaaagcatgactgtgggaccttgaaggaggggcaatgcaaggaagaactattgcttcactctaattccaaatgtgacttacgtgagtgtcgaaggaggggtggtaatgacatgacttgcacgagaggttga

SEQ ID NO: 91532 - DNA, 333 bp, Glycine max
  Peptide Sequence Number=SeqID_208310
atggggaaagtgttcaatggagtagaagagttctctgaatcacgcaatgtgttcaagacggttcctgcattggtgttgtatcttggagcaattcatttcaaccttgcgttgatactctgggccacagtcttccttcctctctccaaaggactcttggtgttcggtttgctcttggtgttcgtgctcatccctgtggacgagaacagcatttttggtcataaattgtccaaatacatatgcaagcacatttgctcctattttcccataacgcttcacgtagaagaagcaaaagcctttcgtcctgatcaagcttatggcaaagaaaaattttaa

SEQ ID NO: 91533 - DNA, 360 bp, Glycine max
  Peptide Sequence Number=SeqID_208311
atgtcccaaccacactcattgatctctaaaagatcaatgcatctgccattcacaactttcttattgatccatttgttgccaaacttctctcatagcatcctatctctgaacgaggcagcaacctcatattctagcccccttctctccttccttgatttctccattttcacagagcttttcttttttggagactttatcacaactccctggaatgaagagaaatccttgaaagcctttgtaccccattgtcgtgaagatatactaactactaccattgggcgactaaagcaccctggtggttgtgctattggagtcggtgtgaccattagccaatactttggaagatcatgtggcttctag

SEQ ID NO: 91534 - DNA, 429 bp, Glycine max
  Peptide Sequence Number=SeqID_208312
atggcctcctatggtggtgagcttcttctagactcatcttctcctcgaagtggcatctcctctctctcttccttctccattctgctgccattcatcttgcaagaagcaaaggaatccattgatgaagaagatccaagaaccaattcacccccctcttccatcatcttttttcattctccattgaggaaaaatcctaaggagttatgtaatcctactagcaaaataggcttaatttcgggtaaggatattagggacgagattgagagaaagaaaagggatcatatgttgagaaaaagccttgaagaagaattggaagaattggacagctcgctcagcgtgcaatccaggcttagtgcacactctcggttagcaagcaagtttaggcttagtgcacagtctcgctcagggcgtaatccaggcttagcgtga

SEQ ID NO: 91535 - DNA, 222 bp, Glycine max
  Peptide Sequence Number=SeqID_208313
atggaccgagatccgagttgtcgagataggcaacttaaggaggggtttctggggatttttggggagtggagaaggggttatattgttgggtctagatctttgggattgggtggatgtgtccagggcgaagattcgaagggtccatccaaaacaaaggaggccctagctcaagcccttaaagatcgccactatgctgagaaggaagttatgggatggctttga

SEQ ID NO: 91536 - DNA, 321 bp, Glycine max
  Peptide Sequence Number=SeqID_208314
atgaccatatctactccatttacagtagagaagaggttaccttcaaggattgctcaccatcttgaagaggagacagagggtttgagagcagaagatgtttgggttcaaagaggggtggtaactggaggttttggaggaggtgttggtgtgacttgtgggtcactctcactaagtaagatcatagggagaccagtcagggtcacgatgttttacgagaatgctccaaccatatgggatcagcataggcttaaaggagcactcaaacccggtgacccccaaggcctacactccgaagagtccttcagggcctctccctcctga

SEQ ID NO: 91537 - DNA, 201 bp, Glycine max
  Peptide Sequence Number=SeqID_208315
atggaagagagacttgatcatggcttagcaagctgggactggttcgaattcttcccaaatttcagagtggaaaatgggctctcctctaagtcggatcattctccaatcgtgattggacttcacgtcagaagaaaaagacaccactgcaaatccttcagatttgaaaattcttggctacttgaaccaaacattgaaggtgtg

SEQ ID NO: 91538 - DNA, 222 bp, Glycine max
  Peptide Sequence Number=SeqID_208316
atggagagatatgttgcaaatcagaagtctcataatcatgacgacctcgttgaggtggagagacatcttgagcatcttgagagggagaatcatgacgacctcatcattgaggtggagatatgtcttgcaaatcagaagtcccataattcggtgatggggatgtctggcccttacctgctcaagccttttcatatgcttcacttcaatgtcttcatcaagtag

SEQ ID NO: 91539 - DNA, 660 bp, Glycine max
  Peptide Sequence Number=SeqID_208317
atgaagcatgttgtcattatcgaagaacagagtgtagaaacccaaggacccgaaggaatatgcattttcgccaacggcaaagaaactagcaagaacatgttgtttgaaataacaagcgatgaacctttgaagtgcggaagcatgtcatcgtcatcatcgagcaatgcctacgacgtgccatgggtagaaaactatcgttccagcaatgtcatcaacatcgtcgacaatgaggacaccgtctctaggctccaagtcatcgctcgcgatgacaacatgcccaatctcattttattcggtcctcccggaaccggcaaaaccactagcattattgctcttgcacacgagcttctcagaggaccaaattacaaggaagctgttcttgaactaaacgcttcgaatgatagaggaattgatgttgtgaggaacaagatcaagatgtttgctcagaagaaagtcatgctgagctcgaggaggcacaagatagtgatactggctgaagttgataggttttggatcttcttcatcaatggattccttttcttcttgaagatcatggtagcagaatggagaaggaagaaagatgattggagatgccacttcaaggagaagatgattcaagaagaagctcaccaccataggaagccatggataagagcttga

SEQ ID NO: 91540 - DNA, 1917 bp, Glycine max
  Peptide Sequence Number=SeqID_208318
atggagataaagcctactttcctaagtttgattagtgcacatcagtttgtaagcgcgaatcatgaggatccttatacttatctatctactttctatgaactgtgtggcaaaatgggcattcctgaaggtgaagaggaggttgtgtaccttagattattcccattctctttaacaagaaaagccaaagcatggctacaatctcatcctaatcaaagtttgacaagcttgagcgtagtggaagaaaagttcttgaatagatttttccctccttctagatatatcagtgcaaagtcagatgtttccactttcaagcctaaaactaagatgattctggatgcagtcgctagtggaacaattatgtttgtagatgttgaacaagccacaaggataattgatgcctttgcttcaactgatcaccaatctcagcataacagacaatcgatacagaaaagaggagtgttggatctcattctcaagggtttttcaaaggaatcaagattaccccagagaaactacaaaacaaaggatttagagcttgttctccacgaaatccttgaggtggattccaaggactccgctccgattaaaatgttcatctccatgtggtggtctggcagcaaccaaaagtggctcgtggtggccaccaatgatcgtggcacaattcctctcgggttgggatttgcgctgagcgcgacatttcacgttgagtgcaactcctccccagcatataccaacataggcaaacttcatgaagaagctcctcacaataaaaggaagaagtacatagggaaggagactattgagctagaagtaggttgtggtgctacaattcagaagtcaccacctttaaagcataaagatcctgagatcttcactattccatgcacaattggacatctttttatcgagaaggtgttgtcggatctaggagcaagcatcaatcttatacctatttccatgcttaataaaatatgggatgtggacatcaggccaacaagaatggcacttcaactagctaatcgtttaacaaaacctccacatggaattgttgcagatgtgccattcatgaaaacagctaggggcttaattgatatggatgatggacaattcaagataagggttcaagatgaagaagttgtccttaatcttttcaaagcaatgaagcatcctaatgatgaaaagtcttgttttaggattgatgtccttgatgatatgtatgcaaataaactaaagcaagtgtcaaattcatctcttcatgagaaagccttgattaatgcatttgaagcacttgatgaggaggaagaagtggagattgatgattgctttaaaagtattgacactttgaagaaaattcctaaagaagaacttcaaaccaatggctcaactataaagaagattgaatcttgtgatgaaggaagtggtaaggaaggaggaattgttcttggccacataatatcatcaaagggcattaaagtggatgaagctaaagtggatgttattgaaaggttgcctccaccaacgcttcatactacacctgattggtcattacagtttgagcttatgtgcgatgcaagtgattacacaatgggagttgagtttgatttgaaaatcaaagataagaagggcagtgaaaatgttgtggctgatcatctcttcagattgaacaatagtgaggtgaccattaaagaagttgagatacaagaagaattccctaatgaaaagcttctaaagaagaaattctttaaggatgcaaatcattatgtgtgggatgatccttacttgttcatgattgtagtagataacttaataagaaggtgtgtcactgaagcagaagccaagagcattctttggtattgtcacaattctccttatgagggctattttaatggagaaagaactgctgccaaggttcttcaa

SEQ ID NO: 91541 - DNA, 408 bp, Glycine max
  Peptide Sequence Number=SeqID_208319
atgagtgaagctcaaatgatacctcatgatactcagctccatgatgctcaaacaaagaagaaggttgaagaagaagaagcactcattgctgctactacaaaggaaatggttgcctcaaatcaagctgaagcatatgctacaactatggataataccactatatgtgggatcattattgatctcaccaatagtggtatcatggaagaaacacctaaggcatccaatctagccatagctaatgagggctattgctgcacccacacccaccatatgtctgtacccaaaacacttgaaccgttcccactaaccattgaccctaccccacagtccattcttccaacacctccgcttccttcttcttccccaccacctacccaacctccactaccaccgccagctcaagactaa

SEQ ID NO: 91542 - DNA, 357 bp, Glycine max
  Peptide Sequence Number=SeqID_208320
atgtaccctccacttgaactgatccacaagagatgtactgtctcttgttctcagtacaacaacccaagtagatgtaccctctacttgtaccacaaaggatgtaccctccaatgtgttaagacaaagaattctcaagcggttagtcctttgaatctttgtaaggggaaacaaaagatatctcaggcggttagtcctttgaaatcttttgtttcaggggaagggaagaatcaaaagaattctcaggtggttagtcctttgaattctcttggaaagagagaagggagacacaaaagaattcaggcggttagtccttctattcttttggcaaagggagaagtgaatgaagaagaagagtag

SEQ ID NO: 91543 - DNA, 648 bp, Glycine max
  Peptide Sequence Number=SeqID_208321
atgaagcattcctacgagaagacctattactatgactcttgtagtggtaaggagaagtgcaagaaggagggatcttcctcacctaagcaacaaggttcaaagtttccaagtggtaaacatgttcctaaccctagcaacaaggtcatactgcattacattgcccaaacaaagaaaaccaaagttttgagagacaatgagattgtcactactcccatagaagcatgtcacatcttgttgggtaaaccatggaaaattgaaagaaatgtgaaactctatgggaagaccaataagttttcttttgtacatgaaggacgcaagatcaaacatgcaccactttcacctaaggaagcaagtgatggtgccaagtccttgagttttgagattaatgcacattattttgaattgtgtgatcatgaagagtcttcctcaataggaactcatgatgaaagtgtaatgttgcatggatcttcctttgcaacttacgtggaacatgaaacactcaagtgttttgataaagaggatttcaattcgaggacgaattctctcaaagtaggaggggatgatgtggatcaaacaaggaacatggacaatgaagcactacaatgctggaccgatttgcaatacaaggagtggttgttggattgctag

SEQ ID NO: 91544 - DNA, 363 bp, Glycine max
  Peptide Sequence Number=SeqID_208322
atgcaggtagaatactgcaaccctaacattaagactgagaaattagatgctattggaacctgtcacccacaacaattaattatcaaaacattcttttctctatgcagagagagatgtcagcaggttctagaaatagtgaatgaaagcaaggttttctggggtggtcttaaatctgataatgtcactatcgcaacctaccctttggcgggagagcgaggcgagattcaaaaggtgcatctttcaagaaggaaaacgcgtggagttgtcaccaatgtttattcgaggaaaacgttagtaaaaccaaaagacgaagagagaatcgttaaggtgttggaccttgaaacgatctcaagcgatatttga

SEQ ID NO: 91545 - DNA, 2397 bp, Glycine max
  Peptide Sequence Number=SeqID_208323
atgtcttcttctggttatactacgagcagtgctttgttttttctgtttctgactgttcttgctgcaaaagttagcttttgcttttctaccaagtgtagaatatggattggatggcaggtttatgtagtgtacatgggaagcaaaagtggggaacacccagatgatattctgaaggaaaatcatcaaattcttgcttctgttcacagtggaagcattgaacaagcccaagcttctcatatttatacctacagacatggtttcagaggctttgcagccaaactcagtgatgaacaggcttcccaaatttctaaaatgccaggagtggtttctgtttttcccaattctaaaagaaagttgcacacaactcactcatgggatttcatgggacttctggatgaccaaaccatggagactcttggttactccatcagaaaccaagaaaacatcatcattggtttcattgatactgaatccccaagcttcagtgacaccgacatgcctgcagtgccacctggctggaaaggccaatgtcaatcaggggagggattcaattcctcatcatgcaacaggaaagtgataggagcaagatactacaggagtggatatgaagctgctgagggagattcagatgcaaaaaagtccttcagatctgcaagggacagcactggccatgggagccacacagcctccatagcagcagggaggtttgtggcaaacatgaactacaaggggctggcaagtggaggagcaaggggaggtgcaccaatggccagaattgcagtgtacaagacatgttgggattctggatgctacgatgtggacttgctagcagcctttgatgatgctataagagatggggttcacattttgtctctttctctgggggctgaatcaccccagggagactatttcagtgatgccatttctgtggggtcattccatgctgttagtcgtggcgtgctggttgttgcatcggctggaaatgaaggcagtgctggctctgccactaatcttgctccatggatgctcactgttgctgccagctcaactgatagggatttcacttctgatatcatgttgggaaatggtgccaaaatcatgggtgaaagtctcagcctttttgaaatgaatgcctccacaaggataatttctgcttctgcagccaatggaggatactttactccttatcaatccagttactgtttggagagttctctgaataaaacaaagagcaaaggcaaggttctggtgtgtagacacgcagagagttcaacagagtcaaaggtggaaaagagcaagatagtgaaagctgcaggtggagttggcatgatacttattgatgagacagatcaagatgttgccatcccatttgtgatcccttcagctattgttggaaagaaaacaggagaaaagattctatcctatctcagaactacacgtaagcctgaatcaagaatatttggagcaaagacagttcttggagctcatcctgcaccacgtgtagcagcattttcttctaaaggccccaatgctttgaacccagaaattctgaagcccgatgtcacagctccaggactaaatatccttgcagcatggtctccagcagctggaaacatgttcaacattctctcaggaacttctatggcttgtcctcatgtaacaggaattgcaaccttagtcaaagctgtccatccttcatggtctccttctgctatcaaatctgccatcttgaccactgctacaattctggataagcaccacagacccatcattgctgatccagaacaaagaagggctaatgcatttgattatggatcggggtttgtgaaccctgcaagagttcttgatcctggtctcatctatgacttaaagccagcagattttgttgcattcctgtgttcacttggttatgatccgaggtcactccaccaagttacaagagacaacagcacatgtgatagggcatttagcacagcatctgacctcaactacccgtctatttcagtgccaaatcttaaagacaacttttcagttactaggattgtgaccaatgttgggaaagcaaaaagtgtttataaagctgtagtgtctcctccacctggtgttagagtcagtgttatacctaaccggttaatcttctcaagaattggacagaaaatcaatttcactgtgaatttcaaagtaactgctccatcaaagggatatgcatttgggctcttgtcatggaggaatagaagatcacaagtcactagtcctttggttgtccgggttgctcctggaaaaaatgggttgggggagatgcaacgtctatctctcgtggaagaggacgaagagggttttaccttcaacgtgatgaagccaatgagagaagtcggtcgatgtttctctcggtcttga

SEQ ID NO: 91546 - DNA, 216 bp, Glycine max
  Peptide Sequence Number=SeqID_208324
atggcattaggggtcatggcaattcgtccaggcgagctgttacttcaacctgtcagctcacccaagcgagttggttccttcacccctaagctatttgggggcccaggcgagccagaggctagcctaggtgagccagggtccagaaaactccctgtaatgacccttttgcccttacctttcgatatctttcgcgttcttgatcaaaacattgaatga

SEQ ID NO: 91547 - DNA, 207 bp, Glycine max
  Peptide Sequence Number=SeqID_208325
atgatgaggtctagcggtggtgcagcagtgcgaaggtcttgcagcttggcattggtgaggaagtttggcatcgtgagtgagcaatgcttgtgttgtggtggcacgaacgaagtagaaccgagaggtgagaatatacaggcgaaaagaaagagagtggaggagcaagaggcggagcggtgccacaagaggttgcagtgtcagcggtga

SEQ ID NO: 91548 - DNA, 447 bp, Glycine max
  Peptide Sequence Number=SeqID_208326
atggtagtcaaactggagatttctaactttatagtgtgcagagtcttgattgaccagaggagctcgaccaatattctctattggtctaccttcaaaaaatttgatattccaacaagtcagatcaagccattctctgaacaactcataggcttcttgggagagacaacttacacaatgggacatgtcaacttgctaacgactttcagaaacgagaagtgttccaagaccataatgatcaggaaccaactcccctccacaattcacatccttatcaatgtcaaagagggagaggttgacttcctagaagaagtatttggcttgtcgggtagccttgaagaaaccaacttcacgagtcttaaggatatcgacctcagtttcatcgagatcactcttccatttttcctcagttgtctctgcattcaccttaagaacaatttagcctattaa

SEQ ID NO: 91549 - DNA, 888 bp, Glycine max
  Peptide Sequence Number=SeqID_208327
atggattctatccacacagcactcaatgccaaaattgattcaattttggaacgtttcaccacaatcatggtgactccgtcttctccatcttctcttcagccgcctcctccactgcctgttcatcaacctcacatgaagctggaggttccacgattcgatggccacgatccccttggctggatatttaaaatatctcagttcttcgattatcaggccattctagagcacgaacgcctcaccatcgccgccttctacatggacggtcccgccttgtcgtggttccagtggatgtcacgcaatggctatttcccttcgtggccagccatgctccaggctctggagtcacgattcgccccttcttattacgatgatccccagggcacgctattcaaacttcggcagaccggtacagtcacagagtatctgacggagttcgaaagcttggcgaatcgtacctttggtctcacaccatcctgcttgcttagctgtttcgtgtccgggctcatcctggagcttcgccgcgaggtgcaagcgctctgtcctatgtccttgctgcaagtgacggagctcgcgcgactccaggaggataagatgttggatcatcgttccagccactatagctactcgtcctcttctctgactccgccaaaaccccaggccccttccgcgaaccctacccctcgccttcctgtcaagcgtcttactgcagaggaactggcgttccgtcgcgaccaaggcctttgttaccattgtgatgacaaatggtctcctggtcaccgttgcaggatgcgtctccacctgttcattgccaacgaggatttcaatttctcctctgattttttggattcccctttgaatgtcgtgcctgagccagtgttagttccctag

SEQ ID NO: 91550 - DNA, 2577 bp, Glycine max
  Peptide Sequence Number=SeqID_208328
atgggaggcttattgcacatgtttgagttcaatcagggtaggatggccaagaaagttcatgcccagaggagcaataatggtgacctggaaagctctggaaatggcatggaactgcaagtagaaacatctcaggtccactgtgcagaaggagaattaccatactcttgtcaagtagaagatggctggtcaaagaaaaatagttactcaaatgtggtttcagtgaaaaaactgaacaaagaggatttatccaaacaatcaggcaccaccagaaataatgcagcaagccttgtggcaaggttgatggggatagacaccatgccattgccattagagactaattccgttgttccattagatgaaagcaaacataaaaatatggagaggaagttttcaaaaaaaggaatgaatcgaaggggttcggttggcaggggttcctccaactttaattcttctagccagatggaatttgattctttttatcaagacatcgatggtgatcatgatgatggatgcagacagaattttggaaaaccaaggcctagggaacatcctcaggaagaggaactccaaaaattcaagaaagaatttgaagcatatcaagaatcaaggtttaaggagtgttcaaaggatgttgaaattggaagtggttctaggagaataccttctcaagagaacctgaggaaggaaaagatgctacagattgcaagttcaaagacagatagccacacatttaagacaaagctacctaatggtaatatgatggagccaatcccaactacgaaaaaagatttctttccttcaagaagtaaaacactaagtcgagactttgaggagtctttaatgatgaaatctggaagcagattagatatatgtgcttcttccgctcagatagttatcttgaagcctggttctgataggatttgcaattgcaaccatgaagagaattgcatcaatttatcaggcactttacacgggagaaaaggtttagaagattttcttgaggaagtgagggagcggttggaatgtgaactgcaagggattagagctagtggaattgagacaccttacaatgaaaaactatctgatgctaaagaggtcagagaaagtgtgactagagatgctgaaccaaatttactccgctcagaatcaacaagatcatataaaagtaaaatgcagttcaatggaccaagttctccagaacttttcaacatagataccagaagattcttgtcagagaggctaagaaatattgtaaatggtgaactgcatttggacattcctgaagtggcctgttacaatgatagagttagactaaagcaggatactacaaagtgtgcaaatgacaagagccagtggagaattttgaaagagaaaaaagaattacaaacaggttcctatagacacaaattagatgacaatgtattgttccacaaggatttgtctcctagaaatcttgaaagatccttgtctgctcctgcatcaggaacatcatttgggaggcttcttctagaggaccgccacattttaacgggcgcccttattcagaggaagcttgaagctgttgaagcaatgcctgtggatgtcaaaaaaaagaagaaagatgggtttaatattaaagaaaaactttccaattttactcttggtctcagagggaagctgtttggcaaaagggttcagtcaatagttgaatcacatggcagtgaatacggtccaattttgagagatatcaggagtggaccaactgttttcatgaaatatggtgagagacatgagaactcaactgaggtacctcctagtcctgcatctatgtgcagctgtgttcatgaaaaaaattggagacagactggatattcaagtttaacatcaactccagatgtatcttcattagatgatatttttattcccaaggttttcagagatatcagctctggtttgaatgagctaaagagacaactcagtcaacttgattccgatggctctgaggacttcaccactaagcaggagcctgttgagtcagaattagttcaattagatgatccagcagaatcttatgtaagagatctgcttgttgcctctggtttgtactttggttcatgggataagtctctattaagaggggacacatttgcaaagcctattggcaactcagtttttgaagaagtggaagagtctcatgacaatttgatcaaggaggatgaaagatccacaaaggatcagcagaacaaaaacaagttagagcacaaggttttgcttgatttgttaaatgaggcactttccatagttcttggaccacctttgactttgtctagattccgaaggaaactaagcaattcctccttgcagcctccaccatgtggaaacgaactactgaagttgacatgggacattgtcagtgtttctttaaatccttcatctaacgcatctctttattcacttgatagtttggtggcacaagatctaggatctatctcctggtctggactaacaaatgatcatattgatacattggaaagagagatggcatgtctaatcactgatgatttggttgaagaattcacaaatgatatggtcttttaa

SEQ ID NO: 91551 - DNA, 381 bp, Glycine max
  Peptide Sequence Number=SeqID_208329
atgggacctaaacgggaggaactaaaaggttttttagtgataattcccaaggtggtcacatctctcttgacggtttctagaggtatcatccccttcgacaaacatattgcgacagtagggactaccagcaacaatatgttatcaaagagaaaaactctaaatgagggttcactgttatcaagcaagtcggagacccagcatgaccatagattcacctccactccttatgttcccatggacccgggtatagggccccttttcaactcactgtgtgtgcaaaaaggtgttggtttttgtgtgcatcaaatgaataaatatctatctcatgcatacattaaaaagcacactaaaagcatcaaagagttatatacaaggacataa

SEQ ID NO: 91552 - DNA, 369 bp, Glycine max
  Peptide Sequence Number=SeqID_208330
atgtatgttgggataaagggtatcaccgagaagggttggagggtgaaggcggcatttgtggcgatggtcagtggtgataaaaggggaatgacggtggtggatagtgatgggttgccacaatggaggagtcaacgggttgccagaaacactggaggagataccaaaaaggaagggatggaactcagatccaaatcactaaccaaagatctattcaatccaaaagcttttagttctggatctggaggttttgagttggttcatgctttgtggttgaagcagagacgatcattggatgcctctgatctcaatattcctccacgagtattggatgatgacatttcttgtacttatactaatgttagctactag

SEQ ID NO: 91553 - DNA, 321 bp, Glycine max
  Peptide Sequence Number=SeqID_208331
atggagaagatggatgttcacataataacaagggggatccctaagggaaaatgggcactaagggcaaagacagctcgcccaggcgagctgatgcttactcctgaagtaactggctcacccaagcgagctggtaacttcaccctgaaatctttggggggcccaggcaagccagaggctagcctaggcgagctagggtccaggaaactaaatgaaaaaacccttttgcccctcctttttggtatctttcgtattcttgatcaaaacattgaacaagtcttcgttttgtgtggtaactggtgtcgaacaatgcaattcagctag

SEQ ID NO: 91554 - DNA, 176 bp, Glycine max
  Peptide Sequence Number=SeqID_208332
gctagcctctggcttgcctgggccccccaaagatttcagggtgaagttaccagctcgcttgggtgagccagttacttcaggagtaagcatcagctcgcctgggcgagctgtctttgcccttagtgcccattttcctataaataggcatgctagggaggttgagaagaggttcgaag

SEQ ID NO: 91555 - DNA, 378 bp, Glycine max
  Peptide Sequence Number=SeqID_208333
caaaaggatgcacaagctaaagttgagtatgtgaaaagattgcatgagcaagtgaaggctcaaattgcaaagaagaatgaaattcatgccaagcaagccaacaagaataggaagaaagtggtacttgaaccaggtgattgggtttgggtacacatgaggaaagagaggtttcctaaacaaaggaagtccaaagttcaacctagaggcgacagaccattccaagtgctagaaaggatcaatgacaatgcttacaagatcgatattttaggtggtgattctgaagatttaagggcaaatgctttccaagaaggagggaatgatgagaatcctaaaactgcccaaatacaaggatttatgaccagaagtaggaccaaatag

SEQ ID NO: 91556 - DNA, 231 bp, Glycine max
  Peptide Sequence Number=SeqID_208334
atggccatggttgatcatcagaagttgggtatggatccatatgtttggttaaagtttaagattagcaatgttgggagtttcattagtgacgagcagttgcattcaaatgatgaggaaaggatcagctttgataatggagatgacatgaactcaagactctcagtaaggacttctgatgatgcttactttttacaaggccttatgtttttaaaggggtctagtaactattag

SEQ ID NO: 91557 - DNA, 123 bp, Glycine max
  Peptide Sequence Number=SeqID_208335
atggcgtccaaccgaaagaagcagcagctgggctcgcagtggaggagaaggctcgcggaagaggcatcccaaattgccagtgaaagcaccgcaactgccaccatcaaagccactacattgtag

SEQ ID NO: 91558 - DNA, 140 bp, Glycine max
  Peptide Sequence Number=SeqID_208336
atgcagactggtggaaattcatcagatggattaaaagctagtgatgtagatccacggttggtgtttcatcatggagtgccatctggtggtgccaagttcgcctatgacaccattcagaggatcctggctctttctaccaa

SEQ ID NO: 91559 - DNA, 1608 bp, Glycine max
  Peptide Sequence Number=SeqID_208337
atggctaaagaagaaatcacttcctttgcagtcattcatcatagcctctatatgtacattggacattctaatggtaatatttcagttttgaagcttgaccaagagccatcatggcatttggttcagatgaaatacaccatacctctctcagcttcctatgggaattctgaagtgtctgatgatactgttgtgacgcatatactgcctcaaccagcagctgaaagtaagagggttctcataatctttagaaatggtcaaatgatattatggaatattcgggaaagtagatctattttcaaaactggtgaaaatatgttgcagccactgcatactgaaacaaaaaaagtgacttctgcatgttgggtgtgcccttttggaagtaaagcaattgtagggtacaacaatggagagctcttcatttggagcatccgttctctaaatataggaaatggttcagcatctgaacatagttatcaaaatactcctttgctcaaacttaacttaggatacaagtctgacaaaatttccataggatcaataaaatgggtttatgctggaggaaaggctagtcgactatatattatgggagcctctgactgtgcaacttcaaacttgttgcaggtagtgttgctgaatgagcatacagaagctcgcacaattaagcttggacttcatttgtctgaatgttgtattgacatggagatcatatcaacttcaactgagcaaagcaagaataaacaagattctttcattttgcttgggaagtcaggccatctatatctgtatgacgatattttgattgaaaggtatctgctacaatgccaatctaagtccacaccatcacttccaaaggaggtaactgtaaagttaccactggcagaatcaagcatcacaacagcaaaattcatctccaacaatcccaatgtattaacatttgaagatgagtattacagacagctgatcacaagctatccactgtttgttcctgttgaaacaaatcaaaaagatgagattagcctgagttctgccaaatttacaggattttctaaagttcaaaacttgtacataactggacacagcaatggagccataaacttctgggatgcttcatgccccattttcactccaattttacaattgaagcaacagagtgaaaatgactgttcattaagtggtatacccttgacggcattatacttcgatagcaactccccacttcttgtttctggtgaccagagtggaatggtgaggttcctcaatttggtttgtgtctttagattcaaaactgaaccatatgccactaacagcttcatgtctcttactggaggtacaaagaaagggactgatcatataatccaaagtgtgaaacatgtaaagatcaatggtgccattctgtcattgaacatagatcccagcttgatgcatcttgctgttggttctgatcagggacatcttgctattccatgtattcaaagaaatgcgtttgagaagtcatctatttataggccagtagaagaatatattggtctccagcaaggatattaccacaagaatcattgccagactaacccctcaggcactactgcagctaggagaggccacctataa

SEQ ID NO: 91560 - DNA, 525 bp, Glycine max
  Peptide Sequence Number=SeqID_208338
cggcttcaccccctggccatcggcgtccgtgagcaacaagttgtcgaggatggcgtgctcagagattattggttaaagcaagtaatgactggcgcaggcggcgatgagggagcttatggtccaaatgatgtacagtttgaggccaccgttggtgtagaaggagtcagggatgcttccattatcgccgttggggagctcgatccggaggaggcgaatctcgttgaagttcttgaggacttgggtaggggagtggtgggtgatgtcgccgtcaaagtcttcatcgaagccgacggcgagggaggaggtggaggaagaggatgtggcagtggtggccgtagaggcggaggaggaggagaggcgtttggggtcgaggaactggccgagggggtcacgggacttgtccgaggcagcagaggaggaggaagagtcaccgtaggagatgatgcagtcgacacggatgacgatgttttagacttgcaagacgagggagtggaagcggcgcgagacgatgcagcagcggcctag

SEQ ID NO: 91561 - DNA, 1161 bp, Glycine max
  Peptide Sequence Number=SeqID_208339
atgttaacagcaattttgtggtacacagatggacaaggtgcaccggtcaatggatcgattacaaaagatggattagagtcgagcgaaaggaatcatattgaggatgcaacaacaaagcaacagtacattttgctttgttctgagaaagctttatatgtctattcattggtgcatgcgattcagggagttaaaaaggtgctatacaagaaaaggtttcattcctctacgtgttgctgggcatcaacattttacagcccttctgatgttggccttatactcatttttacaagtggaaaagtagaattaaggtctttgccagagttgtccctaattgtggagacttcaattagaggttataattattctcctccaaaattgaagtcattttctggctgccagatatgttgttcatccaaaggagatcttgttttggtgaacggtaaccaagaattttttgtcgtctcgctgttggtgcaaagaaatattttcaggcttttggactctattagctgcatctacaggaaaaatatgatgctgtcgccagaagtgtttgttcctggcccagtcatctataaggaaaagaaaaagggtatattcagctctgttatcaaagattttgctggcagtaaagaaaagcatgctcccatattggaaaccgaagatactacagaaagcatccaggaactctcagctatcttctcaaatgaaaattttccatgtgatgctgataataatgataatctgactgttgatgaagatgagcttgaattaaacatagatgacattgacctagacgatcatgaagaaaaacacaaagatcaaagtatattgggagctcttaataagaagaaattgactggaaagtttcaggctctaaaaggtagattgaaggagatgaagggcaacatccagaaaacatcaagtaaggaagagcagcaagatgagcaagctggtgcagtcgatcaaatcaagaagaaatatggattttcttcttccaacgaaacaagctttgctaaattggcagaaagcaagctgcaggagaacatgaaaaaattgcagggtatcaaccttcgaaccacagaaatgcaagataaagcaaaatcattttcaacattggcaaaccaagtgctgcggactgcagaacaggaaagacgaaattag

SEQ ID NO: 91562 - DNA, 294 bp, Glycine max
  Peptide Sequence Number=SeqID_208340
atggaatatttaactaagcatgtgactgaattttttcagattgagaatgaatatgagaacattgagaactcctatggcaaaggacgtaaaaagtatatgaaatgggcgtctaagatggctctaagtcttggtgctcggactaaaattgaattgagatatttcaagaaatcaaaaagtatatttgaccgtaaggtaggtttagggtacctacattcatggctggtggaagtgcatattgaagtagaagcacaaactgatagaagacatttgaatgcactaaactcaagtgcataa

SEQ ID NO: 91563 - DNA, 531 bp, Glycine max
  Peptide Sequence Number=SeqID_208341
atgacccgcacaaagaaaactagtcaaatgacatttgaggctgcaaaggaaattgcagacatgattgatgtactgactgctgccattgagcgaccaaagcaccctggtcgtgtccatgctgttggagctgatgtcacgatcaaacactacttgggacaggcttcaaggggctcccgcacctctttgtccatggctgctgaagacctagaccagatgcaatcccgaatgcagccgcagatgcaatcacagggactcacactgcctgttgaggctgaggttggtccttctgttgctcatgtcgatgatgtttctttgggaaatgatcaagtgaagcttggtgttgaggaggtccaagatgttgatgctcatgttcttgtacccactcaagaggataaacaggtagctgagggattggtcaaacttgtagatatattggatcctgacgtcgatcccctatacttgatgacattgaccatccaacaactttcgctcaaaccgttgcaggtgcagtgggatgctagcgtgtttggg

SEQ ID NO: 91564 - DNA, 213 bp, Glycine max
  Peptide Sequence Number=SeqID_208342
atgttagaccaaaaggcgggtgaagtgcgttatgatgaacttgcagtgactaagttcttgccccgatgcatcattgtatccacagttctagctatgatgcatatccagatgttctatgctgcaactcgagggcatggacgtggacacaagcaaggatattacgaggactatgatgatgagaatatgcgatccacttcacctcattgtccttag

SEQ ID NO: 91565 - DNA, 159 bp, Glycine max
  Peptide Sequence Number=SeqID_208343
atgacttctccatggagattcaaaaagttgagtgataaggtcaaagactcccttaatcatagcaaaataaacaacaacaccaagttagctcaaagagttgtttcaagattaaagaatcaagcattcaagattcctctcaaagagtcaagaatcaaatga

SEQ ID NO: 91566 - DNA, 273 bp, Glycine max
  Peptide Sequence Number=SeqID_208344
atgctgattattgataaccatttgaatgatgtgaatgagttgaaatcactgttgagcaaggagtttgacatgaagaacttgggtcctgccaagaagattctggggatggagattcacagggataagaaacccatatggttatggctttcaaaacagggtgggtctgattgttggaagtccattattcaatctcttggggcaatatcaacaactaaaatggagtatatggcagtagcaaaggctagcaaggaagttgtgtggttgcaaggctag

SEQ ID NO: 91567 - DNA, 166 bp, Glycine max
  Peptide Sequence Number=SeqID_208345
atggcttctgctagagggggagactaccatctggatgacactcacactttagggggagattattggagtacaagtgtgagactggtgaaatccatggaagagtcgtttatgaggtttgtggggattcttctcttggatatgaagagtgaagaccatgttcttgaag

SEQ ID NO: 91568 - DNA, 738 bp, Glycine max
  Peptide Sequence Number=SeqID_208346
atggggataatataccgtgatttgaagcctgaaaacgtgctcataagatcagacggtcacataatgctcacagactttgacctatcattaaaaggtaacgataccacatcaacggctcagatcgtgtttgatgaagatcgacccagcaacaccggtagtaacgaacattcgaagaacatgtcatcatgcatgttgccgaattgcatggtcccatcggtcccatgcttccatccaaagcaaggtggtagcaagaggtcctctcgcagtgggtcccttgagatcatagcagagccaatagaagttcgatcaacgtcgttcgttgggacccacgagtacttggcgccagaagtgatttcgggggaaggtcatgggaacggcgttgattggtggacattgggtgtgttcatttttgaaatgttctatgggatgacacccttcaagggacttgagcatgagctaaccctagccaacatagtggctcgagcccttgagtttcctaaggagccgatgatccctggagcagccagggatttgatctcacaacttttggtgaaggactcaagaatgagactagggtctagaatgggtgccgtggcaattaagcaccatccatttttcaacggggtcaattggccattgttgaggtgtgctacccctccctacatcccttcatcagacaagtgcaaggagttgcttcctctctataattgcacaaacaacgctctagacttctattag

SEQ ID NO: 91569 - DNA, 285 bp, Glycine max
  Peptide Sequence Number=SeqID_208347
atggagaggagtatgattgatgctgccagtggtggagctcttggtgatatgacccctgctgaggctagaaatttgattgagaagatggcttccaactcccaacaattcagtgcaagaaatgattctattgttcttataggagtccatgaggtggccacggattcatcttcatctactgaaaataaaaagcttgaaggaaaacttgatgccttggtcaacctacaatttggagtcaatgagcaacttgaagcttatgctgcaaacatttataatagacctcaatag

SEQ ID NO: 91570 - DNA, 306 bp, Glycine max
  Peptide Sequence Number=SeqID_208348
atgaaaccatgccaggcatcagttcctctgccagatggtcatgctccgcagccccgagtcgtccctcaggccccagagacagatatccctcacgtgtcggagctaggagcactattgacatctgcgaggcccgctgtggaagagcctagacatgcagaagtttgctatgggattgctgagaggttggagctccatctgagcctaggggtggtcacgccaagctcatcgatacatgaggtgattgaagaatgtctcaagatggccaggagtgtcacacaggaccagctagtatatgttaggtcttga

SEQ ID NO: 91571 - DNA, 1218 bp, Glycine max
  Peptide Sequence Number=SeqID_208349
atggtagctagtttaaaaggaatagatggatttataagcattgactgtggagcaagtaacgattacttggacgaggaaacaagtatcttttttaagacagacacagatttcatagaaacgggagaaaacttcttgacgtcttcccaatttattcagacaaatgaccctgatttgggaagacagctacacacactcagaagcttccctgagggaaataggaactgttatactctgaagcctgagtataagcaaggtgaacagaaaagttatctgattcgggcaatgttcggatatggaaactacgatggaaaaaatcatgcccctacgttcgatctctatcttggggtcaactactggataaatgttaacacggcaacaaattcctatatttggacggagattattcatgctcccacaacagacaccatacaagtgtgtctcgtaaatattgacactggtacacctttcatttcgtcattagagttacgacctttaagcacttccatttaccaaatcatgtcacaatcatatctacacctcaaggggcggtttgatgtcggtggccctgttgtaaacttttataaaaggtacaaggacgatatctatgatcgcaggtggtactggcgcgatgttaaagattggtataagatcaatacaaccatagatgttaataaatctggcaatgatatttatcaagtaccagctgaaatcttgaaaaccgcagtgcagtccttcaatcgctcatatgacttgtaccatgactatgaaattgaatggaatgttcacttgaacaagtattccagatattatgtctactttcactttgctgaaattcaaaagcttgctccagggctcagaaggataatcaacatcactctcaatgatgaaaacatactctctgagcctataactctcgaatatatgaagcctgtcactattagtaacaaaaatgcaactcaaggtttcgttcgcttttcaattagagcaactgcagaatcggatgctcccccaattctcaatgcttttgaggtttatgaattaataacagatctaaattcaccaacagatattaaagatgttgatgccatggagaacatcaaacgctactatgggatatccagaatagattggcaaggggacccatgcgttccagaaatattcagatggagtggcctggactgcagctacggcatcaatcctagaatcatatcattgtga

SEQ ID NO: 91572 - DNA, 804 bp, Glycine max
  Peptide Sequence Number=SeqID_208350
atggcatggactctatctgatctgcaggcaaatattctcacaagagtacaccatagatgcttgactccacttattggatattgcaatgaaggcaccagaacagcactcatctatgaatacatgaccaacggagacctagctgagaagctatcaggtcaaagtcaaacattcttaggttgggaacagagatttcaaattgctttggattctgcaataggcttggagtaccttcataatggttgcaagcccccaattattcacagagatgttaagactagaaatattttactcgacgagaatctccgcgccaaaatatctgattttggattgtcaagaatcttttcagatgatggtgacacccatgtatcaacagcaattgcaggcaccccaggataccttgacccagaatacaacacaacaaacaggttgaatgaaaaaagtgacgtgtatagttttgggattgttcttctagagataatcacggggaggacagtcatactcaaagcccaggtgagaactcacataatcaaatgggtaagttccatgctggctgatgatggtgaaattgatggtgttgtggatacaaggttacaaggagaatatgacagtgaggctgcaaggaaagtaatagatgttgcaatggcctgtgttgctccgagttctgttaataggccaacaatgaatcaagtggtcatggaactaaaacaatgtttccccgtggggaaacttgggactacgtccactggatccagtgaaattgtctctgcgggtgaaattagcggacttagttctctagccaggtaa

SEQ ID NO: 91573 - DNA, 1521 bp, Glycine max
  Peptide Sequence Number=SeqID_208351
atggctaaacattttgtgttagcaatctatcaattgtgtttgactcttgcagctttaattcatgcccaggatcaatgcaatcaggcttcattagcattgactgtggactcatggatgaaacaagctacaaagatgaaactactggtcaattccttagagaaacagttttggaatgttagaagcttccctgaaggcacaaggaactgctacaccttgtatcttcttcctcgagtaaatagcaataaatgtctcgtaagggcaagattcatgtatggaaactatgatgggaaagattccctgccaaaatttgatttgtaccttggacccaattggtggaactctgtggagtttgaaaatgcttctagtgtgacaaccaaggaaattgtccaagttgccacctcagattatattcaaatttgccttgttaacacaaataatgggacacccttcatatcaatcttggagatcagagttctcaatgatggtacctatgtatctgagtcaatacagctcctggaacggtttgatataggcttacaagagggtcaaaatgtcaaggatttgtcgaataacagtttaactggttctatacctgattcattatctgaactcaagtccctgaggattttaaatataggagggaataagctatcaggctcaattcctgcaacactctctgagagaacaaggaatgggtcgctgcttatattaagcgtggactcgaagaaacaagagttcagctactcggaggttcaaagtattacgaataattttgagaggattgtgggtaaaggaggatttggaactgtctactatggttgcataggtgaaacacaagtagcagtcaagatgctctctccctcaactcaagggtatcagcaatttctgacagaggcaaaaattctgacaagagtacaccatagatgcttgactccactcattggatattgcaatgaaggcaccggaacagcactcatctatgaatacatgaccaacggagacttagctgagcaactatcaggtgaaagtcaaacgttgataggttgggaacagagacttcaaattgctctagattctgctgtaggcttagagtaccttcacaatggttgcaagcccccaattgttcacagagatgttaagactagaaacattttactcaacgaaaatcgccacgttgttctgctagagataatcacggggagggcagcaataatgaaaacccatgagaaaactcacataattaaatgggtaggttccatgctgttggctgatgatggtgaaattgatggtgttgtggatacaaggttacaaggagaatatgacagtgaggctgcaaggaaagtagtagatgttgcaatggcctgtgtagctccgagttctgttaataggccaacaatgaatcaagtggtcatagaattaaaacaatgtttatgcaaggcaaaaactgagaatacttccactggatccattgaacttgtctctgtgggtgcaattagtggagttagttctctagcgagataa

SEQ ID NO: 91574 - DNA, 315 bp, Glycine max
  Peptide Sequence Number=SeqID_208352
atgtgggtgcaagccattggtttgtttgctcaagcgacctgtgctcctgagtttggactttccaagaccattcaatcagaaattactcatgctacatatttgtcctttgcgagaatcaaccgcctttttcattcttccttgctacaaggttgtgaaaacaaaacaacgatggatacctcagagccctacactggggcaatgaaaggcaccatgcataaacctcaagcgaacataagggcagatcaaaagttctcacccgtcgatgtttttaaacaaataaactgggggacaaacccggggatttcaatggattga

SEQ ID NO: 91575 - DNA, 114 bp, Glycine max
  Peptide Sequence Number=SeqID_208353
atgtctgcttggacattcaaagacggttattaccgaaaaaccgtctttgaatgttttgttgacattgctggaaacgcagccgatgcagctgcaattgcggtcacagcaacttaa

SEQ ID NO: 91576 - DNA, 213 bp, Glycine max
  Peptide Sequence Number=SeqID_208354
atggcacgcagcgtgtttgctccgtgcccctatttaagggacctatatgggaaagagctaaaaaggcttttagtgataattcccaaggtggttatatctctcttgatggtctctagaggtatcattcccttcgaaggacatatttcagcagtagggactactagcaacaatatgttatcaaagagaaaaactctagatgagggttcactgtaa

SEQ ID NO: 91577 - DNA, 213 bp, Glycine max
  Peptide Sequence Number=SeqID_208355
atggcaaataattctgaagcatggatgcctggctcgctcagcgagctagattggctaagcgaggcttatccacttagcgaggaagtcagctcgctaagcgagtacgaaaccctagagaatgttgagtcagagagtagcacgctgagcatgaagccagccaacccagcaaggattttgtctcttctcgcgcttagcgcatccaagctcgcttag

SEQ ID NO: 91578 - DNA, 633 bp, Glycine max
  Peptide Sequence Number=SeqID_208356
atggcctctaaaaagagatgtgcatcatcttccaggccccaggagccctatgacacattcagatttgtgtctgaaattgcacaggagcgatataagacaaatacggagaaccacatagacttggcactagttaaggagttttactctaatctctatgatcccgaagaccgttcttccaggcaatgcaaggtgcgggggaagacgattaagttcgatgccgccacattgaacacatttctagaaaccctagtggtgcttgagcctagggagagatacccaacatactcccgttacggccacactcaccctgaccatcaggctattacagcaaagttatgcttaccagggcaggggtttgttctaaatgctgagggggctccttggaagctgctgaggaaggacctgaccactctagctcagacttggagtgtcctttcttactccaaccttgctcccacttctcatacctttgaccttaatatggacagagcaaggtttgtttatggcttggttatgaagatggacatggacttgggctccatgatttcatgccaaatctctcagatagcccagtccaactcctctcgcttaggctttttagctctcattactccacgattccctgacttttga

SEQ ID NO: 91579 - DNA, 294 bp, Glycine max
  Peptide Sequence Number=SeqID_208357
atggtggttgagcaaacatgtaaaaaattggaaacgaacaacaaaaccaacaaaaataatcaagatatgaacattgccttgcaaacaaaacggtattatagacatccaaaactcaagaagcaatggggttttcttctgacctcagagaaagagaggcaacactttttttttgctcgtgctttgcatcatcgaaaggacaattcagtggggagcagaggtagtgcacctgccatgccattggttttctctctgtcactgccattgtccaccactagaacgtgtagactgaaatga

SEQ ID NO: 91580 - DNA, 867 bp, Glycine max
  Peptide Sequence Number=SeqID_208358
atggctcgcatcccagacaagatacaggacataaatggatccaaagaaaccctgaaacttgttgtgaggataactgatctttggtttgtgggaacgcctgacaagtctgaacaagcagagatgattatagtagattgcaatggagaccaaattcatgcggtttgtaagcgagaccaaatcaagtcttggaagtcgatcttgaaagagaattgtacttatatgatgcacaattttaaagttgtcaagaatgatgacattattggtgtcgttgatgaggtcgtctaccaacaagtttcatcgaagagtatgagggttgcttttaaattgaagaatttgaggcttaccgaattaggcattgaggcccactcagttatgacacctcacagtcaaacaagttcacaactttcagcttgcatccattgttacaagaaaactgatgtagacactgctcccttcacatgtgcatgtggcaaatataatcagcaagttgtgcttaggtatagacttgaggtcatggttaaccacaaggaggaatgcacgaaattcttgctttgggaccatgaatgcactaagctaattggtcaatcagctgacgaagttaataggttaaagatagcagatggtgatgttgatttgaatgtttcacccgaagtgcttgataagctcttgggatattcacttgtgtttaaagttaaggttcagccaaagttcaagaattttgttgttctaaaatactcatctgacttagatttgattaagaccatagtagacttactacctgatgctgaggcatcttacaagaccgatattccactccctgattacaatgatcctcccaactatgagactatgagtgcaaaatttgat

SEQ ID NO: 91581 - DNA, 753 bp, Glycine max
  Peptide Sequence Number=SeqID_208359
tgttggatatacgagcactttttgtcagtttcagagtgcaatgctgatccggactatgacgaggtgtcaccacgtgtgtgtcggtggattgtgacgaagaagactgtgaagaaggtatctacagtgacgtacaggcagtgcctggattgtctaaggatcctagatgtctgctggatgccatatgcagagcaccgacctatccaggactttcatctgatttcgtgtttctcgggacagctccattgggggcctgttgttgtcagatacagaccggaaaaggttatgcgccagttcggctacgtccagtgcattcctgcacaccctgtccattcatgggtgtcatatgatgacgtgaatgatacttggacgcactactcagactatctggcaacagcaggtgatctatgtattgtgtcaggtcagtgtgcgcctgactacatagactggttctttgtcatattgcatccattcatgactgtgccacagacggatcctcctcaagatgcatatgcgacgcatcccagtcatatccctcatgaggcagcaccgacatcgacacatgcagatcctgatgcggacgagcccaaacatgcagtggaggcttgtcatgcgatcgcggaggcgttggagcaacatctaaatgcgccaagcacatccactcatgaagaggtcatccaaaaatgcctcaggattgccaggggtgtcacagaagatgtgaggtctcaacgtaggcgccgcacggatcatcaatag

SEQ ID NO: 91582 - DNA, 292 bp, Glycine max
  Peptide Sequence Number=SeqID_208360
atggaagacacacccgtgagccctcgcctcgccctcccgccgaagggtaggttgcgacagttggcgactccactggggactgatattgccatgctgtgtacatccccctattgcgcttatgcgcatctacatcatgtcgtcacgcatgcgttgtatgttggtctcgtcttttgtcacgggaagccggaagacgcacccttgagcccttgcgttgccctctcgccaaagggtaggttgcgacagttggcgactccactggggactattgttagagagttaggccaatcaatcg

SEQ ID NO: 91583 - DNA, 327 bp, Glycine max
  Peptide Sequence Number=SeqID_208361
atgcattcatatcatgcaccgcataaacatctcttcagcatcataattgtcgcaacgtgcccttttgcgggcgggcgacgcgtgactcgcgggatgcgtgttccacgaaaggaatacgcgcggaatcgccaccaacgtttatttgaggaaaacgtcgaaaaaaccgaaggaaaaccggtcaaaaagaaaattctaagttcgggagttgtatttacgcttgaggaaggtgatcattttaaggcgttggaccttgaaaatgatccattttacttagtaagaaacagaaatgataaactttcaaaatcctatttttgtggacgagcttga

SEQ ID NO: 91584 - DNA, 546 bp, Glycine max
  Peptide Sequence Number=SeqID_208362
atggagagttgggaatggaggacaaccaaattttgggaggatgcttgggttcctaatacgggtaagcttcgggagcataatatttctgaggcttcaatgttgaggatggagttttttagtccctgtctggtatcagatcattctcgaccaaacttggaagaagacttatgtattagcttgagatatgtagaaggcatcagacatggaggtggtgttgaggaatatcaatcatatccaatgtgtggtgtgggttcaatattggactcccctacaaatggttacataaagctcagttgtgatggtttcatgaagagcttcatttctcgagctacttgtggtggggtgttttgggatgagcagggtccttccttgctggtgacaatggaccttaataatggggtttgtggtcatgaccatccttgttttaagctagtagaggaggttcgttggaggcttagcgacgtggaagcttatactttgtctcatgtagatagagatgctaacaaatttgcaaatgtttttgctcattatgttgtgagtaattag

SEQ ID NO: 91585 - DNA, 99 bp, Glycine max
  Peptide Sequence Number=SeqID_208363
atggagtctaaagatgctattcatgcgctcctaatgaaggcggtgagagccaagtacaagtgtgggcttgagagcattcctcatattgacaagaattga

SEQ ID NO: 91586 - DNA, 504 bp, Glycine max
  Peptide Sequence Number=SeqID_208364
atgatcttattttcactttcctcactgccaatactttctaaggaggtaagcaacaccgaaaagagcctatattatattgccctacccttcctagccgttggatatgctggacatgcagcttcataccgaaggccattggagtcacgaattaatagacaaatcacatatgaagagctactaataatagcgaattataaatttgtgggtgtcgtggccacttatttcctctcccatgttggtggctttgcaattcaattcgtgaagtcatggccaactcgtttcggcgttgccacgctctttgtcacggtagctacgcttctttacttgactgggattggttcttatagaaaggggactccaggaggaagccctctcacgacgttctttagagtcttgatagcatcttgttccaaaaagtcctatgccctcctaaggaatgcaaatgagctttacgatgaaaatgttgatcctactatgcctcgtcatactaattgcctcaggtag

SEQ ID NO: 91587 - DNA, 1023 bp, Glycine max
  Peptide Sequence Number=SeqID_208365
atgggaggcacttactttatgaagcaaggaaacgaaatgaacccatatctaggaaaattgcagctccctcttttcacacttgttgtatttcacaaattagccgagaccttgatctccttcatctggggcatagttagagacaaggtacgcgaaaaccgaagaaaatacctcgccccaatcggaatggcaggggctatagtatgctccatactgtgttgcataactgctgcttcagttgagaggaggagattggatgttgttagaaagcatggggtaatggagaaaaaccctaaagacaaaggcacaatccctatgaccatgttttggctgattccacaatatgttctcctcagtgcccttagtgcaatatctagtttctgttcttcccgtttctacactgatcaagctcctgagtcactgagagattactttgtggatatcacacttggtgtatctagggcaggaatcatggggagtgtggtcacagtttatgctataggcaaggataaagctcacggaggaagaaagatgagatggggagggagaagggatccatgtgagcaagagaggaacgacggcgaggttggagttatcattggtgttacaatgttgatggatgtaatgatggcaaaggctatgatggtggttgggaaacaacaaaaatctctaacgcaatgttccatctcaatccatttcattgacgactctcaagcccaacaacatgttccctcagtagcacaactcttccacctaggaggatcaaaccaagttttggctcagacatgcagcttcaacaaccttgactccctcattgataacaccgttcccaaattcattcatctcaatggcatattcaacacattccacgagagctgtcaagcgaactacgcaaaaaggacagatcgagcgtgggcagctgctgaagttgctattgttgatccttgcaacgccacgctagtgatggcagaattcttcacagatcttaggctcagtaatgggatgtgtcagcttccatttctttag

SEQ ID NO: 91588 - DNA, 852 bp, Glycine max
  Peptide Sequence Number=SeqID_208366
atgcagctttccctgccctttgtatcagaagaatttcttcacagagcagctgatctgactctggtgccatctgctgccattgcgggggatctcctagcagctagagtcacagcagcatcagagaatatgtgtttcctggtatgcctactactatgcagcaaaattttgaccgagtttttctcctgttggtatccagctaacaagattcgtctttggaacaagggtgttgattctgaaaaattccatcccaaataccgctcccatgaaatgcgattaagactaagcaatggtgaacctgacaaacccttgattgttcatgttggacggcttggagtagagaagagtttagattttctgaaaagggaggagctagagaaaatgtttgaaggtatgcctgcagtattcactggaatgttagttggggaagaactgtcccaagcatatgccagtggagatgtatttgtcatgccttcagagtcagagacacttggtcttgtagttttggaggccatgtcttcagggatacctgttgtggcggcatgtgctggaggtattcctgatataatccctgtggatcaagatggtaaaactagctatctgtacaatccaggagattttgaagactgcttgagcaaactaaggccccttttgctcaacaaagagttgagagaaaccatgggaaaagctgcgcgtgaagagatggagaagtatgattggaaggaagccacgcgaaagattcgcaacgaacaatacaatgctgccatttggttctggcgcaagaaaagagctcaactattgagacccttccaatggctggcaaaacgttttttcccatcaccacaagtcaactag

SEQ ID NO: 91589 - DNA, 384 bp, Glycine max
  Peptide Sequence Number=SeqID_208367
atgtctagaaagagcaaaagggtgtgctttagtcctgatgtcaacgacaaaccaaccctctttctcaaatacaatggtggtggtggcaacgacaaggataatagagtttcaagaaacgggaagagggtcaccagaccatgcactttcagattttctatggacactaacttgtctcctgcgaagtttctactgcagctaggagaaaaggtggcaagtgctataagaaacgtttctgtgagaaggagatcctccagaaaggtttcttcatccactttggttaggtcacgttcattatcagacctcactgattcacaccgagccgaaactgtagaagattgcattgagttcttacattcctcctcatctagggagagaccaagttga

SEQ ID NO: 91590 - DNA, 798 bp, Glycine max
  Peptide Sequence Number=SeqID_208368
atgtcccatatcccttggtgccttcaaaaaaggaaaaagagtgatattttgctcattttcttgacatttttaagaagctggagatcaccattccctttggagaatccttgcaatagattaagcaaagctctcattgatttgggggcaaacatcaatttgatgcctctctctatgtgtcagaggatcaggaacctgaagattaccccaactagggtgactcttcaactagtagacttctctattacaatgccatatggtgtggttgaagatgtcctggttaaggttcaacaattcacctttcctgtggactttgggatcatggacgtaaaggaggatttagacattcccctgattttgggttgtccattcatgcttactgccaaatgtgttatggacatggggaatggtaatctagaaatgagtgtggaggaccagaaggagattcccctaggggaatacgcctttgaagaattgaaaaaggactttgtaacaaagaagcctaaggttgaattgaagtatgtttttcttgaggcacatgataccaagccagtagtcatcagtaatgaattatcttcagttgaggaagaacacttagtggagtcacatggaggagaatatgatgtagctccatgtggagcttgtagaccttggatcttcttcatcaatgaagtcctttgcttcttcaagatcatggtagcggaatggagaaggaagaaagatgattggagatgccacttcaaggagaagatgagtcaagaagaagctcaccaccataagaagccatggataaaagcttga

SEQ ID NO: 91591 - DNA, 249 bp, Glycine max
  Peptide Sequence Number=SeqID_208369
atgctctcgaaaacggaagcttcgagcacactccagacatcttctcaacgatcccaacgggtgttacagtttcaaatgtcaacacttctactacatctaatagagctacgctcctggtcagtagaagaagggtctagacagctcaagtgcttcatacagcttcacatctttgatggtgaaggggccagaccacttggacttgagttttttaggaaaaagctgttggaccagcggcctcaaaaatcttaa

SEQ ID NO: 91592 - DNA, 690 bp, Glycine max
  Peptide Sequence Number=SeqID_208370
atgtcatttgggttatgtaatgcccctgccaccttccagagatgtatgctagctatttttgctaatttggtcgaaaaatgcattgaggtgttcatggatgatttatcagtatctgactcctccattgaatcttgtttatccaatatggaattggtgctaaagcggtgtgtggaaaataacttggtgttgaattgggagaaatgccatttcatggtccaaaaggggcttgtcttaggccataagatctcgtcccaagagattgaagtggataagacaaaaattgatgttattgagaagttacctcctccatcgcgcaagaaccacactaagcgcaattccaacccgaaagggaattgcactgagcgcaaattatcccacttagagcaagaggaattgcgctcaacacggattgtcgcacccaacacatcccaacccaagaggaattgcactaagcatgaaaattcgcgcttagcaccaaaagtctctctctctctctctcaaaattccatccaaaccaccctagaaactcctcctccaccacccacaaccaccagtggccaccacaagccaccgttgcttgccaccgaaccaccacatcgagaggaatgttttaatcagagcgaaatcctcagaatccacctcaaggattcgatggagaacaatccctcaatccctcaaggattctcctaa

SEQ ID NO: 91593 - DNA, 576 bp, Glycine max
  Peptide Sequence Number=SeqID_208371
atggagggtgcagtgaccatgatggatatccctggtgagagtgtcgcatggacacgcttaggctattttccaatgaatggtaccacattgcatttgagagttgagagtggtgataccgtagtgacaaaaagggttgttatagtttttatcgtttttatcagagaccctaaaggagaaaggcttatgtcaacccccgtgatggtggcctcaaattggagccaagaatttcagttgatgtgtgacgctaatgactatgtagtgggagcagtgttaggacaacatagggatcatgcggcgatcaaataccttctgacaaaggctgattccaagctaaggttgattagatgggtgttaatactccaagaatttgacattgtgatcaaagataagaagggatgcgagaatctggtggttgatcacctatctaggttggtaaatgaagaagtcactcgagaggagcaagatattcgagatgagtttccagacaaatccttattatctgtgggtgagcggccttggtttgcagacattgccaactttaaggcagttggaatcattccaaatgatcttaactag

SEQ ID NO: 91594 - DNA, 266 bp, Glycine max
  Peptide Sequence Number=SeqID_208372
atggaggtgcaagtgggccaacttgctaagcaattggctgagaaatccactaggaactttgtggtgaacacagagaagaacccaaagaaggaatgcaaggtggttctcaccaggagaaagaggaaggagagccttgaaacagaaaagagagctaaaggagtagtggaggatgtgagtgataaggaagtagaggatgagaggaaagagaaagaattgagagataagaaaaataaaaagaatgagaaaaatgaaaaagaaaaaaatag

SEQ ID NO: 91595 - DNA, 351 bp, Glycine max
  Peptide Sequence Number=SeqID_208373
atggatgtagttgatttccttcttgtatgtgaggaaaatagtttgagaacttgggaggaggtggtggagaagtatttcctagagtccaaaaccgccgaggggaaggcagagatttccatatttcaccaattccctaatgagtcattgagtgaagctctagaccgcttttgtggtctacttcaaagaactcctactcatgggtttactcaaaacaaactcttagccaagaaaattgagacactcacggaggcattgaacaaacttcctcaacagttgcattatgtgcaacctgcttcatcctatgtgatgcaagttggggaatataccctatgtggtggagctcatgagtaa

SEQ ID NO: 91596 - DNA, 540 bp, Glycine max
  Peptide Sequence Number=SeqID_208374
gctagcacctatgtcaagactatgtgtgtgcacttatgcttgcttcttggtgtgggtagccacatgcaggagcttcggagggtcaggtctgggatcatgggggagaaggataacatggtcaccatacatgatcatgggggagctgagtgggtttatgataattatagggatgggacttatttgaggagggttgttatgcccttggagattcttttgactaactataagaggttttttgtcaaggattctagtgtcgatgctatttgttatggtgctaaactttatgaggggttgacaatcgttcacaatatccctttgcgccataatcaagtcaaggttggtgttaaggaagttagagatgcagatgctttgatttctgtactcactcaagaggttcagttagtgggacagatacttaacacattcgttgtttggctgacacatcttgtcaagcgtttatcagaacaaggagttgtgggaccgaagaaacctgcacatgcactagatgtcaattgtaattttaggaagtttcaagaataa

SEQ ID NO: 91597 - DNA, 616 bp, Glycine max
  Peptide Sequence Number=SeqID_208375
catacatctacttgggttgtaatactgagaacaagagagggtacatctcttatggatcagttcaagtggagcgtgcatccactttgttgttcaaagagaacaagggagggtacatcccttgtggatctttgcttgtaaaggattttacaaggttattggaaatctcaagaaccgtgggttgcatggggactggattacaagagacacatgaagtcgcagtgaagcccccaatctcgcaagatgagtttgttggagaagcgaatgccatgaggcactccacaaaggattctgaggcgtcaatccagcgaagggcccactgggcttttttgatgatgcatgggatggtttctaagaggaggttgtacatttcggagtggatattttcgatggacgatgccgtcggaggcggtgaagaaggcgaggacgtgggtgatgaaggggcgctcgccgtcgctgagggtggcccaatggcagaggtcctgcgagagaaccgatctgggttcggagccaggagtggttcttctgttatccttgtggattattttgatagccttgtgaagttgcctgctacagtcgtgcagaaggcggagaagtatactttggcaatcgtagcttg

SEQ ID NO: 91598 - DNA, 354 bp, Glycine max
  Peptide Sequence Number=SeqID_208376
atgattggccaaaaggttgtaatcgattaccagaagcccaaacgttacagagacggtgaagggattgaagcattcattttgtactgtctccgtgcgattcacttttcactctccatgaatattatctcacaaatcccaatgctggaggtttggtggtatgcgggaaaagagagggttttgggaggaagagaagggaaaacgaaattgagaggaagaggaggccgagaagctatcgtcgacaaaagcggggcttttgctcctacataccctccatcgaagaggaaatcagacctacgtagttcttcctttaagggtgaatcaagtgattctttttacttgaaaggtgatcattaa

SEQ ID NO: 91599 - DNA, 213 bp, Glycine max
  Peptide Sequence Number=SeqID_208377
atggccgcgacggcaggtcgaaccagttgtcaggttgcgcgatggtgcagtggtggtgcaagtgaaggaagggagaagaaaatgctagctggtatagtctcgcagataactgggtttagttatcgtgcgagtgggcctcgtcgtggcggcaggaggacgatgttcatcgttgttagaggcgtgggtgctaacaattacttatgtgtgaattga

SEQ ID NO: 91600 - DNA, 522 bp, Glycine max
  Peptide Sequence Number=SeqID_208378
atgaagaaccaaccagcttccacgaagctagtaagcattagtgctggcaggatgctggcgttcgtgttgaataatcatggagaacacgcgagtagcggaagagtaggggcaagtaatcaaggggtgaaagttatcaagctcttcccagagagacttaagtttggtatagtagtcagtaatagagagattaccttgctggagggaataaatttcttcctagagctcagcaacccgaaggatatctccttatgtgaatcattctctgaggtcagtccaggtgtcaatggctctctcaaagaagactacactctgagcaatggaaggaatcagtatggagccagtgaggaagcccatcttgtttttggagacaagagccatgcgtacataacgagaccatcacttaaagttgggtcctgtgagtacaggagtaacaaggatggaagatgggctttcactagggatctgagaaaggtggagctggtggaggaggtgggggatcctcctcaccagaggaagtgctag

SEQ ID NO: 91601 - DNA, 4461 bp, Glycine max
  Peptide Sequence Number=SeqID_208379
atggctgatcacggaaccaggaatacaaccacagaacgtttggaagatgcaatcgcacgcctcactaacagccaagcaaatctcaccgaacattacacagacctctctggtagagtggattcgatcctggaccacctcaggatgcgtgatgcgcaccagaaccagccctcccctagcagctcgaacaaccaccgtaactccgttaagctcgatattccgtgctttgatgctctggaatcacggtttgctccgacgttctacgacgatcccaagggagctttattcaagcttgtgcaacgcggttctgttaacgactacttaacagaattcgagagattggctaaccgcgtggtaggactccctccaccatttttgttaagctgtttcatctctggattaaatccagaactccgacgtgaggtgttggctctccagccaatatctcttttgcaggccactgccctcgccaagctacaagaagataagttgcgcgacaaacgttcttcgttccaacggcccttccagccttccccatcaagttcctctaccagcctcaaccctaaagttaagccaccatacgttcaacgtacaccggaggacatgtcgtttcgtagagagaaagggacgaatactactgctcagatgggaacagatgcatctagtaccaccatgggggctatgccaccagatgacggcgaccctgactccataacaccaaattcttgcctggaggacaatggaggtgactctgaacccgccatggacaccggctttccccacatcagtcttcatgccatgtctggcctaccatcatcggagacattccgcgtctatggtactatcaagaacacacgcctcaccatcctcatagacagtgggagtacccacaacttccttcaagcacgggttgcgcaattccttaaccttcctgtcgaaaccacacgtcctctgagggtcctcatcgggaatgggtctgtcctagactgcaaccaacactgccctgatactcagctctcgatccagggccactcctttccggtcaccttccacttacttcagatcagtggggcagacgcagtgcttggcatagattggttaaaacaatttgggcccatcacgactgactacacctccttcattatgaggttcacccatttgggccaggagatatccttgcacaccgacgtagctcttggacctaagcctgcttcagcagcccaagtgaaatgcctaatccatatagcttccaccgtgagtcatcttcctcttgtggctgaacccgttgcaaggcttctccgccgatatgataagctctttcagccctcgacacatctacctccctcatgcaaggtgaacaaccgtatcactctactcccttccacggcgccggacgagcacgagcccatactcttctccagtccttttggtgaagaagaaggacgacacatggcgaatctcgatctccggcaaggattccaccaaatactcatgaacgaagctgacatagagaaaacagctttccgaacgcaccatgggcactatgaatacttcgttatgcccttcggcttgtgtaacgcaccttcgaccttccaagtagccatgaatcacctcctcgcgccgttcctgcgttgtttagcagctgtgttttttgacgacatactcgtctatagcgactcactgtcatcccacgttcagcacctcgacataatcttccaagctcttctacgaggtcagtactacttaaagcaaacgaaatgcttatttgctcaaacccaactagagtaccttgggcatgtcgtctccagcaatggtgtagctcccgagccgtccaagattcaagccatcatccaatggccaactccaacatcagccaaggatcttcgagcatttcttgggctcacagggttttatcggaagttcattcagaagtacgcagctatcgcaaccccactcacccatctgttctgtaaggatgcattcgaatggtcacaagagtcgcaggatgcctttgacaaactcaaaacctccataaccagtgcgccggtgttggctctccctaacttcaacgagccttttacggtggaaacaaatgcatctagtaccaccatgtgggctatgctcatacagcaaggacacccactagcattttttagtaagaatttcagcccacgtttgtcacatgcttccacgtacgtgagggagcttcatgctatcatcgcggcagtgcgaaaatggcggcagtaccttctcggtcgtccattcactatcctcaccgatcacaagagccttcgggaactcatgtcgcagtataaggttggtgcagctaacgttgtcgcggacgcactctcgcgacggccacctgcttcaggccaattgctcctcctctctatgccgcaaatggatttcatgcgtgatattcaacaaacgcttgagaatgatcccagtttttgggagttggtacgcaacattaaggcgaatccttcagcatatcctcagttcagccttagtaagggttatttgctgttcaacggtcgaatttggttgaataaaaccaatccttacattccttccttattactagaattccatgccacaccacttggtggccatctgggaatagccaagaccacgcatcgtctcgaatcgagcttcttctggcaaggtatgaagcaggatgttaagcaattcattcgagagtgcaaggtttgtcagcagaataagtccagtactaggcgcatggcaggtctactgcaactgctaccaactccgacgggggtatgggaagacatctccatggatttcgtaacccatctgctgccctctaacggcttcactgtcatcttggtcgtggttgacaggttctccaagggggtgcatcttggagcattacccacagggttctcagccttcaaagttgccacggtattcctcgacatcatttgcaagcaccatggtttccctaggagcatcatttctgatagggatcctgtgtttccgagtgccttttggagagaattgtttcgaatctacgacactcgtcttcggcttaacacaacgtatcatccacaatcagacgaccagactgagtggtgctacaacacttctctacactctagctcggggcttactctgtttgaggtcatgtatggcaaacctccaccatcaattccccattacattcccagcttaaccaacaatgaagctgttgagtccctagttgaatctcgtcaagttatgcacgctaagttgcagaagagactggaaaaggctcaagattccatgaaaaaatatgcaaatgttcgatgcgaagatataacattttctgtgggccaatgggtctacgtgaagctccgcccaacccgccagcgctcagttgccgaagtcgcgtaccgattagaacttccggcgagagcatgcattcaccctgttttccactgctccttgttgcgccatcatcacggagctccgccctccgccacggaaccttggccccgggagatcatgggccataagcccttgcaatgccccctttgcatcctggacagcaagttcgatacttctacatctcctccaactcaattggtcctaacccaatgggtcgggcaacctcccgaagacacttcttgggagccatggcctgaattacaagaagcctaccaccttgaggacaaggtggtgttcgagggaggaggtattgttagcacccacgcctctaacaacgatgaacgtcgtcctcctcgtgcagctgcagctaaaaagctgattcagccagtcagccccaaaatgaccaatgatgtgtacaagcttcctgtggaaagtggcaagacctacttactgagaatcatcaatgctgcactcaatgaggagctcttctacaaaattgctggccattcactcactgtggtatctgtggataacttgactgctatagccacattgcagtacactggcactctttccaccacccccacacttttcaccatccctcccccaagaaatgcaacacaaattgctaacgacttcaataagtctcttaagagccttaattccaagaaatacctatcaaaagttccacaaacagttgattattcactgttggatttgggattaaccattgtccatcttgtagagcaggaaatgggagtttacaactacacggcgactccaccagtggttgcttcgcaaaccacaaatgacaccaaggcttacaggctggcattcaattccactgttcatgttgttttgcaggatactggagctattgctcctaagagcctcccggttcatcttcatgggttcaatttttccgttgttggctctggtgtgggaaactatgaccccaaaacgaatcaaaataactttaaccttgtggatcctgttgagaggaacacaattggagttcctactggaggatggattgctttcagattcagagcagataacccaggtaaaaattcttaa

SEQ ID NO: 91602 - DNA, 1707 bp, Glycine max
  Peptide Sequence Number=SeqID_208380
atggcagaagatgacatatatacacaagatgggaccattaccatctccaaaaaacctgccaacaagaaaaagactggaaattggaaagcttgctattttattcttggaaatgaatgttctgagagattggcatactatggtatgagtacaaacctggtgaactatcttcgggagcgtttcaaccagggaaatgcaaccgctgcaaataatgtcacaacctggtcaggcacatgctacatcacaccattgattggagcctttctagctgattcatacttgggaagatactggacaatttccagtttctcaattgtctatgttattgggatgatactcttaacattgtctgcttctgcccctggactaaagccatcatgtgatgctaatggttgccatccaacatctgcacaaaccgcaacttgcttcatagcactctacctgattgctcttggaactggtggtatcaagccatgtgtctcagcttttggtgcagaccaatttgatgattcggacgagaaagagaaaataaagaagagctctttcttcaattggttttacttctctattaatattggtgctcttgttgcttcctcagtgttagtttggatacagatgaatgttggctggggatggggttttggagttcctgctgttgcaatggtcattgcaattatatttttctttggtggtagccggctctacagactccaaatacctggaggcagtccccttacaaggatttgtcaagtaatagttgcagccttgaggaaaatcggtcttcaagtgcccaatgataaatctcttcttcatgagacaatagatctagaatctgtcatcaaagggagccgcaagcttgatcacacaaaccgcttcaagtgtttggataaggcagctgtagagaccgaatctgatcataccaaagacttgtcaaatccttggaggctttgcacagtaacacaagttgaggaactcaaatcagtaatctcattactcccagtttgggcatcattgattgcctttgcaactgtgtacggtcaaatgagcaccatgtttgttctccaaggcaacacaatggaccagcgcattggtcctcacttcaaaatcccatcagcatccctcaccatttttgacaccctaagtgtcatcttctgggctccggtgtatgaccgcttcattgtcccatttgcaagcaagtacactggccacaaacaaggattcacacaactccaaagaatgggaattggccttgtgatctccactatagccatggttgttgctggcattctagaagtctatcgcctcggcatagtcaggaaaaacaactactatgatgttgagaccatccccttgtcaatcttctggcaagtaccacaatattttcttgttggatgtgcagaagttttcaccaacattggttccttagagttcttttatggtcaggcaccagatgctatgagaagccttggtatggctctctcactcacaactaatgcgttgggaaattacattagcacccttcttgtcattattgtaactaaggttaccacaagacatggtaagcttggttggattccagacaatctaaatagaggtcatcttgactacttctactggcttttgaccgttctcagctttctcaatttccttgtgtatctctgggttgcaaagaggtacaggtacaagaaggtagctggaaatgctcattga

SEQ ID NO: 91603 - DNA, 2202 bp, Glycine max
  Peptide Sequence Number=SeqID_208381
atggtggagcttcccaagtccctctcaccccaccgtcttctcaagctcctcaaagccgaaaaatcccctctttccgccctcaatgtcttcgacgctgccgtacgccgccctggcttcagcccctcctccgccgtcttccaccacatcctccgccgcgtggccgccgaccccggcctcctcctcgcccacgcaccacgcatcatcgccgcgatccactgcccctgcccggaggatgtgcccctcactctcctcaaagcctacgccaaaacccgcatgcccaacgaggccctgcacgtgtttcagaccatgccgcacgtgttcgggtgctccccaaccattcgctccttcaacaccctcctcaacgcgttcgtcgagtcacaccagtgggcgcgtgcggagaacttcttcaagtacttcgaggccgcgcgtgtttcgccgaacgttgaaacctataatgttctcatgaaggtgatgtgtaagaagggtgagttcgagaagggtagggggttgctgacgtggatgtggggtgcggggatgagccctgataggatcacctacgggactttgattgggggtgtggcgaagagtggggatttggggtttgcgcttgaggtgttcgatgaaatgcgtgaacgaggggtggagcctgatgtggtgtgttacaacatgatcattgacgggtttttcaaaaggggggattttgtgaaggcaggtgagatgtgggagaggttgttgagggaggaattggtgtttcccagcgttgtgagttataatgttatgattagtgggttatgtaagtgtgggaggtttagtgagggtttggagatatgggagaggatgaagaagaatgagaggaagtgtgatttgtttacttatagtgctttgattcacgggttgagtgaggcaggggatttgggtggagcgaggaaggtttatgaggagatggttgggagaggggttaggcctgatgttgttacgtgtaatgcgatgcttaatgggttgtgtaaggcggggaatgttgaggagtgttttgagttgtgggaggaaatggggaagtgcagtttgcggaatgtgagaagttataacatatttctcaaggggttgtttgagaatgggaaggtggatgatgcgatgatgttgtgggatggtttgttggaggcagattctgctacttatggtgtggtagttcatggtttgtgttggaatgggtatgtgaatagggctttgcaggtgttggaagaggctgaacatagggaaggcggtatggatgtggatgagtttgcttactcgtcactgataaatgcattgtgcaaggaagggagattagatgaggcagacggagttgtagaacttatgaataagcgtggatgcaaatttaactctcatgtttgtaatgtgctgattgatggttttgttaaacattccaaacttgacagtgctgttaaagtctttagggaaatgagcggcaaaggttgctcactgactgttgtgtcctataatattcttataaatggattattaagagctgaaaggtttcgtgaggcttatgattgcgttaatgaaatgttggagaaagggtggaagccagatattatcacatacagtacgttgataggtggtctttatgagagcaacatgatggatgcagcccttaggttgtggcatcagtttctggatacagggcataagcctgatattattatgtacaacattgtcatccatagactatgttcctctggcaaagtggaggatgctctgcagctttattcaacattgaggcagaagaagtgtgttaatcttgtgactcacaataccatcatggaggggttttacaaagttgggaactgtgaaatggcatcaaagatttgggctcacatcttagaagatgaactacagcccgacatcatctcgaaatttgaggcccctgggcaaatagcttttggctacggctggtggactacatatagtacaaacaggaacattatgttatcaggtacttgggtgcaatacagtttgcctctagggtacctaaagtttggagttgctaagcagaatcggacgggtgttttggtttctgggatatttgtctgcgtcatgatgttaaaagtttcatcagcatcacttggtaacccagttactcagattttggtgattctagttatatcaccaatatctgctgttattgatgccaaagcaaagtag

SEQ ID NO: 91604 - DNA, 771 bp, Glycine max
  Peptide Sequence Number=SeqID_208382
atgattgcactcaaatccattcatcctttcttcactcctatctatatcaaatataacatccaccgaagcagatgcctcaacacaaaagattctgttttgtgcctctgcaagtccaatcaatctgaatctcaagctccccaaccaggagatattcgcaaacaagaactgctagcccaaattgccatgcttcaaactcaaaaagtccgtcttatggactattttgatgagagatctgaatacttgacccagtttggtgaagaagcgaaggctgagtttgacaagattggagaagatgccctccaaggattagatgaagctagtgccagaataacagcaaacatagagagccagatggtggagtttgaggaatctgcagaacttaacagacaagagattcaggagcgtgaaaaagaactagacaaatttgaagttcaaatggaggatggaagaaacgaagggctattctttaagaacctcagaaagaaggcacctgttgacaaagcgaaagctaaggaagaggcagaaaaaatcaaagatgtagccagagaaaaagctggtagcagaacaagaaaaggcatttacctcctctttattggcttactgacctttgcaatagttgattctgttgcctcatcatcaactgattggagaaaaatagcagttctgggagctattctagtggctttagtttctcagttcatctacgaacagacaatgtcaatagaaactggaaaaataagaaagatcgataccgaagaggaaaataactga

SEQ ID NO: 91605 - DNA, 339 bp, Glycine max
  Peptide Sequence Number=SeqID_208383
atgcttttcctcctattccaccattttgcgcttcttcttcttcgtcgtcgtcaacatcttcgtttgactcgaacaacaaattccttgttgagtcaccattctggtagctttgagtgggccgaaggcctcgtcgctgtgctccatgagcaagcgaaactcgtcctcaaggcaaaacatggcatgttggagcatgtcctcgatgtgaacgaggcacacgatgatgaacttgtcggagaagagttggctccactcagtgacgatagcgatgagctcgtccaaggtgtcgaggaaggtagcagaatcggcggcgtcggcccagattgtgtggtcggaggagaa

SEQ ID NO: 91606 - DNA, 315 bp, Glycine max
  Peptide Sequence Number=SeqID_208384
atgttgtggtcattgttcaatttgccaaagtctagagttttcaagaatatggattcactacgtgtaagtttgagtcaacttagtgatggtgcaatcagtacaaatgttgattttcttgaagttataccaaagaaaagattgaatggattaaagattgcagagaggagtatgattttatgtacattcaaacatattatggatgatgaagaatggtggtacacagcctatacctgtagtaaggttgtgtatccagattccaacatattcttttgtcctaaatgtaacaaacatgttgtcaatgtggtcttaaggtga

SEQ ID NO: 91607 - DNA, 282 bp, Glycine max
  Peptide Sequence Number=SeqID_208385
atggttgggaatggtggtgttgtggttcacttctggttggttgagaagttatggaatgttatcgcacgcaagtttgacggcagtgcaattggtatggcactgaagatcacaaggaaggaccccattggtgccttttggcaatgcattgggggagtcaatggtagagctaaaaatgaacttgcagatggatgtcgcattgctgcgagcatagatcttcaatggaaatccagcacgattcgacgaaaatgggatctaaaccagacgcgaactcggagaggctga

SEQ ID NO: 91608 - DNA, 594 bp, Glycine max
  Peptide Sequence Number=SeqID_208386
atgaatggtgataagttcactactattgcatttatcaccaaagagaaacgtggaaatagaaatgccatccaaaatgagaaagtggaatattacaatatctgtaggcaagattatactcaactaggtgaccctgatgagtttgttgaagggctaaacccaatgaaacaaggacacttgaaagcattagaatcactggtcaatgaagattttgacaattcaaatgagaattcacattcatcatgcttaaaaaatgaagatgtggaactcaatcaatcacaaaacaacctatccttcgaggataatcatattccaaggccagttattcctatcggacctcgttttcaagctgaagttccaacgtgggaagacagaaccaatatacaacataatgatgatagtttaaagttaatgggcatccaactttggcctatgcctaatattagcgaaaacaaaacaaacgatgttgggggaggatcaattgattgtgttaaactacatattagggaagcaagagaactcttgaaattggagattggagcaactttttcgagttggaagtttgatgagatgggcgaagatgtttcaaagtcatga

SEQ ID NO: 91609 - DNA, 198 bp, Glycine max
  Peptide Sequence Number=SeqID_208387
atggctatttggggactttacgatggagtacaaagagaaagggaaaatagggtggaccataggcccttgatggatggcctaacctacttccacccaacaaaggcccatggtgatgacaagtattgttcactagtgaaaaaagcaggaaggtccatcggggaatgccttgaggcggagggaagaagaccagtggcctag

SEQ ID NO: 91610 - DNA, 897 bp, Glycine max
  Peptide Sequence Number=SeqID_208388
atgaaaaaacaagcttttgggtcagaagacattttggaacctaacaagtcatcccaccaaagacctcgtaatcaaatgcataagattgacacactttcgattcctaatgcaaaatgtgcgaagaggaaacttgaccagtatatgtgtggtcataaagttgctactgaccttggacttatcactagagagaaatgtagtaatcaaaatgccatcctaaatgagaaagtagaacaatgcagtatttgtaggcaagattatcctcagctaggtgtctctgatgcgttaattgaagggccaaacccaaaacaaggatacttggaaaaccatcgtaaggatttagtgacaagttgtaattatgttactactaccgagacatcaatggagaaatcaaatatggaattttcgaaagcattagaaccattgtttaatggagattttgacaattcaagtgagacttcagtttcatcaagctcagaaaatgaagacaaggaactcagtcagccaccaaacaacttatcttccgaggataatcatattccaaggccagttattcccatcggacctcgtttccaagttgaagttccaaagtgggaaggcacaaccaatgtaagacatcatcatagtgatgatgatttaaagtggcttggcatccaactttttccaacgctcaatattagtgaaaacaaaacaaaagatattggggaaggtaggcatgattcatgctcatgtaaatttcctggatcagttgattgtgttgagctacatgttagggaaacaagagaactcttgaaattggagattggaacaacattttcaagttggaagtatgatgagatggggaaagttgtttcaaagtcatggacatcggaagagcagaagaaatttgaatctttgtaa

SEQ ID NO: 91611 - DNA, 1065 bp, Glycine max
  Peptide Sequence Number=SeqID_208389
atggagatcattgccaccattttcttttgcattttactcatcttctcatcccttattctttcgtatccattaataaagaaacacaagaaacaacaacacgtagtagctaagcctaagcttccccctggctcaatgggctggccttacataggagagacccttcaactctattctcaagaccctaacatcttctttgcttcaaagcaaaaaagatatggagaaattttcaagacacacatactaggttgtccatgcgtgatgttggcgagccctgaggctgcacggtttgtgttggtgactcatgctcacttgttcaaacccacataccccaaaagcaaagagaagctaataggcccttcagcattgttcttccaccaaggagaataccacactcgcatcaggaagctggtgcaaacctctctctctcctgaatccattcgaaaactgatcccagacatcgaaaacgaggtcgtttcctccttggaattgtgggtttccgctgctggacaagtcattaacgctttccaagaaatgaaaaagactcatggccctccccttaacccttcttcttcgcagttctctttcaatattggcatcctctctgtctttggtcatttggaagacaattatagagatcagcttaaggaaaactactgcatagtggagaaagggtacaattctttccctaacaggatacccggaactgcatactccaaagcactcttggcaaggaggagaatcagagagattataagtgagatcatttgtaagagaaaagagcagagattgatggagagggatctattaggccacttgctgaactacaaggatgaaaaaggacaaatgctaagcgatgaccaaattgctgataatgtaattggggtactatttgcagctcaggatactacagcaagtgttctaacctggattctcaagtatcttcatgatgaccagaaacttcttgaagcaataaaagcagagcaaatggcagtatatgaagctaatgaaggagggaagatgccattgacatggggtcagaccagaaatatgccaattactcatagg

SEQ ID NO: 91612 - DNA, 543 bp, Glycine max
  Peptide Sequence Number=SeqID_208390
atggtgaggagcatgcttaagagcaaaaaacttccaaaggagttttgggcagaagcagtggcttatgtagtttacctttccaacgatttccaacaagaagtgtatagggaaaaacatcacaagaagcatggagtggaaggaagcctgacgtttcacactaagtgtttggaagcattgctattttcactgcctttgttggccaacttcaagagctcacaagaaatttatgaggtaattgaaaataaggataatcttactttattttgtctatttgttgattgtgagcccatgagcttccaagaagccattaagaacaagaattggaaaaattctatggacgaagaaatcaagacaatcaagaagaatgacacgtgggagctaatttcacttccaaaagggcacaaggcaattggcatgaaatgggtattcaaagccaagaaaaatgctaaaggagaagttgaaagatataaggcaaggaaaaaggctataatcatagagttggcatcgactatgatgaggaatttgcttcctttgcttgattag

SEQ ID NO: 91613 - DNA, 317 bp, Glycine max
  Peptide Sequence Number=SeqID_208391
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgattccttactgccattgatggcggtaacattgctcaacaatggcaatgcccgactagtgaaacagccaaccagcataatgcggttttgtctcctgtttga

SEQ ID NO: 91614 - DNA, 435 bp, Glycine max
  Peptide Sequence Number=SeqID_208392
atgaaggctctccttggcacgcaagatatttgggagatagtagagaaaggttaccccaagccagaaaatgagggtagtctttctcaaactcaaaaggatagtttaagagactcaagaaagataggcaagaagactctttatctaatctatcatggattagatgacaatgcttttgaaaaggtgaagtcatctccgaatgaagaagaagaaagtagtcacaataattactcaagacgcaagttaattcgatcaacaaagaaagtaatcacaataatagaagccaacgaaggcgaggtcgtgatggagatcgaggaagaggacaaggtcatggacaaggaaaaggatgaggttggaggccttatgacgacaactacaacttccaaagaggttatgggcaaggcaactgaagatcgaggtatcacaagtcaaatgtga

SEQ ID NO: 91615 - DNA, 204 bp, Glycine max
  Peptide Sequence Number=SeqID_208393
atgtcaggcatcaataggttgcacgtttggaattggatgttgaacacatctatactcacatcacaggttgcttcctatgagtttaccaccttaacttgcatcccaggtgtcatcacatattgtggagctaaaatccagatattctgcttgtgggttgataagcctgggatgcctaaagctgaatttagttgtacctttttctga

SEQ ID NO: 91616 - DNA, 815 bp, Glycine max
  Peptide Sequence Number=SeqID_208394
atggccgacgaagctgtggttgttctagatgacatttaccctttgctgaagttgaatatggcggcgaggaacgctgagaagcagatcccgccagagccgcactgggtgttctgctacacaatgctccataaggatgatagtagcatagaaacagatgtcaaggtgccaatactgatagcctttcaccgtcatatttatcatcatgattggcacttttcatgtgagggtatgttcccagttgagcaaggggatcttcacaagcgctggaagttggttaatatgaagttgagaaattttcacaagtgtgttgtgcttcccattggcagcttgtctagtgggctttgtaggcatcggactattctttttaagaatattgttgagctgagtaattatattgccgagtgtgcttgggtgtatgaagaggctgcattagtgttgcttgggagattggcagattatattggattgccctgtcgcatagctcgaggttgcaagtattgtgttgcagatcatagatcttcttgcctagtcaaaattaaagatgacaaacaactctcaagggtgtttcaggatccttccatgacaattctcagaaaattgctcaggaaggtagaaatcataaaaagctctagatctggtgaaccaaattttgagtctcatcacgtggaagcaaatgatttgcagtctgtggttgatcaatattttcaaattagggacacttctaagccagcacgtcatatagagacacattttggggtcaataaagagcttactgcatccttaaccaaagcatggcttgagaaaatgggaatcaa

SEQ ID NO: 91617 - DNA, 456 bp, Glycine max
  Peptide Sequence Number=SeqID_208395
atggctacttatgtgagatgcattgttggcaatttgagtgccacgtggactatccaacgtggcactacccgacactatttcagaacccaacaaaataaaaggaaagagagagagagagagagttggaaaaagaaccttgtaagtttcctcgtagacagggagatagcgcaactcgtttgtggactcaccccaggcttcgatcatcatgagggccttgttgcggttgttgacgacggcctaagggtcatcgatgaacctaaccatctcgttgaggacacgctcggcggtgactttggagaaggccttctcgcagttcttgacaagggtttcgaggaggacaagggcgaggtactgaaccctagggctcttgaggatgatcctcttcttgattccgcggatgagtttgatgctactgagcttgtcggcattgatgagatcgcagagattgagatttag

SEQ ID NO: 91618 - DNA, 685 bp, Glycine max
  Peptide Sequence Number=SeqID_208396
cctaatcatacttgggcacaagtctttatcctcttttcacaagtcaatgttattattatcaccggcattgttccatcctcatcgccctgccaactcttgtggctgccatcccgaggagcatttcatcggcttttgcccgtcatgtctgtatgagcgcttaaccattcttaagcatgacggttcatcttccattgacacgcgccctattacctcccttacttctcccgaagctaattgtcaacccttcaccacaacgcttgatggtaaccaccttcccaagtcttcctccatcaccttcaaccctaagctttgcagcacgaaatcttttcctgctttaaaaaatgaagggctttcttgtgccttagagccacgacgaaaatcatgtgacgtcatcccctatagcccccttttttccatttctaacccagacgacaaacatgaaattcctataaaggaacccaaagttgaaacgtgcaacctcacttcgtcttccattatagaacttgaagctgatgtggaagcagaaaaaaccctaaaggcgagggatgatctcttggatatagattctcaagggaagaagagttctagccgcgatttaaaggaatgcatctggtttgatacgacaaactttaggaagaagtttcgaaagtggaggcaaaagcagaagatgaagaaacgtgagtga

SEQ ID NO: 91619 - DNA, 783 bp, Glycine max
  Peptide Sequence Number=SeqID_208397
atgcaatccttgcttactggcagccgcctggcttggggggcgcaaaatattgccaagtatgaagagggggcttataccggtgaggtgagtgcggaaatgttgcgagactttggggcgcagtatgtcattatcggccactctgagcgcagcacggcttattgtgagtcagatgaaaatattgccgaaaaatttatgatggccaaacgtcatggtttgatcccgattttatgtgtcggtgaaaccttgctggagcgcgaagcgggtgtcatggagcgcgtggttggcaagcagcttgaaaccattattcgcctgtttggcggggaggcgtttgcagggactattgtttcctatgagccaatctgggcaattggtacagggttggccgcttctgccgagcaggcggtggccatgcacacgtttattcgtgagactgttgcggctgcagataaagctgcggctcaaacgctaaaaatcctctatgggggcagcgtaaacccgcaaaatgcgcatggtaaaggcgccgacatgggcgcagcctttggaagtggtgcctctggcagtttatttggggtgtccggatcttctaacttgcttagcaagctgacatcgatttttattacagtgttttttgcaaccagcttaacgttggcatttatgtccagccataaagcgggttctggcagcgtggtgaaagccccgttgacacaacaggctccggccaaaggtgaagcagctgaagctgtgaagccggttgaaaatacgcccaaagatattcctaattaa

SEQ ID NO: 91620 - DNA, 927 bp, Glycine max
  Peptide Sequence Number=SeqID_208398
atgtatagtatggctgaggcgattggcggcattactggtgccaaaggtggtattttacctccagcagcaaacagtacaggcatgcatctgatgggcgtcatgccatctgcgactggtatgcatgcacgtgccatgattgaaatcccacgcaaggcttatctgttactgaacattgagccagaactggactgccagcatgctgcgctggcaagtgatgcgatggcaaaagcggaatgcgtgattgccttaactgcctataagtctgcagcacttgagaatgcagatatcctgctgccgatcgcaccttttactgaaacatcaggcaccttcatgagtatggaaggccgtgtgcaaagcttccaggccgtgactcgtccattaggcgaagcacgtccaggctggaaagtgctgcgtgtactggccaataccttgggcttgtccggtttcgaatacaacagttccgaagaggttaaaaatgccattttcaatggcgaaaaaccttcggccgtcgtgtggcgcagcttgaataacaacttgaaagagttggtggaaattcaggtcaatatcaagaaagaaggtttgcaacgtattggcgaagtgccgcaatacgaatttgacccgattgtacgtcgctcagccccgttgcaaaaaaccaaatacaacatccgccccatggcacgtatgcgtgccgagcaattggctgaactaggcctggcggatggcgatatcgtggttgcacgtcaggataaaggcagtgccgtactcaaggtgcgtctggataatcatgtggccaaaggctgtgtccgggtagctgctgcacatccgctgacggcaggtttgggcgacctcatgggggatatcacccttgaaaaggcctcggccgaacaagtggcgatttacgaaaaacaactgaccgagatggcataa

SEQ ID NO: 91621 - DNA, 180 bp, Glycine max
  Peptide Sequence Number=SeqID_208399
atggatcatatccaatggacatctctagaattcaacaagggtagcacagttgcacagaggttgattagtgaatatataccacaatacaactactcacttttggcctttggttggatgctcctcaagatgtcgtaccggatgtcacgacatcacgcttcagaccatgcagattatatttga

SEQ ID NO: 91622 - DNA, 594 bp, Glycine max
  Peptide Sequence Number=SeqID_208400
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaaacacaaaccccggcgcttcgtgcgccaaggaactcaaatctgttaagtgcgactcccgggggcccggagacgaacgtagcgaaatgcgatacttggtgtgaattgcagaatcccgtgaaccatcgagtctttgaacgcaagttgcgcccgaagccattaggccgagggcacgcctgcctgggtgtcacacatcgtttccccaacgcaaacatgtaa

SEQ ID NO: 91623 - DNA, 318 bp, Glycine max
  Peptide Sequence Number=SeqID_208401
atggaggctagtctgtgcattccgggcaagggctttattctagacacggagggccaaccagggaagctcctcagaaaagatcttaccaccatggagtgtctcagacatggagtgtcttctcatttgaacacagacagagctaggttggtctatggcttaatcgcaaggatgaaaatgaacattggcggtttgatctctgcacaaatgaccatgatggctcagtctaactcttctcgcttaggcttcccagctttaatcacagcctgtgtagatcaaggggagttggatctgatgctcttagctcctacaaaaacctaa

SEQ ID NO: 91624 - DNA, 276 bp, Glycine max
  Peptide Sequence Number=SeqID_208402
atgaagactttgggaggagtggatgacatctactatgccgccctcatcaacaaacaaaagaggcagaagaaactggccaaggctattgctaataaagacaaggctttggaaacttttggccttgctataaaggttaaaaggatccttagggagcagaagggaaaggtccaaaccaaaaagcctgcccatcaacaaaaggaggaggaaaaaattgttatagaggagcaacggatgaagaagaaacatgaagtgcccagaccctctcttccagtgtag

SEQ ID NO: 91625 - DNA, 228 bp, Glycine max
  Peptide Sequence Number=SeqID_208403
atgggctcagaaatctaccctgaggatcatgagaaccctagggccttctttagtagctctagcccaatcctcttggatccttctatccaatacccttgggggtattcaattatctacaaggtcccccctcttgtccttttaacaaaggctactctcagtccgacgtgcgagatcttagagcctaccttggccacatccaccctgacgagggacaactctagattttag

SEQ ID NO: 91626 - DNA, 411 bp, Glycine max
  Peptide Sequence Number=SeqID_208404
atggaaaaatccgacaagatgaatttcaaagagaagaaagaaaagaaaggatatatcacttgggaagataatgtcttaaattattcaagtgattcagagaagaaaatcataagtttgggtatcatgatgaaagactatgaaaatggagaagagcaaagtcgatacattgatagcaatttctccaaacacatggcatgcatcaaagtttattcatatttctccccaagaaaagtgaatatgcaatttatggagacaacaaacaaaggccacttgatcaacaaccccaacaattggaagtggaagttactggaagttggaagttggaagttggagatgaaagttattggaagttggaagttggaagttgagaatggaggttggaagttggaaggggaagttactaaaaattga

SEQ ID NO: 91627 - DNA, 174 bp, Glycine max
  Peptide Sequence Number=SeqID_208405
atgcaaggaataaaatttaagcatagaccaaaccaattgtggaacgcgactccaattgctcttgcagagaggagggtggaggtggcaagaaagaatgcccggagacaatttccgacaacgacgaacgacacaactgttggaggaggtgagggattgtggaatcatctactataa

SEQ ID NO: 91628 - DNA, 1068 bp, Glycine max
  Peptide Sequence Number=SeqID_208406
atggtgatgatgaaacttgtgaagtgggtttcctttgttttggttgtttattggtttttggtgaatggttcatttgccacattcactcctcgtgataattatctaattgcatgtggttcctcccaaagcataacttcccaagaccgcacttttgttcctgattcacaacattcttcactaaagttgaaaactgggaattctgttgttgctagttccaattctagtgtcccttccccaatatatcaatcagctaggattttcactgagaaagcttcttataggtttcaggttgaggaagtggtcactgatgattttgttctattgtgcaacttctcctttaggaactacaatggttcttatatgtttagggagtatgccatcaatgttacctctgataccttcactgtcaccttcattccttcaaatggttcagtagcctttgtcaatgcaattgaagttgtgtcaatgccaaatgacttgtttgttgatcaggcattggcccttaacccaactgcagcattcaatggcctttctgagcttgcttttgagaccgtttatcggttaaacataggaggtccgttgctcactccccaaaatgacacattaggaaggacttgggagaatgatcagaaatacctccatgtgaatagttcagtcactaaggtgtctgttaacccttccagtattaagtatcatgcaggtgttacgcctgagaccgcaccgaattgggtctatgccacttctgaagtaatgggggatgcaaatgtacctgactcaaatttcaacattacttgggtcttttctgtggatccaaacttctcctatttcatccgggtgcacttttgtgatattattagcaagtctctcaacactttagtgttcaatttgttcataaacactgacatagctcttggaagccttgacctctcatccataactaatgacttggctgtgccttactacaaggactttgtttccaatgcctcagcagactccaacattttgacagtgagtgttggtcctgattcaatggcagatattacaaatgccactatgaatggtcttgag

SEQ ID NO: 91629 - DNA, 177 bp, Glycine max
  Peptide Sequence Number=SeqID_208407
atgtcacgtcaaatcgtctttgctattgtcgtagaagagttaccattcgaacagcaaagacggcaaggaataatgagagactgttttatgcttgtccattatcataataagatgcagatcgatgtaatttcttttcgtgggttgatgaagacattgatgttggtgcaacttaaatag

SEQ ID NO: 91630 - DNA, 828 bp, Glycine max
  Peptide Sequence Number=SeqID_208408
atgaaaagcacgttgtccccacaagatcaagccatacgtaagcgtgccgcagtgctttcggtattgatgcatgtgctgttgtttctgggcatgattttcatgatcgattggaaagcggtacatgtgaatcctagtgtcatggaagcgaccctgtgggacagtttgcctagtaaacaacctgtcaaaccggtcacgaaacctgtggatccaacaccgcctccaccggcgcctgaaccgaaaccagagcccaaaccgcctgaaccaaagccaccgcaaccggagccaaaaccagaccctcaggtcaagcaagcggaacaagaagcgcaaattgcactcaaaaagcaggaagatgaaaaaaaacggcaattagaggaagagaaaaaaaaggaagaagagaaaaagaaacaggaagaaaagctgaagaaaattcaggaagccctgcgtaagcaagaggaagaggaaaagctgaaaaaaatccaggacgcaatgcgtcaacaggatatggaagcacagcaatctgctgcttcagcggcagatccttcggtgctggcttattatatgggcttgatgaagcggaaaattaaaagcaccatgaacccagctttatgtccagcttctaacccggagttgttagttgacatacagttgaccaattcgggtgatatatctggtatgcccaaactggtaaaaggctcgggggatgcggtctgtgatgatgcagttattcgagctgtactggctgcaaaaccttttgatttgcctgatgacccggctactcgcaaacaaatggtagatttaatacatttgaaatacaggccgcgtagttaa

SEQ ID NO: 91631 - DNA, 975 bp, Glycine max
  Peptide Sequence Number=SeqID_208409
atggcctcggcgtgcgtgacgaacgctacccgcgcggcggcgtgcagggacggcgcggcggcggcgcacctgaaaatgatctcgatattcgtcatcttcgtgacgagcgtggccgggatgtcgtcgccggtggccctcgccggaatcttccgtgggaagcctctctacgacaaggccatcgtcgtaatcaagtgtttcgcggcgggggtgatactctcgacctcgctggtccacgtgctccccgacgcgtacgccgcactcgccgactgccacgtggcgtcgcgccatccctggagggacttccccttcgcgggcctcgtcacgctcgtcggcgcgctacttgccctagtcgtggacctcgccgccagctcgcacgtggagcagcacgcgcacgcgcagtacgcgccggtggagaaggaggccgcggtggagctcggtggatccgccggcgatggcgacggagaaaagggtgaagaattggcgaaattgaaacagaggctggtttcgcaagtgctggagattgggataatatttcactcagtgataattggggttactatgggaatgtctcaaaacgtttgcactattcggccactcgttgctgctttggcctttcatcaaatatttgaaggcatgggtcttggtggctgcgtcgctcaggcgggatttagctttggaacaattacatacatgtgcttcatgttcgcagtgacaacaccaataggaataattttggggatggcattattctcacttacaggttatgatgatagtagcccaaatgccttaatcatggaagggttactgggttcaatttcatcaggaatactaatttacatggcccttgtcgatctcattgcagttgacttttttcacaacaagcttatgaactccaatcgcctgttgaagaaagcatcttttgttgccctaacccttggttctgctgcaatgtctattctcgccctatgggcttga

SEQ ID NO: 91632 - DNA, 303 bp, Glycine max
  Peptide Sequence Number=SeqID_208410
atgacgaatatcgagatcattttcaggtgcgccgccgccgcgccgtccctgcacgccgccgcgcgggtagcgttcgtcacgcacgccgaggccatgcaaggcaaaacctctacttgctgggttccgatatggcagtttcctcgcaggttccgacacgccggcggcggtggagggctgagtgaccgtcatgcggatgttgaacatgatggccttgacggtgacggtgacggtgagaataagggtggaggtatatcaaggaaggaagataagggtgcaatcctgtcattccacataaaaatgtga

SEQ ID NO: 91633 - DNA, 1497 bp, Glycine max
  Peptide Sequence Number=SeqID_208411
atggccgcagccttagaatgttggtccagccgcaccaccgccgccgccgccacctccaccgacgacgacacggtggagcaagtcctcatgcgcacccaccacagatccgagggaaccaccaccacttccacccccaacaacaacaacaacaaagacccttcctccgccatccccgtccacaagaagctccagaagctcactcgcaacgtctccgaagccatcgcttcctttagaaactccctcaacctcgattctccgccttcttccaaagccgatgcttcttcccggaagctcgcgtggggaagcgttgttcgcaatcttactcagctctaccccggtagccagctccctgagaagctcatgtccaacattcgcaagcattacgattccttgcccctcagttatgcacaggcggagtttgatatgaaggatgtgtttcttcacataaagttgatggagcaagcttcagagagtgaccagcctgcgattttgattcaagaggagtgtgattacgaggttcaggggtctgctttgaggctcacgtttgcttgcaactctccgatttcgtggcctgcgatgtccggtgcgttggatagttcctccatttgctgcaagaggatgcagatctttgagaagaagggtttcaccttgggggttgtgcttcttgtggttcaatctgggcatgataagttggtgaggaccagggttgaaagtgctttgaagtttgccatgaagaggccgaaaaccggtgctgtcaagcttccctttgggctttgtgggtgccaagaggagaattctaaagggggagaccttgtggagattgaagaagaaatcagtgatggttaccgtgggaaggagtttgagaattcaggccaaaggattcagcttcaggtgcctttgccttcttcatcttttgttgtgtcagtggacgaatggcagaccataaagtcaggtggggatgagattgagaaatggttgttgaactcagatagtgttgagtttgttgagcagattgggccgaattcgtttaagggagtgtatttggggaagagggttaagattgagaagctgaaggggtgtgataaagggaattcttatgagtttgagctccacaaggatctgctggaactcatgacttgtggtcatagaaacattctgcagttctgtggtatttgtgtggatgataatcatgggttgtgtgtggtgaccaagttcatggaaggtggatctgttcacgacttgatgatgaagaacaagaagcttcagactaaggatattgtgaggattgctgttgatgtggctgaagggatcaagtttatgaatgaccatggtgttgcatatagagaccttaatacaccgaggattctgttggataggcatgggaatgcttgcttgggagacatgggtatagtcactgcctgcaaaagtgttggagaagcaatggagtatgaaactgatggttataggtggctagctcccgaggattatgttccatag

SEQ ID NO: 91634 - DNA, 5133 bp, Glycine max
  Peptide Sequence Number=SeqID_208412
atggctgcaaacgctcctatcaccatgaaagagaccttcacgctgggaagcgttggaatcaaccagcagttcattacatttactcatgtgacaatggaatcggataaatacatttgtgtcagggaaactggacctcagaacagtgttgttatcattgacatgagcatgccaatgcagcctttgagacggcccataaccgctgattcggctttgatgaaccccaattccagaattcttgctctcaaagcccaagttccaggaaccactcaggatcatttgcaagtttttaacattgaaacgaaagcaaagatgaactcgcatcagatgaaagaacagtggataactccaaatacactgggaattgtcactcagatgtctgtatatcattggtcagttgaaggcaatggtgagccaatgaagatgtttgaccgaacagctaatctggctaataaccaaattattagttatcgttgtgatcctaatgaaaagtggttggttttgattggaatagctcctggttcagcagagagaccacaactagtaaaaggaaacatgcaactcttctctgtggatcagcaacgtagtcaggctcttgaagcacatgctgcctcatttgcttcgtttagagtggctgggaatgataaggattctactcttatttgttttgcatcaaagagtatgaatgctggacaggttacatcaaagatgcatgtcattgaacttggtgcccagccaggcaaaccatcatttactaagaaacaagcagatctgttcttccctccagactttgctgatgactttcctgtgtcaatgcagatttcaaataaatatggactgatttacgttatcacaaagcttgggctgttatttgtctatgatctggagacttccaccgcagtttatagaaaccgaatcagtcccgatcctatatttttgaccacagaagcaccttcagtaggggggttttatgccatcaatagacgtggccaggtgttgcttgctactataaatgaggcagccattgtaccttttgttagtggccagctaaataatttggaacttgcagttaatctggctaaaagaggaaacctccctggtgcagaagaattggttgtcaagcggtttcaagaattatttgctcagaccaagtataaggaagctgcagaacttgctgcagaatctccacaaggaattcttcgaactcctgacactgttgctaaatttcagagtgtacctgtgcaagctgggcagacaccaccactgttacagtactttggtactctgttaaccaggggaaaactcaattcttatgagtcattggaattgtcacggcttgtggtaaatcaaaacaaaaagaatcttctggaaaattggctagcagaggacaaacttgaatgcagcgaagagcttggtgaccttgtgaagacagtggataatgaccttgcattgaaaatatttatcaaagccagagccacaccgaaagttgtggcagcatttgctgagaggagggaatttgacaagattctgatatactcaaagcaggttggatacactcctgattacatgttccttctgcaaacaatattaagggcagatgcccagggtgctgtaaattttgctctgatgatgtctcaaatggaggggggttgccctgttgactataacacaataaccgatctctttcttcagaggaatttaatccgcgaggcaactgcctttttattggatgtgctgaagccaaacctaccagaacatggatatcttcaaacgaaggtactggaaattaatcttgtgacctttccaaatgttgctgatgctatattggccaatggcatgtttagtcattatgaccgtccacggattgctcagctttgtgaaaaggccggccttttcattcgggctcttcagcattattccgagttgcctgacatcaaacgtgtcattgtgaatacacatgccatcgaaccgcaggctctagttgagttctttggaaccctttcaaaagaatgggcgctagagtgcatgaaagatcttttactgactgctaaggaatattgtgaacagctgggtgttgatgcatgcattaaactctttgagcaattcaagtcctatgaaggactatactttttcttgggtgcatatttgagctctagtgaggatcctgatattcacttcaagtatattgaagcagctgctaaaactggacaaattaaggaggtggagcgtgttactcgggaatcaaacttttatgatgctgagaagaccaagaactttctaatggagaccaagcttccagatgcacgaccattgataaacgtgtgtgatcgttttggttttgttccggatctcacccattatctctataccagcaacatgcttcgttatattgaaggatatgttcagaaggtgaatccaggaaatgctcctctagttgttggacaattattagatgatgaatgccctgaagatttcattaaaggtcttatactttcagttcgttctcttcttccagttgagcctttagttgaagaatgtgagaagagaaatcgtcttcgcttgcttactcagtttttggagcatcttgtaagtgagggaagccaggatgtgcatgtacataatgctctgggtaaaattatcattgacagcaataacaatcctgagcattttcttacaaccaacccatattatgattctcgtgttgttggtaaatattgtgagaagcgggatcctacacttgctgttgttgcttaccgaagggggcaatgtgatgatgagcttgttaatgttaccaataaaaattccttgttcaaactccaagccagatatgtcgtggagcgtatggatgctgacctctgggagaaagttcttaatcctgagaatgagttcagaaggcagttgattgatcaagtggtgtccactgctttgcctgaaagccagagtcctgatcaagtttcagctgcagtgaaagcttttatgactgctgatcttccccatgagttgattgagcttcttgaaaagattgtcttacaaaattctgctttcagtggaaactttaatctgcaaaatttgctgatcctcactgcaatcaaggcagacccctcaagagtcatggattacattaataggctggacaactttgatggccctgctgttggggaggtggcagtagaagcaaacctatatgaagaagcttttgccattttcaaaaaatttaatttgaatgttcaagctgttaatgtcctactagataaccttcggaccattgatcgagctgtggagtttgcattccgggttgaagaagaggctgtatggagccaagtggctaaggcacaactaagagaaggcttagtaagtgatgcaattgagtcattcatccgtgcagatgattccactcacttcttagaggttataaaagcttccgaagatgcagaagtataccatgacctagtaaggtaccttctcatggttaggcagaataccaaagagcccaaggtggacagtgagctcatatatgcatatgcaaagattgaccaacttggagaaattgaagagtttatattgatgccaaatgttgctaatttaccaaatgttggagaccgtttgtatgatgaggctctctatgaggctgcaaaaattatatttgcttttatttcaaactgggctaagttagcagtgacattggtgaagcttaaacaattccaaggtgctgttgatgctgctaggaaagcaaacagttcaaaaacatggaaggaagtttgttttgcctgtgttgatgctgaggaattccgattggctcagatttgtggtcttaatgtcatcattcaggtggatgatttggaagaggttagtgagttttatcagaacagaggatgctttaatgaactcatatctctaatggagagtggacttggactggagcgtgcccatatgggtatctttactgagttgggagttctttatgcaagatatcgtcctgagaagttaatggagcacattaagctgttctcaactcggcttaacattcccaagcttattcgagcctgtgatgagcagcagcattggatggaacttacatacttatacatccaatatgatgagtttgataatgctgcaactactgtaatgaatcactctcctgaagcatgggaccacatgcaattcaaagatattatagttaaggttgcaagtgtggagctctactataaggctgttcacttctacttgcaagaacatcctgatattataaatgatcttcttaatgtacttgcccttcgtgtggaccacacccgtgttgtggatataatgcggaaggctggccacatccgattggttaagccgtacttggttgcagttcaaagcaataatgtgtctgctgttaatgaagctttgaatgaaatttatgttgaggaggaggactatgatagacttcatgaatcaatagatctgcatgacaacttcgatcagataggtcttgcacagaagggtaaggctgcgtacaacatccctcccccataccttcgcatagcgaagagcctctgggcaatggggtacgaaattgagaagcatgagcttcttgagatgaggcgtgttgctgcttacatttataagaaagctggaagatggaagcagtccattgctttgtcaaaaaaagacaatctttacaaggactgtatggaaacttgctctcaatctggtgaccgtgaactctcggaggatttgcttgtttactttattgagcaggagaagaaagaatgttttgcatcttgcctctttgtctgttatgatataatacggccagatgttgctcttgagctagcttggatgaacaatatgattgattttgctttcccatacctcttacagtttattcgagagtatactggtaaagttgatgagcttatcaaggacaaaattgaagcacaaaaagtggagaaagctaaagagaaggaagagaaggaagttcttgcacagcagaatatgtatgcccagttactaccacttgctttgcctgcaccaccaagtatgggtggaggagggtatgcaccaccaacaccccctattggtggtatggggatgcctccgatgcccccttttggcatgcctccaatgggcggtggcagcggctcctactga

SEQ ID NO: 91635 - DNA, 591 bp, Glycine max
  Peptide Sequence Number=SeqID_208413
atggcattcttgaagacaagaaggtggcacactggctgccaaacagacccaacagtgggtgctggtactgttcacctgcaaagaaagctgcacacagatatgtctgagcgaggaacatttggaaacaaggccaaacagaacctaaacagggccaaagaaagtgaaatagtgtcgacggaggaagaggaggatggtggatcgatcgccaaacagtggatcacgccggaaaaggtgtcacaccaaatggcgtgtgcgtcattagactgcaacacgacagcgtgcacggttgtcgtcaggaggggagactccagcgagatggaagtgtggtggcagtgtaagcacgctcacaacatgcacattacttttcaggcaaaaggaacgttgcggcagaaaggggaaataagtaaaagaagatcgctggaaaaggtgtggcgagtagaaaggtcatcgaaaataggacgacaagcaaagagaggtccaccggaatgtggaaataggtcacctgaagtaggacgactaatagagaggtctaccgaggacaatagggtccccggtggagaacgactttcgttagtcctttgtaaaaaataa

SEQ ID NO: 91636 - DNA, 726 bp, Glycine max
  Peptide Sequence Number=SeqID_208414
atgccgactcaaaccgagtcacccagcaactcactgagtcaactcgctgagaacatgttctccgacaacaaccgcaacatcatgctcgcagcaattattttcttgctcctagttatcctcttcgtcctcctactccatgtgtacgccaaatggttcttattccaggtacaatcacgttcccagactcggcggcggcgaactccggtgaccgtctccggcgttctggaaccttcccatttccacagcatcaacatagaagcctcacccacgtgctccaaaggccttgattcggccacactttcggcgattcccttgtttgtgcaaggaccagagaaaacagaggaaacggaggaattggaatgtgtcatttgcttgagcgttattgaggagggtgagataggaaggagattgccgaagtgtggccacgcttttcacatggagtgcattgatatgtggttgagtttacattgcaattgtccaatttgtagagctcctattgttgttagtggcgattctcatttgggttctgttgatggtgatagtgatggtgtggttgagattggggttgttacaccgggttatgagattagtgggagtgaacatggtggggtgagtggttctgttcctgaagcttcttcatctttgttgggtttctctctgaagagattgctgagtaaggtttttctgtcacctgatcatgtaactgaattggatggttcacattga

SEQ ID NO: 91637 - DNA, 801 bp, Glycine max
  Peptide Sequence Number=SeqID_208415
atggcaatctcatttgcatggatgtttggtgaagccaagcccagtggcaaggaacttcttcttggcgttttgattccgaaactcagctccaaaactatacagcaggctgttggagttgtggggtgccttattatgcctcacaatgtgttcttgcactctgctcttgttcagtcaaggcaggttgaccgcagcaagaaaggccgggttcaagaagctcttaattattactctatagagtccacccttgcccttgtagtctcctttatcataaatatatttgtaacaacagtgtttgctaaggggttttatggttctgaacttgcaaacagcattggccttgtaaatgctggacagtatcttgaggagacatatgggggtggactatttccaattttatacatatggggtattggattattagcagcaggccaaagtagcactattacaggtacttatgctggacaattcatcatgggaggttttctaaacttaaggttaaagaagtggatgagagcattgatcacccgaagttgtgcaatatttccaaccatgatagttgctcttatattcgatacctcggaagaatcgttagatgttttgaatgagtggcttaatgttcttcagtcagtccagatcccctttgcactcattcccttgctttgtctggtgtcaaaggagcagataatgggcactttcagaattggtgctgtcctcaagaaaaattggagattgtaccactttccttttttatgtcggggactctggggtggcgtatgtgctgctattttggatattccttaa

SEQ ID NO: 91638 - DNA, 1707 bp, Glycine max
  Peptide Sequence Number=SeqID_208416
atgcaatggatcttaaatttggtcacttcctctttcacccttagtgtgtatagggaaagggcgagagtagatcctaatgaaacaaagcgtttagaagttgagaagatagcggaagtgaagaagggaagggatccattgcaattccatggcggcgtcgtggtcgtcgtcgtcttcaaactgaacgccggagagagtcaccgtggtcacttgccggagccagagagaatgaaacgcaagcgtgggcataagaaagggaaggcaaaaggcaccactaaccatggaagcagtagtgctaatgctaattctaaggaagaagaaacctctgggttggatgataaagatcactctggaatggaagttgacacaccttcttcgacggggacggatcagcagcataattacaatgttgccaacataaatcctgatggttctgttgataaggctgctattgggcgtgttaaggtgaagctcaagacacctaaattactggactcccaacccacctcatctgatgctcccactcccacacaaagcgatactgagagaatggaagatagtgcaaatttgttgcctgatatgaaactcagtactctgtctaagagagctgctagcatcaaaattaagtcttcatcaaaccaccagacattctcagcttccactcaacataataataagcaggaattggatgcttccttagtggttataaggaaggtaatgaaaatggatgcagctgaacccttcaatgttcctgtcaatcctgaagctctgggaattcctgactatttcgatatcatagacacaccaatggattttggaactatatgcaacaatcttgaaaagaatgaaaagtatatgaattcagaggatgtatttaaggatgttcaatacatttgggacaactgttacaagtataacaataagggtgactatatcttggatcttatgaggcgagtaaagaaaaactttatgaagtactgggctgcagctgggctatacagtgaacaatcaaaagggaccaaggaagacattgcactgtctggtgatggaaaagcagggaagggtggtcaattgaagcagaagacaaaaaagcgtcatggaagacaccataaacatgattgtttatgtgctatttgtgttctaaagcgacgtaggaaggaacgggaagagaatgctcgaattgctagaggcaattttggatctagtggtgataagcatgctaatgaggaatcaatacaagtagagagtcccggtggtgaggattcgtcatcaaatatagatgaatctatcggcactgatggagatgttgatgaagagaaaggagaggtggcaaagatggagattagtgagaagcagtgtagcccttctgagagaaagcatccaagcattgatgttgataatgatgatgacaatgatgatcatggcctagaggaaggggaggaggaggaggaggagggggaggaggaggaggaggaggaggaggaggagaatgaagaggaagaagatgaggaagagattgaaatgaacagtcagaagagagagatgaatgaaactttaaaacatggtggaaccttggcagagaaatcaaatgttggtgatgcaaccgctctacatgatgaatatagaacaaagcaacaagaaggacaagctgtggcagtcccgcaacagaagaaacccaaggtatttccctcactgtttgatcagtattga

SEQ ID NO: 91639 - DNA, 1056 bp, Glycine max
  Peptide Sequence Number=SeqID_208417
atgacagagaatctgaagcatacggtggatttggaatgcagtgataataacattaataggccgtcaaagatatcaataatcgagtatcccattgacagtgacattgacgaagaagaagaaatgatcaaaaaccctaggaatggcattcaacgctatttggttgctatcgagtatattgggactcgcttctccggttctcagaagcagctcaatgtccgcaccgtcgtcggggttcttgaggacgctggagtgcatgccttgtcaaatgtttgtcatgtcgatattcaacgcatcagcaaaaggaggcctggtgaagtgttaactcctcatgaacctgctgtcgttggaagagctgtaaaccatttcttacagaagcaagacagtgacttaatggttattgatgttcgatgtgttccatctgattttcatgcaagatttaaagcacaagagcgcatatacttctatcggttgctgtctgggccagagcctttgtcgaccttcgagaaagatcgagcatggcatgtacctgaggagcttagtcttccagctatgcaagaagcatgcagagttcttgttggattccatgattttagttccttcagggcagctggttgtcaggcaaagtcaccaattagaactctggatgaactcagtgtcaatgaggtaattgaaagtccatattttccatctctaatggatagagaacaacataataaagtcagtggtgatcttcgtagctgccccaacaactctgaaactgacattcctcctacttctaatcctagcattgataaagtaatggcatcaagtcaagatgtaggatttggcaaaagaaggcgacatcgttgcctggtggtaacagcacgtgcacgtgcttttctttaccatcaggttagactacttgttggtgttctcaaggctgttggcactggaaacttaacaattccggacgttgaaagaattttgaatgcgaggactgttacggccgcaagtccaatggccccggcatgtggtctctacctaggagaggtgaaatatgatctgcctaccacatag

SEQ ID NO: 91640 - DNA, 247 bp, Glycine max
  Peptide Sequence Number=SeqID_208418
atgaggcattcaagaaggcaaattatcctaactctgacaattaaccgagaattcatcgaaggaaaaatcaactatcttggtgtctatgatgttactgttatggtttttttcatttacggttcgcttggttcgctttcttctttgctttctccttttggtgttggtttttcaacaaaaggtgccgcttcggtggtggtaaaagtgttacaggtcgacgatggttggttcgtcgttggaggtacaccag

SEQ ID NO: 91641 - DNA, 405 bp, Glycine max
  Peptide Sequence Number=SeqID_208419
atgtggttattcaattatggcattggcattcacctgctagagtcagaaaaggttccggtggaaaaaagagagatcaacccgaaagaaaatcatatatcgtttcaatgctcagacatgaaagttataatgcagaaactggatgcaatgaagattgagtatgtgagagcagttgtggaagagggtggaattaaagttgatcagctcttctttcatgacccagatggatatatgatagaaatatgcaactgccaaaatctccctgtgcttcccatttcctcatgccctctaaagcagctcgcagcaggggaagctactacattgaacattaactgctttgcagacgaatctgtgtctatgctgatgatggacaatttggtgatggatatgttgaagatttcaatataa

SEQ ID NO: 91642 - DNA, 1272 bp, Glycine max
  Peptide Sequence Number=SeqID_208420
atgggattatgtaataatgaggcactcttggctcctggttcagaactttggatgttcaatgaggttcctgaaaaggaaagagaaaagaagcttgttgatggtggacttgatgtttctgagttagagaacataaaacttgtccatagggagggtaatgctgtgattaggcggcacctggagggtcttccactggagacttttgattctggagaaaatgaagacctgtttatacttcttcttacgctttccattggcggtttcgatgacaaactctgtggagaagatgttagtgagcttggcaccataactgtttcgtccgccggtagtcttcttctcgttgtcattgttgaagacgtagaccttatcattgtagttgttgctagtaaggaggtggccgaagatgagttcagggacgtagaccttatcttcctggtggatctccacgggaacaccgtcgccattgttgaagacggagatggtattggcctcggcgttgatggtgaccttgagggcatccatggacgggtcgtgttgcttgttgttggtggcgttgacgaggatctcgtcgaagatcttgtagaggccgaggatgtaggagacggtgcggtgcaccatctcgtcgttctcgtacacccacaacgtctgcgtgtgcttcccgacggagctgacgtaggtgtcgaggtggaggaggatgagctccagctgtgtctttctttgatccttattcttgcagatgagtcagtggaggactctgtagctcactctgactcaaggtccctagctacccttctactcattcgggacatacagtcaaaacgtctaccatacaaagacactgggttctctcacaactcttggatccgtgacatgcagcaagcttcagttaaatcaattataattagtgaaattttagattctaggactagaaatctagtgtctgtgtcaagaatcagtgattatgtgttatctaatgagctggttagcatggcactagcaatggtggcagaagacaagcaaattaaccgtgttcttgaggaattatttgcagaggaggggaacgagatgtgtacgaaagcagcagagttgtatttatttgacaaggaagaagtgtgtttctatgatataatgattaggggtcgtacaagaaacgagattgttatcggctatcgcctggctaaccaagatcgagctattatcaacccttctcaaaagtcgctgccaagaatatggtccattgctgatgtttttgttgttattgccaaaggagattga

SEQ ID NO: 91643 - DNA, 2040 bp, Glycine max
  Peptide Sequence Number=SeqID_208421
atgacagaaaaaatcccactcaactcactcaggacccatccctcagcatctgagagagagccccacaaacacaaagggaatctgtctcaactcaactcagctcagtgcagaatgcgaaagagcaatgaggaatttccgaatctgagtctaaggaagccacccttaaagaggagcaagacaattccaaatccaaaacacacccatttctctgtctctgtctctgactccgacgagcaatggaactacccttcttttcttggcaccaccaccaagaaaaaaaaaacatctttcaaaccccacaacctcaaccttcccaaaccctcacttgttccaccaccgccaccaccacctcctcctcctccttccacatcctcgtcgccactctcttcacaagtcaccagacctcaacaccatcagcgctctccgatcttgtatctgctttttattgcttctattgtttttgtaccccattccgcttatctacaatataagctcacaaaactggaggatgagaaacttaacctgtgctgccaaattgacttttgtcctggcaatgaaaggacatctttacaaaaagttgatggttcattttcttatatcctgaacgctgacagtagaacagttgctttgtatattgtggtggtcaccctcattttaccttttatgttgtacaaatatcttgattaccttcctcaaatagtaaatttcttgaggagaacaaacaataacaaggaggatgtaccgttgaagaagagggttgcttatatggtagatgtgtttttctccatatatccttatgcaaagctgctcgcccttctctttgcaactctatttcttataggctttggtggtttagccttgtatgcggtgactggtggtagccttgctgaggcactttggcattcttggacttatgtagctgactcaggaaatcatgctgaaacagaaggaaccgggcagaggattgtctctgtctcaattagttcaggtggtatgttgatatttgctatgatgcttgggctagtttcagatgctatatcagagaaggtagattctctcagaaaagggaagagtgaagtgattgaaaaaaaccacatactcattcttggttggagtgacaaattgggctcacttttgaagcagttagcaatagcaaataagagtattggtggtggtgttattgtggtgcttgcagaaaaagaaaaggaggaaatggaaatggacatagcaaagttggaatttgatttcatgggaacatccgtaatttgtagaagtggcagtcctcttatactggctgacctaaagaaggtttcagtttctaaggcacgtgcaatcattgtattagcttcagatgaaaatgcagatcagagtgatgcacgtgctttgagagttgttcttagcctaacaggtgtaagggagggcttagggggtcatgttgttgtggagatgagtgaccttgacaacgaacctctggtgaaacttgttggcggagaactcattgaaacagttgttgcacatgatgtaattggacgtttgatgattcagtgtgctctacagcctggccttgcacagatatgggaggatattttgggatttgagaatgcggagttttacatcaaaaggtggcctgaactggatggtctctttttcaaagatgtattaatttcatttcctgatgcaataccttgtggagttaaggttgctgcagatgggggcatgattatcatcaacccagatgatagttatgtcctgagagatggggatgaagtccttgtcatagctgaggatgatgacacttacgcaccaggtcctcttccagaggtacataagggactttgttcaaggatacatgatccacctaagtatcctgacaagatattgttttgtggctggcgtcgtgatattgatgatatgatcatgctatggtggccatgccttggccacaaggggcctccagggggtttcaaaccccttcaagctggtgattttatttttttatcattcagaaagattaaacagaaacaggaaacaagaagctaa

SEQ ID NO: 91644 - DNA, 252 bp, Glycine max
  Peptide Sequence Number=SeqID_208422
atggctatggataatgaagatatgaacaccgacagaagctccataggcaaccctgttaatgctggatttggtggtatcaatagggatcagcgtggcaactggatcactggtgtggactcaacgcatccttatgctcctgttgttcagaagattgaagctctttgtcatcaagcttggtccctttccttcatccatacttatagggaggggaacaaatgtgcaggcattgggacccctagagggaaaacttag

SEQ ID NO: 91645 - DNA, 1437 bp, Glycine max
  Peptide Sequence Number=SeqID_208423
atgaaggtggtgagagtgtatagaggcagaagaattatactaaggatttttaacgtgaaaaaaacttccttgtgtgtaaggaaaaatctccgggtttctataaaagattgtatctcaccggacttgacatcatttgcgacctcctctggagatgttgctgctggtttcacaggtgtgcatgaatcagaagccctgtcttgttattcatcagtctcaacttctgttggcgtgcaaagcaaaactgtcaagggttctgtaattgccaaaaataatcctaaatcttctggtttaatgaagccaaacaagttaaagtctacacatagaaatgggattttaaccagcacgatatctgagactgtggctgatacaggaaaagatatcaaaattctaaacaaggctcctcatttgcgttctaattttccagcagccactgctccaaatacatatcaccaaataggaaaattttcatcattagccaacccaacatgccatgtttccccccccacaaaccacaggccaaatacctctactaactacagaccaactgggagagtgtctaatgtaaatgatcgagttttgttgggtgacaacaaattcaggagtggacaatctgaaatgtcaatggagatgactcggggtcctcggggtcattacaacaattttcttctacaaccatcacttgttaaggatgcacttgcaatcacaatatgtagagacgaatataacctttcagatttccaaactgaatacgaaattgctaaattttatgtgattaaatctttcaatgaagatgacgttcataagagtgttaaatataatgtttggacaagtactccaaatggaaataagaagttgaacgccgcattccttgatgcagaagctaaattgagacagacagggactaagtgtccagttttcctcttcttctcggttaatgctagcagacagtttgttggagtggctgagatgcttggaccggtggactttaaaaacgacatgaacttttggaaacttgataagtacaacggtttcttcccaattaagtggcacataataaaagatgttcccaacaatcagtttgtgcatatcatccttccaagcaatgagaacaagcctgtaacttacactagggacacacaagagattggattgaaggagggcctggagatgctgaatatttttagaagttatacagctaagacatctctattggatgattttgacttctatgagaggcgagaaaagttatttcgttcccagaggagtactaagcacaagcatgcaaggccggaacaggaagtatatggcaatgacaattatcaaaacactgtcaaagccagagagaagaaaatggagatgcaatcgagtggtaccaagcaaggtactctcatcaaacataccaaaaacctttctctcaacaactctggatttagatag

SEQ ID NO: 91646 - DNA, 1165 bp, Glycine max
  Peptide Sequence Number=SeqID_208424
gcggaagatctatgatgagtacaatgatgaggtagtcgagttgacgaaagatgaaatcaaactcgtccgtagactgctcaagaatcgggcaccccattctgactttgatccatatccagatagtgttgactggtttaaatgggaagatgccaaacatccattgtctaatgcacctgaaccaaaaagaaggtttattccttcaaagtgggaagctaaaaaggttgtacagtatgttagagcaatccgtcagggattaatcactttcgacaagccaaaagaggaagatggtccatatcacttgtggggagatgattctggttcaacagaaagagcaaatcatttggcttacattcctgccccaaagcagaaattacctggccatgatgagtcatataatcctcctctagagtacattccaacccaagaagagatcaattcttatcaattgatgtttgaggaagaccgccccaagtttattccaaaaaggtttgcatctatgaggagcattcctgcatatgagaatgctatgaaagactgctttgaacggtgtttggatttgtacttgtgccctcgagttcggaaaaaacgcctcaatattgatcctgaatctttaaagccaaagcttccaagtcgaaaagagcttaagccttatcccacaacttgctatatcgagtataaaggccatgaagatgctgttacatcaatttcactcgaagcttcaggacaatggatggcttcaggtgggatggagatgggtcccttattttctgttatctgcaaaggttcacgtgatggaactgtccgtatctgggaggttgaaactggcagatgtcttaggcggtgggaggttggtgaatctgttagctgtgttgcttggaatcctctgcctgatattcatcttttggccgtttctgtgggccaagatgtacttctacttaacacttgtttgggggatgaagaagagcagaaacggattaaggagcttctctgggttgactcgtctacagcatcagatgactctggcaacaaagcacctagtgtaagctggcttaaagatgataaacatatgggtttaaggttaaggcactttaagactgttactgctgtagaatggcaccggaaaggtgactacttttcgacagtgatgccagcagatatcctttga

SEQ ID NO: 91647 - DNA, 327 bp, Glycine max
  Peptide Sequence Number=SeqID_208425
atggcgacttcttcgagttcttcgagctggcgcgagggcatgtcctccgacaacataaagggactgtgcctcgctctctcttctagcttcttcatcggcgccagcttcattgtcaaaaagaagggtttgaagaaggccggtgctagtggaatcagggccggaagtggaggttattcttacttgtatgagccgctttggtgggtgggaatgataacaatgattgttggagagattgccaattttgcagcttatgcatttgccccagctatattggtcacccctcttggtgctcttagcattattatcaggcatgataaaaaaatttag

SEQ ID NO: 91648 - DNA, 501 bp, Glycine max
  Peptide Sequence Number=SeqID_208426
atgggtcaaccttggaagttccatttgaggaagcgtcggaggagtctaagattttggggttggaaggaacaacagcgtcgtcttcttcgacctgaggcctctgagaacgaagaaaccaacaagggttgcgggcaagagcgattccatgtgaatagtgttgttcccaccaaaccctacctagtcactcaagtgacatggctcgaggaccgcccttctccctccactgttaacggtgacggcaccgcttacatggcatccgcggatgaaagcattaaggtttcaaggagggaaggcgaggcgaaagggcacaagtttgatggttgtggtggtgcggggttggacggtggtgatggcataggcatggcactaacttgtactggttggaccgctaatggacgtttttatctgtcagaccatttgggtagtcctcttttaggagctaaaatactggaggagattggatcggatgcatctcttgtgaagtatgctgaattctgttaa

SEQ ID NO: 91649 - DNA, 357 bp, Glycine max
  Peptide Sequence Number=SeqID_208427
atgaactcaacgaaaagaggagagagaactcagaaaaggcgagcggctgctaacgctactctgcactactcgccaactctcgtaattgctcgccagcgaactcggcgaccccatgtagctcgtgcacccattgctgcagctgttgtacgtgttactcgaactcatctccgagttgtcaaactcacccaacccgagttggtgttgttggtggtgatcggcggcggagtactacattggcgacgccgtgtatgcgtccggcggagagaggaaggaaatggccgagggagttgggggtggcgcgtgagagagttacagaaagtacgcgtgactgtgagaaggagagaactggtgtgttga

SEQ ID NO: 91650 - DNA, 678 bp, Glycine max
  Peptide Sequence Number=SeqID_208428
atgaaggcgaagaagcatgcccacgctgaagaggagggagttgctccgcttccttcaccaacactatccgattccgactctgattacgaggactcttcagccgatgatcaccacgaatcttctgtctcgctggattctcaatcccaatcggaattagaagacgcttcacctgaaaatggtagctccggcgttgtagaatctgcagaaaatgaatcatctcaatacgagctagaagtgctatcttgttgttctattcgcttagctataactaatatgcttagaagcaatcctttcaggacactgttaatgaagaagacggtggaagtgagagctctgatctccatctggaaggagctgagagtgactcctccgaggatgaggttgtcattgttgtcatcgtcttctaatatttatgatttggctttggtggctcctcgaaacaccgtgggagatgtgccattgaagtggtatgaggatgaacctcatattggatacgacatcaagggaaaaaagattaagaaaaaggaaaagcaagacaagttggattcatttcttgcaagtgttgatgattctaagaattggttagtttcatatgtctgcattacttattttcttcatttcaatttccattattgcattcttttatttggatactcacatttggcatgttttctataa

SEQ ID NO: 91651 - DNA, 378 bp, Glycine max
  Peptide Sequence Number=SeqID_208429
atgggaagatctaagtttactgtagagaaaggctcaagccaaaacaactcaccaactgtgcaaaatgctcatcatgtaaaaggaccatctggcttgggaggggtcatgattggaataggacagcaggtgtactcaatactccttttgagtgttttttttcttgaggtctatgcaacaggattcataccatacatagggaagctgctcaactttttactcctttcctggatgtatgcatattactgcttcgagtatgtggtccataacttcatgtacaaatggaatttcaatgaagtggctcttgacagaaggctggattactttgaatcttactggccattttttgctggttttggatgtgagtggggtgtgggttga

SEQ ID NO: 91652 - DNA, 216 bp, Glycine max
  Peptide Sequence Number=SeqID_208430
atgacggagaagaaggctcaagaaatccccaaggatagatcagagccgccatgccttggaacccatcatcctccttgctaccaccacttctccggcgtcaacatgtacatgcatatgcgtcaaggtcgtcgaccacacctcctagttatatgtcatccctcaaagtatcgtgacggccttcacacatggtcaacggtatcgacaagcaacaattag

SEQ ID NO: 91653 - DNA, 303 bp, Glycine max
  Peptide Sequence Number=SeqID_208431
atgttgttgtcacaccaagtcttccatgcagctgcagatgcttgcctccttcttaaacaagcaagccttaaagcttatttcatccataaacctacatcctactacggatcatctaccttgtacttgatccgtatgctaaaccctgtcacctaccctaaagcgaatcttctgaatccctatgtggatcaacttaaacacattacaaaccaaaaaacaagtagcaaaaaaaaccatggggagaagagccttacctcaacgtcagcgatggagcacatcctcaatgccgtcaaagcaaagctctaa

SEQ ID NO: 91654 - DNA, 402 bp, Glycine max
  Peptide Sequence Number=SeqID_208432
atgcttccaagttgctgcaccacgagcgcgctcttttggttcgttggttttccggcgatgctcattcatccctcaaccggaaccgcggtacattgccaatgggttggagatataaggtgggtcggatggatgtgtggaaaactcaattccacgagtcttcagcaagaagcagtgtctttgaaccagcctcctgctttaataaacattcatttggcatgcagaagagaaacatcttcatggctaccattaaaaggggttccattatcgggtctgagttcaatggagagatttcacgatagaataggaaatgtgctcagtagagaattgcaaatgtatagctacctgggcaaatcggtgaccctagtttctaactactcaccagtgtccttgaccttggattga

SEQ ID NO: 91655 - DNA, 655 bp, Glycine max
  Peptide Sequence Number=SeqID_208433
cttgcggacccaactcaattcattgcaagaagcctctggtggctctcgcatatcagttaatgaccttgtaatcaagaacttcatgaatcttagcttaaaacgattcaaagagcattacagtaatatgtgtccccattgtgaacggaaaagtcaggctgctgctttggctctccgtaaagttcctcaatgtaacagttcatgggcaaatgattatattcgccagtatcataatgtgaatattaatgttgctgtgcagacagataatgggctctttgttccagttgtcagggatgcagacaagaaaggcctctctaaaataggggaagaggtcaaacaattggcaaagaaagccaaagaaaacagcttgaaaccccaagaatatgagggaggtacatttacagtgactaacctgggagggccatttggtgtcaaacaattctgtgcaatcatcaatcctcctcaggcaggcattcttgccgttggatctgctgagaggagggtcgttccgggttcgggtgctgaagaattcaagtttgcttccttcatgtctgtgaccctcagctgtgatcatcgtgttatagatggtgcaattggtgccgaatggttaaaagcattcaaaggctatattgaaaatccagagaccatgttgttgtaa

SEQ ID NO: 91656 - DNA, 333 bp, Glycine max
  Peptide Sequence Number=SeqID_208434
atgtacccagttgagcgatacatgaagatcttaaaaagatataccaagaatctacaccattctggagcatccattgttgaaaggtacattgcagaagaagcttttgaggtttgttcaaggtacattgaaaagacaaaacctgttgggctttccgagtctcaacatgatgagagagtggcagccttagtcaaggaaggtaaccaaaaaatgactaagaataggttgttgaaaaagcataacaagactttcctaaattggtttaaagatacaatctttggttatgacaatgctttcgaaatgttaaggaagttagcagatgagcctaaacgcaac

SEQ ID NO: 91657 - DNA, 528 bp, Glycine max
  Peptide Sequence Number=SeqID_208435
atgggatacgatatgcctaccaaaggatcagatgatgcagagctcaacttaatggaaggtgggatgtggagacaaatttcacttttgggaggacaagtggagaggaggtggaggaaaccattgttcgacaatgaagtagatatggcggtttctttcctaaatgaagttgagggccatagaatccagcctcatattccagatcaatgggtgtgggtggctgatcctcagggtcaacactcggctaggggtgcatataatttgctcacgaaggctgtaacacataagatccaggatggagtgttcaaggaactgtggaagctcaaggtcccatttaaaattgttttcttcgcatggcggctaatcaaagataggctaccaaccagagtaaaccttcggaggaggcaaatcgagttacatgacgtgttctgtcctttttgtggatcatcggaggagagcgcatcgagttacatgacctcttctttcaatgcagcaaaatacttccactgtggtgggaatcaccctccttaa

SEQ ID NO: 91658 - DNA, 1314 bp, Glycine max
  Peptide Sequence Number=SeqID_208436
atggaggcgacacaaggaagttggtcggagttcgttcattttagttggcattaccttactcagtccgaagtgtgtatcaaagacgaaaaggaaagggaagttaagaacagctgcgactccctcaacctcgtactcgttctcttccccattgtttgcggcttcttcagcagaagcaacaccaacaccacctccgaaacccaaaccccgcgctctcgcagaacgttttcgaacccttctacgccaccatcagcatggttccaaaacgattattctcagattcataatcgatcgtttaataggctgaggagctttgatgaaaggttccggttttatgataatacttaccttctccggcaccgccacaggcatatgagaactgagcctgaagaagaagaaaaggaaataggaattgataatgtccccactgcgccgccgcagcagggaacggaagctgagcatgaaagggaagatttagatgcgaagatttcgccaccgccgccggcgacgagaacgaaaggtgttcgacggaatttcaagcgaacacatcaagcggaaacaatcgagaaacatgaagcaaatgatttacctgtgatggattcacaaccgccgccggtgacaagaactaaaggtgttcggagaaatgccaagcgaacatatcagccggaaaccatggagaaacgcgaaacaaacgattttgaagcgcagaattcacaaccgccggcgtcaccaccgtgtcctccgctaccgacgactcgaacgagaggagttcgacgaaatgcgaagccggaaggaaatgattccgttgtgaaaagttcaccaccaccgccgccacctaaggtttttcagaacctgttttctttgaagaaagggaaacacaaaaaccgtcacattgtttgtgtggcaacaataacaagagcaagcgtatcaaacaagagggagcatggttcttcctctaatgtgatgatggctggcaatgagtcaccattaaaccctattcctccaccgccaccactgccgccgttcaagttgccggggtggaagttccggggtagacagattggtagttcacgtagtggatcacctgatgatttggatgaagttagtgtggacacaccaacaactagtactcatgatgaaacaagaagccaagtcaatagtccttttgccaaaaatggtgaagattctgcaagtgtgagtgcactctcattgttctgtcctagccctgatgttgataccaaggctcaccacttcattgagagcttcagggctggtttgaggatggccaagatgaacttcagggcaggggattgggag

SEQ ID NO: 91659 - DNA, 3264 bp, Glycine max
  Peptide Sequence Number=SeqID_208437
atgtggggacaaagtgtatcatgtcacagtgagagtcaaaattcacatagtgtcctttggagaagagtgatgattccgccactgaataataaagacttgcaagagataatcaaagtgaggcatccggatttggagcttcatgttggcaaactaatagaaacctttgaaagggttaactctatttccatggttcaaatagcgggttttcacctgggaagttctgcttcggtttattgtccctgcaggttctcattaagggatctccttaaatggtgcaaaaggattgcaggtttaggtttttgctttgatggtagcttatcagaaaatcaatgtttttgtgtgtataaagaggctgttgacgtatttgcatccttttcatcttcaattaaaaaccgtttgtcagtaatgaaagagatagcagggttgtggaaagtaccagtttctgcagctgagaccttgtatccctgtgacaaacctataattcagttgcaacaacataaaagaccttttgtcgagatccgcagttctatgcatgttttggagcgcattgcttgctctgtcaagtataatgaacctgtcctcttggttggagaaaccggtactgggaagactacaattgttcaaaatttggctttaaggcttgatcaaaagcttactgttttgaacctgagtcagcaaagtgatgttgctgacttactagggggttttaagcctatggatgctcagtctgtgtatgtgtccctttatggcgagtttctgtctctctttaccaagacatttcctaaagagaataatgatggctttattactagaatgcaaaattatttagaagatcatcgacaaaagtttttaattgataagaatggggaagctctgctgaaaagattgcaaatagcagttgggaagtcagttaagcttatacaacctggatcttccaaaaagcgtaaaaggccattagaagaaaaattaatccaagagtgggagagattttgtattaaattgcatagtgtctgtcaaagtaatcgttcttcagcgatgatgttttcttttgtagaaggaagttttgtgaccgctcttagaaatggtgactgggttttgcttgatgaggtgaatttggctcctccggaaaccttgcaaagaattattggtgttctagaaggggaacatggtgtgctgtgtttagctgaaagaggtgatatggattatatacatcgtcatccaaaattccgtatatttgcttgcatgaatccagcaacagatgcagggaagagggatttgcccttttctttgaggagtagatttactgagtattttgttgatgatgttttggatgatgacgatttaagtctgtttattagtcagttcattagtagtgcctatatggatcagcagttggtgaataaaattgtgtgtttctataaagaagcgaaaaaggaatctgaagagagattgcaggatggtactaaccagaagcctcaatacagtttaaggtccctttatcgtgctctggagtatacacggaaggcagagagaaaatttaaaattcagaaggcattatatgatgggtttagtatgttttttgtttcattgttggatggatccagtgctgaaataatgaggcaaaaaatatcatctcttttgttagaagggaagatgcctccacatgtacatttttcccactatttagatacctccaaatctaatggatattccgggaattatgttcaaactaagtctgtgcaggagcatcttggcaatttggcacgagctgttctaatgagatatcctgtcctcttacagggacccacgtctagtggaaaaactagccttgttcgatatcttgctgcaataactggtcatgattttgtaagaataaataatcatgaatacactgacttgcaagagtatctaggttcttatataactgacactagtggaaagcttgtttttaatgaaggcgttttagttaaagctgtaagaaatggttattggattgtactggacgagcttaatttggctccatctgatgtgctggaggcgttgaaccgattacttgatgacaacagagagctttatgttcctgaactgcaagaaagaattaaagcagatccaaactttatgctttttgccactcaaaatccacctacactttatggaggccgcaaaatgttgtcccgggcatttcgtaatcgttttgtagagattcatgttggtgaaattccagatggtgagctcagcacaatattgtctgagagatgtcaaatctacataggtcatgccgagaaaatggttgaagtgatgaaggatcttcggttgcacagacagagtagcagagtctttgctggtaaacatggatttatgacacctcgagacttgtttcgctgggctgatcgttttcagagatttggtaactcttatgaagatttggccaaagatggctattatcttttggcagaaaggctacggaatgaggatgaaaagtccgttgttcaaaaagttctgaagaagcatcttggggttacactaaacaaaaaaaatttacatgatcagatatcatttagaggtcactcttcttgcaatttcaatgttggtttaggtggttcagagagtcttgaaagtgtgctcttgaccaaaagtatgcagaggttatatttccttgtggaacgctgttataatttacgtgagcctgtactgcttgttggggaaacaggtggagggaagactacttccgtttcttctgacataaatcatgcttcttcaactcttgatctgctgaatggtatgataaggaattgtaaagaaggtcaagtttttagtccggatgtcagtggagaagatcttaatgttcttgagcaaataaaattggacctcaatggcttgcatcaaaagtggcagagcatatttgtgtggcaggatggtcctcttataaaagcaatgagagatggtgacctttttcttgtggatgaaatatccttggctgatgatagtgtacttgagagattgaatagtgtgttggagccagaaaggatgctatgcccaaagtctccttgctacgaaggaatggggagggtctttgtatgtagccttaccctgactttttttggattcgaacccatgaccaaccggtcaccaagacacaactttactgctgtgccaggactcgcttcttatttttcttgcttaaaagaggtattggaaggaatcaggaggcgggcctttcttcagttggtggacatatgtactgagaagttggagatctcttga

SEQ ID NO: 91660 - DNA, 1037 bp, Glycine max
  Peptide Sequence Number=SeqID_208438
gttcaatggggtgtctgatgtgcgcagattggaaaggcaactcgacaaccttataataggtggtttgaagctgtatgtcaacgtaccaaagaaagatagcacctcgccagaagcaactgcaacacaaggcaccctcaatgttatacgcgaaggcccttctcacaaatacaacgacctcagggcagagtggtactccgatgcgtgggtgggtcgcctgaagaacttggccacctttgatatagctaaagacaacatatcatgggaggcggaggagctggccaaggaagaaacccaacacgggtcgatgtcgattcacacgttggagaaatggaatcccaagatgaaaactggtcacaaactagtctgggtgctttgttggggcattccgttagtagcatgggatatggcgcaaattcgaaagattgttgtagcgataggggatattgtggaggtggatgacgatgtagaggagcttcgaaggctagatagggcgagggtgttaatcagaaccccatggagacccacactccaacacacagtaaacctccatatcattggcgagctatacaaagtccacatcatggaagaaacagggctcgacaacgggaaatgcagctaccaagctcgaagtaatctcagattatcagatgagattgattctgatgtcagtgacaccgaaagcccgctttcaaaggccataggagcgctggattccgactatgcgccgagacgtaatgacggtaactccaccgacgggggaacgaccaaaggaaacaaaggaaacttactattacccaatggtacaaccattgatgacgaaccaggggataataaccctggtggccgtaaatgggatggcagcagtggcacaacccacattaggattgcgccatgttgcacaaataaggaaatattgagagatcaaagggagccacgcaacgggagccggggagagcaggtcatggtaggaacgactcacgaaacaaccatcgttgacctcgtgcagagccaagagatacaagacgacatcggacctg

SEQ ID NO: 91661 - DNA, 1293 bp, Glycine max
  Peptide Sequence Number=SeqID_208439
atgtctgttgttgttactttctttgaagaaactcatttcttctcatcctccaagcaagatatcaactcaattcagaaggtcttacttatcccatccttcaacccagtagtatttcctatacgtgagaactccaaccaagaacaaaatcattctcgccctccaaccaacagggcagtcaacttcccctatgacggatccttcatcatcccttcttcatcatcacctcctcatgatgatgactcaggttgtcccattactcttaagaaaggaatttggtctactcaaaatcctcatcctatttacctgagttatcatcgtttatcttcttcacatttctcttgtatttccactttgtcttttcttactattcccaaaaatgttcatgaagcacttgatcatcctggatggcgacaagccatgattgttgaaatgcaggctcttgaacacagcgacacatgggagttggttcctcttcttcctgggaagaaggtggttggttgtagatgggtatatgctattaaagttggtcctaatggtgaagttgatcgtcttaaggcccaattagtggctaaaggatatacccagatatatggtcttgactatggtgacactttctctcctgtggccaaaatcactactattttgctcttctttgccatggctgctattgtcattggcccgaagtatgccctttgtattttagaagaaataggcatgactaattctagacccattgatagtcctatggacccgaatcagaagttaatggcaaaccaagaccagtttaccgtcgtcgcgcatcagagcactgctgtcgcggttgacgtgcgtcgtgcgtcatgcggcggtcgcgtgcgtcgtccattggtcgtcgaacgtcgtctgcttttgtcgtgtgcatcgccggcgcctgcgccgccattcgtcgcactggagactgctgctggtcgtgccgctgaagaggagaaactcggccatggctatggcggccgccatagcgccgccataagcaacccgcaacaccaccgctatttggtggcgtttttccaaatttccgcgacgccattccaccatggccgctttttaataacactgacaagaccaaacatctcctttgcaattagtgtggctagtcaattcatgcaagctcctcatgttgatcattggaaggctatgattcgcattcttaggtatattaagaaggctccaagacaaggattgttatatgagaacaaaggaaatacccaaatctttggattttgtgaagctgattgggctagagatgccccatag

SEQ ID NO: 91662 - DNA, 291 bp, Glycine max
  Peptide Sequence Number=SeqID_208440
atggatacagctgaccaaagaaaaggcgagtatcctcctactagggatacagagaacccactattgggaaaatttgacaagccacttccatgttttggctgtggcattggatggttctctcttctgctaggatttgtttgcccactaatgtggtattatgctacaattctctactttggaaattactatcataaggatccaagagagcgggctgggcttgctgcttctgcaattgctgctctacttttcacaattgccgcagtgataacagtagctgttattttcttgtaa

SEQ ID NO: 91663 - DNA, 4470 bp, Glycine max
  Peptide Sequence Number=SeqID_208441
atggtggtggtggccgtcaccagaaaggtcattggaaaagaagaaagggtcgctggaagatgggcagcgagcagaaaggccctgaaggaaggctgctgggttttgctggatgagattaatcttgctccacaatctgttttagaaggtttgaatgctattctggaccacagagctgaggtgtttataccagagttgggtaatacttataaatgcccaccatcatttagagtttttgcttgtcagaatccatcacatcaaggtggtggccgaaaaggccttccaaagtcatttcttaatagatttaccaaggtgtatgttgacgagttagttgaggaagactacctatccatttgtgaatcaaaattttcgactatacctagaactttactcacaaagttactcttattcaataaaaggatgcatgaagacaccacagtaaatcaaaagtttgccaaagatggcttcccatgggagttcaatcttcgtgatgtatttcggtcttgtgagataattgaaggtgcaccaaagtactctggattatactccttcttgaacattgtttatattcagagaatgcgtttggcagctgatcgaaaggaagtcttacgagttttcaaggaggtatttgaggtgacaccgtttataaatccatatcctcgcattcaactcaattcacaccatttaattgtggggaatgttactatcaagaggaatcacgtccaattaactacgtcctcaagcaaacagctcctgatgcttcctgaaatccgtcaaagtttggaatctgctgctcgatgtgttgagcgtcaatggttatgtatcttgactgggccatcatgctctggaaaaacttcattgataagattacttgctaacctaacgggcaatgtgctaaatgaagtaaatctttcatctgcaactgatatatctgaattattaggatcttttgaacagtatgacgccttgcgtaatttttccaaagttgttgctcaatttgagtgctatgttaatgagtacatcagtttgcaactggagacttcaaatgaagcaattttcagggaaacagatttttatatcagatggatggctttcctttctgggttgaaatttgactgcttgtcatcttcagctgcaaattgttttgaaaatctatgttttctcattggacaactaaagttgcagatacaaaagaattctgtacctgtatcttactcattccatgaacttgatttggccatgaagacagttttgaagatgaaagcagatgttgtttcaaccaaatttgaatgggttacaggattgttgatcaaggctattgagcaaggggaatggatagtcttggagaatgcaaatctatgtaaccccacggttcttgataggattaactcattggtggaaccttgtggatcaatcacggtcaatgagcgtggaatcgttgatggaaacccattggttattcatccacaccctaatttccgcatattcctcacagttaatccccactatggtgaagtttctcgagcaatgcgtaataggggagttgaaatatttatgctgcagccgtattggttagatgatagaagtgggtacaatgatgaggatgttgaattcaaagatgttaggaggtttcttgttttatcgggtattccgattgctcaattggttgattcaatggctagagcccacacttatgctaaaaataaaggttcagagcttaatgagcacattacttatcttgaactctcacattgggttcacctgtttctgcagcttctgaagaatggttgttgtcctatttggagtctaaaaataagttgggagcatatatatctctcctcattgggtgttgagggagaaaaaataatcgatttcgccaaaactaaatatttgtcggcaactaatttggctgggtatgatgatttgacagcgtgtcctttggctttgcctggaggatggccattgccactaagtgtaagggattatgtatattactctaaagaagcttctatcaaacagaactgtatgtatctggaattcctgggaactcagattgcgtctcatcaatatcgaattgctcgtaagaggcactcaacagcttgtgtgcagactcccagtgatcatgtgagggcatatttgatggatatgatgactttacgtgaacttatgtttcctaaggcttcaaatgtgatgatttcagactatgggagggagtgcaaatatgactcagaattgaccaataggatgctattctttgcagccaattggacaattgaacaagctactgaaagtgattttaagttctatcttctcaggttcaagtggtttagttctcaaatgcagcccttctgccagttctttagtaactttgtcatactgatagaacagatgatcaagcatcctatttgggagtatatttcatgccgtgacaaactagatgctgatttgaagttaatgcccttgctgtcacttgatttagttgatttggctccatcaaatagcaaaattaagtatctttgtaatgccattagttgctttgatccactaagattaacttaccagcaacggaatattgagagccagcataattttgatgaagaagtcagtattgagagccagcacagttttggtgaaaaaaccagttgcttcattcgacttttgaagtctctttactttttgcaagatgaaatacttaacaaatttgtcatttcaactccaaagctaatagaggaccaatcatttgactataaactacagttatactctaaccttattgaggaccatgctttattttggcattacttcatttcttcagagtttgatcacatgatgatttcttggcattgtttggtgaaggatgctcggaagtttatagatatgtgtccagaagctgtagataattttttgatggagagccaaaaaattgaggagttttctttttcagtaaattcagaaaaatctttgctgtggattcatggtggtcacccatttttgccctcttcttctgatttacttgatcaacagcaccagcttttaaaatttgttgaaacaatttggccaagaaagacaggatcctgttatcaagaaaattttgaatgcacaattcttggtcaagatattccttgcttaagtggaattttgagcagccatcttactgatgttgttgcatcatttgatcatgatcttcgcttcctcgtgacacaagatgtctcaaactcatcctttttaatggcaaaatggaatcatgaggatggtattcatattgttgagaagttgaaggagatgcatcagatactatcaagaaggtttgaacatgaaaagcacaagttgcagttgaatacaggatccaaagacctttcagcttttgctgaaaattcagctgcttgttgttcatttacacctgtaatgttgtgtgaaaaatctgtatttgaggcttggcaggatacgtttcttccggtagattataccagtttattctgggacatgaagttattacagaaactcacatcaattcatttggatgatcttgaagagttacaccaagctgtgggatgtgtatccaatctgttggactttgctttgaaattttcattgagtttctcatcaaggcctccacaaatgtttttgccacaccaaaagatattgtggaccctgaatgcatgggcatcagtggattcagtaaatttgaaaattgcaagctttattctggagatgtggtttaagtggcatgaatctatttgggtatatttccctaaatctgtgaagattgatggctctgatgaaattgaactaccccacatgctcgttgagcctttcagtgcattagctgtgtttcagatgacgcaaagcacacatgctatcaaggagttttgggtgcaatgtctcaagtctagagttacctcgttcaatttgtggcattgttctcatcatggaacacatctgcctgattttcttttatctgctgctcgctgtcttttccagcagattatttatgcacatagaaaatcttttgaggcggatcaatttgctagaatcaaatatatttttttttctgagaagaatgtacttacggaagaaagcattgatttgctgagctctctcgttgcttcatcaagacaccacaggttgaaaaactcagtgcagaagttcatagtgccactgcttagagagctgtatcttcagtctaatactgctgatttcaattatactattggttgtgcatgggctcacgttggagcattacgcattaatctcttgcttagctgtaaggacattgatcctgccatgaagtactattgcaagtactctcagcttgtggaaacaatatcatcacttgaacttgaaattcaggtaaggaaagagtgtggttatcttgctggacaggttttgacacaagaggctgacaaaagaaaagcacaaaggctggaaaagcttcaggcagagtgtcgaaagctacagagaaagcaaagataa

SEQ ID NO: 91664 - DNA, 159 bp, Glycine max
  Peptide Sequence Number=SeqID_208442
attgtgtttcgtgctgaaccatcgaaatacaagaagttaattgatgtttgtatggactttcttaaacaacacgatgctttggaagtgttggtgaaaagtaggggtactgctaaggaattacaagagtttgttgacgatgcttgcagctggcaggtataa

SEQ ID NO: 91665 - DNA, 795 bp, Glycine max
  Peptide Sequence Number=SeqID_208443
atggatgagtatgctgcatatagcgacattattcaaccaattcaagttgctgtgtatgagatgaaatttggattgtcgctggttttgtctagtacctgggaaaaaaaatgtttgaatgaacttgggcaggaagacatcaacgtgattatggaaatgatatacacacttatgcgcttccctcgtgctgcttcatgcatgttcatttctgtcaagcatgacattgggttggacatgcgtccttcatacaggctagattctgctacaggcttttatttggtggatgtggatttgatggtaaggcttgttactctttcaagtggtgttgctgctgatcagaaggtatctggggtgcactatagagcttctgtctattggaacattcttgttcaaattgcacattgtacagctaatgcaaaaataattgatgataaatcttatatgctcatgcacaagattttcaacgtgtttgccaagctttggttgaataagaaggatgatgtaaagtcagagagtgattttaattctcaacagtacaagtttaaacctcgagctttcgaaattgagagtgttattgaagttgaattaccacctcttgcaaattcagttgcacctgaaacatttttggaatggaaggaaaaatcttctgacaaaattgtaccctctcaggatgaaaaaccgaagcagctggaagagtctatcccattcctcagccatgtggttctcattcacaatcggttatttggatctagtgatctagtccagactggattaaatgaattgaatcacccggattga

SEQ ID NO: 91666 - DNA, 753 bp, Glycine max
  Peptide Sequence Number=SeqID_208444
atggcacaaatgttgaaagtacttgcacctctccaacagcagattctttccgttctaaatgagtgggaggatcataatgatcttcagaattttttggatataattgacatgctcttgactctcccgtcggatacccctttagcaaaggccttttcagggttgcagtttttactgcacaaagctgaagttatgcaagaaaatggttcaaagttctccttctcaaatcaattcaaatctgtttatgatctgttgtcatcatggcaaaagatagaactggactcttggccggctttgcttgatgaggtgatggaccagtacgagaataacgcgggggaacttctgtataatggccattcaactatctgctatactgctagtgtttttagagttcagcactccatatatgatggaggccttgaggaattcattcaaacatccagtattggggaatttaggaaacgtcttcagattctctttgcgttccttggtcaaaatcatatcagtgcatgcttgaaaattaattccagttctagtcagtcggaacaatcaaccttcttatacaatatctttggattttatgcgcagttcttaccaatagtattgaagtgcattgatgctagtaggaaagaggtcgagattgaacttagcaaactagtgaaactatgtcggtgggtgcatggcaagagttatttatcaattgaaagcttgaaaaagggtcggcagaagctgaagaagcttatacaaaagtatact

SEQ ID NO: 91667 - DNA, 3936 bp, Glycine max
  Peptide Sequence Number=SeqID_208445
atgcaggaccagcataaatcttggtggttccttcagctttctgggaacattccatatttactgctaacaaatagtagattatcatgtgtaacctcgggaattcctgaagttgaaaataagaatagtccagaagaaagttttcttatggagtggaaaacagccattgattattacttcaagagtgttgtgtctgtcctgcttttgcagcagacatgcctcaatccacacaaagatataactcttgaacaggttgacagttctagttctttcctcaaccagctcgtacagatacaacagaagcaactcactgctgccactgcatttgacaagcagttgaaatgctttagagaatgtgtatctactctgggaaaattgttttcactttcctcctccactgataacaatataaatcatatgtgctctattattccaaaacaatttgcttcttacaagtgtttgtggcaacaaaaacaattatttgacactctgtgttctacatcacaagaagaattgcttttactaaggatattagaaaatagccatttaaacacttgtcatagagcaagaccattagccaggcagatgattgcttccattgaagaatttttgccattgttctgtaaatcgaaggaatcattggattgttacctaattgggagaaccaaagctgtcaccgcagtgacttattcctcgcatctttgcattgttactcaagaaattgagcagctggtttctgaaaatttcaagaccattagggattttaaggatcgttttcttgaactacaggagcatgatttggatagaagcactgccagaaaagttctgattcagcattttcaagaaatagctgataaggcaaaattagttgaggaagagtttacaatggcaataaagggaaactccaatcaagtagatttatctgaagatatattttgtgaaagaaactctgtggagcttaatgccaggttcaatgaagcccttatgtctacttgtcagcatcttgcaactgtattgcagaatttatgtttgccaagcaatattcctatggttgacgagtccatggtaaaaattgtttcatgggaatcgctatttgagtcatttgttacaaatcttagcttggacatattatgtcagaatcttttcaaagcaatttcttttggggagaagttggtgaattgttgtgatgataacaacaacagttatttgcatgtagaagcccattttagaaatctacatttgctcatggatcagttactaaactttggtgatgaactcatgaaaaatttcttagccatgcacaaatcagtatcagtaacaacgcatgtgattgcaaatattttagcttctttattttcaaaaggttttggaatatctcctgaaaaccaggaggaagatggaaccctcaatacatctggagatgcaagtgggacaggcatgggagagggtgtcggattaaaggatgtaagtgatcagattactgatgaagatcagctgctgggagcacgggaacagcaaaatgaaaagcaagatgactctaatgaagtgccaagcagtaataatacagggattgagatggaacaggattttgaggctgatgcaatgagccttagtgaggactctggagaagatgatgatattgatggtgaaaatgaggaacttgagtctgaaatgggacctgctggaccagacagtgaagcagtgggtgagaaagtttgtgatgagaatgaagatgaaacccccaatgatacaagagaaaagtatgaatctggaccttcggtcaaggacagagatggagggaatagagagttaagagccaaggatgactctacaactaatgaacctggggatggtaattgtgatgaaggtgatgctcaggatgatgaaactgtaaccccagatgaaataggtgatggagagaatgctgatgaggtgactatggacaaagacacagcatattcagatcccactgggttgaagcctgatgtgctggatcaaacttctgacacagttatggatttggacgtaaatgaagatgcagatctcatggaagatggagaaccggatgagcaagttgatttagctgagaacagaaatgaagggaatcgagatgaagagacttgctctcctgatgaagttatggaagaggcaaatactgaagttgacgtgaactcaggaaaagatgatcaagagaatgcagacttgaattccacagaaccaaagaaagatgtatcaagattgtcggagttgaataatgaacaagtttcccctgctgaattagcatcacagtccaaagttgattggcagacatctggttctgaaaatgtagcagcagagtcgaatgtgtctaatagtcatcatgactttgactctactctgttgggaggcttgccttctagcagtatgtctgatatggatgttgagatgcccaactcatcaaatagtgggggatttggagaaaatcaacccaaatctcatcatccatggaccgatcattcatttattcaggagaagcatactaatcctcgtcgaagtataggtgatgcacttgaatataagaaagaaagagttaatgtatctggtgatgttccagaagataacaatgagatgcagggtgagatggaagatgaaaatgctgatgagtatggctatgtttctgaatttgaaaagggaacaactcaggctctgggacctgcaacacttgagcaagttgatagaaacattgattgtgataagcttgataaagaatgtcttgctggagaagatgcaaaattgcagtttgagaaggaaaaatctgaaatgaattctgtaaataattcttcattgatcccccaaaatgaaaaaagggagaaagtgaatacctcaactatggagaagtcacgagaagatggatcagtgtatcctattgctagtatgaatattgatctagaaaatcgtttggaagatttggtttcttttgggaattcatacttgagtgagaacaatgataatataagccagccttttcagcatgacaaagacttgggtaaatgccaagaaccttttgatgtacctgatcatgtgaaagataatgctactgctctttggagaagattcgagcttagcacaacaaaattgtctcatgagttgactgagcaattgcgccttgtaatggagcccactgtggccagcaagcttcaaggggattatagaactggcaaaaggataaatatgaaaaaggtaattccttacatagcaagtgattatagtaaagatagaatatggctgagacgaaccagacccaacaaacgtgattaccaagttgttatagctgttgatgattcacatagtatgtcagagaatggctgtggtgacgttgctattgaggcattggttacagtatgtcgtgctgtttcgcaattggaaatgggcagcttggctgttgctagttttggaacgaagggaaacataaaattattgcacgactttgacaggccctttactggagagtctggtgttaagatgatctccaatttgacattcaagcaagaaaatactattgcggatgagccagttgttgacctgttgaagtacttgactaacaagctagatactgcagttgcaaaagctcgacttccatctggacataacccccttcagcagctagttttaataattgcagatggtcggtttgttgaaaagaagaaattaaagcagtgtgttagagatgtgtcaactggtaatcgaatggttgctttcttgcttctggataattctcaggagtcaattatggatctcaaggaagcgtctgttgagggtggacagacgaaaattttcaagtacatggattcctttccatttccctactacattgttctgaggaacattgaagcactgcctaggactcttgcaaacttattgagacagtggatggagcttatgcaacattcaactggttga

SEQ ID NO: 91668 - DNA, 357 bp, Glycine max
  Peptide Sequence Number=SeqID_208446
atgacacacggtgagttccttgaagaaaacgcatcctctaggtttgggttcggagcgaggtttggtttggtttggactttgaagaacaagaaagataataagcacttggcactcactgccactacaaaagtgggaggtttcaatggagaaggtgttgtgagagaaaaagaggaagaagaagaaaacaacaagtggccttcatggctgcagccacttctcaagacacgtttctttgttcaatgcaaagtccacgcggattcccacaagagtgaatgcaatatgtattgcttggactgtgtgaatggagccctttgctctgcatgtctctcttcccacaaagaacacagaataattcag

SEQ ID NO: 91669 - DNA, 153 bp, Glycine max
  Peptide Sequence Number=SeqID_208447
atggggagccccgcttcccattctattggcagtctgacctcaccagggtcgagaaagctattttggagtgccggtcttactaaacgtgcggttcattctatctcttccctcggtattatgggtgacttcgctaggaggacccttgtgaagtag

SEQ ID NO: 91670 - DNA, 415 bp, Glycine max
  Peptide Sequence Number=SeqID_208448
atgaagacattgtggaagatgaaataccttgaagaatcgaagacagtgaaggaagaaggaaaaggattggatgtagaaggaaaggaagcaagtgatcaaggtaacggtgacccgaaatcgaacatccactccattcaaaggggagatgaaattttcgataactggtttcatcaaaccctcaacacatcccacacacaccagcacacaagtaaacacgcctgtgcacatctctctctatcactgtcgcaacgtgcccttcgcgggcgagcgagggcgaggctcacgggtgcgcttcccaaaggaggaaagatgcacggagtcgccaccaacgaaggtattagcacctctcacgtcgacaaaagcagggcttttgctcctacgtaccctcctttggagaggaaatcagacctacgta

SEQ ID NO: 91671 - DNA, 312 bp, Glycine max
  Peptide Sequence Number=SeqID_208449
atgtcaatccttaccctcggaagcaaaaaagaagagaaggaaaatttccaatcaaagagaaagcaaagaaaaagaaaaaaaaaagaaagaaggaaaatttccaatcaaaggaaaaaagagaggaaaggaaattcccaatcaaagagtgggaaaaggaaaaaagagaggaaaggaaattctcaatcaaagagtgggcgaaagcaaaaagaaaagaaagaaaattcccaaccaaagagaaataattcgcaaagtcaagtcgtgacatatctatggtttggaattaggatgaaacacttacctgtgcgaggttga

SEQ ID NO: 91672 - DNA, 798 bp, Glycine max
  Peptide Sequence Number=SeqID_208450
atgggttccaaagacagttgcagaaccgaacttcgcattgccatccgccaactcagcgatcgatgcctctactctgcttctaaatgggcagcagaacagttggtgggtattgaggaagaccctgccaagttcactccttcgaatacgaggttccagcgtgggagttcgagaatttgccgcaagtctaggactcatgagactgctgcggtgatcaccccggtcgtgggtgttttgtatgacgccacacctgtgaatgtgatggagaaggatgaacttgtagatggtgatttttacctctggcaaagtcctatttcggttgccgctggagaaaagcaaaaagaggaagagacgatagaacttggggggcctctgggtaagagtgatgctatcaatcacgaactagtttctttggagagagagttgtcaacaattcgcaagaatggcaaagttgatcctttttgtttgtatttatatggtcttgtgctcaaacagaaaggcaacgagaacctcgcatgtacagttcttgtagaatctgtgaattactacccttggaactggaatgcctggaccaagctgcaatccttgtgcaaaaaggttgatatcttgaatagtctgaatctcaatagtcattggatgaaggactttttccttgccagtgtttaccaagaattaaggatgcataatgactctctgtcaaagtatgaatatctactaggaaccttcggttatagtaattacttacaggcacaaattgcaaaagtccagtacagtttgagggaatttgcggctgctgactga

SEQ ID NO: 91673 - DNA, 221 bp, Glycine max
  Peptide Sequence Number=SeqID_208451
atgcagattgggctagtgatagcgcgtggtggttgtcgtccgcgtgaacctttggtgttgcacaagaagaatgtcacgttgtggagtattgagtgtgttgagcatgtttacattccatttgccccaacagcccttgtggacgtcacagaaaagtggatgttgtgcttctctaccattggaggtggcagacttctcgtcaacataaccataataatgtcatg

SEQ ID NO: 91674 - DNA, 1103 bp, Glycine max
  Peptide Sequence Number=SeqID_208452
atgaattttaacaacgtgaatgctccaaaggttcctggtggcggagtcgctgctttgcttaaagttggcattattggtgggcttgttgtatatggggctgcaaacagcttgtacaatgttgagggaggtcatcgagccattgtcttcaatcgtgttgtcggtgtcaaagataaggtctatcctgaagggacacatattatgattccttggttcgagaggcctgtgatctacgatgtacgtgcacgccctcatttagtagagagtacatcagggagccgtgatctccaaatggtgaaaattggacttagagtccttacccgccctgttcctgaccagttaccaacagtttatcgaaccctgggtgagaattataatgaaagggtcctgccttctattatacacgaaactctcaaagctgtagttgcacagtataatgccagtcagctcattactcagagagagaatgttagtcgagaaataaggaagatattgactcagagggcctcccagtttaacattgctttggatgatgtgtcaatcacaagtttgacgtttgggaaggaatttacagctgctattgaagccaagcaagttgctgctcaagaagctgagagggctaaatttgttgtagaaaaagctgaacaagacaaaagaagtgctgttattagagctcagggtgaagccaagagtgcccagttgattggtgaagctattgccaataatcctgcgtttatcaccttaaggaaaattgaagcggcaagggaaatcgctcacacaatttcaaattctgccaacaaggtttacttgaattcagatgatctcttgctgaatcttcaggaaaaagtgaacggcagctgggaagctaaacgacggcgtggagtgatgatattggaggagatgttcttctgcagcagcagtagcagtagccagcagcttcaaccatttgaaaatccttcttccaatctactccttctctctggccctccttcttcgtacgtgaatgatgatgaagacattcgcaagtactttgctgctttccacctgtatgatacattgcctgcagctgttcttattgatgatttcggagatttctttgacaacaa

SEQ ID NO: 91675 - DNA, 2727 bp, Glycine max
  Peptide Sequence Number=SeqID_208453
atggagagtagcagcgagcagagactgcagtccctggagcgttgcattgaggagaaggagaagaaactcgtctccatcaaacgccaattcggccgcgaaattgacgccaaagagagggaatacgacgtggtgacgaggaaagtcgaagaacggaacagagagttggagtcagtacagaggaggatcaccgattgtgagtggaaactcgacaccgtgcgccgcatgatcaccgagagcgatgaggtttaccagcaaaaacagaggggcattcaggatagtgaccgtgaactcgccgagaaggaggcgcaccgctctttgatcgcggacatgatcagagagcgcgagcaagagttgagggccaaggacgccgagtttcagcaggttttggacgaaggcatggctctcaaaaacaaagttgctcaactcaacgatgaccttaagaccaaaaaggaagagcttgacgtcgtgacgcggagcttgattaatgaacaagccactgaaaccaccatcaagtccatgcgtgccagaattaagcaactacttcgccagccatatgagtctgagtctaaacagaagcaatttgaaggtcaagcgaaggagcttgaatcaaaacagaagcattatgaacgccaagtaaaggaactccaatcaaaacagaagcaatatgaaggaagagtgaaagagcttaagttaaatgagaagttgtatgaaagaaaagtcagggagcttggttctagagagaaacaatatgaaacaagaatgaaagagcttgagtcaaatgagaagcagtgtgaaacaagaatgaaagaggttgagtcaaatgcgaagcaatatgaaaaaagagtaaaagaacttgtttcacatgagaggcaatatgtaaaaagtgtgattgagctcaattcaaaggagaagcaaattgaaggacaaatggtggatcttgagtccaaaaagaaccaatatgaaggactagtgaaggagcttgagtcaaaagaagcacggtgtaaagtgctactcaaggagctcgagtcaatagagaaaaaaattcaagaacaaatgaaggatctagagttcaaaaagaatcaatgtgaatcatcaagaaaatcatttgaagaggaaaaactgtcgaaacagaagtctaatgaccaacaacatttcacaaatgccaacagtgcaagtctctttaaccaacaaaattttacaggtgcagataatagcaagaatttacctttgttcattaatcttctggaaaagtacgagttgatgtgtagtcaagtctctgatgctctccaaacatttgctaaccctactaagctggtgctagatacaataaaaggtttttacacttctcattcaaggcaaggacttattgaatatgatgcaagtatctcaaggagaatatgtaatcttttaatggatgaattgaagaaatcttcgccggtaattgggattcgtgttaaacaagaagcaatcaaattggcaactgactggaaggcaaacttagttgcgggtgataaggattgtttagaggttctggacttttttaagtttgttgctacttatgagattggttcatctttcgatgcaattgagcttcagaggcttctagatataattgccctacaatatcaaactctgcaagccattggtaaaattaaagaaccttcagataatcaatcgagtcccaccattgatggaagaaatttgcattttcccagtattaagcacataaatgagtcggttaatctccatacatcatcagatccagcaaaacttgttttggatatcatactggtccctattgcttcagagaaacagggaagtgaaggtgctattatcattgatgagagccacatcttactgttggaacaattgatgagaatctcaccacgggtcaaaccccgtgtaagagaggaggcgctgaagatagcatttgctttgaaagcgaacataagagaaagtgctgaaaactctttgacaattctgggctttctattgttactatctgcttatggattggtttcttattttagaaaagatgagcttttcaagcagttggaatctgctgctcagcacaagcaagctgtagagctgtttcggactcttggttttgtggataaaatctttgattttgttcggaatcttattatgaagcagcaacacatagaggctgttagattcatttgtgcatataagttggctgacaagatccaaccagttgatctcttgcgacaacatgtggcgaaagtaaagtcagtcaccaatagatttgcttgcatgaaagagtccgtcgaacaaaagattaaggtcagagacgaagaaattgttggcctgcgaactgttctagaatgcatttcagagaacaacctagaatctcatcaggatctaggtaaagagattaatgatcgcattgttgatctagagaagcagaaggaaaatgttgttcgtttaacatcaggaccttcctccgaagttgaggaaaagacgtgtggtggagaagcagtgacagtaaccgtgcacaaacctgaagaaaagaaacgtcttgtgggagtaagcctccccattaataatcagtggggtaacatcagcaaaggtcctcggacaagtgtaacttaccctcggttcgctcctcttcctcctcctcctcctcctccatatgcgagcccagggatgagtgttgctgccattgaggaggaaaatatgctatggctctgtcgaaagtggatctaa

SEQ ID NO: 91676 - DNA, 333 bp, Glycine max
  Peptide Sequence Number=SeqID_208454
ggcccaattggtggctagaaccacggtgttgctagcagagttctatgtcatcactgacaacaccatcatcgtcacccaacgcatcatcaagaagcttccaatagaggccaacttcaggctcacaaattgcaagtccaccctcgcaaagcctccaccctacaccctcgcaaatctggttgtcgatgtagaggcatccatcggaggaagagacagtggtgcacaggacagagaaagaggggaaggcgaacaacttgtcatcgaggttgtcatggaggtgagaggaggaagggcaagggcaagaagggttccgagtagaaatagagacggcaaagg

SEQ ID NO: 91677 - DNA, 428 bp, Glycine max
  Peptide Sequence Number=SeqID_208455
gaccttcctccgaagttgaggaaaagacgtgtggtggagaagcagtgacagtaaccgtgcacaaacctgaagaaaagaaacgtcatgtgggagtaagcctccccattaataatcagtggggtaacatcagcaaacgtcctcggacaagtgtaacttaccctcggttcgctcctcttcctcctcctcctcctcctccgcctcctcctcctcctcctctgcctcctccacctcctcctcctcctcctctgcctcctccgcctcctcctcgtcctcctcaataccagcgtgtatttatgcctatgcccggcgcctcgcagtttgttttcccggaaaactactttagacctgctaatcctatggcttggtctggaaacaacggaacaaattactatggtaactccaggccgccatatcctccttttggatga

SEQ ID NO: 91678 - DNA, 246 bp, Glycine max
  Peptide Sequence Number=SeqID_208456
atggtagccaaaagagaggttaacggcgggggagagggaaccgcgctaatattcacctacggaaccctgaagcgagggttctcaaaccacccccttctccaagacctcattcgctccggcgacgcctctttcgtcggaacctaccgcaccgccgtcaaatacccccttgtctgtgggccctacaaagtccccttcctcctcaacattcccggatcgggtcgatgggtccacggggagatttactcg

SEQ ID NO: 91679 - DNA, 165 bp, Glycine max
  Peptide Sequence Number=SeqID_208457
atgttaggtgtcgatcatttgggctctaagcaccaagctaagactgaagcaggtgctgatagcaactcagagaatggaaataacagcagcaatgcagagccacacgaaggaaggcccaaaaggaacatctcaaaacccaattacttgaaggattatgacacttag

SEQ ID NO: 91680 - DNA, 3591 bp, Glycine max
  Peptide Sequence Number=SeqID_208458
atgagactcgaatcagggacttgtaatgtgtgctcagctgcttgttcatcttgcatgcatcctaaccgagctctcatggggtcaaaggctgaagaattctctgatgaaaactgtcgcttaggggaggttaatcagtattgtgatgagagtgatagatcttctcttgggagcagagcttgtgaaaggttgaagcatggtgtcagtgaaaccagtcacaagcctagtgtttcttccactcatgattctctatctgaaaatgctgagaacagtcaagccttatcagagaagtatcaggattccaagtgtttagaaagtcttgatgatagcacttcttgtattagtaggaccaaaggatctggaaatgggccaactgttgacatatctagtttgtcagaatgttgtatggaaaatgttgattcatcattgaccaaagagagagtacctattattgttcctggtgaaaaatctctggcagataaggaaaacctaaataatggtacagccaaggtttcaattgaaatatgtccaaagtcagaagaagatactgaaaataatgttgatgttgcggaagatgatgatcataaatattcagcccatgatggattgcatgagaaggttgaggagctgattaaatcatctggaagggctgaacctcaatcagaagatgagagtgatgaatcagatgttgttgagcatgatgtaaaagtatgtgacatctgtggagatgctggtcgtgaggatctacttgccatatgtagtaggtgcagtgatggtgcagagcacacctattgcatgcgggaaatgcttgagaaggtccctgaaggggactggttatgtgaagaatgcaagtgtgcagaggagactgcaaatcgaaagctagcagcaaaaaggcaagctcttgaatcaagcacgggatcaccaaaggcatcaagccctaagagaatagtcccactgtcgcgggaatcttcattcaagagcatggataaagaaaagatgaaatctggtcaacagaagatccccatgcataaccacctcggtggcgatgacacagaacttgcccgttctctatcagctggccctcggagtcaaaatgcaaggagtacattgctgaagtctaattcattcaacaacaattccaagccaagagtcaaacttgttgatgaagttgttccccaaaagcagaaaggggttgttgaacatatttctaagaatatggagacacctgctgggatgataagcaaatcaatgtcattcaaattgtcgaatttgggtcgttcaaatgctgttgaatcaaaagtgaaaatgatctcttctaagcctggaacgacacaggatttgaaagcatcaagacatgcaaaagattctgcttcatttgacaggaaatttctgtctaagattgatcgacctgtcatttgttcaaccatggttagttctgttgtttccacatcaaagggtgatccgaagcttacaccacatggcgaaactgctaaaccttctacagttaacaacaatagagagtttaaggtcaaccaagatggaaaattatattcattatcgaagtctatgaataatactagcagtaaaagtccagaacctcaagttagttcagatagaacatcaacaagtgtcgatgaaactcaacaggataagctgcctcgatcacaggatacagctaatcaggttgacaaagccaaagatagttccattgatcatgtgatgtcaggtgttactaatgcttcaaaaagctcattctgtcgtaaatgtaaagattttggccatgctacagaatgttgtacagttagtggtacgcaggaatttggtgccgaatcatcagtcattgccacaagtagttcaaaagaggagatgcatgagggaaatagattgaaagctgcaatccaggcagctttgcttagaaggcctgaaatacacaagaggaaagaagctccggatcaaactaatgagtttcctacatcaagcactggtttgaaacgcgaagtcacttctcaaaagcaagtgttggtttccagtacattgaagaatagtatatctgctgaagaaagcaatatgaagcaggaaatcattgtgaattctacagttgaaacctccaaatgtccatctgccaatgatctgaagcaagttaaattttgtcgaactgatttttgctctcagctgagaaagtcagattctgttggtcccacttctggaaagcctgtagtgagagacttgcccaataatgccatggaaatatcaagtattctttcaaagatgtcagtcattccagaatatgagtacatctggcagggtgtctttaaagtgcatagaaatggaatgcctcctgacttgtatactgggattcaagcacatttatctgcatgtgcttcccctaaggttcatgagggtctattggatcacatgattagaaatgatttagcacttagggggacttctgatggtgttgaacttcttatatttgcatctaatcagcttccagaagattcacaacctgtcatgactttgtctgaaactcggtgttcacctaagcgcatggatgaagagttcattgaccaagatcacaatatgagagatagtgttccagagcatcgacaatacatagagtctaaacctcctgaagcaatggaaactagtgtaagtagtaggattgtggaaacaaaaactaatcatgatatttctgttaagcaagagaactctttgtcttcggggatcccttcggttggttaccaagagatagatactgcaagcaatatcaatagggataaaattttggacagaacaaacaatgatgagaatcagcaaaggcctaaaaggaaacagatggaagatgatcttgatattaacgttgaggcaacgtttctgggagacctgactgtgaaagcggtcaactgtcaactacctaatgataaaaaagttaagcatatagatctttcagatacagctgtggaagcttctgcagttagttgtcagaaaatgccttggaatgaggtaaatggaaaatttgaaaacggagaaagttatagcaagaagctgcaaacaggttttggtggaattcacggatgttatgattctggagccagggaatcttttaatggtagttttgcgtcacttgtaaatgatcttggttcctgttcttcaggggagaacaaacggtgcaaaaaaccttgtgatgagaaaatcatccacgaggacttaggagcgatggaaagaaccttctttcctgttgatactcgtaaaaaaaaagactcggggatggtactgaatgagcctcgtgcatacgtggaccaatttcaagttggaattccaaatctagagcttggtttggggggtgaaacgaaaccgtcacacaagggtatgctgcctttctttgttggtgcggttgacaagaaaaatagccaggaaaagactccagatatattgacagatgagcgagaggatgagaatgttgctgcgtctctttccctgtctctatcttttccatcttcaaacaaggaacacgtcaaacctgttacaaaagctgaggatgggcataatgtgaattcgccgtatctcctttttgggagattcacggacaaataa

SEQ ID NO: 91681 - DNA, 1008 bp, Glycine max
  Peptide Sequence Number=SeqID_208459
atggagatgaaaatgcaattaaaaagtagcgcaaaaggaaaggtaggagagaaagagaaagtaatcagaagaattggagtgagtgagaaagaaatgggttggggaaggggaatgttggaaggtgtggtggtggtgggatgtctgtgtttactgggttgggcgggtctgtggtttttgaaccgtcgactctacaaagagtacgaagagaaacgcgtcctcgtccaaatcatcttcagcgtcgtctttgccttctcctgcaatcttctccagctcgtcatcttcgaaatcattccaatcctctccaaagaggcaagagtggtgaactggaaggtggacttgttctgtttgatcttgttgctggtcttccttctcccctattaccattgttacttgatgctcaaaaacaatggcgtcagggctgagagggctgcacttggtgctattctctttctgttcgcttttctctatgccttttggcgcatgggcattcactttccaatgccatctccagataaaggtttcttcaccatgcctcaactggtgagtcgaattggggttattggtgttactgtcatggctgtgctatctggttttggtgctgtaaacctcccatacagttacttatcacttttcatcagagagattgaggaaacagaaatcaaggccttggaaagacagctaatgcaatcgattgagacctgtgtatcaaagaaaaagaaaattattctttgccaaatggagatggataacaagcaaggatctgaagagaagttaaatgctagatctttaattaaacgaattgttggtacggttgttcgatctgtgcaagaggatcaaaaagagcaagatattaaagggttggaagcagaagttctggccttagaagagctttcaaagcaattgttcttggaggtctatgaacttcgtcaagcaaagtgtttggactcttctgctgatgatgtgtgtgtgcatatcctcctcaatcaccattctaaatttccaatataa

SEQ ID NO: 91682 - DNA, 564 bp, Glycine max
  Peptide Sequence Number=SeqID_208460
atggcaataacactcaacaatggcttcaagatcaagatgcccatcattgaaggaaaagaaatcagggacctaattctcaattccatcaaaatcggttatcgcccatcattgatgaatatagttaaaatttactacttccttttgctaaacactttttgcagcaactatgatgtcttactgaccagagattgtttggcatactccaagataaagcctgcagtaaatcagattgaaactcatccatacttgcagcgtgttttgtctgaagcacgggatttgtgtcactgcacacactccactaggaggtgctggagcaaaggctggatggtttgggtctggccgaaaaaatacaaaaagactgttgcccagatcgctcttcgctggggcattcaaaggaacactgtggtcattcctaaattgtcaaaactggagaggttgaaagagaactttcaggttttcgattttgagttgtctaaagaggacatggagctcattggaagtatatgtagaaaatatcgaaccaaccaaccagctgtgttttggggcatagatttgtatgcgtga

SEQ ID NO: 91683 - DNA, 150 bp, Glycine max
  Peptide Sequence Number=SeqID_208461
atggagctgtggaagaaaaacgggaagcgtgggttgaggtgttattcgcagaaagaaacgattggttatgtgaagcttttggctctcttagtctgttgtgacgaattgatgatgatcatcaggatatgcatctcttgctcttttgtttag

SEQ ID NO: 91684 - DNA, 111 bp, Glycine max
  Peptide Sequence Number=SeqID_208462
atgggagccaaggagaacgtgaccaatgtcgacggttcaaaaaagggtatgaatgattttaaagaggcgaagagtacgatgaaagattttaaagaggttgggtatgaatga

SEQ ID NO: 91685 - DNA, 285 bp, Glycine max
  Peptide Sequence Number=SeqID_208463
atgaccccactggtgaccctattcacgctgagcccccaacctcagcgggaaaatctcggatctataaacccaagtaacgggcccggacccaatccagaaggtggccacgtaagtatgaagaaatatgctctcagcggaaagaaaattcctcacgtaggacaataccgcaccgatgctgagcccagccgcccacgtcagcgtggtccgcgaatggtcctccactgtgaggctcaggcccagagtcaaaagcgagagtctaagcccactaacgctggaaaggaataa

SEQ ID NO: 91686 - DNA, 654 bp, Glycine max
  Peptide Sequence Number=SeqID_208464
atggtttttctttttcataatcaaccgatggaggtggttctcgttcaaatgctgaggctggcatgggtcgctgccacgttacccatcatcgtcgcttctattcccactcccaagctcaactgcctccgtggcaccttgctgggttttgctcgtagaggcaaaatcatgcactcttcctcccaaaaagtaactatttctcagaggttcttcttgcacttctacgttgtggcttttatatggacaacgttgctacttgttgggacttgggcatatgcgtacagcatggtgccacttgttgtggagccgttttcttactctactatcactagcttcttgactggtggttctactattagaactgatacgcataaattgaggcagggatatgtggcctggcaagcggtttttctgcttttgatgatggaagttcatgtcctcagacgcctttatgagacgatacatgtttttaactatagcccttctgctcgcatgcatgccgttggtgaaattcatgcgagtctcactaaatatgcgggttctattcccggtttgattttgcttcaccataaggcattttctgactcaactgagcatgctatggtgcttggaacaacattgttcttgttgccgcaaaactttgtctatttagcatga

SEQ ID NO: 91687 - DNA, 438 bp, Glycine max
  Peptide Sequence Number=SeqID_208465
atgtattatgtaaaagaagctgcgcatgtcgaccccatgttcgtagctgataacaccaaccccaagttactagttaggcttgtagtagtgggtgaaagtgaaactgatctgggaaatgcagcggaagattattacaaagtgctggaggttgaatatgatgcaaccgatgaaaatatcaaattaaattaccgaagactcgcgctgaaatggcatcctgacaagcacggaggagatagtgctgttactgcaaaatttcaagagataaatgaagcttacaatgtattaagtgatcctaccaagcgtttggactatgatttaactgggatatgcgagattgaaaaatatagcttgcaggagtatcttgccagatttaaaagcatgattcttacctgcaatggacttggtatcaatcagacagacagatggtatttattttga

SEQ ID NO: 91688 - DNA, 234 bp, Glycine max
  Peptide Sequence Number=SeqID_208466
atgagaggtggatttgtaggcgggagaaggagggagggacagacacgtgtcggtcacggattaggggctgtgtatggagtgttgtccgagaaagttagtgacgtggcaatccttatccagtgttggctcgagattggttctcctgtgacgcgtaccacagtatcatgtgacttgtttgttttgttcagtataataataatattaatgtctgatcctgcttttgttgtcacatga

SEQ ID NO: 91689 - DNA, 975 bp, Glycine max
  Peptide Sequence Number=SeqID_208467
atggtgttggcatatgctgccatgctttcttccactttaccgtttcaaaagtctgttcctttgacttctcaacgttcaggaacagcatttggttcctctttccaattcaatagagagaatggtactgttgttacacctcttgtcgtgtgtcatgctaagaagaaactcagttttatggagcaaattctcgattacattgaagggggtcctaaattaaggaagtggtatggtgcacctgatatccttgaaaaagatggtactgcaatagaagataatgaggatgattatccggaagatgaagtcagggatgcagtgctggtaacagatggagatagtgagatgggtcagatggtgatattgtcattgattgtgaaaaaagctcgagtaaagacactggttaaggataaaagggttgcacttgaagcctttggaagttatgttgagtttcttattattgatcacatgatgcttgttgcaaagtcaatggcaggagatacaagtgacaaacgatttgtcaagaaagctctgagaggagttcgcacaatcatatgcccaaatgagggatttctttctagcgttggtagccttcaaggggtacaacatgtaatcgtcttatctcggttgtcagtttatggtggtcaaagtggctttcaatccatgatgaaaagcaatgcaaagaaattggctgaacaagatgaatcagtattgaaaacctcaggaattccttacaccataattaggaccggtgcattacaagatacacctggtgggaagcaaggctttacctttgatgagggttgtgcagctagtggaagtattagcaaagaagatgctgcctttgtttgtgtagcagcttttgattgtgtcccacaaactggattcatttttgaggtggccaatggggataacaaagtttcagattggaaagaatgtttggccacattgatggagaaagcaagtcaaaaacttcagtga

SEQ ID NO: 91690 - DNA, 816 bp, Glycine max
  Peptide Sequence Number=SeqID_208468
atggacaccaacactagtacattattcacaaatgtgaacagcacttggaatcttgaaaagatggaaacaaatgaacaacaacaacaacatgatgaccatagtattattctccaagttcaagaccctatgggttctgggatttggcccatcaacaactaccagaaccttcttcaaatgcatcaaacacccaacacaacaacctcatccacggtcatagtaccaccctcctcctcatcagggttccttggagacatactaggtgttcatcacaacctagaagaagatgaagagccagaagaagagctaggagccatgaaggagatgatgtacaagatcgctgctatgcaacccgtggacatcgaccccgccacgattcgaaaaccaaagagaagaaatgttcgcatcagtgatgacccgcagagcgtggctgcacgccacaggagagagaggatcagcgagaaaatccgaatcctccaaagactcgttcccggtggaaccaaaatggacactgcttcaatgctcgatgaagccattcgatatgttaagttcttgaagagacaaatcaggttgcttcaatctattcctcaaccttcacgtcaaccaccacaatgcattggtgttgccagtactactcctcatgctagtaccttgttgttagccccttcttctgattggccttttgcaccaaatgtgctaccccgttccaccgccgtcagcgcctccatggacatgtcggctggactcggattcgacggccatgctcatgcttgtgatggctcctccagctttaaccatcatgaggtaatcagtgaataa

SEQ ID NO: 91691 - DNA, 1092 bp, Glycine max
  Peptide Sequence Number=SeqID_208469
atggtggatatttgtgttcttgactgttcttacgctcctgaaggtgacaaatataaggtggcaaaacgatggggccacattcatattgtgacaaggaaatggtttgatcaatctattgctcgaaaagcatgtctgaatgaggagttgttcgctgttcagcatggatctgtatcttcgcataaagtaactagggacttaacaatgcaacatagccaagaaaaggatttcgggaaattgcactctgcggcatcctcaggtgctacagattcaaatgtgcaagttttttcttgtgctgagtttatggatagagatctcgaagctacacagtcagaacacatgtcttcagtttcaaatgttcctttatttgctaaggaggcagattctgaacctcttccattgcagacctgcagtgaattgaactttgatggtgctgttgctaatgattctgaatctgatgataatgacctgtacttgtcagagtgcagaatattactagttggttttgaagcatgtgaaatgcggaaactagttaatatggtgcgtaaaggtggtggctcccggtatatgtcttttaatgacaaattgacacacatagtaattgggaatcctactgaaatggaaaagaaggatgtgaggagtcttgctgctttaggtgtaatttatgttgttaaaactgcatggcttgaagattgtgaccgtgaaaagaaacaagtccctgttcttaggagacacattgcatatgatctactttatccaaaagcaaaaggagcagtaacaggcagtatgtctatggatcacgctaaaatctccagctttcatcaaagattgcatcaggtggactttgaaattgtaaagccagaatctttggagaaaagaaaagaagagaaaaaagatatgggtataaatggtcactctttcagtgaagcaataggcagaacgatgctgcaaaatcaacttcctgataataaattgagctcacaaaggatgacccaacataactccagtgttcaatacacgaagtcagcaaatgtttttagagggaaactattttgtttctcaaatttatatcctgaagaaaaggcaagtcattag

SEQ ID NO: 91692 - DNA, 435 bp, Glycine max
  Peptide Sequence Number=SeqID_208470
atgttgaagacgaagccattccaaggcgcgaacgtgttcatgtcgcgaaacctcgtgccgccggaagtcttcgacaagctacacgacgcggtcaaagataacggcgcccaaatccacctctgctgcgacccttcccgaaacggccccaacgattaccacattatttcttccagcaaacacgaaaagttcgatgacctcaaatccaagggctgtaaattgctcggtcctatatgtgttctttcatgtgccaaaggaggaaggcctcttcctaaacaaggctttacttgttgccttgccatggacggagtcaaagtacttgcatctggctttgacacggatgagaaggtctactcaattggatatcagcagcaggttgtgatcatattcaaggtagtcaaactcgagagtctatgtagactcgtggagcttccgtaa

SEQ ID NO: 91693 - DNA, 960 bp, Glycine max
  Peptide Sequence Number=SeqID_208471
atgaagaacttatgtgagaaagactctggtcctacccatttaacatattatgctcttggacgcacatcatggggaacttcctctgaatctgatgtgcaacaatcatccatgtccaaaagtttgagcttgaaaataagtgttcttccgcaacaatgccataagaccaagctgttgaattttcagtatcaagatcgagattcatcttcaactcaatcatccggccagtcttatccagaagttggttcagcacaatcaggtcaaatttcagtgcagtgtagcaattgttctgcttgttcaacacttaacacaactgggggaaagagtgtggaaggtgtcatcagctcaactgtggggattcaggattataccttccctctttcacaactgtgttacaaccaatcacttgctcatactgcattccactttgccgagccgtgctttattggcctagtagctgctccatatgcgccacagcctaatattaatgatgctcagctagtaggaatgagtcctgctcgaattcctctgccacctgatcttattgaggggcctatgtatgtgaatgcaaagcagtaccatgctattctgagacgcaggcagtatcgtgcaaaacttgaagcacagaacaaactcatcaaagaacggaaaccatatcttcacgagtcccgccatctacatgcactgaagagagctagaggttccggtggacgctttttgaatgccaaaaagctcacttcagcgaaccatggtgattctataacaacatgttctgatgtcttccagcaacatgagtcagactttaggttatgtggttacccttctcgtattggaagaagcgtgcagggttactcggtggaaatcaacatcatctatcagtccttatgtgacaaacttttttggcacactagcaagtgttccatagggaagtcatccttggctcatttacattattatgtctga

SEQ ID NO: 91694 - DNA, 813 bp, Glycine max
  Peptide Sequence Number=SeqID_208472
atggtgtttttgttcaaggctggatccttgctggatgttgacagtcacattctttattctccacttccctgccgtgttcccttgcctgggtttgaaagcttccggttttgcttttcacagtatgacgagaaagacagaaatctcctaagaaacttgtgctttcatcttggagctaaatatggggagaagttgactaagaaggttacccatttgttgtgtaaattcaccaatgggcccaagtatgaggctgcttgtaaatgggggattcaatcggttacatctgaatggatatttgaatgtgtcaaacagaatggagttgtggccattgatcagtttttaccaaaagaagtcactgctcaagaccgagatgcaggaatttgcactgtgagtcaatttcctacccaggctgttcaaatgataagtgacttgccctcccagttgtctagtcaatcacaaactttgagaggcacgacaaataaaaatgtcagttgtggagttgataatcatgagaccagttttaggataccaagtaattatagcaaaaaggcaaggcttgtggaggaaccttgcctatccaataagaagccttcagcttcaaattcaggtattcatgctgatgacaagaatttttccaaagacaatatgcttatagatgccggggaggcttttcatgctgttccagatgttgctgctgcaattgaggacttgttagagcagactagtaagaatagatttacccatctgatcgctcagtccttagtgaagataattccaatcctcatactgtctttggattatctaaacactggttaa

SEQ ID NO: 91695 - DNA, 2445 bp, Glycine max
  Peptide Sequence Number=SeqID_208473
atggcttctaagatcttctatctattatctctcctcttgctagcacaccttcttcagccacacgtatttgttaaaggagatggcagtttgatagagaaaacctgcaagaacaccaagtactacaatctgtgtttctcctccctgaaatccaatccaagcagcgcaaacgcggacccaaagggcttggctgtgatcatggttgggattggaatggccaatgccacttccacttctctctatttgtcttctaagatgcttggcactgccaacaacaacgattccaccttcaaaagggtgctgaaggagtgtgcagaaaagtacaagtatgccagtgatgccctccaagcttctgctcaggatttggttaatgaggcatatgactatgcttccatgcacatcattgcagcctatgattactccaatgtttgtcacaacttgttcaaactctactcgggtttggtttatccttctgagcttgctcctagagaggatggtaatcacttagcaaaaggggggcgcgaaaatccatttctcagtgtctatgtggcttcttcttctttcttctacactccaaacctaaaaactccgatacggaaaacaatgaagggtggcacggttcagattagctggcacgacggcaaacccgtcttaaccctcgatttccaccctcactccgccactctcgccaccgccggcgccgatttcgacatcaagttttggcaaataaaaccagcggggtcaccgaagaagcttcccgtggtttcctatcttagtaacctctcttaccatagctctgcagttaatgttattcgcttctcttcttccggggaattgctagcctctggtgctgatggaggggacttgataatttggaagctgcattctactgatgctggccagacatggaaggttctcaagatgttacgatctcaccacaaggacattttggacctgcagtggtctactgatgccacgtatatcatttctggatcagttgataattgttgcattatatgggatgttaacaaaggaactaaccttcagacgttggatacccatgcacactatgttcagggggttgcatgggaccctctagggaaatatgttacttctcttagttctgataggacttgccgaatttacatgaataagcctcataaatcaaagggcattgagaaaatcaattatgtttgtcagcaagtcatttccaaggcagatcagccattatttaagaattctaaggagacaaaatttcatctcttccatgatgagacgttgccatctttcttcaggagattagcatggtctcctgatggttcatttctacttgtgcccgcaggctcttacaaaattagtactgcatctgaatctgtgaatgcggcttacatattttctagaaaagatctttctaggcctgctatacaacttccctgtgcaagcaaagctgttgtagctgtccgattctgccccatattttttaaacttcggggaacaaattcagctattaaccttcgcatagcgaagagcctctgggcaatgggatgcataatgctcattttgcttactgcagctgggttatttaaattcccatatcgcatcatatttgctgttgccactttgaattcattgtacatttatgacactgagagcacctctccgatagctgtattagctggccttcactatgccgcaataacagatattacctggtcatctgatgctcattatttggcattgtcctcacaagatggtttctgctctttggtggaatttgaaaatgacgaacttggatcaccttactctttatcagaaggaaaagtctcaaacaaggatggtaggagcactgtacagacaaccaatgacactgtaactgtaccaactgggaatgttagtgcagttctagcagagagcaagaaaatggaatcagaagacacggctgatgacgtggtcattgaagcctctggcaatattggtgctgttgtaacagaaagtgggaaaactgtaacacaagagaaggctggcatgatccagtcaactgggaatttagcagattttaggaaaaatgaagcagcagggaaagctgtttacatggtcattgaggcaacaggggatgttggaggggttatagcagatagtaggaaaaatgaagcagaagagaaaactgatgacatggtcattgaaacaactggaagtattgatgcagctgaattagatagaagaaaagctgagccagaagataaggcagagaaacagccagctaatctagattcagatggtaaacaagcggaagcaaaggagaagacaaagactctgcaatcaagtttagacggtataaaatcaggggcagaagaaaaggcagggccacaattgttcaatccgaagagtacacccatatcaaataagccagccaagaagcgtattactcctactgccattgatccatga

SEQ ID NO: 91696 - DNA, 1353 bp, Glycine max
  Peptide Sequence Number=SeqID_208474
atgagtgctctgaataggactattatttccttcaacaaaacttcatccttcaatcatcgaaggactctcggcattgtaagtcccagagtgattcataacaaccgcttcggatgtgtctctctgaggcttcaggttcttgtcatctttgtctctgtggtttccttctttttagccataggtggctacatgtacgtgcttccaagccttagccacgcgtttttcaatggccaagttcccttgttattatctgaacataacagcaacggatcagtgagagaatgtgatgtatttgatggaagctgggtgcaggttaaaaaagatcacaccttgtacaatgccacagagtgtccttttgtggaacgaggattcgattgtttagggaatgggaggagtgacagggattatcttggttggaggtggaagccaaggagttgtgagattccaaggtttgatgtgcgtggtgtgttggaaatgttgagaagcaaaagggttgtttttgttggtgattcaatgagtaggacgcagtgggagtctctgatttgtatgctgatggctggtgttgaagataagaggggtgtttatgaagtgaaccagaatcagataacaaagcggatcaggttcttaggggttcggttcagtgccttcaatttcaccattgagttttttcgctcggttttccttgtgcagcagggtcgagtgcctagacatgcaccaaagagggtcaaatcgacgcttttgttggacaagttggatgatataagtgaccagtgggttaattcagatattctgattttcaatactggacattggtgggtgccatctaagctttttgatatgggctgctatttccaggttggaagctctctgaaacttgggatgacaattccaactgcctttagaatagcacttgaaacttggtcatcatgggttgacagagagattaataaaaatagaacacgtatcttctttagaacttttgagccttcccactggagccttcatgattgctgcagtgatcttacccgttggatttgcaatgtgacccagtacccaacattagaaactaatggaagggaccaaagcttgttttcagatacaattttacaagttgtaaagaatgttactattcctataaatgttcttcatgttacttctatgtctgctttccggagtgatgcacatgttggtaactggagtgacaacccatctattcaagattgtagccactggtgtcttcctggggtacctgatatgtggaatgaaattatcctgtcccaactttttactgaatttgaaatcccttctcagcaaattgaatcactcagtaagttcagttatcttctagtagactaa

SEQ ID NO: 91697 - DNA, 786 bp, Glycine max
  Peptide Sequence Number=SeqID_208475
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcaaatgattgtaaactcaccgatattaatgcgtccaccattgagaccacgcatagcaatgccaaaaccttgtccttcttttccaacaagattggcggcaggaattgcacaatcctcgaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 91698 - DNA, 954 bp, Glycine max
  Peptide Sequence Number=SeqID_208476
atggtgtggatcttgtttctttctttttctttttttttttggtttctgaaatccatgaacaacggcaactctgcagtggataaaactacttgtgctgatagtattggtaaaatattaccaaatcactcagagttatctcagtcaagttctggtgtggatttatgtcgctctggttctaaagatcatgctaagcagttatcatctgaactccctgccctgagttgctcattttcagatggagaaagcaggattcagctgaactcagttaataacctacatggagtcaatgataatactgtggaagaaaattggatacaagctgaggatgttcaacttttaaaatctgaggatttacagtcatcacttaagttgaagaaagatggctctgatgaagggggtttatctactaatgtggccttgtgtgccccttctactcgtattttatcaaagactcctaaagaaactgggtcagttggggaatcaaagtctgtaatttcacgtggaagactaggtagatcattgggttctgattatgtggcagcaacctctggtcctggtctatcaccaagttcttcagttggttcactgtcttcggaaaaatcaactctgaatcccaatgccaaggagttcaggctcaaccctaatgcaaagagttttattccgtctcaatcacatgctaggccccgctcccccatgtctgatggttccttctatttcccagctactgtatccaccataccaaatatgccagccatgtccatgggtattggagttgggactacttttgcagggccacaaccagtcgtatataatccacaagcggcacaaatgccatcccaaccatattttcatccaaatggaccacagtatggacaacttcttggtcatcctaggcaagttttatacatgccaagttacctccctgagatgccatataagggacgggatcattga

SEQ ID NO: 91699 - DNA, 1101 bp, Glycine max
  Peptide Sequence Number=SeqID_208477
atgtcacgggaatctactcagatacacgagcaattgctcagcttcttcatcggtacaaagcctttgcatgctttgatttcgcagcaagacagtggtccatatgtggagattgacgtgaggtcaggggagagtgatgggtatgatgcagtgttcctgagtccacataagtttcttggtggtcctgactctcctggtgtgctcctcatgaacaaggccctgtacctgctaggatcttcaccaccgtccacttgtggaggtggaaccgtgacttatgtcaatgccttcaatgaacaggatacattatacttggagaacatagaggaaagggaaactggggggacgcctccaataatccagacagtgagagcagcattggcattttgggtgaaggaatatataagctatgaagatattgaaaaacgggaacaactgtacattaacaaggcactcgagagacttggttcaaaccccaacattgaggttctaggaaacttaaaggccaagagacaagctatattgtcatttctgatatactctaccaccaccaattcttgctcagctggtgagtggagtgatggtaacaaagaaaatgaaggggagcttgatttgtgggcagaaacggggaaccaaagaggtaaaccacttcatggtccttttgttgcagcattgctcaatgacctctttggaattcaagctcgaggagggtgtgcttgtgctggaccttatggacacgaattgctccacatcaacaagtctcattcacttgccattagatcagcagttcaagagggctatattggagtaaagccagggtggactcgagtaagttttccatactacatgagtgaagaggattttgagtacattctgaaagccatagagtttatagctgtgtatggccaacgattcattcctctatatagtttcaatttgataaatggcagctggagattgaagacacagaaatttgaggcacaaaccaaggaaggcactgacaaatttgaggtggctaaatgtgttgctagtagcctccgcaaattcccttctcagggtatactccaggaggaagtggatcccaatatcttctgctttagaatttaa

SEQ ID NO: 91700 - DNA, 744 bp, Glycine max
  Peptide Sequence Number=SeqID_208478
ttcttttgctgccttgaaagattttggggatgttggttctgttgcttatgaagatggggcagcagaatttgatgttgcagataggaagaggagaatgagggctgaacagcaagtcttgggaaggctgtgggtgaggatgaatttgcaacaaattgggcagcctaaatcatctaatggatatggtcatcagaaatctgaaaaagaaggggcaactaagtctgataataagctcccatctgtaaagtcaaattctagcagcagattagcaggagtagtgactggcaataaaggtggtggttatgggagtccttcacatgatcgattagtatatttaacaacatgccttattgggcagcatgtggaagtccagaatttgacattttttactgcttatgtcatcattactgttctcttaggaatcattttgaaaatggctcgcttgacaaaggctgcctctttgcaaggacagggatctggtgtagaatttgtcagcgaagctccttctaagactttaattatacctgccaacgaccttgcacaagttatagcaaaggatgttgctgtttccagagatggcctacctagtgaatctcactatgatatgcatcacgaaatcatggttgattcagtaatatctcaatcctgtcatgttgagacagggagagaattacagcgatgggtacctgatgaagatgatcaacaatgccctgaactggaaaatatctttgatggcccttggaatag

SEQ ID NO: 91701 - DNA, 1575 bp, Glycine max
  Peptide Sequence Number=SeqID_208479
atgtacatggctgcatatgattggagaatagcatttcagaacactgaggtgagggatcaaacactaagtcggataaaaagcaacatagaacttatggttgctactaatggtggaaataaggcagttattattccacattcaatgggggtcttgtacttcctacattttatgaaatgggttgaagcaccagctccaatgggtggtgggggaggaccagattggtgctccaaatatataaaggcagttgtaaacattggtggaccatttttaggtgttcccaaggctatagcagggctattctcagctgaggccagggatattgctgttgccagattttgcgaagtaaatagtcttgttcaacattttctgcttcacttaactatttatttgcatgagagaaagcaaattcagattgcatctggcactaatgctatagcaatatttttctttgttcggctcactgttcaatatcttagactcaaactaaatttggttctttcgtgtcatatatccaggacgatagctccaggatttttagataacgatctgtttcgcattcaaaccttgcaacatgtaatgaagatgacccgtacttgggactcaacaatgtcaatgataccaagaggaggagatactatatggggtggtcttgattggtcaccagaagaaggctatcaccctagccagaggaagcatagcagtgactatactcagttaacagaccaagagacaaatcaaacaaatgttgtcaactatggaagaatgatatcatttggcagagatgtggccgaggcacactcctctaagattgagatggctgactttcggggtgccatcaagggtcgcagtgttgcaaataccacctgtcgtgatgtgtggactgaataccatgaaatgggatttgagggagtgagagcagttgctgaacataaagtttacacagctggctctatcgtagaactccttcaatttgttgctccaaagatgatggctcgtggtagtgctcatttctcttatgaaattgctgacaatttggatgaccctaaatataatcactacaagtattggtcaaaccctttggaaacaaaactaccaaatgctcctgatatggaaatcttctctatgtatggagttggcttaccaactgaaagatcttatatttacaagttaactccctttgccgagtgttacattccttttgaaattgacaccacgcaagatggtggaagtgatgaagatagttgtctgcaaggtggagtctacactgttgatggggatgagactgtgccagttctaagttcaggcttcatgtgtgctaaaggctggcgcggaaaaacaagattcaacccgtctggtatgcgcacctacgttagagaatatgatcattctcctccagccaaccttctagagggaaggggcacacaaagtggtgctcatgttgacatcatgggaaactttgcattgattgaggatgttataagagtggctgctggagccaaaggagaagatctaggaggtgataaagtgtattctgatatcttcaagtggtctgagaaaatcaagttacccctatga

SEQ ID NO: 91702 - DNA, 951 bp, Glycine max
  Peptide Sequence Number=SeqID_208480
atggttaaaactgttggagttcggttccaccctactggtgttgagttagttgtgtactttctgaagaggaaagtgatgggaaaaaaaatctgcgatggtttcattgctgaacttgacatatacaagtatgctccttgggatctcccagaatctatgaatgccataccaacaaggtccaccatagttggtagatggctgggttccttaagcatgttgacaggagttcgattccctggccgtgtgtatagagaagactttgttgggagaggcaaaacccactttcgtgatctctacacttcgagggttagtcccatggcttctggctataagtcttgtctgagaactggggaattggaatggtacttcttctgcccgctagagaagaaatatggcagtgggagcaagatgaagcgtgctactgaaattgggtattggaaagctactgggaaggatagagttgttcagcacaataatcgaactgtggggatgataaagacactgatatttcacacgggtaaatcgcctcgtggcgaaagaactgattgggttatgcatgagcataggcttgaagataaggacctcgctgacaaagggattgctcaggattcctatgtagtctgcaaggtattccaaaaggaaggtcttggtcccgggaagggaacacactatgcgagaccatttaatgaggaagagtgggacgatgaagaaattggaataccttgtgctgctttgactgcacaagttcccaccttgcctattacatctgatggttctgttgcaaatgacaatcatctccctgctagtggatgtattgggtcagcatccacatcatgtctatcaggatcagtgccttctctgggcacagtaaatcctactggtccaaatgatcaagctgttaatgatgatattttaccaatgcttcatatttttaatgatgacaaatggtttgag

SEQ ID NO: 91703 - DNA, 171 bp, Glycine max
  Peptide Sequence Number=SeqID_208481
atggacaaaagtgtggcagacacacaagcagctttagaattcagatctaagaggaaaaggagagatggaacaggtgcacgagtggccatggttgccgggtgccagcacgtggagaaactctacctattgccactgtactttggcacacattataaagtaagatcactatga

SEQ ID NO: 91704 - DNA, 249 bp, Glycine max
  Peptide Sequence Number=SeqID_208482
atggttggaattggacttagcgcacctctgggcgctcaacgcaatttcctctcgattggaattgcgcttagcgcgtcattcacgcttagcgagagaccaaaagttgttattttcaaaatcccagtggtcaaactgtggaaacatgtcttaagaagctccagacaaaatttgaagatgatccaacgattaacaaattcgggattgcaattttactggactaggtttagacaaaaatctaaaatctcataa

SEQ ID NO: 91705 - DNA, 276 bp, Glycine max
  Peptide Sequence Number=SeqID_208483
atggaggcatccattatgttacctcttgaaaggacttcgtcaattgaaagagagcccaggactcttaatatcaaccaaattcaatccgctagggagttagcaatatatatattgaacacaaagaccatagaagaagcgtccagaattttcacggaggggttgcagccggtggttagtgctgctccaaagatgggtttgggtgaagaagttgaagtgttggactccaaagtagcctccgtagcagcattcagggacatagcatctgcacctttctag

SEQ ID NO: 91706 - DNA, 456 bp, Glycine max
  Peptide Sequence Number=SeqID_208484
atgacaaaagcagaaaactcagtagaaaagaatgagaacgtggctgtggcggttgaccgtaatgtgatgattctgactccgacaacggccacgatgcaatccttgatttcaccgttagggtttccactggcaaccggaagcgcaggagcgactctgccggttcccaacgtgaggactttctcactctacaacctcgaggacttgccccggccctcgcagatggaccagttgtgtgacaagtggaggccttaccggtccgttgcttcgtggtacatgtggagatttgttgaagccaagggaactccttcgagtgcggtggcggtagccaccgatgctggcttgcagcagcagcagcaccatcaccagcaccaacaacaagagcaacaacagctgcagcaacatcctccacagccacagcttttggatcccatcaatagcatgtttaatctcggctaa

SEQ ID NO: 91707 - DNA, 249 bp, Glycine max
  Peptide Sequence Number=SeqID_208485
atggcggcacgcaacaacaacgtggcgaccctagaaggtgggggtgcaggtggcagaatggattgggtgggtgatgatacacatggcactcgaagatggcatcgtacaaatagacaaaacgatgcatgcaaacgtgttttgcccaacccatcagcccataaggggtatgcagattgggctcctaaactaggcatgatgttgactccttacttaatggacttgggagttgttattcataccattttgtga

SEQ ID NO: 91708 - DNA, 1701 bp, Glycine max
  Peptide Sequence Number=SeqID_208486
atggtccctggttccaaaacggagggtggtggcactggtaccactcacttgctctctgcaagagtgcgcaaaaccattcaatccatcaaggaaatcgtggggaaccattctgatgccgatatctatgtcgcccttaaggaagccaacatggatcctaacgaaaccactcagaaattgctcaaccaagatccatttcacgaggtgaagagaaggagagaccggaagaaggagactcagaatgttgggaacaggggtcagccttcagctgactcacgaaggccatctgagaataatagtggtcaaggaatgaaatttcacacccattctgaacgcaatgttcgaagaacaaactattctcgcagtacttttcctggcatcagcagagagtttcgtgttgttagagacaacagagtaaatcatatatataaagaagtaacgcctctttcacagcagcactcaacatctgtcactgagcagttaaatgtaaacatatctgataagggctcatcaatttccaccaatcataggtcatctggctctaggaattcgtctcaagcttcaaatggtccttctgattcacatgctagatacgcgccaaaaaccattgacagaaaaattgtatatgaggataaggataagcaaggcatgatttcaaatgcagcaggacgggtgcaaccaattaagcctaacagcgtccatcaaaattctgccttggtggcatcaaccagttctgctgttggggtgtattcctcttcaacagatccagttcatgtgccctctcctgattctagatcaccaggtgttgttggagccattaggcgtgaagttgggtttgttggtgttcggcgacagtcttcagacaacaaagcaaagcaatcatttgctcctagtagccctcatgttgtgggtaaagatggtacatctgcagattcttttcaatcagttggggctgtctcaaagactgaacaatttagtcaaactaatgtaactgaaccttcattatctggtatgccagttagcagaccgtcgctgaacaaccagcataataataggccacatcaacaacttgtgggacatcaaagagtttctcagcaaaataaagaatggaagcctaaatcaagccagaagccaaactgtaataatagtcctggagtaataggaaccccaaaaaaggctgctgctgctgcttcacctccagcagaaaattctggagatatagaatcaaatactgtagagcttcaagataaactttcccaagtaaatatatatgagaaccaaaatgtgattatagcacagcatattcgagttccagagactgatcgctgtcggcttacatttggtaccattgggactgaacttgattcttcaaggcctcaatctaagtatcacattataggagcttctgaaaaatcaaatgaggaattgactgcaagcttgacagtacctgctccagagttgtccactgatgatgtttctgggagcaaacaggtggacttgcgggatgaacacattagaagtttggggtcagactctccagtatctggtgctacttctgagcaacaattgcctgacaacaaagactcttcaaacactaagaatctggacaattatgccaatattggattagttcgtgatagtagtccatcctatgcaccttcagaacagcagcaacaagattctcatgatatgccaggctttgcg

SEQ ID NO: 91709 - DNA, 1248 bp, Glycine max
  Peptide Sequence Number=SeqID_208487
atgttgacttgcatagcgtgtaccaagcaactcaacaatggatctcttcgccaagaagaagaggaagaagctgtttctgttcacacacccagcaccaagcaagccatcaaggctctaacttctcagatcaaggacatggcagtgaaggcttctggggcatataagagctgcaggccatgttcaggatcttcaaatggtaacaggaataggaagtatgcagactcagatattgggtcagattcagcaaggttcaactgggcctaccgcagaactgggagctccaattcaaccccaaggatgtgggggaaggaagtggaaaatgggggtagggtgaaagggctttcaagtggagaaggaacaccagcatcagtgagtggaagaactgagtcagtggtgttcatggaggaggatgagcctaaggagtggattgcacaagttgagcctggtgtgcttattacttttgtttcattgactcagggagggaatgatctcaagagaatacggttcagtcgtgaaatgtttaataaatggcaagctcagaggtggtgggcagagaattatgacaaggtcatggagttgtacaatgttcagaggttcaatcagcaagcagttcctcttccaaccccacctagatctgaagatgagagctcaaagattgaatctgctagggacagtcctgccactcctccactcagcaaagaacgtgcaccccgacattttcaccatccaacaggaatgggctactcctcatcagattcactggatcgccaccaaatacaaccacacccttgctatgaaacaagtggtctgacatcgacacctaatctttccaacattagtgcaccaaagaccgaaagatcatcccttgatgcttctgtgaggactagttcatctggagaagatcactcgggcgagttttcaatcagcaatgctagtgatatggaaactgaatgggttgaacaggatgaaccaggagtatacatcactatcagagcactgccaggtggaaccagagaactcaggcgtgtccggttcagtggtagtgccttcctattaagctcttttttttttgccgagaaaggtttggagaaatgcatgcgagattgtggtgggaagagaatcgtgctaggatacaagaacaatacttgtgatgactgtgactatagaagagcctttacacagattaactgcttcagcaggctaacacagtacagcttgaaagctttacaacagtgtcgtgcattctag

SEQ ID NO: 91710 - DNA, 3165 bp, Glycine max
  Peptide Sequence Number=SeqID_208488
atggcaactcagtttcgagggagggactctgatctttggaagcgcatatgtgctgatgaatatatgaaatgtgctgtgattgaatgctatgaatcctttaaacatgttctacatgatttagtgataggagaaactgaaaaaagtataatttcctccatcatcaaagaagtcgagagcaacatctcaaagaatacacttcttacaaatttccgtatgggctttctaccctccctttgtaagaagttcgtggagcttgtggaaatcatgaaaaatggagatccatccaagcggggtacagtggtggtcttgctgcaagacatgttagaagtggtcactgatatgatggtgaatgaaatcagcgaattggcagaacttcatcaaagtagtaaggataccggacaacaagtttttgctggtacagaggcaaaacctgctatactattccctcctgtggttacagcacaatgggaggaacagattagacgtctttatctactcttgactgtcaaggaaactgccgttgaagttccaacaaacagtgaagtacgtagaagggtttcattctttaccaattcattgttcatggatatgccacgtgctcctcgagtacgtaaaatgctctcattcagtgtcctaactccatactacagtgaagagacagtatattctaagaatgacattgaggttgagaatgaagatggtgtgtcaatcatgtattaccttcaaaagatcttccctgaggaatggaataacttcttggagcgacttgattgtaagaaagatagtgatatatgggagaaagaggagaatatattacagctacgtcactgggcctcattaaggggacaaacactttgtaggacagttaggggaatgatgtactaccgacgagcaataaagctccaggcatttcttgatatggcttctgaaaaagagatattcgatggttataaagctattgctgttccatctgaggaagaaaaaaagagtcatagatccttatatgcccgtttagaggctatggctgacttgaaattcacatacgttgcgacctgtcagcaatatgggaatcagaagcgctctggggaccgtcgtgcaacagatatcctgaatttgatggttaacaatccctcacttcgtgttgcatatattgatgaagttgaagaaagagaaggtggaaaagtacagaaagtttattattctgtattggtcaaagctgtggacaatcttgaccaagaaatatatcgaataaagcttccgggcccagcaaagttaggagaaggaaagccagaaaaccaaaatcatgccatcatttttactagaggggaagctcttcaggctatcgacatgaaccaggataattatttggaagaagctttgaaaatgcgtaaccttctggaagaatttaatgaggatcatggagtgcgcccccccaccatattaggtgttcgtgagcatattttcactggaagtgtctcttccttggcctggtttatgtcaaaccaagaaactagctttgtcactattggtcaaagagttcttgctagaccactaaaggttcgattccactatggtcatccggatgtttttgatagaattttccattttacccgtggaggaatcagcaaggcttcttgtggcatcaatctgagcgaggatatatttgctggattcaactcaacactaagacgtgggaatgttactcatcatgaatatatccaagttggaaagggtagagatgtagggctcaatcaaatctctctttttgaagcaaaagtggcctgtggtaatggagagcagatactaagcagggacatctacagactggggcatcgatttgactttttccgcatgctatcattttactttacaaccgttggattttatatcagctcaatgttagtggccatcacggtatatgctttcctctatggcagattttacctgtcattgagtggattggaggaggctataattaagatagccaggaaaaagggagatgatccattaaaggcagcaatggcttcccaatcccttgttcaaataggtcttctgatgactcttcccatggttatggaaattggactagagagaggattcagaactgcactaagtgacatcataataatgcagctgcagctagcacccgttttcttcactttctcactagggactaagatgcactattttgggcgcactctcctgcatggaggggcaaagtacagagcaactgggcgtggttttgtagttcgtcacgagaggtttgcagataactacaggatgtattctaggagtcactttgtaaaagggatagagatttctatactgcttatatgttatgggctttatggatcagcagctcctgattcaacagcatatgcccttctctcagtatcaatgtggtttttggcatgttcttggttgttcagtcctttcctttttaacccatcgggattcgagtggcagaagattgttgaggattgggatgattgggcaaaatggataagtagtcgaggtggtattggtgttccttcaattaagagctgggaatcatggtgggatgaggagcaggaacatctgcagtacactgggatttgggggaggatttgggaggtcattcttgccctgcgtttctttgtctatcagtatgggattgtgtatcatctacatgttgctagaggtgacaagagtatcggggtttatggtctgtcctggttagttgtagtggctgtcatagtcatcttgaagatagtgtccatggggagcaagacattcagtgcagatttccagctgatgtttcgtctcctcaaaatgtttctgtttattggaaccattgtcattctaattttgatgtttgtcctacttagtttcacagttggtgacatctttgcgagcctcctagcctttatgcccacaggttgggcatttatacagatagctcaagcatgtaagccattggtgaagggaattggaatgtgggggtctatcaaagcgttatcaagagggtatgaatacgtgatgggagtgattatctttgcaccagtggccataatggcttggttcccttttgtttccgaattccaaactagactgctatacaaccaagctttcagccgagggcttcaaatccagcgcattctggctggtggcaagaagaataaataa

SEQ ID NO: 91711 - DNA, 150 bp, Glycine max
  Peptide Sequence Number=SeqID_208489
atggatttacctttgtgctgcattcctcttcaggcttatccattcttcaaaggtgttgaatggaataagttgtatcaaatggaagcttcatttattcctgagtctgacagccaaactcaatcatcttcaagatctggtccatggaggaag

SEQ ID NO: 91712 - DNA, 372 bp, Glycine max
  Peptide Sequence Number=SeqID_208490
atgcctcagagaattgaagggaaccaatttgcaaagtaccacgaattggttattgaaagctacaaagacttggcattctcagaatatgcaagggtaggaagagcattgaccttatatgaagttggtgacagagaagaagcaattgcagagatggaagacgtttcaatatctctaaaagggtatccagaaatacatgcagctcttgcagcagccttatatgcagataagcatgccgctttgcttgctgaaaaccagtttgccattgcaactcttcttgatccccattttacagacctttcatatgttagagacacaaagcaccggcctccaagtttgatcagttcactgcagcacttcatcacactatcttaa

SEQ ID NO: 91713 - DNA, 702 bp, Glycine max
  Peptide Sequence Number=SeqID_208491
atggattcgagttcggggcatcaagaattcgattatttgtttaagttgttgatgattggagactctggggttggcaagagtagtcttcttctcagtttcacctccgatgcttttgaagatctctcccccactatcggtgttgattttaaggtcaaatatgtgatgatggggggtaaaaagctgaagcttgcaatttgggatactggtattcactttgttgttattcctttcatgataactttgcttatggatactgctgaatggaggtggcccttccaagttagtgtagtggtgaaatttgactttggattagctgctaatgttgttcctctaactaatgcagtttatgatgtaacccggcgagatacatttacaaatctttctgaaatatgggcaaaggaaatagacctttattcaactaatcaagattgcatcaagatgcttgttggaaacaaactagataaggacggtgatagagttgtgacaaagaaagagggaatagactttgccagggaatacggttgcctatttattgaatgcagtgctaaaactcgagttaatgttcagcaatgctttgaagagcttgttttgaagattctggatacacctagcctcatagccgagggctcaaagggtgttaaaaagaacattttcaaggacaggccaccccagtctgatgcatccgcaagtagttgttgctga

SEQ ID NO: 91714 - DNA, 1260 bp, Glycine max
  Peptide Sequence Number=SeqID_208492
atgggcgcgggacgaagttggttccaaaatccaaatattgggttgacgaaatggcggtggagaggaagaagaatgtcgaatccggatcagacagtattgaatcggcggccatcaagaagtgccgcgacgacgacgttttcgctggaggtgttcgacaacgacgtcgtgccctcctcactcgcctccatttctcccattctcagagtcgccaacgaaattgaaaccgagcgccccagggttgcttatctctgtaggttctatgccttcgaaaaagcgcacaggctagatcagagttctagcgggcgtggcgtcaggcagtttaagacgttgttactacagcgattggagagggacaatccaactagtcttgcctctcgggctaagaaaacagatgcgagagaaattcaatcttactatcagcaatattatgaacattatgtcagaactctcgaccaagtgaatcaggcagacagagcccagcttagcaaagcttaccagactgctggggttctattcgaagtgctttgtgccgtcaacaagactgagaaggtcgaagaagttgctcctgagattatcgcggctgctagagatgtccaggagaagacggagatttatacgccttacaatattcttcctctggatgctgctggtgcttctgtgcccattatgcaatttgaagagattaaggctgctgtttctgcgctttggaatactcgtggcttgaactggcctaattcatttgagcaacagaggcagaaaactggagatttagacatgcttgattggcttagagccatgtttggctttcagctcgatgatcgggctgttgattcagtgatgaaaaatctcttcaagaattacaaatcatggtgcaaattcttgggacgaaaacatagtttacgacttcctcaaggtcagcaagagatacagcagaggaagttgctttatatgggcttgtatcttcttatctggggcgaagcatccaatgttcgtttcatgccagagtgtctatgctacatatttcacaatatggcatatgaactccatggtttattggctggaaatgtcagcattgttactggtgaaaatatcaagccttcttatggtggtgatgatgaggcattcctgcgcaaggttataactcccctgtatcaagtaatacaaaaggaagcaaagaagagtggacatggaaaggctccgcactcagcatggtgcaactatgatgatctaaatgagtatttctggtctgtttttctttag

SEQ ID NO: 91715 - DNA, 780 bp, Glycine max
  Peptide Sequence Number=SeqID_208493
atggagcatttgggccaaatagaagagcgtattagatgcctagaagcagtagttttcagggctaggcagcgtcagaggcagcgaccgagtcatgctccaattcaggtaactaactatgcaggagaattgggaacagtagctgatctaccagccgaagaagaaaggttgcatcaagagtttggtggtattgatgttggaggagagatggtgggagatgggagaacgtgtaaaaggaaggctagctatttggttgctaaagcattgggtgtggaaaccagtcagggtgagggttttgcaacaaatttgtttcattgtaatgtatgcttggacagggcaagagatccggttttgacctgttgtggtcacttgttttgctggccatgctttcataagttgtcgtatgcttattcagatgtcagggaatgtccggtttgtaaaggagatgtccctgaagaaggaattgtcccaatatatggcaatttcctgctcgacctcgtccacatagaattgagagtattaggcagcggttcagatattgaggagcttcttctacaatccaggtcatactgtggtttgaaatctcctcctgtgaaattgatagaagaaccggtgttgttaaatggtggcgctatgaccgccatggcggaatggcatggtgggttttttgtcaactgcgataggcaatttgtgatgggaggcccgctatggcagtgctataggctgcaatggtttatatgtcagagttttggccttccaccatattctgccatccaccattga

SEQ ID NO: 91716 - DNA, 1872 bp, Glycine max
  Peptide Sequence Number=SeqID_208494
atgccggcttggtggaatagaaagtggagcaagagcaaggaggagcaggagcagccggaggaggaggatgaggaggaagagccacgtgccgcttttcagctgaatttcatgagcggtgagcgggacaagaacaagggtaggagttgtagtaagaagaagaccaagagcttcgacgacaaggtcaaaggggttccgttaccacttccctcgcatagtctcagcgatccaattcaatcatttggatctgtttcggtgtccggtggttccagcatcagctcctccacctcctatgacgatcatccaatttcgcctcccaacaccaacaggaaattgcagacaaatgcggctgatgtggtcgcagcaaagagacctaataccttgacctcggtgcttttccaatctggtgctaaactaatccatggtatttgtttaacatgcagaggacgagaggaggtgaggttcaatgtgaggtcaaaaagtccgggtcctgggtcaagaggacctaccagtcctacctcaccgcttcatcaaaggttgcatgctttgagccttgactctcccacggggagtgagtgtcatccattacctcttccacctggctctccaactagtccttcttctgtgctttccaacgctagagcaaatggacatttggaaaatgctaccagcaatgtgtccaaatggagaaaaggaaagcttctaggacggggaacatttgggcataacatgtattcgcctcaatgtctatattctggacagattactgaaaccatttctattctgcttcctatgtctgacagtgaaaatggacaaatgtgtgcaataaaagaagtcaaggttgtctttgatgatcacacatcgaaagagtgcctcaaacaacttaaccaggagataaatttgctaaatcagctttcacacccaaatattgttcaatactatgggagtgaactggtagaagaatcactttctgtatatttggaatatgtctctggtggttctatccataaattacttcaggagtatggtccatttaaggagcctgttattcaaaattataccaggcagattgtctctggacttgcttatctgcatggaagaaatacagtacacagggatattaaaggggcgaacatactagttgatcctaatggtgaaatcaaactggcagactttggaatggctaaacatataaattcttctgcctcgatgctttcattcaaaggaagtccatactggatggcacctgaggttgtaatgaatacaaatggctatagtcttccagttgatatatggagcttggggtgcacaattattgaaatggcaacatcaaaacctccctggaatcagtatgaaggggtagctgccatatttaaaattgggaacagcaaagatatgcctgaaatccccgagcatctttcgaatgatgcaaaaaaattcatcaagctatgcttacaaagagacccattagctcgcccgacagcccaaaagttactagaccaccccttcattcgagatcaatcagcaacaaaagctgcaaatgtcagcataaccagagatgctttcccttgcatgtttgatggaagccggacaccgcctgtgttagagtcccattccaaccgaacaagcataacttctcttgatggagattatgcatcaaagccagctcttgcagcaccacgtgcattaaggagttcaagagataacacaagaatcatcacatctttaccagtatctccctcttcaagtccattgcgaagatcctcatatccaatgacatcaaatgccacgtttgctcttgatccttggcatgaaacatctcgatacagagccaatacaccacctggtggatctccaagaatgagactaatttaa

SEQ ID NO: 91717 - DNA, 201 bp, Glycine max
  Peptide Sequence Number=SeqID_208495
atgagaggcaagccacttataaatgcaagaggtgtggaagatgtgcctgcaagtgtgaagcttccatacactgtcctcttcttcaaaacttgtcaagcagataacacattcagtctgccgtgtcatgatatggttggcgataactatgagcacaacaacaaccatttcggtctcaacaatgctggaggctggagcatataa

SEQ ID NO: 91718 - DNA, 207 bp, Glycine max
  Peptide Sequence Number=SeqID_208496
atgaagaagattaaggattcaaggaaacataaaagttacccaaagtcatcaaaagtcatatctagaaagcaacggagactggttaagtttgacaatgtcaaacccatgactaggaagatgccacgacatacctgtaatgtccaaactgagttcagaaactcatatttggcaatagctatgtcacatattgatcttggagaaaattga

SEQ ID NO: 91719 - DNA, 459 bp, Glycine max
  Peptide Sequence Number=SeqID_208497
atggtcaagggtagtgagcttgaccaagggtgctacaatagtggcatatcccttgataaagtggcggccaatgctggatcacgaccaccttggcatccactgactgcaccccttgatgcgacaccacatgcccaaggtattccacctgaggtgttcttcgaaggtgccactatagatcaaaatatcatcgaagaagacgatgataaaacgacgaaggggcgctgcgagtctaaaaggcattactccaaactcatagtggccatgatgagttcgaaaggccgtcttcggaatgtcgtcagaatgcattctgatttggtggtagccttggagcaagtccagcttcgagaattaacgggctccaccgagctcatccaagagctcgtctatagtttggatgggaaacctgtcgcggacggtgagggcattgaaggccctatagttaacgcaaaaccttcatga

SEQ ID NO: 91720 - DNA, 1431 bp, Glycine max
  Peptide Sequence Number=SeqID_208498
atggctgacacttcacatccttccaacaattctgatgacctcaaggaagccatcctctgtctcacccaccaccaacagtccctcgacgaaactatgcaaacaatgaccctccgtattgatgacctcctcagccgtcttccccccttccttccacctcatcaaccttttgcttccctaccaccaccaacacccccacaacctgcatcaaaccacagaatcaaattagaggtgcctcgttttgatggatctgaccctctaggttggatttttaaaattaatcagttctttgagtaccacggtactcctaaacctgagcatttgacggtggcctcattttacatggatggcagggcgttggcctggtttcaatggatgaccggcaacggtcaattcacgttgtggccggtcttcctccaggcacttcagacccgttttgcccacacccagtacgaggaccctaccgaagcgctgttgaagttgacacagagagggacagttgcacaatacctttttgagttcgaggacctcgccaataggattattggcctccctgcgccgtttctcctcagctgcttcatatcggggctgacgccagaaattcgtcacgaagtccaagcccaccagcctttaaccttggttcaagctgcgggcctagctcgacttcaagaggagaagatcctcgatactcgatcgacaccacggagtcgagcaccacctcagccgctatcaccttttcctccacctcctcgcgcgcctccaccacctccacacacctctcttcctccacctcctggtcgcccaatgccacccaccgtcaaacgcttgccgcaagaggagatagcctcgcgcagggagcgcgggctttggttcaactgtgacgataagttccatagagggcatcgctgcgcctctagggcttttcttctcatcactaaggacgacaacccctctctgcctcatatagaagcatatgacccgctccctgaaccgctcgacccaatggacccgtacccgacccaaatcagttttaattgcttagcgggccatgtggctccagagacgctaaggttcttgggccttgttggcggtcaggcggtggtgctcctggtggacgaaggaagcacctataacttcatccaacaacacctggtaacccgccttggtctttctccttgccccactactccgttgagggtgatggttggaaacggacaacagctggagtgcacgtgcgtctatgaagcaattttagtggaaattcaggagaccaaattcattgttgacttgcatgtcttaccgatatcaggcgccaacgctgtccttggcgtgcagtggctcaaggcgcttggccctgtcctcacggactacaattccttaactatgaagttctttcatgatggccgctttgtggagctgaagggcgatacatag

SEQ ID NO: 91721 - DNA, 1465 bp, Glycine max
  Peptide Sequence Number=SeqID_208499
caaaaacatcctgaaatagagtactatgagctatcaaagaaagttgtcgattatgccaaaggcattccgtttgttcttaaacttttgggtcaccgtcttcatggaaaagagaaagagatatgggaaagccaattagaaggacaaaatgtgcaaaccaaaaaggatgaaaagaagatacttatggatattgcatgttttttctatgggctgcgtctagaagttaagaggataaaacttttattgaaagatcatgattattcagtggcttcgggattagaaagattgaaggataaagctcttatcagtatttctaaagaaaatatggtatcaatgcatgacattataaaagaaactgcttggcagattgctccccaggaatctattgaagaccctagaagccaaattcgactatttgatcctgatgatgtctatcaagtactaaaatacaacaagggtaacgaggctatcagaagcatagtcgtcaacttgttgagaatgaagcaattgcgattaaaccctcaagtatttactaagatgaacaagctccattttctaaatttttatagtgtatggtccagcagtactttcctccaggatccatggggcttgtatctttctcaagggcttgaatctttgccaaatgaactaagatatcttaggtggacgcattaccccttggaatctttgccttcaaagttttctgcagaaaatcttgttgagttgcacttgccatatagccgtgtgaaaaaactttggctaaaagtaccggatcttgtgaatttaaaggtccttaaactgcattcatcagcacatgtaaaggagctgccagacttatcaacggccacaaatcttgaaataataggtctccgattctgtgtagggttgactagagtgcatccatcagttttctctctcaaaaagcttgagaaattggatttaggtggatgcacttcccttacaagccttcgaagcaatatccatatgcaatcccttcgctatctctcccttcatggctgcttagaactaaaggatttctctgtgatctcaaagaatctggtaaagttgaatttagaactaactagtatcaaacaattgcctttatctattggatctcaaagcatgcttaagatgctacgtctagcatacacttatatcgagaccttgccaacaagcatcaagcatcttacaaggctgcgacatctagatcttcgatattgcgcggggcttcggactctaccagagcttcccccatcacttgaaacactagatgtccgcgaatgcgtgtcattggagactgtaatgttcccttctattcctcaacaaaggaaggaaaataagaaaaaagtttgcttctggaactgcttgcaattggatgaatattctctcatggccattgagatgaatgcgcaaattaacatggtgaaatttgcacaccaacatttatctacatttcgtgatgctcaag

SEQ ID NO: 91722 - DNA, 1770 bp, Glycine max
  Peptide Sequence Number=SeqID_208500
atgggttcaacccggatgggccaagtccagattctcaaccaactctctactttttcccccttggatcatcgccacatagttttgggggctttgccttcatgtgtgaatatcctggtcaaagaagaggagaaacatcgcatatcatgtggatcacctgttcattctcatgaaaatatagatagccagtgttcagctgataaatttcctgtcatggatgggaaggttcaatctgaaactccctgccaggaaattccttctatagcatcaagttttaattatactcatagtaatcaatctgggagtattgatcagtgttccagaccttcagaaggagtaatagagagcggatcatctgcttctgctgtctattccaatttaaagtctgatatttcaatgtcagatggagaaatatgcttggacaagctatcaatcagagaactgcatgaactgtttaaggtaacgtttggtcgggaaactactgtgaaagacaaacagtggctgaaaaggaggattgccatgagtttaaccaactcatgtgatgtttcagctacaactttcattattaaagataacaaaatagttagaaaatttgaagaagacagttctggaaatatgaatgctggatctttaatctcttcggaaaatatgactgaagaagatgtcaactttaaggattcatctgctgtagatgcttgtggaattgatgataaccaagttgtttctgaaacaagatcagaaaatggattggaatatgagaattatcagacaggacaaagagctgcaaaaagaattcggagacctacgaagagatatattgaagagctctctgaaaatgaatctagagagcacaatccgaggttgtcaatttctaataaaaccgtgggatttggacatgtttctccaacttcgaatgtcaggcctgctagaaatgctttttcagaggcgagaacatatagcaccaggttagactctcttggaggttctaatgtccaaattccttgtgtgtctcgggttcggagaagtcgtccaagaaaagatatcgcgtctcttatgcatctgggaaatgtccctttggtgcttcatgtctttccagtggtgcctttctactcctgctgtgtctttccagaaaaattccatccaactggaatgggtgaggctgaaaaactgagtaataagctccttgagcatagttctgatgctggtagtgacttttcagacaaagttttgaagtcaagaatgcctgcaaagtttcatcaaccatcctcttctgaacctgtgaaagagcagtgtccagtaatatgcccgattgagctacggcaggaattgaggccaaaaagggcagatccatctggccatacttcagatgacaataatatagttactgttcccactgcaaaaggagggatgaggaggaagcatcatcgtgcatggactcttgttgaggtgattaaattggtggaaggtgtgtcacggtgtggagcagggaggtggtctgaaatcaaacggctctcctttgcatcatactcatatcgtacctctgttgatcttaaggacaagtggaggaatttgctcaaagctagctttgcactggcacctgcagatgaggggataaattcgcggaagcatggtacggctcccattcccgagaaaattttgcttcgtgtaagagagcttgctgagatgaattctcaagtgcctccaaattatagctcaagccagttagcttctggtggagggagtgtgcatggagatagatcagggtacttgtaa

SEQ ID NO: 91723 - DNA, 1341 bp, Glycine max
  Peptide Sequence Number=SeqID_208501
atgggtatcattgaaaagatcaaagaaattgaagccgagatggctcggacccagaaaaacaaagccacagagtatcatctcgggcagctcaaggcaaaaatagcaaaactgaggacacaattattggagcctccaaaattaaggcttggttttggtccacaatcacagcctaatgtgggttgcatcaaccactgcacccaagatgttttggctcttcacatgattcagttcacaattcaagactacgagaatgatttcatacattttagtagtagtccaggttctagtggaggtggagaaggatttgaagttacaaaatttggtcatggacgtgttgcactgattggatttccaagtgtggggaagtctactcttttgacaatgttaacgggcacacattctgaagctgcatcttatgagtttacaactttgacctgtattcctgggattatacactataatgatactaaaattcagttacttgatcttcctggaattattgaaggtgcttctgaaggcaagggacgtggaagacaggttattgctgttgctaaatcttctgacatagtattgatggttcttgatgcttccaaaagtgagggtcataggcaaatattgaccaaagagctggaagctgtgggtttgcggttaaacaagagaccacctcagatatattttaaaaagaaaaagacagggggcatttcattcaacagcactttgcctttgactcatgtggatgagaagctttgttatcagattctgcacgagtacaaaattcacaatgcagagatccttttccgtgaggatgccacagtggatgatctcatagatgtcattgaaggaaaccggaaatacatgaagtgtgtatatgtctacaacaagatagatgttattggtattgatgatgtggacagattagcccgccaaccaaattctgttgtcattagctgcaatttgaagctgaacttagacagactgcttgcaaggatgtgggatgaaatgggtctggttagagtttacacaaaaccacaaggccagcagcccgattttggcgatcctgtggttctttctgctgatagaggtggctgtactgtagaagacttctgcaaccatatacacagaagtttggtgaaggatgtgaagtatgttctggtctggggtattagtgcaaggcactacccacaacattgtggtcttagtcataatcttcgtgacgaagatgtggttcagattgttaagaaaaaggaaaaggaagagggaggaaggggacgatttaaatcacattccaatgctcctgctaggatatctgacagagagaagaaggcaccactgaagacataa

SEQ ID NO: 91724 - DNA, 297 bp, Glycine max
  Peptide Sequence Number=SeqID_208502
atgaaaagccaacacttgaaaaaccatgatcaatatgaagaaggagaagaagaagaagaagaagaagaagtagaagaaagagacaaaagtatgagaaaagcaattgaaaaagttgactcagttggaacaggaattttgggaaaacacaatgatcaacaacacacatacttttacctattctttcctctatctcccaagcaagcaagcaaaaggaaaggatgggtttgcataagattccagagaccaatcaaaagacatcatcagcacatacttttctctctcacctcactgtcctaa

SEQ ID NO: 91725 - DNA, 4440 bp, Glycine max
  Peptide Sequence Number=SeqID_208503
atgggttctcgaggaaggccattatttgatctcaacgagccacctgccgaggataatgatgagagggaaggtattgtctgcttccagccccaaaagacacatccatcaacaaatccacacacgtctgacttatttgcaacatcatctgctgcccaaggaataataaataatcatgctttttcacatgcctcatctgtctctggatttcaaccttttgttcggcctaaatccactggtgtccctgaattggatgctgaatccaagacagcaggagatcaggatgcaaaagtttcctctaaagatgaagtgagagttatggattcacggatattaagttcggcaaatgctcaatctacagagagggaagagggggaatggtctgatgaggagggcggctttgctaatgcaaatggaggtaataatgctattgcaaatggaggtaataatgctattgcaaatggaggtaataatttgccacaacgaagtcaagcttcagaagagccagcaacttctggaatggtggatgggggtgttgcagtggcttctgacagtaagtctagaaatattaagagttctgatagtataaatgatgaaaagagtagccatgcttctataggtctagaatcaaactctagtgaacagaaaagcaatagtattccaaatttagaaagcaatataaaaagtgaagcttctattgatgcacaggaggaaccccctttaatccccaagccaaaagaagtgaaaggtattgaagcaagtcatgcacttaggtgtgctaataatcctgggaagaggaggattgaccaacgtaaagaagaaatgttgggaaagaaacgtaatagacagactatgtttcttaacttggaagatgtgaagcaagcaggtcctattaaaacctcaacccctagaaggcagaccttctcatcacctgtcataagtcgtaccataaaggaagtccgcactgttcctgcacaagttgagcgtgttggaatagctaaggatcagaagctcaccgacacatcttctgctgaaggtggcaatcatgctgaagcacaagagcctaaatctgattgtaatggtgatacttctggaccactagttagatctaggaggttaaacagtgagacagaacctcctacagagggcaatttaccacccattccaagacagggttcatggaaacaactgtcagattcaaggcagcagaagaatgtattccattctaataggaagtcgggactgagtggtcaaagctccaatgatgtcaaattggtaaacaagaaacatctttctatcaagaagcagacacctatcagcagccagtcccaggacacttctgttgaacgccttatacgggaggtgaccagtgaaaagttttggcatcacccagaggagactgagctacagtgtgttcctggacgatttgaatcagtagaagagtatgctagagtatttgagcctttgctgtttgaagaatgccgtgctcaactttacagtacctgggaagaatcaacggaaacagtttcaagggatactcatattatggtgcgagtgaaggcaaatgagtcaagagaaagaggttggtatgatgtgaaggttcttccagtacatgagttcaagtggtcatttaaggagggtgatgttgcaatcctttcatcccctaggcctggatcagttagatccaagcagaatagttcttctttagctcaggatgatggggaatcagaagtcactgggcgtgtggttggtactgttaggcgtcacatacctattgatacccgtgatcctcctggtgcaattttacattactatgttggagactcttatgaccccagcaggcaagtttttgttcaaattttcccattaaagggctcttttgatgattgtgttgatatggttgatgatgatcatatcataagaaaacttcaagctggaagcatctggtatctcacagtgcttggttctcttgctaccacacagagggagtatattgccctacatgcatttcgtcgcttaaatttgcagatgcaaactgcaatccttcaacctagtcctgaacacttccctaaatatgagcaacagaccccagccatgcctgaatgcttcacacagaactttgttgagtatctgcgtaggaccttcaatgaaccccagttggcagcaatccaatgggcagcaatgcatacagcagcaggtactagtagtggaacgacaaagaggcaagaaccttggccatttacccttgttcaaggacctccaggaacaggaaaaacacatacagtatggggaatgttgaatgtcattcaccttgtgcagtatcagcactactacacctctttacttaagcatgtagcccctgagagctacaagcaagtcaatgagatcaattcagataatgccccaactggatctattgatgaagttcttcaaaacatggaccagaatctcttgcgaactttacctaaattggtcccaaaacctagaatgttagtttgtgctccttctaatgctgccaccgatgagcttcttgcccgtgttcttgatcgtggatttattgatggagagatgaaagtatatcgacctgatgtggctcgagttggggttgattctcagacacgtgctgcccaagcagtttcagttgagcgtagaactgaacagcttcttgtcaagagtcgggaagaaattatgggatggatgcaccagttaaagaatcgtgaagcgcaattggttcagcagttgcatggtcttcatagagaactaaatgctactgctgctgctgttcgttcccaaggatctgttggtgttgatcctgaccttctcatggccagagatcagaacagagatgctttgctacagaaccttgctgctgtggttgaaaacagggataaggttttggttgagatgtctcgccttgcccttttggaaagtaggttccgtcctggtagcggttttaatttggaagaggcccgtgctagtttggaggccagttttgcaaatgaagcagagatagttttcactacagtttctagtagtggtcgcaagttgttttctcgtctttcccatggttttgatatggtggtcattgatgaggcagcccaagccagtgaggtggcaattctgcccccactctctcttggtgcagcacgatgtgttcttgttggagatcctcagcagcttcctgctacagttataagcaaggctgctggaacattgatgtacagtaggagtctttttgaaaggttccaacaagcaggatgcccgacaatgttgttgtctgtgcagtatagaatgcacccccagattcgggatttcccttctaggtacttctatcagggacgccttactgatagtgaaagtgtggctaaattgcctgatgagccatactacaaggaccctttacttagaccatatatattctatgacatcagacatgggcgcgagtctcacagaggtggatcagtgtcttatcaaaacatacatgaagcacaattttgtctccgactgtatgagcatgttcagaaaacagtgaagtctttgggtttaggaaagattactgttggcataattactccttataagctgcagttgaaatgcctccagcgtgagtttgacgaagtcttaaattcagaagaagggaaggatctatatatcaacacagtagatgccttccaaggtcaagaacgggatgtcattataatgtcttgtgtgcgtgcatccagtcatggtgttggctttgttgcagatatacgtcgaatgaatgttgcccttacgcgtgcgcgaagggccctttgggtcatgggaaatgcaaatgctctgctgcaatctgaagattgggctgcgttgattaatgatgcaaaatctcggaattgctacatggacatggactctcttcctaaggactttctggtatctaaggcacctgtttacacatcattgcctggtaagccttcctcaaatatgaggggcatgagatcaggtggaccaagatatagatcaatggacatgcatatggagtcaaggttaggaccaccatcagaagatgatgagaatatgggtgctccagttagctccagaaatgggaaccatcgtcaattgcggtattcaatggagaattctttagatgatgttgagcatgggggtgacaaatcaagagatgcctggcagtatggaatacaaaagaagcataactcatctggaaccatgggaaagagagaccgcttcggccagatattggggctttcagcgaagctgtatgagccccatgagattctcagccttggaagagggggagaggagcatgcaatgttggataagccaaacctactttcttatcttgcacatatgcttgtgttggttcttacaaacttgggacacatagctggatggatgtgttgggggaagactgcagagatttgcaagccctatttttatatggagtga

SEQ ID NO: 91726 - DNA, 582 bp, Glycine max
  Peptide Sequence Number=SeqID_208504
atgaatcaaccaagtaacatcttgctactaacatggtaccattctgaatgtcctcccaaatcctcaggttcggcttggacaatactatcaagatcttttgcagaatattgcatagtggggtgggaaaatttgccaaggaccctcctcctctactacaccaactttgtgtcatccccagaaggatatttccaaacagttatatgcaactctgaagattacaagaacaccactgttaaccatgatcttcactacattacttgggacaaccctccaaaacaacaccctaggtctctaggacttaaggattataggagaatggttcttactagccgcccgttcgccagaaaattcaagagaaatgatccagtgcttgataaaattgatagagaccttctgaaaaggtatcatgggaaattttcttatgggggatggtgctctcagggtggaaaatacaaagcatgttcaggtttgagaactgagaattatggtgtgcttaggcctggtccatcctcaagaaggctgaaaaatctgctaacaaaacttctctctgataaattttttcacaaacaacagtgcaggtaa

SEQ ID NO: 91727 - DNA, 330 bp, Glycine max
  Peptide Sequence Number=SeqID_208505
atgcattttctgatcacgttcatcaggactgaactcgcgagattaccgtaccagcaatgtcatggaatgcaagagatgaccctggatttgtgtttgccacttttgaaaagacaggaagagcagatagcagcagggaagattatcctccccaaacgaacaaacaaacaaaaaaggaccgtaggaaaattaccagagaaaaagaataggatagtttttgggaaagctgaattccacaatattgttgaccccaccaattttcaaattgaagagatgttttgccgtgataaacctggttccatctcaagatgcactgaatctgtctcaagatag

SEQ ID NO: 91728 - DNA, 180 bp, Glycine max
  Peptide Sequence Number=SeqID_208506
atgggtatgatggggtcacctaatctcacctcacaactacgagcaaatggagccatggtttatgcacagcagctgcgtatgagtcagggtcaaatcaggcagcaactatcacagcaaggttcacttaacactgcacagtcaaggtctgtcgtgtttatgatatttcaagatgtggtataa

SEQ ID NO: 91729 - DNA, 339 bp, Glycine max
  Peptide Sequence Number=SeqID_208507
atgaatcacaaaaaccttgctgatttatctgtttgccctgtgatattgcgcagagaaaattgggatttaaaaattcccggatactcaagtgaagagaagaagaatcagaacaaacctctattaaatgacctccacaagaggcgcctagatatggttcgcacattgatggaatctttgccctctgagtcgagtgttaacagttctaaagagatgagtatacagggcatttctaatcctccccctgtgggaacccaccatctagtaagacccttgagttcagagcagttgatttctcatgcagctggttctcaaatgctacagcagatgacaagattttaa

SEQ ID NO: 91730 - DNA, 296 bp, Glycine max
  Peptide Sequence Number=SeqID_208508
caggccaaaagtcacttagtctaacaggatcactgccagatgctactgcatctggtgcaactacaccaggtggtagttctagccaaggaactgaagctacaaaccaagtccttgggaagagaaagatacaggatttagtcggacaggtggatccacaaggtaggctgaaccccgaagttatagatcttcttttagagcttgctgatgacttccttgattctggagatcccttttgggatcaaaaggggaatgggagggtaacgtcacgtgggatcaaatcccttacccaacagtag

SEQ ID NO: 91731 - DNA, 192 bp, Glycine max
  Peptide Sequence Number=SeqID_208509
atggtaggacaactgatcgttaatgtaattgaaggggaaaaaagaaagcaagggcgtaatagacaaaaaaaactcatactcgattcattggtggaaactagtggtggtcgcgatgtgtggtggaaacgggatatggtacatggtggtagtggtggtggtggcgtgataaggtttcaaggatttgagaagtaa

SEQ ID NO: 91732 - DNA, 263 bp, Glycine max
  Peptide Sequence Number=SeqID_208510
atgggtagaagtcgttgttgttccaaggaagggttgaacaaaggagcatggacagctctggaagatagaattttgacagaatacattaacattcatggcgaaggaaaatggaggcacttgcccaaaagagcaggtcttaagagatgtgggaaaagttgcaggctaagatggttgaattatctgagacctggcattaaaagaggcaacattactaatgatgaagaggagcttataattaggcttcacaatcttcttggaaacag

SEQ ID NO: 91733 - DNA, 213 bp, Glycine max
  Peptide Sequence Number=SeqID_208511
atggggctaaccctgaatgatggctgcagattctcaccggatggaagtgcggaatcgaagacatgtactgagaggtttataatcgctcacgcatcatattcaatcaatttagctatactgtcttggttggatcccttaaatgcattaaacaatgggaaaaacttaaaatgtgttgagacacagtacctatggtactgttggtgcaattcttaa

SEQ ID NO: 91734 - DNA, 273 bp, Glycine max
  Peptide Sequence Number=SeqID_208512
atgcccccccataaaaacatccacactcatatcaacatatctatgtccactaaggcaaatttaattagagctttgaaaatttctgtagtgaagagatctaccaaggttcaacatatcaaagagaccatgcacaatgtaaatgttatgggggttctagtgatcaagaaaatcgatggaaccttaaagattaagacacttgaatttggggttaccgagacaatgaacagtggtgtggacgtaaggaggatgttaacaggaacaagacaacagtaa

SEQ ID NO: 91735 - DNA, 2763 bp, Glycine max
  Peptide Sequence Number=SeqID_208513
atgcattgtgtgatcccaatgagtaacacacatctgtccaagtccaactataattttttactcaaatttccctctgatttttgtgcttatatgcaaacaccttttccttataggaatgaaagtgaggctatcaaaagcattgttgaaaatgttacacatttgttagacaagagagagttgttcgttgctgataatccagtgggagtagaacctcgagtgcaagaaatgattcagctcttagacctaaaatcatcaaaccatgttctactactagggatgtgggggatgggaggcattggtaaaacaaccactgcaaaagccatctacaataagattggccgcaattttgagggaaggagcttccttgcacatattagggaagtttgggggcaagacactggcaaaatctgtttacaaaaacaaatattgtttgacatctgcaaacaaacagaaacgatccataatgttgaatcaggaaagtatttattaaagcaaagactttgccataaaagggtacttcttgtacttgacgatgtgagtgaattggaacaattgaatactttgtgtggaagtcgtgaatggtttggtcgagggagtagaataatcatcacaagtagagataagcatatacttagaggaaaaggagttgacaaagtatacataatgaaaggaatggatgaaagagagtctattgagctttttagttggcatgcattcaagcaagaaagtcttccagaagattttattgaactttctgcaaatttaattgaatattctgggggattaccactagctcttgaagtccttgggtgttatttgtttgatatggaggtaacagaatggaagactgtattgcagaaactcaagagaattcctaattgtcaagtacaaaagaagttaaaaataagttatgatggtttaagtgatgatacagagagagaaatattccttgatatagcttgtttctttattggaatggaccgaaatgatgttatatgtatattaaatggttgtggacttttcgctgaacatggaatacgtgtgcttgtagagcgaagccttgtaactgttgatgataagaacaagcttggaatgcatgatttgctacgagacatgggaagagaaatcattcgagcaaaatcaccgaaggagcctgaggagcgtagtaggctatggtttcacgaggatgttcttgatgtattatcaaaagaaactggaacaaaagctgttgagggtttgactttgatgctaccaagaactaatacaaaatgcttgagtactacagcttttaagaagatgaagaaactcaggttgcttcaacttgctggtgttcaacttgctggagattttaagaacctttcaagagatttgagatggctatgctggcatggatttcctttaaaatgcataccgacagacttttatcaaggaagtttagtttccattgagttagaaaacagcaatgtcaagcttttgtggaaagaaactcagttgatggaaaagttgaaaattcttaatcttagtcattctagtaatttgacacagaccccagacttctccaacttaccaaatcttgaaaagctaatactcattgattgtccaagattatctaaggtatctcatactattggacgtctcaaggaagttgtcatgataaatttgaaagactgtgttagtcttcgtaaccttccaagaagcatatataagttgaaatctctgaaaactctcattctttctggatgtttaatgattgacaagttagaagaggacttggagcagatgaagtctttgacaaccctgattgcagataatactgcaataacaagagtgcccttttcattagtaaggtcaagaagtattggatatatttctctgtgcggccatgaaggattctcacgtgatgtgattccctctatcatatggtcgtggatgtcaccaacgaaaaatccctcatgcctagtccaatcatatgtgggcatgtcatcccttgtctctttaaatataccaaatagtagttcccaagatttatcaactatttccaaagaccttccaaagctcagaagtctttgggtggactgcagctcaaaacctcaactatctcgagatacaagaataattttggatgctttatatgccacaacaaatttaggggaattggaatcaactgcaactacatcacaagtgccaaatataaaaacgtctgcgttaattgaatgcaatagtcaaaatatgactactagtgggtgttactatggtttgctcccaggtgacaattatcctgattggttaacctttaattttgacggctcttctgtaacttttgatgtccctcgagtgaatgggcgtaacttgaaaacaatgatgtgcattatccactgttttactcctgacaacttcacatcagatggccttaaaaatgtgttgataataaatcacacaaagaacaccattcagctttataagagagatacattagtatcctttgaagatgaggaatggcatatagtagtatcaaatattgaacctggtaacaatgtggaggtgattgttgtttttgagaatcgattcattgtgaagaagacaacagtttatctgatttatgatgaaccaattgataaaaagttagagtattgccatgcatctgataagaatgttattgtttccagtggcgatgaaaatatatccactgttaggtggatctctcttcaagaggaacccaccaatgactttaaacaaaaacagaaaagaagaaaaattgaatga

SEQ ID NO: 91736 - DNA, 747 bp, Glycine max
  Peptide Sequence Number=SeqID_208514
atgattgccctgaaagccattcaagcgtcctccttcgctctccaccacaacaacgtaagactccctcacacaagagcttcttctgttctgtgcttttgcagcaagtcgaacaagaacgagcctgataattcccaaccaccacccgaaggagatgctcagagtcaggagcttctggcacaaatcgcgatgcttcagacgcagaaggttcgcctcaccgactttctggatgagaggtccgcgtatttggcccagttcggggaagaggccaaggccgagttcgacaagattggggaagatgcactcaaaggattggatgaagctggtgccagaataacagcaaacatagagagccagatgctagaattcgaggaatctactgaacttaacagactagagattgaggagagtgaaaacaaaatagtggagtttgagggccaaatggagaaggatagaaacgaagggctattctttaagaaccttggacagaaggcacctgtttacaaagcaaaagccaaggaggaggaggaggttgaaaagatcaaagatgtgaacagtgaaagcagtggtagcaaaacaaggaaaaatgtttacctcttcttcattggcttgctgacttttggaatagttgattctcttgcctcatcctcaggtgctgattggaaaaaagttgcagttcttggaggtattcttgtggtcttgttttctctgttcatcaatgaacaaaacaaggacaacaagaaagactaa

SEQ ID NO: 91737 - DNA, 594 bp, Glycine max
  Peptide Sequence Number=SeqID_208515
atggagctcaacacaaaagccaaatatactttgacatttgccctatcaaaatatcagtacaacaagatatgcagactgagaactgctaaagagatttgggactcattaagcataaactatgacgacattgaagatgttagaatgaggaaagtcgtgactatgaccagacattatgaaaacttcataatgaatggtggagaatttatggacaacatgtttagaagacttcaagctcagataaacatgaaggcgttggacaactttcctaaggatgactcagacggtgagaaaagtatcaattcagacgatgaacaacccaacatctatctcatggcagatacagatgataaggtcgaggtaaaaagttattctgaatctgatacctcttcttgtgcttcatcagacgatgaagaggatatgccctatgatgttcttcttcaggatgaagtacaagtggaaaattggcatgccctaggtaaaggaactggtttcagtgttatttatagagattcaaaaggccaacctatggcagtagctaccctcagtattccacactcttatgctataaaagttgcagaatcactggctttttag

SEQ ID NO: 91738 - DNA, 114 bp, Glycine max
  Peptide Sequence Number=SeqID_208516
atgacaactggaagagagttattaggagcaaaatgtgaggctctgttggcaaacacagagattagcttggaggccaaggaagctgttagcagaacaatagccatgatctcctag

SEQ ID NO: 91739 - DNA, 576 bp, Glycine max
  Peptide Sequence Number=SeqID_208517
atggattcagcgttttcgtccttgggtttcgtgattttcggtatttcaattagtttttacgcgtttattgtccaatccctgacgcaaaatgggaacaatggcgctgaattagcaccaccagcgtattgggtgtcaagtccaccgtcaccgccgactcctccgctgttgtcaccgtatcctccgccgccaccctcacaatctaagacactcagaccgggagcgctgccgcctcatcctaacaataggcccaacgtgagaagacctcctcctcctcaccgccgccaccaccaccgcagaccgccgcctccgccgccgccaccaccaccgcacacgatgaatgccggtaaaaaggttggacttttgtttgtgggcattgctgcaatcatgcaagttggcgtggttgggttcttggcgaatattggttggattctgcagaatctgggtgggaggaacatgaaaaaaaaggcaagcatggaaagacatggaggatttgaggaatcattggaacatgaattgtgcaatttgatgccatcatttcggcccccttggcgttactgtgtatattggtactgctag

SEQ ID NO: 91740 - DNA, 1182 bp, Glycine max
  Peptide Sequence Number=SeqID_208518
atgatgagtgcaagtgcaggtgcaagaaataggtctccgttcacacaaattcagtggcaagagcttgagcaacaagctcttgtttttaagtacatggttacaggaacacctatcccaccagatctcatctactctattaaaagaagtctagacacttcaatttcttcaaggctcttcccacatcatccaattgggtggggatgttttgaaatgggatttggcagaaaagtagacccagagccagggaggtgcagaagaacagatggcaagaaatggagatgttcaaaggaggcatatccagactcaaagtactgtgaaagacacatgcacagaggcagaaaccgttcaagaaagcctgtggaagtttcttcagcaacaagcaccgccacaaacacctcccaaacaatcccatcatcttataccagaaacctttccttgaccaataacagtaaccccaacataacaccaccaccaccaccctcttctttccctttctctcatttgccctcttctatgcctattgatcagtcccaacccttttcccaatcctaccaaaactcttctctcaatcccttcttctactcccaatcaacctcctctagacccccagatgctgattttccaccccaagatgccaccacccaccacctattcatggactctgctggctcttattctcatgatgaaaagaattatagtttagttttgaaccgagctaattgttatgatgttctctacttgttgattcttgatagcaggcatgttcatggaataagggaagatgtggatgagagagctttcttcccagaagcatcaggatcagctaggagctatacagactcgtaccaacaactatcaatgagctcctacaagtcctattcaaactccaactttcagaacattaataatgatgccaccaccaacccaagacagcaagagcagcaactacaacaacaacaacactgttttgttttagggacagacttcaaatcaacaaggccaagcaaagagaaagaagctgagacaacaacaggtcagagaccccttcaccgtttctttggggagtggccaccaaagaacacaacaacagattcctggctagatcttgcttccaactccagaatccaaaccggtgatgatcctgcttcttcttccctactctcattatcacaccctttttaa

SEQ ID NO: 91741 - DNA, 228 bp, Glycine max
  Peptide Sequence Number=SeqID_208519
atgaatgatgctggttgggacagtgcaagtaaaagactatcgggtagaaggaagttcggagttgtttgcttgcaattgaaagcacttgactttctccctaggggttggcagaaggtgtcaggaaagtgcactctgaggggcttcaaaataatcgcctctttccctttgactggatatggattcagactagcctatctatctatatgcacttcaaccttacatgtgtaa

SEQ ID NO: 91742 - DNA, 276 bp, Glycine max
  Peptide Sequence Number=SeqID_208520
atgtttaacgagttttggagggtagcaacaaaccctgatggcaccaccgtcgcgctggcaaaggtgcaatggtcctgcaatgagatgcgagggcaccaccatggactatgtttgattttggcacattggttgtggtggcgttcagttatctcctttaaaaagctggtagaggcaatagagttggagtggtgcattggaattttgtggccagcacgaggggcaatgagaagggggagaaacagagttggagggggtgcagttagggatggaaattga

SEQ ID NO: 91743 - DNA, 318 bp, Glycine max
  Peptide Sequence Number=SeqID_208521
atgactaaagaaaagaaccaatttgtcattccttttaagccttctaatccatcaaactcattcctaattcctggggttaaatactttaatgagaggatgagagaaataattgctactgatgtgatagttcatgaatacctttttggcattgttgatgatgaagtttggatgtgggcttttcaatatggaaatcctgactttcaaaaagctttgttgaaaactgtcaacaaaattagcttaacaactgacatgtggaaatcaagtcaccaagcggttgggtatatggttgtcaccggtcatttcattgatgtggagtga

SEQ ID NO: 91744 - DNA, 759 bp, Glycine max
  Peptide Sequence Number=SeqID_208522
atgagggagattgaagaaaaggcttatggagaacaagatcctctttatacttatgcaccttcaaatgaagattgggaaaaagtgttgaaagtttgtaaacttttagaagtatttaacttagctacacatataatatcaggcactgagtatccaattgctaatttgtttcttgcagaagtttggagggccaagcaacttgaagaaattgttaaggaaaatgtgaaaaaggtgcaaaatgctcttcaacaattatatgatgagtatgtggctttaaacaatgaagagtcatcctcaaatgaaaggaatgttggtggcataaactcctcaagtgtccatttgccttatacatcttcaatgattgggtttgatcaattaatgagccttatgcatgaaaaggaaatagtcccaccaatgaaatcagaactagatgcttatctcgagaagaaaaatacttatattcctaataatggaaactcctcttttagtgccttggagtggtggaggaataacaacttcaaatataagattttatcaaagaaggcaagagatatactagctgttccaatatcaatcgttgcatcagaatctacatttagtgctggaggtagagtaattgatgagtatcgttctagattgaatgaagaatctattgaagctctcatatgcgatgaggattggattcgccataattacaatttgaagagaaaaacaaaggttgatgatcaaccgcttgaagaaatcaccttgaaaatatcataa

SEQ ID NO: 91745 - DNA, 692 bp, Glycine max
  Peptide Sequence Number=SeqID_208523
gtgtgaatggtcttggtgtatctgcagcacggttagacatagcaaaaggtggatccatcccaatgcacacacaccttgctgccactgaacttctgataatggtgcaaggacaaatcagtgctggttttatgacaccaactgcactttataccaagacactaaaaccgggtgatattatggttttcccacaaggacagttgcattttcaggtgaattctgggaacggaaaaaccactgcttttcttgcattcagcggtgcaaaccctgaagcacaactacttgaccttctgttatttggcaacagcttgccttctgagttggttgcacaaactaccttccttgaggttgaacaagtgaagaaggttaaggctcgttttggtggaagaggattaaaggaagggagaggggaggagaaggaaagaggggagagaaattttgattacacattctatttggttaagaagagaggagagatcattaaagaaaaagagcaggctattgctccctttccgtcatcctccgaaacgctaactacgcgtcgtcgtcgtgaacatcaccgacaccgaaggatacagaggaatgtcgtcttgtttaatggtgctactttggaggctgaaaacgtgatggatcttattaagttgaagttccgacaacggttgtcttggtggcagcggagtagggaatgtatttag

SEQ ID NO: 91746 - DNA, 228 bp, Glycine max
  Peptide Sequence Number=SeqID_208524
atgaatgagaagttgtgggatggaactcagaagccgtcaaatatttcagttaatttggcactccagcacctgtatgattggaaacaaattcattcttgcatcaggcactctcgtgggaattttattgctgccagaacacaatgctatcaggggagatctttcacctcaggaagcagaggaaatagcattgcttacagtgacggaaatgagcagaaaagcatttcatga

SEQ ID NO: 91747 - DNA, 1626 bp, Glycine max
  Peptide Sequence Number=SeqID_208525
atggaaccaaatccaacatcagatcacagtctagactggtttgaaggttctgtgtcttactttccaccactcttagattatccatacgactctggtgacatccaagactatcagttgtgggaacaagacataaccagccactaccaaactgataccaataccagttcttcccctaatgctaccaacatttctacaaccacaacaccccttgagacttgtgactctaataacaacctaccactttctgatttgccaaagaaaagaaatgccactgatgagtctagtcccaaaccaccacaaaaccacaagcacaagaaaatcaagagcaaaccaataaacaatgaagcctataccggacacgcagaagggacaacaacaacaacagttagaaaatctggtgggaacaagaaagggggagctaaggccaatggaaataactgcaacaacaaggatggtagatgggcagaacagttgctgaacccttgtgctgcagccataacaggtggaaacctgaaccgtgtgcaacacctctcgtatgttctccatgagttagcatcacctactggcgatgctaaccacaggcttgcagcacatggtcttaaagcactgacacaacatctatcatcttctccctcttcagggtctataacttttgcttccagcgagccgcggttcttccaaaagacactcctcaagttctatgaggttagcccttggttttccttccctaacaacatagcaaatgcttccatccttcaagttcttggcgaagacactgataataattcacgcacccttcacatccttgacattggagtctctcatggaatgcaatggccaacttttcttgaggccttgagtcgcagacctggtggacctcctccgttggttcgcctcaccgtggtcactgcttcttcctccactgaaaatgacacaccattttgtattggtcctcctggtgataacttctcttctagactccttggttttgctcagtcaatgaatgttaacttgcagataaacaaactagataactgtccattgcatactctgaatgctcaaagtgttgacacctccccggatgaaatctttgttgtgtgtgcacagtttaggttgcatcagttgaatcacaatgcccctgatgaaaggagtgagtttctgaaggtgttgagaaacatggagcccaaaggggtgatactaagtgacaacaacatgggatgttgttgcaattgttgtggggatttcaccactggattctctcggagggtggagtacttgtggaggtttttggactcaacaagctccgcgttcaagggccgggagagcgacgagaggagagtgatggaaggtgaggctgcgaaggcattgacaaaccagcgcgagacgaatgaagggaaggagaaatggtgtgagagaatgaaagaagcagggtttgtgggggaagtatttggagaggatgcaatagatggaggtagagctttgctgaggaagtatgatggtaattgggagatgaaagtggaagatgacaatacaagtgttggactatggtggaaggggcaaagtgtttctttctgttctttgtggaagctggatgggaattataagacctcaacatttacatcatga

SEQ ID NO: 91748 - DNA, 483 bp, Glycine max
  Peptide Sequence Number=SeqID_208526
atggttctcattcttttctttctcgctcttatttcatccacatctcatgcttctaattttaatgatttctgcgtagcagacctcaaggctccagagagcccttctggctatccttgtttaccacctaatactttgacggcagataactttgtgttcactcttcaacttccaaacaccacaaaccctttactcaaagcaggaattaacactgcatttgtcaatgactttcctgctctcaatggccttggcgtctctgctgcacgtgtagttattgaaaaagatggattttttccactgcacacacattcagatgccactgaactaataatcacagtagaagtttttagtagctcaaaccctgatgtccaattatttaatgatatatttgccaacaatgtaccttctcacatacttgcacaaactaccttccttgatgttgcccaagtcaagaagcttaaggctcgtttcggtggcagcggctag

SEQ ID NO: 91749 - DNA, 201 bp, Glycine max
  Peptide Sequence Number=SeqID_208527
atgtctgagagaaatgttctcattgcgaaaaactatgggattctgtctaatattcttcacttgcggctgctagagcagacaacttttactatcctttggaataggaaccgagtcaggtatgtttgtgtaagggcaccgttaagctccactatagcccaagaattgtttatagactttgtcttccttttcagggttcgctga

SEQ ID NO: 91750 - DNA, 108 bp, Glycine max
  Peptide Sequence Number=SeqID_208528
atggtagagaaaggagattcaggggtatggaagcaaggaactatagatgtagcagtgatttttaggttggagaaagcagtgatttccagcttggagaatggggagtag

SEQ ID NO: 91751 - DNA, 828 bp, Glycine max
  Peptide Sequence Number=SeqID_208529
atggccgttgagatggttgtcggaatctttcaagtgtcgtcgaagaagtcctatgggtttaaagagtatcgtgatgaggaagaggaaaaaacaacaattgagaattgggttcagagtttgaatgcaagagaatcagaattgagggctcagaaatcacgattcagaatgggtcaaactgaaagcgcagaagctgtggcggagactcaaaccacaacccaccactcctccaatcccacttccgtggaatccgtcctcgtagaagctgcagaatatggaaatcagaacactgagtctgtggaggaaatgactcagaaagcccttgaatgcccttgcgttgctgacttgcgaaccggttccagtggctctcagttctcagaggcattcctgtgttttgtcaagagtacctctgaagaaaagcctggctacagagactattttaatgttggtatgattaagagttctgtggtaatatgcaaggctcggactgtgtacatccatttgttgcactgcagagctgcatcaaggctaatccagatgcattctctaaggacattctgggcaaagccgaagatgaaagcaaggagttggagccagttcaagaatataaaatacttcctcccaaatggtcttggtgatgaggacatgttcaagagcaagggcaaggatccacttgaaggacttggaggacctatgacaagggctagagcaaggaaagccaaggaagctcttcaacaagtgctgtccatactatttgaatccaagcccaagtttcaaggagaaaagtccaaggttgtgagttgtatcatggcccaaatggaggaggactaa

SEQ ID NO: 91752 - DNA, 2148 bp, Glycine max
  Peptide Sequence Number=SeqID_208530
atggcggtttctacgatagccttgtacgcgagtccaccaagcagcgtgtgttccacgccgcaccagatcaacgcccacgctagctacgacttcgaattggggtcgcgatcttcttcgccggcggggtcgacggcgccgccgtcgacgtcgcagaagccggtgatgggtggtctctcatgcctgttctcttcgcctgcgccggcggtgaagcacgcgcctccgctgtcgtcgaacttctccggcgaggaggacgagatgaaggaactgagcagttccttctcgtattctccgagcaaattcgcaggttcttcgtggaagagggatcagagtcccgtgtcggtgtttcatggtcctgtttcgtgtagtagtagtggtagaagttccacgggttcttcgagccgtattagaagcttcaggggtgggaccagtggtttgtttgatgggtttgtgaggaatgcgttggggtcttcatgtttggactatgacttagatgctggtgattcttctgctatgattgatgagttgaccttcaatttggaggataatttcgtggagggtgggtttcactttgagccctatgctaaaaaattgcttcttggggcgcaaatgaggcacaagatcttctgtgaggagtttgtcattaaggccttttgtgaagccgagaaagcacacagagggcagatgcgggctagtggggatccttacttgcagcattgtttggagactgccgtgttgctggctttgattggtgccaattccactgttgtggcggcggggctcttgcatgactctctggatgatgcttttctgacttatgattatatagttgggatgtttggcgctggtgttgctgatttggttgaaggggtttctaaattgagtcacttaagcaagctggctcgagaaaataatacagctagcaagtcagttgaagcagaccggttgcatactatgttccttggcatggcagatgcaagagctgtcctcattaaattggcagatcggttgcataatatgatgacactagatgcattgccagtggccaagcggcagaggtttgctaaggagactttggagatttttgcacctttggccaatcgcttgggaatttctacttggaaggaacaattggaaaatttatgttttaagcatctcaacccaagccaccatgaggagctttcatccaagcttgtggaatcgtatgatgatgcaatgattacttctgcaatagagagattagaggaagcacttaaagatgaaggcatttcttataatgtcatttctgggcggcataagagcttatatagcgtttattgcaaaatgttaaagaagaaactaaccatagatgatatccatgacatttatgggctgcgcttgattgttgacaaggaagaagactgttacaaagctttgacagttgttcatcgattatggtctgaggtgcctggaaagctgaaagattacatatgtcgtcccaagttcaatggatatcaatctctgcatactgttgtgatgggtgaaggcaaggttccccttgaagtacaaattcggaccaaagatatgcatttacaagcagaatttggatttgctgctcattggagatacaaggaagatgattgtcagcattcttcatttgtgcttcagatggttgagtgggctcgatgggttgtcacctggcagtgcgaagcaatgagtagagattgttcatctgttggatatgctgattcagtcaatcccccatgcaagttcccttcccatgctgatgattgcccatattcttacaagcctgattgtggtcagaatgggcctgtgtttgttatcatgattgagaatgataagatgtctgtccaagaatttagcgcaaactcaacagtattggatttgttgaaaagatctgggagagcaagctctaggttgacaacatataggttcccattgaaggaagagttgaggccaaggctgaatcacaaacctgttagtgaccccaatagcaagttgaagatgggagatgtgattgaacttacgccagccatacctgacaagtctcttacagaatacagggaagaaatccagcgtatgtacgatcgtgggctaactgtgtcgagcatgggaaccgctgcaagcaccatggttggctcaaggagttga

SEQ ID NO: 91753 - DNA, 348 bp, Glycine max
  Peptide Sequence Number=SeqID_208531
atggagcaccatgagaagaagcaaggtagcgagtggctctctgctcttcactcgaggcttcaaaattataatcaaaaccaacactcatcaatgtcagcgccaacaacgatgtaccacacaacatgcacaagcatcgagttgagtagaagtgtgagtggtaaagtgcgtttttgtgaactcaaaattcccaaaagcaaagaacatagcgccaactcaaaattcccaaaagcaaagaacacagcaccacgaagaacacagcgccacaaagtggatcgaacaggatataaaaacccttttgctggttttggaggctttggcacctttagacctctctggatggattgctag

SEQ ID NO: 91754 - DNA, 591 bp, Glycine max
  Peptide Sequence Number=SeqID_208532
ctggtcggcgatcgcgacaacatcgcgctggcctgcggcgtgcatccgctcaatcaggaaacgccgtatgacgtggaagagtttcgccgtctggcggcggaagagcaggagaccaaagcccagcagcaggcctcgttccgtgagcatatccgcaccggcattgcgctggacaagccgattattgtgcacacccgcgatgcgcgcgaagacacgctggccattctgcgtgaagaacaggtagagcggtgcggcggtgtgctgcactgtttcaccgaagacaaagagacggcggcgcagctgctggatcttgggttctacatctccttctccggcattgtgaccttccgcaacgccgaacaaatccgcgaagcagcgcgctatgtaccgctggatcgcattctggttgaaaccgattcaccctatctggcgccggtaccgcatcgcggcaaagaaaatcagcctgccttcacccgcgacgtggctgagtatatggccgtggtgaagggcgtcgatcttgcgaccctggcggccgccaccacggaaaacttctcccgcctgtttaaggtgccgatgagccgactcggcggctaa

SEQ ID NO: 91755 - DNA, 276 bp, Glycine max
  Peptide Sequence Number=SeqID_208533
atgaataaggggttgtttggggttggatttttgttggtgttggcgaatcttctgcatcctctccatgatgagctcatactcgcacttttcatagaagtggcactcgttcttgcacttccaggggaggtagaactcagccagcctgcctgtgtcgctatcatcttcttcgatgacccttccacttccatctcttcctctttgatcgatcgactcgcctctttttactcattcttccgattcaacaccgaggaagagtactccggtcttgagatctaa

SEQ ID NO: 91756 - DNA, 2096 bp, Glycine max
  Peptide Sequence Number=SeqID_208534
taccaaaggttttttggccagaagctgcaaaatggacagttcatgttctcaacaggagtcctacattgacagtgaaagataaaactccagaagagatgtggagtggaatcaaacctaaagtagattactttaaagtatttgggtgcctaactcatgtccatgtacctgatcagaaaagaacaaagctggatgacaagagcctgcagtgtgtattgcttggggtaagtgatgaatctaaagcttatagattgttcgatccagttgcaagaaaaattatagtcagcagagatgtgagttttgaagaggataagggctggaattgggggaggactgcagaagaagtgaagcatgacgtgttgatttgggaaggtagtaatgatagtgaggatgcctcctctgaaaatgaagaagaagctgttgtggaaggtactgaaacagcaggagttacagaccaagatgcagaagcaacaacctctacatcaagtgattcatctaatgaagatgcatctgtacatgctacagctgaaggaaggagtcgaagagcacccaactacttgcaagattatgaaactggtgaaggattatctgaagatgaagattattttgcaatgtttatctctgatgatgaagattattttgcaatgtttacctctcatgaagatccaagctcatttgaagaagctgaaagagatgagaaatggagaaaggcaatggatttggagattgaagcaatcaaaaagaatgaaacctggcagcttacaactttgcccaaaggtgctaagaagattggagtgaaatgggtttttagaaccaagttaaatgagaatggtgaagttgataagctcaaagcccgactagtagctaaaggctatgctcagcaacaagggattgactacaacgaagtgtttgccccggtagcaaggtgggacacaatccggatggttttagctctaccagcacaaaagggatggaatgtgtatcaactagatatcaaaagcgcatttcttcacggagaattgacagaggacgtgtatgtggaacaaccaccgggttatgttcgaaagggtgaagaagagaaggtctacaagcttaagaaagctttatatgggttaaagcaagcaccacgtgcttggtatagcaaaattgaagcctattttgtgaaggagggatttgaacgatgcgatcatgagcacactctctttgtcaaaacaggaggaggtaaaagaattttaattgtgagtttgtatgttgatgacttaattttcactgggaatgatgcatgcatgtttgaaagctttaagaagtccatgaagattgagtttgatatgacagatttagggaagatgaaatatttccttggtgtagaaattcagcaaaattcagaaggcatctacttaagtcagaagaaatatgcttgtgaattacttgagaagtttgggctgcagaattgcaattcagtaaagaatcctatagtgcctggttttaagttgtcaaagaaaggagaaggtgctaggattgatgctactgcctacaagcaattaattgggagtctcatgtacattactgtaacaaggcctgatttaatgtatgtggtatgtctcttgagtaggtatatggccagccccactgaattgcatatgcaggcagcaaagagggttcttcgttatttaaagggaactgtggagttaggtgtgttttataagagaggagatgttaaagacttggtggcttacactgatagtgattatgctggagatattgatgatagaaggagcacatccggatatgtatttttactgagtggtggagcagtctcatgggcatcaaagaagcaaccggtagtaacattgtccaccgctgaggcagagtatgtggcagctgctgtttgtgcttgtcaatgtgtgtggatgagaaaggtgttggagaagattgggctctcacaaagcaaggatctaacaaaaaaggaagtggtgaggctcattcattgtggcacaagcaatcaagtagctgatattatgaccaaaccattgaaacttgatgtgttcctgaaattaagagtccagcttggagttcgtgaggtttcaaatttaaactga

SEQ ID NO: 91757 - DNA, 1491 bp, Glycine max
  Peptide Sequence Number=SeqID_208535
atgtcagctgaaagtagcaactttgtgcagccagcaatacccaagtttgatggtcattatgaccattgggctatgctcatggagaattttcttcggtcaaaagagtattggcatttggtggaaacaggcattcctacagtagctaaggggattcaatcaacagaggcccagaggaagtcaattgaagatcacaaactgaaagacctgaaggcgaaaaactatctcttccaggccatagatagaaacatcatggagactattcttgacaagggaagttcaaagagcatttgggactcaatgaaacagaaatatcaggggaccagcagagtgaagagagcacaactacaagcattgaggaaggaatttgaagtccttcaaatgaaaggaggagaaaaagtggaagagtactttgctcggacacttacaattgtgaacaagatgaagatttatggtgagaacataactcaagttatgattgtagaaaagatcttgagatctatgacctcaagatttgactatgttgtgtgctcagtagaggagtccaacaacttggattcactgacagtagatgagcttcaaagcagccttttggttcatgaacaaagaatgaattctcatggtggtgacacaagggatgagcaagcattgaaggtctcacatgaagaacagaatggaggtagaggcagaggtagaggctttggtcggggtcgaggcagaggcagaggaaggcagtctccaaacaaagccacagtggagtgctttaagtgccacaaactaggacacttccaatacgaatgcccaagatggaaggagagtgcaaactatgctgagatttatgaagaagaagagatgctgctcatgtctcttgtcgaagctgacaacttgcaacaagaagagacttggtttcttgactccggttgtagcaatcacatgtgtggaaatagggagtggttctctaccattgatgaggctttcagacactcggtaaagcttggcaacgattcaaaaatggaagtactgggcaaagggaacatcagacttcagatcaatggtgcaattcatgtagtcactgatgtttactatgtcccagatttgaaaaataatttactaagtgtaggccaacttcaagaaagaggactagctttacttatacaagatgggaaatgcaagttgtaccaccctagaagaggattgataatgcaaacagaaatgacagcaaatcggatgtttgtgttgctggctagtgtagtgcttgaagagacttcaacatttctacaactagctactgaagatagttcacaattgtggcacggtagatttggacacttgagttacaaaggtttgaggactttgcaacacaaacagatggtgaaaggtcttccatttttcaaagattcaagtaaaagttgccctggatgctttgtaggaaagcaacatagagatgtcattccaaagaagagtcaatggagagcttcccataaattacagctt

SEQ ID NO: 91758 - DNA, 555 bp, Glycine max
  Peptide Sequence Number=SeqID_208536
atggctctgagaaagctttccacaaagcgatctaggaaggacgttgcggccaaagggactagtaccgcccccgagttcgacagccatcgtttcaggagcattgagcaccagcagcgtttcgaggccatcaagggatggtccttccaccgagagagacgcgtccagctcagggacgatgagtacacggatttccaggaggagatagctcgccggcgttggacatcgctggtcactcccatggccaagtttgattcggatatagttctagagttttatgccaatgcttggcccacggaggagggcgtgcgggacatgcggtcgtgggtaaggggccagtggattccttttgatgcagacgccctcagccagttcctgggatacccgctagtgttggaggagggccaggagtgcgagtatagtcagagaaggaaccgggccgatggatttgacgaggaggccattgcccagctgctatgcataccaggtcaggattttgcccggaccgttgtcgagagacggggtgcggatcatgtgcaccagcatgactacctttga

SEQ ID NO: 91759 - DNA, 189 bp, Glycine max
  Peptide Sequence Number=SeqID_208537
atgtatttaagggtttatttgtatggtggtggcgacaacgacgatgacaatgttgatagtagcgacaacgatattggtgtcaataccaatggtggtggtgctgacattgagatagtgtattggttagtgatggtactgatgacggtggtggtggtggtgttgttaagaatggtcattgtcaaatgttga

SEQ ID NO: 91760 - DNA, 358 bp, Glycine max
  Peptide Sequence Number=SeqID_208538
atttattggaggtcccactagaaggatcaacaccaatccgtgcctgttcctcctctaccagctcaatatctttcctttcaccttagcttttgaaaactacactgtaatttacaaaacaaaagttgaaaggaaagatattgacatgatagacgaggaagaagcacagattggtagtgatcgttctagtgcaacctcgaataaagctgagatttataacgaggaggcacggaagaaaacacagaagcataaaccaaagagggtggagagtgtcaatgagcttccctttattgttggaaaactttgtcgtgcagaacaagttggaaccaactggggaagtgaagtcttgcaagtgttgtaa

SEQ ID NO: 91761 - DNA, 213 bp, Glycine max
  Peptide Sequence Number=SeqID_208539
atgcgtcaggtggtaggcagatatacccaagtgattatccgtacaaagacaacatctgctgatcctgacccatgcatcaggtggcaggtggaaataccccgagtggttatccgtacaaacacaacatctgttaatccttacccatgcgtcaggtggcaggcggagacacccaagggttatccgtacacacatttatgctaccctgacctgtga

SEQ ID NO: 91762 - DNA, 378 bp, Glycine max
  Peptide Sequence Number=SeqID_208540
atggatctagaaggaaaaggtagaggaatctattttggtgcaaaatctattttcgcaccagcatctattaaatttggaagctcgttgccactcctcaaggtcttgggtggtggcactcacattttgttgaaactggatgttgtcggttgccatttgcttcatcatctccttcaaggaaggaccatacctcaagtttggatgatctctctaactaggattacaggtgttggagtaaggattatatttttgttgttgaggtctaaatggttgtcaagattgcatggtagaaacatcaaaagtccttcaatggtgattttccaccatggagatgcagcaggagataaaggagaagaggtgaaaggagatgccatccactag

SEQ ID NO: 91763 - DNA, 345 bp, Glycine max
  Peptide Sequence Number=SeqID_208541
atggaagaaactaaatctattgacgaaaagcttaatagatttggagttataataaataatcaaaaatccctggggaagatatacggtacccaagatcatatcagaaagatcctaaggagcttgcctaaggaagcaaaatatctagccaggttaaagctagatgaattggtgggatctttaaaagtccatgagcaaaaaatcatggatgaaattcagcctagaaaaaggaataacatagcccttaaggcaagtacctcttcaaggaagactgcacatcaacaagcaacttctaaagaagaagaagatactacttctagagaggaggatgaagttgctttcatctga

SEQ ID NO: 91764 - DNA, 192 bp, Glycine max
  Peptide Sequence Number=SeqID_208542
atgggcaccagtatttactttggacttgaagccaaacaacccaagtttaagaagtcgtcatgtggtatgcatgtccgtgcaacaagcaagctagtggggccaaaggctcctggggaaacttgtcatattgtgattgatcacggtggaaatgttccctactgggaaggacagagttatggtgttattccacca

SEQ ID NO: 91765 - DNA, 540 bp, Glycine max
  Peptide Sequence Number=SeqID_208543
atggacgaagatcaatgggcgtatgacaatacaatgtctcaagaagttgatatggattatgaaaatgaacaagaatgtggtgtgaatgaaccacatgttgattgttcggatgcttttaatacttctcaagtctttggtacccgagatgatattctgcagtgggctccattggttgcccatgaaaacggatttgttgctggatgtatgcttgtccctgttgcatgctggttttcaagaaaaataatgtttttgacaaatgggatgcgacatatctatcatgtagaagcaaagcttcatgatgaatcaagattgattcaaagatgttttgatgataacaaagatgatgacaaaggtgatgacaaaaagctcaaaggtcaatcaaagaatgagttcaagatgttcaagatagaatcaagaacatttcaagattcaagaggaaagttgatttcaagaatcaagaatcaagattcaaggatcaagctttcaagaatcaagatcaagattcaagacttaagattcaagaatcaagagaagacttaa

SEQ ID NO: 91766 - DNA, 132 bp, Glycine max
  Peptide Sequence Number=SeqID_208544
atgttgatgatgctgaaaatacactgtgatgattttgtgtatgtacatgggggtgcattgaccttgttggatgtccctgtgaccttgttggatgtccctggtgggggaaagggagtggttaaagagttttaa

SEQ ID NO: 91767 - DNA, 999 bp, Glycine max
  Peptide Sequence Number=SeqID_208545
atggaacttgagatacgtgcttgtctcttgttgtttctctttagtctcttctcatgctctcaagcctacactttctatgttggtgggaaagatgggtgggttttgtacccttctgagaattacaatcattgggctgaaaggatgaggttccaagtcagtgatactcttgtttttaagtacaagaagggctcggatactgtgttggtggtgaacaaggatgattatgagaaatgtaacaagaagaacccgatcaagaagtttgaggatagtgaatcggagtttcagtttgatcgatcgggtccattttacttcattagtgggaaagatggtaattgtgaaaagggtcagaaattgattattgtggtgttggctgtgagagagccacctccttattatcctccgacacctccaaacactccttacgttccaattactcctccaaaagcaccttatcatccaaatccaccttatgttccaacccctccaaacactccttatgttccaattactcctccgagagcaccttatgttccagcacctcctcaaactccaactgttccaactcctccagaaactccttatcatccaccctatgttccaatacctcctcctaaaacaccttcacctatttccagtcctccctatgttcatccaaaaccaccttcacctattcattatccacctaatgttccaacacctccaaaaactccttcccctgtatacactcctcccaatgttcccactcaagcaccttcacctgctaatcatcctccatatattccaactcctccacaaactccttccccagtttatactcctcctaattttccaacgcctccaaaaataccctctcctgtgtacactcccccaaaagctccttcccctagtaacaatccaccctatgttcctacacctccaaaaacaccttctccttcttataatcctcctaatgttcccactcctcccaaaacaccttcacctatttacactccaccaaat

SEQ ID NO: 91768 - DNA, 207 bp, Glycine max
  Peptide Sequence Number=SeqID_208546
atgggcccagtacttgctcgtacctgcctcggtggttggccgcctattggtcggccatgtgtcataggcaacgctctagcctttgtagatgagatgagatggactctagaggtgggggtggtgagtttgttgcccgctgttggccatccccaggctgttgtggtgcctcgtcctgcacctgcctgggggcgcggtacttctcgatga

SEQ ID NO: 91769 - DNA, 369 bp, Glycine max
  Peptide Sequence Number=SeqID_208547
atgttttccaagaaggagggaatgatgagaatcctgaaactgaccaaatacaggccaaaggcccaagtggagaaggacgaaggcccaagtggagaacgacaaagcccccgagtggagaaggatgaaggcctagagacttatcaaggtaatccttgtggcgtctaccctgacttatcttccttcactggaagtggtgtcatccaaaactccgtagcctctattgtcacaacctacccttcagcgggagggcgatgcaaggctcacgggggcgtcttccaagggaggaaaacacgcagagtcgccaccaacgtttattcggggaaaacattggaaaaaccgaaatgtgtggtctacgaactttatgtgtga

SEQ ID NO: 91770 - DNA, 348 bp, Glycine max
  Peptide Sequence Number=SeqID_208548
atggcgtaccttcgcttgatgcaatggcacttgctggtgtcaaatacaacactgaagtgtttgcgatgttcatggaaccgcttcttgaatgtcggtagttttaaggcaaacgttgctggcagcactggtgcaaggaagatcttccttgacatgaatgaagagtttgaggaaacaatgaaggtctcctttcagaactcgagttcaacatatttcacgttgaagcttaaactcatgttatgcggcttcataaaatcgagcatcaacttcactgagacatggtgcactgctgttgacaaaggaaactacattgatgagaacatgttagggttttgcggtagaatgagttga

SEQ ID NO: 91771 - DNA, 660 bp, Glycine max
  Peptide Sequence Number=SeqID_208549
atggcagctgatccaactcaaacctttatgggttacctcacacctactttgggagaatctaataccatcagacctcttgatctatcgaagggtgccacatttgacttcaagcatggattcctacagatgttggagaacaacccatttagtggtgctacccttgaagattctatgcataacttgaagaagttaatcaaactttccaacattgcaagacaaaaccatgcatcagtagaatatgaaggcatgggattggctaagctctttaccagtaaacaacatctcttcatggaaccaatgcaaaaatactttttctctcccatgaagacaaatactagggacattggaaactttgtgcagagggagcaagaaagtctacctctattgttctgtggtgtgaattatcatttttggaaagttcacataaagattttcatggggtcgattaataagggtatatgccaagctgttgtgaatggctatacaattccaactcaagaagtcaataatgagacaataaagaaaccctatgaatcttggtccactaaagaaactaaaagagctaaatatgactctaaagcaacaaacattatgaaaaagatgatggtactaagcaaaccaagaggggaggggggtgaattggttttcaaaacaaaatga

SEQ ID NO: 91772 - DNA, 261 bp, Glycine max
  Peptide Sequence Number=SeqID_208550
atggtaaatcacatggctgacttggcaaccttgacaaaaaatatgagaaatcgtccgttggcatactccccaaaggaggaagagaagaaggtccctgctgagagggattgggagacacttgaccaagtgattcttgacagtggggagacaaccattagagaagttcctcaggaagtagctggatggttgatcaaggagagtagtgaggaggactcagaggaacatatgcatgaaatttcttcacaggaaccctactgctag

SEQ ID NO: 91773 - DNA, 267 bp, Glycine max
  Peptide Sequence Number=SeqID_208551
atggatgtgcaagcatccgaggaatatggagtacatgctttccaaaaacgtctacaggttgatgaagtgcaatggggaaaactattggtggcaatagtcattgtacctttgcttgatgcaacaacacttgttgtcggagacgtcctcagtatgttcatgatgttcatgacatcacttctagtgatggcaaaggagatgaaggaagagttcgaggaaatgctaaaggtgagtgaattggtgaagacaagtgaactgaggctcatttga

SEQ ID NO: 91774 - DNA, 177 bp, Glycine max
  Peptide Sequence Number=SeqID_208552
atgatggtgaaggcaacatcgacggtcgaggcaatcactggcgacgcggcatggatggacagaacagcgtttgacgacgcgagaaaggagagcccagaagtgaagaagaagaagatgaataataggcatgaggaagagagagaatggtgcacaaagaaaaaccctacaatacattaa

SEQ ID NO: 91775 - DNA, 992 bp, Glycine max
  Peptide Sequence Number=SeqID_208553
ttggtattggtgtcagggtgccaagtggatatgattatgcatgggatctcctcattagctctacgccatttgtggaatggaaagaaatgttatggagaatgggaactgggagccgattttctatttgtagaaatggtcctaagctttcacatttgttctttacagacaatgtattgctcttcaccaaggcaaaaccgactaagggtgtcatgagcaaaaggaagagtaaactctccaatgtctccaacattaggttcactaataatctaggcaaatatctaggtttcaacatagtgcatggtcatgtcactaatagccattttgatttgcttctagagagggttcaaagggctcatttccagaatgtggaatttcttggaaagcttatttgggatgtgcttcatcaccctaataagctttgggttcaggaagtggacatgattcatatccatgatgtggatctgaggatatgtgatgtcttttctagaggatggaaattggagaatctttatacaaatataactactgaggttagggatagtattcttggtatgagtgttgttattcacccaagcatccttgacacgtgggcacaaataccagagaatgccaagtttttcctctggcaagtgggtcatgatgcgtttcccactagggagttcctaaggagaatgcatactattgcggatgaattgtacttgaggtgtgggacgataaccgaatatatctcgcatattctatggaagtgtgggagtattgacttggtggggaagttcttcaatatatctttgccttctgatgagagcttgagtttgggatggttgaactggattcatataagcataactaaggtgccaggtagttcattaagtgcaccttccatgccaactatggtctcctctattcaatttgtggctaggcaagtgagtctcaatgttgatggcagttgtgtggccaatccagggcctgctagctacgggggacttttgtga

SEQ ID NO: 91776 - DNA, 234 bp, Glycine max
  Peptide Sequence Number=SeqID_208554
atggttcagatgtttgtaagagattctacttctaaacaatggcaaactacctttgcatgtgcgttatatgggttctggattgctaagaatcgaaaggtgcttcaggaggtggatatccaacacaatgagttgttctacttcatcaaacaatgcgcatctctatttgcgcttgattgtaaggataacatttctactcctgtgaccaacatgctctataaccaacatgctctatag

SEQ ID NO: 91777 - DNA, 369 bp, Glycine max
  Peptide Sequence Number=SeqID_208555
atgaagaacgcattcgacaagaaggtgcgctcgtgcaagttccatgagggggaccttgtgctgaaaaaggtgtcccacgttgttaaagataatcgagggaagtgggccccgaactacgaagggcctttcgttgtaaaaagggctttttccggaggggctctggtgctcaccaacatggatggcgaggagctaccttcacccgagcaaaatcgtcttaggcaatggtcaaatgccgggacgggtctaaaggcagaaaccaatcgaggtaaaatgggacggacacaagcagaggctaggatcacgatcgatagatcgtcatttcatgcccagcactggacaagcgggaagcgcagctgggggacaacctag

SEQ ID NO: 91778 - DNA, 294 bp, Glycine max
  Peptide Sequence Number=SeqID_208556
atgtcggccaggaaagatgaccaatccaggtctaaaacagaagaatcaccagatgacgccgatcgaacatttcctaatagacatcgtccaaatattatcgggggattgaatagaaaaaacaatagcggacattgtcgatgtcggccaggaaagatgaccagatccaggtctaaaacagaagaatcaccggatgacgccgatcgaaaatttcctaatagacatcgtccaaatattatcgggggattgaatagaaaaaacaatagcggacattggtcgttaaatagccccgattga

SEQ ID NO: 91779 - DNA, 330 bp, Glycine max
  Peptide Sequence Number=SeqID_208557
atgcctgaagtagacgaggtgcaagagcgaatgaaggccgacatggaggccatgaaagaacagatggccacaatgatgaaggccatgatgagcatgaagaagataatggaggtcattgcggttgcaattgccattgtcagtgatgtttttggggtggacccgactcccccatctggcctcaatcaaataagtcatccaacctccgatgtgagaggcaaaaggttggcaagtgcgggcggcccccattgtgtgcaaattcaaaacaagcacgccttcgtgctatatggcttgcctcccaactatacaccacccaatgtggcatacactccg

SEQ ID NO: 91780 - DNA, 672 bp, Glycine max
  Peptide Sequence Number=SeqID_208558
atgtggagagatgtttcaagatcagcatttgtgtttggatttggatcattcatcatagtctcatcttcttatgcaaaggatatcaatctaagggggatcataaacgttgaggactcaaattatgttgtgggagaagaagatgcaatttggatgctaaaattaatcctcccttacttgaatgagttcctatcaaaactcaaagccttgttttctggagatccaggtaccacaataaagttggcagtgttgctctttgttttggccagatgtggcagctacataaccgtttggaagatggccaaatttggcttctttggagtttttactgtaccaaagatatgctcttcgtattctgcacagttaactgaatatggaaatttttggattcgtcgattccgggatgcatgggattcatgcactcacaagaaagccgtggctcttggcatcttcgggcttgtatggaatttatcatcagttgttgctcgcatttgggcagtgttcgtactatttgcagccttcagatattatcaacaacattatttggtgagagatgaatggggggaagatgaagcaggatgtgatgaaacatggcaagaccctgttggagttagaccgaaacaaggacctgcaaccaactttagtgataccaataaaataaagaaagggttctaa

SEQ ID NO: 91781 - DNA, 171 bp, Glycine max
  Peptide Sequence Number=SeqID_208559
atggcggttggtggggtgcaacacattgtaaagcaattgaaaaaagcaaagcaaactagtaccgtggcagaacaccagacaaacgcacccttaattttggccaattttgttcctcttaaagtgttgatgcgtgtgcttcaagaatgtgaacgccgaatagcaattttctaa

SEQ ID NO: 91782 - DNA, 303 bp, Glycine max
  Peptide Sequence Number=SeqID_208560
atgactaacatggttcaagcctcttgtagttggacaatagtggtcagcctcttgaaatccccacctaagtattgtttgattttgatgccattcatggtccgtatccttttggtggttgggtcctctaatatcactgctccatatggcataacttcgttgatgatgaatgcttgcccatttgatgcaatcctccctaggaagggaccagtcactagagccatgagcaagaggctccaagaggattgggctagagccggtgaagaaagccctacggttctcatgaaccttaggatagatttctga

SEQ ID NO: 91783 - DNA, 681 bp, Glycine max
  Peptide Sequence Number=SeqID_208561
atggacgacttctctattgttgactcttctttttatttatatttggctaatcttgacattgtactgaagcggtgtgttgaaataaacctggtgctgaattgggagaaatgccactttatggtgattgaaggcattgtgttgggccataaaatctttgtgcacgacattgaggttgacaaagccaaggtggaagtcttggaaaaattacctccacagacaaatgtcaaaggcatcagaagttttttaggatatgttggattctacaggtgtttcacaaaagatttttctaagattgtcaagcctttgagcaatgtcttgaataaagaagtttcgttccattttgataaattatgttttgaagcttttgatactttgaaacagaaactaatttctgcacccataatcactactccaaattggacacttgattttgaaataatgtgtgatgcaagtgattatgtagtaggagcagttcagggtcaaaggaaaaataaaatttttcatgtcatacactatgcaagcaaggaatttgatttggaaattaaggataagaagggaagtgaaaatactatggctgatcatctttctaggctgagtattgatgaggtgaccacacaaggacccgagattcaagaagagtttctagatgagaagctattcaacattacagtaaggccatag

SEQ ID NO: 91784 - DNA, 372 bp, Glycine max
  Peptide Sequence Number=SeqID_208562
atggcctttggccgacctgagcatcaaggccatgttcgcgtcgcatggacaggtgtcacaataagccaatactttggccaagcctcacgtgcttctagcacattgtcaccatcgatcaaccaacaacaattggctaatatcatcggtggaattaaggatgacataaaaaagcagctacaagatgagataagaaatgaggtacaggatgagataagaaaggagtcagcccccattaaggcgctagaaatacaagctctacttgcacgtgttagcacaaagggtagctgcgctagacttgaaggaagcggattacttaaagagcttttgaatggtgatgacgatctgatgggcttgttcgtagttgttgggtaa

SEQ ID NO: 91785 - DNA, 294 bp, Glycine max
  Peptide Sequence Number=SeqID_208563
atgcaccgcaggctgcagacgcaccaccaacacctcattaggctgatccagctaggtcatctggcatggagtggtatttacagcacttgcctcagtctgcagagccagggtttcgctccttttgcgtgccctacttcagatcagtttagggctgaggttgcatggcccggagattggcctgaggcccaggcaggggaggcgcccgtagaggctcccggcgacgcggaggaggtctgcatggatgaggagatgtcagatttactcggtttcttgggagggagtggagccacatga

SEQ ID NO: 91786 - DNA, 240 bp, Glycine max
  Peptide Sequence Number=SeqID_208564
atgcatgacaaaagatcactacacaacattaaaggcatactgtcaaatttatgtcaacaagcttatggtgtacctctttcaaacctattgctatcaatatatacgccaataatccgtgatgcaccaacaacttttgcgtcctctacaacctgtgatgacaaaaagctcaaaggtcaatcaaagaatgagttcaagatgttcaagatagaatcaagaacacttcaagattcaagaggatag

SEQ ID NO: 91787 - DNA, 498 bp, Glycine max
  Peptide Sequence Number=SeqID_208565
atgaactatagcaatgctacaaaggattctgatgttggtcaagattatgatgatttatgcaaagaaagtgaagtaaatctagcagaagtgaaggatataattcaggattctatcaaaggcagatgcctaaagtttgaagaaaatctcatgaaggatgtcaatccaaggtacctaaggaatccaattgctaaggagaacatgaataaggatctaaatgagtttgagaatgaagtcaaaggatgcagttttcgacagatttactgcaaaggccttcgaatcatccaagattcgaataaacatttcagcccctcaaggaaatatgagcaaaactcaaggaaggcacactcaaaggatgaggaagttggttttggagaattaatagagaaatcaacaaaagcaaggaaggattcaaattccgaaaatgaagaagagatggtgattgatacattcaaatttggtttcgatgattctttagaagacatcactgaacgattttga

SEQ ID NO: 91788 - DNA, 288 bp, Glycine max
  Peptide Sequence Number=SeqID_208566
atgcacgaacaatacgattcacaaacaatcataaggagaatacttacctcagaggagaacgaagaagacgcaaaaaagaagaagcaacaacgaaggagcaggagccacgaagaagaagaaccaggaacagaggagcaggacccacgaaggaagaagaagcacgaacggagagagaagaaacaacaaggaacgcgaaggggaagaagaaggcaaatggcgcaacgaagaggaagaagaagaaggaaagcggcacagcgaagaggaagaagaaaagcggcactcaagtga

SEQ ID NO: 91789 - DNA, 696 bp, Glycine max
  Peptide Sequence Number=SeqID_208567
atgaaaattacatggagattgagtctaacaccaacttctagtccaattatcaaaaaagaaaaatattctcaagctactcaccatgaagaggaattacctatagtagatgctcttgcaataataatccctaaaccccttgttaatgatattcttcaatcctttgataatttcaactattgcatccctgaatcagacaaaggtattgaagtagcccctatggccaatcaagaaaatttatcattggggataatggctgctactttgcttgctccacaacaatccgcaatacccccaagttcaattgttgatccacctcaagataatgaagatccaactaatgctgacctcttttcctttattgacatttggtcctcatattcgatgccatcaaaggcttccgaagagagtcacaatagaaccattacgtgcttcgatgaagttgtgaatcatttcaagaaaattgcttttgacaagaatctagaaaactctttagctgatcctgactataaagaaaaacttcgacaaacagtgaatggagttgtcaaattgaatgacttgatggctgatgagcttcgtgaagaaatggagacattccttgacgttttcaataatgcttttgaagctcatcaactttgtaatccacatgcttctgatattgctgatatcaagtcttcgacagagcaagacaggacctaa

SEQ ID NO: 91790 - DNA, 303 bp, Glycine max
  Peptide Sequence Number=SeqID_208568
atggggaagaggaagctggagctaggttttgaagatcagaaaattgattttgatttgtttgttgaagacaagcctgctccagaacacaatgtttgcttacagggtttcaatttcttggaaaaaggactgaaaaataagttagaaaaatattttttgaaaaacagtcctttcgctaagtgcaagcctcgtgctaagcgtatctttgttcatgcgctaagctgtgattctcaagcgcttagcacccaacccttgcatctgaggttgatttggtccattaagctggccaaggttgagctaagttaa

SEQ ID NO: 91791 - DNA, 1308 bp, Glycine max
  Peptide Sequence Number=SeqID_208569
atgccgcagcaccaaccaactctaatggaacctgttctcagctacaacaatagcaccaacaatggaaatggcaacagtgactatgatatcataagctggtttgaggatgtatctcagaacgctggttttgttcagactcagttgctgttccagattctcaagcaaaactatggggttgaatatctcaagaaatggttggggagctacaacatccttgagatggatgcatgtgcattggaatcccttttctcttctgtggttccccttgcctcacatgctgattttgagccatttatccaacggattgcagatggggacacagctcctttactcactcaacaacccataaccactctttccttaagcagttctggaaccacagaggggaggcagaagttcgtaccctttacccgccatagtgcacaaaccacacttcaaatattcaccttagctgcagcatatagatcaaggatttatccaataaggcaaggtggaaggattcttgaattcatatacagcagcaacaggttcaaaacaaaaggaggattaacagtaggaaccgccacaacacactactatgctagtgaagaattcaatatcaagcagcacaagaccaagtcatttacttgcagccctcaagaagtgatttctgggggagactataagcaatccacatattgccacctccttcttggcctattcttctctgaccaagtggagtttataacctcagcttttatctacagcatggtgcaagctttcaccacttttgaggaactttggagagaaatttgcaatgacataagagatggaactctgagctcaaggatcaagtcacccaaaatgagaaaagctgttttggatatcatctctccaaatccaaatttggccgcaaagttggaagatgcttgcaaggggctagaagtagtggattggtttggtttgattccaaaactttggccaaatgcaaagtatgtgtattccataatgacagggtccatgcaaccatatttgaaaaaacttaggcactatgcaaatgggttgcctttggttagtgctgactatggctcaactgagagctggataggggttaatgttgaccctagtttgccaccagaagatgtaacatttgctgtggttcccactttctcttactttgagttcataccactccacaggaatgaaaaaaatttcagctcaggaggtgatgatttcattgaagacaagcctattccactgtctcagatcaaagttggacaagagtatgaagtagtcctcacaactttcaccggtattcatttttcttaa

SEQ ID NO: 91792 - DNA, 268 bp, Glycine max
  Peptide Sequence Number=SeqID_208570
cttgggaggattgatggggacccggtgttgagagaaacgaggatatgggctacgtgggagtacgtgagctcagttggaggtgggcaacaggggatggagaccttggggacgtcaggtggggtgctattgcccaaaaccaagcttgaccaatcccgaaccaacccgggcatagtcggggactggaacattgtggaggcctctggtaatcgattaccagcctgtgtaatcgattacacagagggatggatcactggtaatcgattaccag

SEQ ID NO: 91793 - DNA, 459 bp, Glycine max
  Peptide Sequence Number=SeqID_208571
atggatgatttacaagatacaatcgggtatagtgggcagagaggttcggacaacctaggggaattagcttcgagactataccttttggagttgggagcttggggatcgatatacgttgtacccgtatatggaaatcactcccaactgccatccatgtggttgtgtaaaccaccaatacctgggaggcttggtggcattgttgggtcctgttatgtgtcgagtgtgacagagcaaaggactcacccctgtaaccagcaacgttcagggtcaggagagaaaagtaaaatctcctttgatgtgtcataccctaatttcgtccggggattattacttgatgacatgcaacctttgattggccgcttcaagatacttggcaccctttgttgcacaatatgtaagtcccgagacgcgccgaaaatcaaaaggaagcagggttacgcgatccgtgaaattccgtaa

SEQ ID NO: 91794 - DNA, 294 bp, Glycine max
  Peptide Sequence Number=SeqID_208572
atggatcagcattttatagctttttattttttcaccattttcaaaatttcaatgtcatggcccatcttggcccatcaagaatcttctggaggaagcaacaggtcgcctgggcgagcatgttgcttcaagtttaagccactagctcgcctgtgcaagctgggcggcaagctcctcctccatttttcctataaaatggcattggaggctggggggaaggggttcaacccctttggcaatcaggtttcacttaaaattagtgaggagaagaagaaagaaggagaaaatgaaggttga

SEQ ID NO: 91795 - DNA, 312 bp, Glycine max
  Peptide Sequence Number=SeqID_208573
atgattatgaagggtcaagacatttatagtagacaagatgaggttgctacttcaccttcctctagtgaaagtgaagaagcaaatggggaagaatctagtgaagaaattgactcccaagaagaaagggaccttttaatggtcagaaggcttctaggaggccaatcttgtcacttggcaggtgatatttttttgcttgacattggttacaaagtagcacctactaatgttgatgagaaaaagcttggcctacgtcagttgaacaaaccctcagctgccataaacagaagacaaactttgtcgatgtcagcataa

SEQ ID NO: 91796 - DNA, 267 bp, Glycine max
  Peptide Sequence Number=SeqID_208574
atgatgaaggtggagaagaaattgatacatagaataggacaacaacaatctccaaggagtaaaaagagtggggacaacaacaatctccaaggagtaaaaagagtgggtgggagtgaaattgagcatgaaacatcccttgcaacttgcttgacaatgattggcttctctcctagtggcttggtgagaaagtttgttttccttatcgtagttcatcttgctggagagaatcagcttgtgaccaacagttttatccaacatataaaatga

SEQ ID NO: 91797 - DNA, 778 bp, Glycine max
  Peptide Sequence Number=SeqID_208575
atgctggcgtacgccaaagcgtggctcgcgctcaaggaactcggcgtcgacgccgatctctccaacgaagtgagcgaccgaccgacgttttatctgaaaaaattacgcctgatttacggcgacgacggggaagggctcgaagatcctaggattttagaacaaaagacgcgcgccgccgtcatcattcagaagcgattcaggggcatgcttcatcgcgtgatgatgcatcaaatgctcgtcgagcgcagcgtgaacggtattttccacaaggttttacgcgagagggatccgatgagttacaccgcgcgagcgatagacgtgtttcactcgcgcctgggattctcactcaccgaggtgcatcgcaagctgaattcaatattggatcacagcgacatcgtagacgagccgaccaagattgataaaccgtcgacgttgatgtcgacggcgcttcaggcggcggcgggtagggctatgacggtgaaacgcgagaccggtaagcaaccgcaggcgacaacagcgagtcagcgcgcgcgaacggcgcaacccgtggacaccggacgcgccgcgggatggggtacgtcgtcgttggaggatccgattcaaaagttgcagtcgcgcgtcgacgagctcacgggccgactcgtgcctctcgagcgcaagattacgaacgcgaacgccaagcagacggccgcgttgacggagacgaacgaacgtttgagcgaactcacgtctcaactcgaagccctcatgcagctcacggtgtccagcatggagtcgg

SEQ ID NO: 91798 - DNA, 585 bp, Glycine max
  Peptide Sequence Number=SeqID_208576
atgggggcggagcgcaagagcgcggtgatgactccagaaaatcgcaagctcaccgcgtaccacgagggcggtcacgcgttggtagcgcttcgcacggcgggggcgaggcccgtgcacaaggcgaccatcgtgcctcgcggccaagcgctcggcatggtcatgcagctgcccgaaaaggatgaattacagatgacgagacgccagctattggcaatgttggatgtcacgatgggaggtcgcgtcgccgaagagcttatttttggaccggaggaaatcaccaccggcgcgtcgagcgatttacagcaggcgacgcggttggcgcgcgagatgattacgcggtacggtatgagtgacaagattggattggcgtcgcaagactacgcgtcggaggagatttcgagcgagacgagacaattaatcgaagacgaggtgaaatcgatgcttgacgcggcgtacaagcgcgcgaaaagtttgcttgtcgcgcacgagggcgatctccactccatcgcgcgccgcctgttggatgccgaaagcgtctctggacgcgagctaaaggagctctgcggcatagcgcccgcgacgtag

SEQ ID NO: 91799 - DNA, 626 bp, Glycine max
  Peptide Sequence Number=SeqID_208577
atgcgacgagagcggtatccaaacgagcgcgagatcgggctgttcgaactgtcgaaatacggcgttccggtgttgttgagcgggttggcgtacatgctcgtggcggcgccgtttttgttaccgggcggcgaacgcgacggggcgaacgcgaacgatttggatttggaggatttgaccgtcggtgcggtcatccccagaggatcgccggtggtgaacgctgaggtggccgtcctgcgcggattgaatgggttgtatttggtgagcgtgcagcgcggcgacacgctcatgcgcggtgtgcagccaaacttcatcctcgaggtgggtgacattttaatcttcaccggtctcatcgatcgcataggtgaggtttgcaaagagcatggtttagtgccgttgacgcacgaggtggaggctaagatgctcgaagtgaagcaagagacgaaacagagcgaggaggataacgtcgagagctcggtgacgtttccgccacgtgtcagaccggtgcacgcctcgagagagtctcagcggggtcgtacgtcgcaagacgacagcagcatctcgggcgtcgcgtggttacatcgaaactccacggccgcgggtgggcgcacgagcatcgatttgcacgc

SEQ ID NO: 91800 - DNA, 537 bp, Glycine max
  Peptide Sequence Number=SeqID_208578
atggagattcgaaacaataataataatggagattcgagcatagcgacaatgcaagttggcagtgcaacaacaactgctcctatgacaaatgcgtacaatgcaatgttgttgatgagtacatcgaatgtgatgacatcgatgaatgcatcagatgctacgacaccaattcttacatcaagtatgacaacttctacaccagcgtctaatatgatgagcactactgctatgccaatatattcaaattcatatttactatcggatacaagattggaacaaatccttccatttatcaccatacccacaatgggtacaagaacttcataccgtggagttcatgcattcaataaaaataataatggaactcctcttagtttgaggtatccatggggcatgcctaattgtagacctcaaggtgtagagttagattcttttcaaccttcaatggaatatcggggtaaaattcaattacttcctaaaatagaaattgaaacaaaaatggttaagggaatgcttattattatgggtcagaacaattaa

SEQ ID NO: 91801 - DNA, 273 bp, Glycine max
  Peptide Sequence Number=SeqID_208579
atgaaatctcacatctctggtgaaagctctctgggcaatgagttgaggagatccgtcagcgagaagcttcatcacgttgatgaggccgatgctgccaagcaaggtagggttctaaacttgtcatttgagactgaactctgcattctcacggcttcaacatacgcagtttttggaagtttcagacataagcagaacctcgaagtgaataaacagaccataaatatatcaaagggaaaaaataataaaatgagcatgcttgatggtggagggtaa

SEQ ID NO: 91802 - DNA, 606 bp, Glycine max
  Peptide Sequence Number=SeqID_208580
atggcttcatattttgcagatcctttgtattggccaatgtttgttattgctattatggcatccatcattgcttctaaagccatgatcttcgggactttctctatcatccaacaatccctcgctctaggatgctttccttgtgtgaagatagtcagccaaaagagaggtttctatttcgccaagtggaacacgaagaaatcaatgtgtttcgatgtgttgcaagatattgatacactaatgtgcgcaatgatcgagcaagagccttttgagcatttgttggttaagaggctgaaggagtttattggttgtggatttttggcgtcccaaagagtgatagaagatggtaaaacagaagaaaaaataaatagtggtgataaagagagagtggtgcaagaggtggaagcagttgaaaaagcagtgagaggaggtgttgttcacttgattggtgaaagtgagatggttgctagcaaaggagctggcatatggaaaaggattctgatagattatgcttacaatttcttgaagaagaatttgaggcaaagtgataaagtatttgatattcctcataagcgtatggtcaaagtgggaatgacatatgaactttaa

SEQ ID NO: 91803 - DNA, 918 bp, Glycine max
  Peptide Sequence Number=SeqID_208581
atggatgagattcatgtaacagatccgaatgctgaagttattgctttatcaccaaccacattaatggcaacaaatagattcgtctgtgagatctgcaacaaagggtttcagaggaaccaaaaccttcagttgcaccgtagaggtcgcaatcctccatggaagctgaggcagagaggaagcaatgagttgatgaagaaaagggtttatgtgtgccctgagccatcatgtgtccaccataacccagctcgtgcattaggagacagcactggcataaaaaaaattacagcagataacatggtgaaaagaaatggaatgcctctaagcactagttccaacaacactactgtatccgaattcaacaacaactacgaccctaagaacccactccaagaacacattgtcccattgccattcaagtccacttcagctcacatgtctgccacggctttattgcagaaagcagcacaaatgggtgccactgcaagcaataataataataataatagcattattattaactctccaaccatgatgcagaaaaactttgttattagcggcatggctggtcctcaccacaaccataattcttcttcctatgaccacttccatcatccaaaccctgatcaatctcacatgcaattttttcacaaggggcaacaagaaattgaccacaacgaaggattgatgaagaacgtggagcaagagatcggtactggtaattcgagtttggttcatgatttcttgggcgttgggggtgcaacttcaagggtgcatgaaccacagaatcaaaaacagcagcagcaaagattggagttagatacattaacccaccagaggttgcagattatgaatcactttcaccaccaccttccacatggggattctgctactatggagaaatccatttgggacatttga

SEQ ID NO: 91804 - DNA, 438 bp, Glycine max
  Peptide Sequence Number=SeqID_208582
atgggtgacaacataggcaaagtcttagacagagaaggctttaagtacaacttcacagcttcagcaagtggcacatctgcacaagatggggtgattaaggagcaagatcggttgcttccaatagctaatgtggggcgcatcatgaagcaaatccttcctcccaacgccaagatctcaaaggaagctaaagaaaccatgcaagaaagtgtgtccgagttcattagctttgtcactggggaagcttctgacaagtgtcacaaggagaagcgcaagaccgtgaatggtgacgatatttgctgggcccttgctactttagggtttgatgactactctgagccacttaaaaggtacttgtataagtatagggagatggagggggagagagcaaatcaaaataagggtagcaatggttatgaaaacaacattgcaaacatataa

SEQ ID NO: 91805 - DNA, 123 bp, Glycine max
  Peptide Sequence Number=SeqID_208583
atgggtcatgttcctgccacaaacggatcaggattcgggtacatgagtattcgacagagcaaagggagggtacctgcaaaaggtacttatcgctcaagtgagggttcaactcagagttattaa

SEQ ID NO: 91806 - DNA, 267 bp, Glycine max
  Peptide Sequence Number=SeqID_208584
atgcagtttctcactgaaaatgatcgtgatgtaggaattgaaaatattgcatatgaaatttgggaacaacaagatcagatgattctatcgcgagttcttggatgcacttattccaatcaattatgggagaaaattcatgagtacttccatttgcaaacacgagctcaagctcgacaattacgcatggaattgcgtcgcagagcgcttgacaacaacatggtagaaactcagtttgtcactaaacttaaaagcaaccaaacttattag

SEQ ID NO: 91807 - DNA, 2687 bp, Glycine max
  Peptide Sequence Number=SeqID_208585
atgggaggtttgggattaatcattttgttattcatctttctgcagaatcctcacgtgtccatgagtgatcttatcttcactgttggtcaaggtcgtaattgtaatttatggcttaaagatcccactgttggtaatgttttgtgcaagttgagccacatagagcgtggaggctcatctgttgcattacttgaaatcacagggggcaaaggttctattcaagttaatggcaagacatatcgaaagaatgcccgtctgattttaagtggaggtgatgaggtggtctttggttcttctggcaagcatgcttatatctttcagctgctcacaaataataatattagtcctgctgttataccttcttctgtgagcattttagaagcccagagtgctccaataaatggaacgcaagttgaagctagatctggtgatccttctgctgttgctggagcatcgatattggcctccttatctaatcttcctaaagatttatctctcctttcacctcctgctaaaactggaaagaatgtgcaacagaactctgacatttcatcactaccttctggcaacgaggatgatatgccaatcagtgaaatgaaggatgccaccaatgatgtagcatctgaagtttgctctgctgacaaaactgttaatgaaaatcctagtcttgacacagcagaagtcgacatcaatgtggatgccgatgttaggaaggttactgctgctacatatgaattgaggccattactgcgcttgcttgctggttcatgtcctgaacttgatttaagttgtggcattaccaagatattggaggagcgaagggaattaagagagctccttaaagatgttgataccccaacaatattggcatcaaccaggcgacaagcatttagggacagtttagaacagagaattctcaaatctaagaatattgatgtctcttttgaaactttcccatattatctaagtgatacaacaaagagcgttttgattgcttctacatttattcatttgaagtgcatgggctttggaaaatatgcttctgacctctcatcagtgtctccacgaatattgttatctggtcctgcaggttcggaaatatatcaggagactttgtgcaaggcacttgcgaagcattttggtgccaggctactgattgtcgattctctctcattgcctggcggagcaccatcaaaggaagttgattctgccaaagaaagttccagacctgaaaaaccatcatctgtgtttactaagagaagttcccagactgccacattacaacataagaaaccagcttctagtgttgatgctgaaattgtaggtggatcaacgataagttctcaggctatgctgaagcaagaggtttctactgcatcgtcaaagggcactactcttaaagagggtgatcgagtaaaatttgttggtaactttccttctgccgtctcatcactgccaaattatccttcaaggggacctagctatggctcccgaggcaaagttctgcttgcttttgaagataataggtcttcaaaaattggggttaggtttgataaatcaattccagatggcaatgatcttggaggcctttgtgaggaggaccgtgggttcttttgttctgcaaatcatttactacgggtagatggttctggaggggatgacgcggacaaagttgcaatcagtgatatctttgaggttacctccaatcagagtaaaagtggtccactggtgttgttcattaaagatatagagaaggcaatggttgggaactatgaagttttgaaaaataaatttgaaagcttgccaccaaatgttgtggtaattggctctcatactctgcttgacaatcggaaggagaagacccaacctggtggccttctgtttaccaagtttgggagcaatcagacagcactacttgatcttgcttttccggataactttggtagactgcatgatcggagcaaagaaacccctaaagtaatgaagcaacttggtcgtcttttcccaaacaaagtgacaatacagctgcctcaggacgaggctatactttctgattggaagcaacaattagaacgtgatattgaaactatgaaagctcagtccaatattgtcagcattcgcacagttctcaacaggattggattggattgccctgaccttgagactcttagcatcaaagaccaaaccctaacaactgaaagtgtggagaagatcattggctgggctataagttaccattttatgcattcatctaaagcttctatcaaagattccaagcttgtgatatctgcagaaagccttaattatggaattaacattctacagggcattcaaaatgagaacaaaaacttgaaaaaatcactgaaggatgtggttactgagaatgaatttgagaaaaaacttcttgctgatgttattccaccaactgatattggggtcacatttgatgatattggagctttagaaaatgtgaaggacaccttgaaggaattggttatgcttcctctacagaggcctgaattgttttgcaaaggacagctggctaagccttgcaagggaatattgctttttgggccccctggcacaggaaaaacaatgcttgcaaaggctgtagcaactgaagctggagcaaatttcattaacatttcaatgtccagcattacttcaaagtggtttggtgaaggagagaa

SEQ ID NO: 91808 - DNA, 4011 bp, Glycine max
  Peptide Sequence Number=SeqID_208586
atggtcgaaaccagacgcggcgcctcttcttccaagcgttctctctcttcgccttcttctgcgtccaacaccaaacgatccaaggtacaaactttcctcaccttcttcgctacccacctctcatattcgatgcggattcccttgttcctcatctgggtatccgatttgaacctcaattcgagatgggtgtctgaggattcctctgtggcggctccggtcaacgaatctggaaccggaaatgaatctggggaaccggagctacgaccctctgatctgccagatacggcgtcgttgaaggtcgcgggtgtttgtgataagtctccttctgaaggcgaggctttggtgcctccactgtgtgcaggtgaaactgcggagaaatcgaaggtggctggtcttcccccaaggagcgtgaagaaacgtgctgcgaaatcgtgccccaagactgcatggggaaagcttctctctcagtgttctaaggtttttgcttctgagagttttactgtttacttgagattttctgggaatgagtctagggagtttgctgacctagggcttgttgtcttgcatttctatattcttgtcaaggttttaaactttggttgtgttgagatcaatggaatcatggaaaaattagaggcaaaagccgccgaggcagctggcattgcggctcccaccgtgtacaagtatagatgtatgcagctgctttatccacttggaagcagaaaggctgtttccaagactcctcatgtgtgcatgactgaacctttcttcaccgttggtcaaggacgacattgtaatttatggcttaaagatcccaccattggtagtgttttgtgcaagctgagccacatagagcgtggaggttcatcgggtgcattactggaaatcacagggggaaaaggttctattcacgttaatggaaagacttatagaaagaatgcccgcctaattttaagtggaggtgatgaggttgtctttggttcttctgccaagtatgcttatcagctgtcgaatagtaatattagtactgctgatatagcttcttccgtgagtattttggaagcccagagtgctccattaaatggaatgcaagttgaagccagatctggagacccttctgctgttgctggagcatctatattggcatctttatctaataatatttgtaaagaattatctctcctaccacctgctgctaaaactggcaagaatgtgcagaacactgacatttcatcactacattctggctgcggggatgatatcccagacaatgaaatgaatgataccaccaataatgctgaaccagctggagatttttctgctgataaaactgttcttgcatcctctaccactgttaacgaaaatcctaaccttgactcagtggaagtcgataccaatattgatgcaaatgttgggaagatgactgctgctgcatatgagttgaggccattactgcgcatgcttactggatcatgtcctgaatttgatttaagtggtagcatttccaagatattggaagggcgaagggaattaagagaacttcttaaagatgttgataccccaacagtattggcatcaaccaagcgggaagcatttaaggacattttacagcagagaattctcatagctgagaagattgatgtctcatttgaaacttttccatattatctaagtgatactacaaagaacgtcttgattgcttctacatttattcatttgaagtgcaatggctttggaaaatatgcttcagacctcccatccgtgtcgccacgaatattgttatctggtcctgcaggttcagaaatataccaggagactttgtccaaggcacttgtgaagcattttggtgccagactactaattgtggattctctttcactgcctggtggatcaccatcaaaggaagttgattctgccaaagaaagttattgtgctgaaaaaccatctgtattttctaggaagaaaaatctccatactgccatgttacaacataagaaaccagcctctagtgttaatgctgaaattattgggggacccatgcttatttctagtgcatcatcaaaaggcactactcttaaaaagggtattctgggaccaagctatggctcccggggcaaagttctcctagcttttgaagataacgggtcttcaaaaattggggttaggtttgataaatcaattccagatggcaatgatcttggtggcctttgtgaagatgaccgtgggttcttctgttctgcaaatcatttactacgagtagacggctctggaggggatgatcttgacaaagttgcaattaatgaaatctttgagagtaaaagtggtgcactcgtgttgttcattaaagatatagagaaggcaatgattggcaactatgaaattttaaaaagtaaatttgaaagcttgccaccaaatgttgtggtagttggttctcacacccagttggataatcgtaaggagaagactcaacccggcagtcttctgtttaccaagtttggaagcaatcagacagcactgcttgatcttgcttttccggataactttagtagactgcatgatagaagcaaagaaatctcaaaagttatgaagcaacttagtcgcctttttccaaacaaagtgaccatacagttgcctcaggacgaggctttactctctgactggaagcagcagttagattgtgacattgaaactatgaaagctcagtccaatgttgtcagcattcgcttagttcttggcagaattggattggattgccctgaccttgagactctctgcatcaaagaccacaccctaacgactgagagtgtggagaagatcattggatgggctataagttaccattttatgcattcatctgaagcttcaatcagagattctaagcttgtaatatctgcagaaagcattaagtatggacataatattctacagggcattcaaaatgagaacaagaacatgaaaaaatcacttaaggatgtggttactgagaatgaatttgagaaaaaactacttactgatgttattccaccgactgatattggggtcacatttgatgatattggagctttagaaaatgttaaggaaaccttgaaggaattagtcatgcttcctcttcagaggcctgaattgtttggcaaaggacagctggctaagccttgcaaaggaatattgctttttggccctcctggcacaggaaaaacaatgcttgcaaaggctgtagcaactgaagctggagcaaattttattaacatttcaatgtccagcattacgtccaagtggtttggtgaaggagaaaaatatgtcaaagcagtcttttctctggccagcaaaattgctccaagtgttatttttgttgatgaggatacatatgagaatctaatgtggagagactgggtaaagctatccgctgaaggcattcatggcttgcaatgtgatggggaaaataatggagggctttggagtggtaaattaggttttacatttgctaatacattgtgggttgatagtatgttaggaagacgtgaaaatcctggtgagcatgaggctatgcgtaaaatgaagaatgaattcatggttaattgggatggtttgcgaacaaaagataaagagcgtatacttgttcttgcggctacaaatagaccttttgatcttgatgaggctgttattaggagacttccacgaagattgatggttaatttgcccgatgctccaaacagagaaaaaattgttagtgttattttagcaaaagaagaattggcacctgatgttgatttcgaagcaatagcaaatatgactgatggatattctgggagtgacctaaagaatctatgtgtcacagcagctcactgtccaataagagagatcttggagaaggaaaagaaggagagaagcttagcattgactgagaaccaaccattacctcagttgtgtagcagtaccgacattcgtcccttaaagatggaagattttatatatgcacatgagcagcacaacaataagattgctgccttgtga

SEQ ID NO: 91809 - DNA, 306 bp, Glycine max
  Peptide Sequence Number=SeqID_208587
atgtttttagcaaattcagttagctcgaagaatttcagagagcccagcatgcagaaagcattagctatctaccaatactacgatctaggggtgtttgcagttggttcgattcagtttttgcggtttgaaaattctgctagtgagagagccatggggctacagaaagtttgctgctttgcactcttaggccacatattcaaaccttggaaacagcctttctgcttccaagtggataaagcagctgcatacatctatacttgtacacggtgggagcctcatgccaatgccatgagtcgccctaactag

SEQ ID NO: 91810 - DNA, 423 bp, Glycine max
  Peptide Sequence Number=SeqID_208588
atgcatattaaggtttcacagatcaagatcaacaactttgggagagcaaagaatttgtcgatgttgaagacgacgataaagttaaagccaatggtggaaaccaacgagtctcatgttgtgaaggagatgcattgcgtcgtgtgcaaggaagcctttgagttaggagtgttggcgcgtgagatgctgtgcaagctccattaccactttgattgcattctcctatggctctcaatgcgaaactcgtgtcctgtgtgtcactatgagctgtcgtcggagcagcccacatataaaaatagagtcactggtaagattgaggaggtggttataaggttgaccatatggaggttgttgagtagcagattcgctgttaggaggcttgccaacgagaaccacttgtcaatgatgtacacctgttttagttag

SEQ ID NO: 91811 - DNA, 435 bp, Glycine max
  Peptide Sequence Number=SeqID_208589
atggatgatgcaaaggggagtgtattttctgggtatttttggcaaaaaattcaaaaggagagtgtactagtaacaagggggagtggaaatagcaaaaccaaaaatagtgacggacacgattcacaagacccgaagcagagccctgctgacatgactgcctttgtgcaaaatcttctccagcagatgcaaaataggttccagacaatgtccgactccattgttacaaagaatatccttttgacttgtcaaatatgtaaactatggaattttttttttcttgacgtcaatgcacttgatgatatgggaagtcgcataaatgagttggaacaaagcatcaatgacctaagagcagagatgggagtggagtcctctccatcacctgcgacccctgctaagccaacagaggaaatcaccaaagaagagggttcagcttaa

SEQ ID NO: 91812 - DNA, 1221 bp, Glycine max
  Peptide Sequence Number=SeqID_208590
atggaccaacaaaattgggctgctaagcttttgggctatcgttttgatatcatatataagccgggtttggagaacaaaggagctgatgccttgtctcgcatgcatgatccagcaatcctggggtctttagtgcattaccctgagtgggaagggagtaaggaagtcattcaagaggtgcatgaggatgaacacttgaagaagataattgctgacctgcaggcagggcatcctacaaggcctggatttacatataaaaaaggggacctatcggaggatagctgcaaatctttactagatgggaatgaagaaaaggatccaacaatatgtccaggaatgcaatgtctcttgcaaccgcttcccataccaacacaaatatggaagaacctttcaatggatttcataactggacttccaaaatcaaagggatttgaagcagtttttgtagtggtggatcgcctctctaagtacagtcatttcattcccctgaagaatccctattcagctagaacattggctgaaatttttaccaaggaggtggaaacacagttgaaaatgagcacagcctatcatcgacaaacagatggtcaaaccgagaccaacctaagacatgggttttatggcttccgtgggcagagtattggcgagactaaagtggaagctgttcagaccgagaattggtggttggtgattgggttttttctcaaattatgcccacatgtgcagcaatcagtcgagacccgcattaatcctaagttagccccacgttattatggcccttttcaagtgataggccatgttggagctgtttcttataagctgcaacttcctccatcttcccaaattcacccagtatttcatatttctcttcttaagaaggttgtggggaattatcaagtggacaaagagttgcccaaggagctggagaatgagccatctaccaaatgggagcctattcaagtgttggcttcaagagtggttagtgccagaggggattcagtacaacaatttcttattcagtggaagcacaaaccagtagaggaagccacatgggaggatgtttcgattatgcagagccagtttcctgagtttagacttgaggacaagtctagtgttcaagaaggaggtattgataggcccctagtgcaggatgcggcccaagtaaataagcccacagtgtggagagtgtatgtgaggaagaataggagaacagagggacaatga

SEQ ID NO: 91813 - DNA, 1830 bp, Glycine max
  Peptide Sequence Number=SeqID_208591
atggtagttgaagctcaaataatcaagcccatcggcaagggcatcgttcacagaatctgcgccggtcaagtcatcctcgacctctcctccgccgtcaaggaacttgtcgaaaacagtttggacgccggcgccaccagcatcgaaatctccctcaaagacttcggcgaacagtggtttcaagtcatcgacaacggttgcggcatttccccaaacaatttcaaggttcttgcgctgaagcatcacacgtcaaagttagcggaatttcacgatcttcagtctctgacgacttttggattccgaggggaggcgctgagttcgctctgcgcgttggggaacttgacagttgaaaccagaacggcgagcgaaccggtcgctacgcacttgacttttgacagttccggtgtccttgtggcggaaagaaaaacggcacggcaaattggtaccactgttatggttaagaagttgttctccagtttgcctgtgagaagcaaagagtttagtcgtaacatacgtagggaatatggcaagttggtttctctgttgaatgcttatgcccttatagcgaaaggagtccgttttgtctgcaccaacacgactggtaaaaatgtgaggtctgtggttcttaaaacgcaaggaagtggttctcttaaggataacatcataacagtgcttggcatgaacactttcagctgcttagagcccgtgacattgtctatatctgattcttgcaaggttgaaggatttctttctaagtctggacagggcaatggacgcaatttggtggatagacagtatttttttgtgaatggtagaccggtggatatgcctaaagttagcaaagttgtgaatgagttgtacaggggtgcaaattccaaacagtatcccattgttattttgaattttacggttcctacaagaacgtatgatgtcaatgtgactcctgacaagaggaaaatatttttttctgaagaaaatgccctattgcaagccctgagagagggattgcaacaaatttattctgctagtaacgtctgttactctgttaatgaagttgtgttgcctgctgaaaaagaagcatgtgttgagttgtgttcctctcatgggaagtctcctattgtaatgaaactattgtccccaaatggcagtcgtcctcagaaagagcaatgtagtgaaagtaacaatggcagtatttctttagatgaaattaatgctgagtgcaacaatgatactatttctcaggatgagcatgaggagaaacatattactcattccaaaaatgcttctgaatcgattaatgaatatctgtactcagatgttgatgaagggctaattcgtgagaatgatgggaatttaatgaaccaggagttcacactcagagcgcattgcgcttcaaaggatgacaatagtggaagacagtcagcgagtcctagtagtattatacctgatcaaactacccttgtctcaaggacagttgagagtggcagctcttctagtaaatattcatttaaccattcaagacatgttcagtccactcttaacaactttgtttctgtaaataaaagaaatcgggatagtgtcattagagccttatctgaagtgcctgttcttagaaatcctcattgtcaattgaagactgcaaatactgaaacacatgacttgattacaagatcatcactttgttttgaccaatgtgatgaacttgctagggcgagcgagattgaagctttgaagcaacttaatcctgataatgtcttccacaaaaatgaaaattcagtttcttttaagggtgactcctctgatagagaacctaaatctaatatgaaggtttaa

SEQ ID NO: 91814 - DNA, 711 bp, Glycine max
  Peptide Sequence Number=SeqID_208592
gaattagatctaaagaataatacacctataggggatacagcatctattaatccttctagcattgatatgatcactgcggatgtttttgcctcagaccctccattacattcatcatctgtacggttagattcttccaagtcttccaggaagaagatatgctccaacatgcaattttcttttcaagagcttaagaaaagaagagagaagaggctttctctgttgcaatccagtaaatttggatgtggaaaagctaaagtcaaaagttgctattcggatgcaactttggagctttcacgatcagaaattgcagagcagaaagaaagggccttggcagcagcagctaccgaacttgaaagatttttcaagaaggaagacttcagcagaatgaaggtgattgggcaattcaatcttggatttatcatttgtaaattggatcaagatttattcattgtggatcagcatgctgctgatgagaagtataattttgagcgtctatcacagtcaaccatcttgaaccaacaacctcttcttaggagactttcaaaaacacggtacaaggaaattgcttattctgatgcaaacttcaagagaaggccaataaaattggagttatcccccgaagaagaaatagttgcttcaatgcacatggacattatcagatggtcaactttgaaaaacgaccagtttgattatctttccttgtgtacttaa

SEQ ID NO: 91815 - DNA, 294 bp, Glycine max
  Peptide Sequence Number=SeqID_208593
atgcctggagtaattggagtagtgatgtgggatagtggagttgtactaggaaagtttctagagcatgttgttgactcagggatgcttgtccttcatggaaagaagattgttgaattgggttctagttatggattggttgggaattatgttgaagtttgttcttactcattctatgatacacctgcagcccttttgggtagtgaggtcattgttactgatctgccagataggcttaggctattgagaaagaacattgagatcaatatggaaatgtttctctacggggttctgtaa

SEQ ID NO: 91816 - DNA, 762 bp, Glycine max
  Peptide Sequence Number=SeqID_208594
atgttgtcaacaagttactatcaggcgaagcagatactatgtccgatgggtatgaagtatcaaaaaattcatgcatgccctaatgattgcatattgtacagacatgagtttgaaaaaatgcagaaatacctcaagtgtggggtatcatggtttaagcgtttgtttgcgaatggagataacgcaaaagaccttacattgcatgcagatgggagaaactatgatcgaatgcttcgtcatccagtcaattcctcccagtggaaaaatattaatggtttgtatctagatttcagcaaagagagaaaatacatgatgttgtctatgatgatatcgtacccaagacaaccaggaaatgacatcaatgtttatctcggtcccttgactgaagacttgacaaagttatgggacgaagggattgccgtgtttgatgggtatcaaaatgagacattcaagttgcgtgtaatgctattttgtaccattaatgactttccaacatatgagaatttgagtggatacagtgttaagagtcatcgtgcgtgccctatctgtgaagaagacacaaaacctgatgacgatcccctatacccgatgatgttgacgatcccagagcttttcctcaaggttatgcaagtgtcgtgggatttaactatgttcggggtgtataatgataatgtccccttgtacataaagcatgaagatctttttgaaatggcacatggtggtcaatgtcttaacatctttgttataaaaatatggattctgtaa

SEQ ID NO: 91817 - DNA, 2145 bp, Glycine max
  Peptide Sequence Number=SeqID_208595
atggttcacaactacgtgttcgtgaatctcaccgtcctcgttgtcctctcggcaactttggtttctcgctgtttcgcgtttacggatccccctgacgtcacagctctgcaggatctatacagggctttaaacagcccagcagtgctgaatggatggaacggtaacgatccttgtgaggaatcttggacaggagtagcatgttctggctcatcagttatacacctcaaaattcgtggactaagccttaccgggtatcttggaggcttgctcaataatctacaaaacttgaagcaacttgatgtcagttctaacaacataatgggtgaaataccactgggtttacccccgaatgccacacatatgaatttaagccataatttcttgaatggacccattggcaatgtgtttactggcttagataatctcaaagaaatggacctttcgtacaataatttcacaggtgatctgccaagttcatttggttccttgacagaccttaatagattgctcctgcagaataacagattcacaggatcagtcacctacctggctgaacttccactcattgatttgaacattcaagataatctgttcagtggcattcttccacagcattttcagtccataccaaacttatggattggagggaacaagttccatgcagtagacggctctcctccctgggcatttcctttggacaatgtacccattgagcaaaacactagtcgcccacccgtaactcaggcgaatgccatcgagaactacgatcctcctaaagtaaggaaacaaaagaacaaacatatgggtcccggaggaatagcttttatggttggtacaggaacattattggcgacaggttttgcgctcttcattgggatccgattgaaaaagctccatagacagagaatggaggactatgaaagaaaccatagttcattgcctagtcaaaccaaagatgtatctactacggcgattgacgagagcctgcaaatcccaccttacaatgctgcatctcttttgagtccaaggcgattaacttcccagatccataaaagaacagggcaaacatcaagaaagagtttttcgggaagagacagattcactggaaggacaaaggtttatacagtagcggaggttcagttggttaccaacagtttccatgaagacaaccttctgggagagggatcccttggccctgtttacagagctgaatttccagaaaacaaggttttcgcagtgaagaacattaacatggctggtatgtctttcattgaagaggaaaagttcttggatgtagtttgcactgcttcccgtctgaaccaccccaacatagtttcacttaaaggctactgcttggagcatggacaacatcttcttgtctatgactatgtcagaaatttaactctagatgatgctcttcacagtgcagcatacaaacctttatcttggggcacacgtctcagaatcgctttaggagttggtcaggccctgaactatttgcactcgactttctctcctgctgtctcccatggaaacttaaaggctaccaatgttctactggacgaaaatctcatgcctcgtgttactgactgcggcttggctattttgagaccactgacaagcgacaaaataaaaaatcgggcttctgagattgatattagggatataggatatagttccccagaccatggccaaccaggaattggcagcacgaagagtgacatcttttccttcggagtactgcttcttgaactgttaacaggaagaaaaccattcgatggttccaggccaagggaagagcaatatctggcaaagtgggcttcatcaaggcttcatgattgcgacagtttggaacagatggtggatccagcaatcaaaagaacattttcatccaaggctctttctcgttatgctgatatcatctccctctgcactcagaaacttaacgtgtctctcgtgcagccagtaaaggaatttcgacctccaatgtctgaaatcgtggactctcttgtatcgttttctcaaaatctcctttcaaagagtggtgctgcagatgacactgaacttgatccacttgagaggtcttttcgcacaaccacctcacgctttatcagttcacccgcattgagctatgtatctgcctga

SEQ ID NO: 91818 - DNA, 226 bp, Glycine max
  Peptide Sequence Number=SeqID_208596
atgggtgaagatcaatggatgtatgacagtataatgtccgaagaagttgatatggatgatgaaaatgaacaagaatgtggtgtgaatgaacaacatgttgattgttcggatgcgttcaatacttctcaggtgtttgctatccgagatgatgttttgcagtgggttcgatcagttgctcatgaaaatggatttgtggtgctgattatgaggctagacacaaacactg

SEQ ID NO: 91819 - DNA, 621 bp, Glycine max
  Peptide Sequence Number=SeqID_208597
atggtacaaattgccaaggaagtgacaaaacttaaaagtggaacactttccaccaatactcaaactaattccaaggagcaatgcaagtccatcaccacaaggagaggtacattggtaggtgacttgagtagagagaaaagtgagcaagaggttgtagttgaagaagtcaatgaggatgaggaaaaaaaccaattagttaaggaaaagaagaatgtggtagtagatcctcctaccaaggatcttccatatcaacatcctcctactaggaaggacaaggaaaggcaatatgcaaggtttctaaagattttcaaaagattgcaaatcaatattcctttttcaaaaacactagagcaaatgcccacctatgccaaacttatgaaagaacttctcactaagaagatatttattaagcaagatacaattcagttggcggctcgatgtagttccattttccaaaatgattttccacaaaaactccaagatctgggtagcttcaccattccaataacttttggaaatctcaaggtagggagagctttacttgaccttgtagctagcatcaatcttatccatctctctttcttggcaaagattggtgatcttgatgttaagcctacttag

SEQ ID NO: 91820 - DNA, 363 bp, Glycine max
  Peptide Sequence Number=SeqID_208598
atggagtgtaggatcttcgtgaaagactccaaatctttgtgcaaatcttctagcacctcatggaggtgctccaccatgccattctccattgcacaagctttggatctggcatggcgaggtagaggtagaggtagatttgtaccggcgatcatgttaagatcgaaaatcattctcgccgttgcagagcctcgaatgccttcactcattgcaaaaccaagtgtcggtgcagatttcgtctatgaaaaggaatccttgatttgttggataccattttactatatcttttcattgtatgcatcaaacttgggacctgttaactcattgacaagtgcactaatttgtcttagtattttaaaacagtaa

SEQ ID NO: 91821 - DNA, 522 bp, Glycine max
  Peptide Sequence Number=SeqID_208599
atgacatttagagggccaaggaaggccaggggtaagagatcagaggtccccactactttagcatcgccagaggaagcaactccttcttcttccacaactccaacacctcccatttcaactccaacacagactccaagccttcagggcttgggcctgccatccatcatgagcatggatgagtttgacacgcaggtggcctggccaggagcccagtcttctccttttggagggggtggggcctccgcagcccaggagcctgagccagaggagccagcagcaacagcaaagggggaggatgagcttactcctcctgagccattttattttgatgcaaatgtacacatggctcaagaggaggagacttccatagaccagattccagagccatctctagtacccatacctgatgattccatgccatttgcaccagcatttgagctagagcaacctatccctcaagattcaccagctgctcaggtgttggatctcaatgagcatgcacaggagcaatcacaagagtag

SEQ ID NO: 91822 - DNA, 918 bp, Glycine max
  Peptide Sequence Number=SeqID_208600
atggcgagacgctcctgcacgagttcgcctgcggcgggtgaaaagcccagcaccagccggttcggcggtcgctgcgccatccgcgggcagcaccacgcaaaacagcccctcttcttcaatcagctgtgccgcacagtgcagcagggtgggatgatcaagcgttgccgtgctgcgcgcggtatcgcgctcgacgctggccgaggccatacccggggtgaaaaacggcggattgctgacaatcagcgagtagcgtttttctgcctgctcactccagctgacgatgtcgtgcgcatgcaccgcgatgcgatgcgcccacggcgacgcggcgacgttctcctgcgcctgcgcggcggcgctgcgctccagttcgacggcatcaatactgacgtcatccggcgtgcgctgcgccagcatcagcgcaatcagaccgctgccgcagccgatatccagtatgcgccgtacgcctgccaccggcgcccaggccccgagcagcaccccatcggtgccgaccttcatggcacagcgatcgataaaggcttcacgcgcccgactgccattcaggctgaggccattcctgccgcgctggaaggccgtgacgtactgggttcggcaccaaccggaacggggaaaaccgcagcctacctgctgcccgctttacagcacctgctcgattttccgcgtaaaaaatcagggccgccgcgcattctgatcctcacgccgacgcgtgaactggcgatgcaggttgccgaccaggcgcgcgagctggccaaacatacccatctcgatatcgccaccatcaccggcggcgtggcctatatgaaccacgcggaagtgttcagtgaaaatcaggacatcgtggtcgcgaccaccggccgtctgctgcagtacatcaaagaagagaactttgactgccgcgcg

SEQ ID NO: 91823 - DNA, 852 bp, Glycine max
  Peptide Sequence Number=SeqID_208601
atggatatgaacttggggtacctcatctcccaccagatatctctgattgcacagcatgacacatccagacttggattccctgccttgatcacagctctatgcaaggccagaggagtccagtcagattctagatccctggagaattttagccctaccattaacttggcatatattaagaagaatcgttggaatcttgatgatccaacagtaacatttagaggtccaaggaaggccaggggtaagagatcagaggtccccactacttcaacagcaccagagacaccaactccttcttcttccacagctccagtaccttcctcagctccagttattcctcctacatctacacagataccacttccagctcctatagctgcaggaccatcagactttatatttacacctcagatgcttcattccatgctccagagcatccacagggagcagttcattatcatgcagagccttcagggcttgggcttgccatccattatgagcatgcatgaatttgatgcgcaggtggcctggccaggagcccagccttctccttctggagggggtggggcctccgcagcccaggggcctgctcctaaggagccagcaacagcaacaatagagggggaggatgagctcacccctcctaagcctttttattttgatgcagatgcgaacattgctcaagaggaggggacttccataaaccagatccatgagccatctcctgtacctatccctgaggagacccagccatctgcaccagtcacggagccaaagcagcctatccaggattcatcagcagctccagcactggatcttaatgaacatcagccacaggatgagcaggatgtttaa

SEQ ID NO: 91824 - DNA, 303 bp, Glycine max
  Peptide Sequence Number=SeqID_208602
atggttaggcaaaagaacgttgtggacgtggattcatgcatatctggctccagcagcatgagaaatttaggaatgagggacagaagaatttcctcatggctgaatggtgtgaaaggaaaagttcataatcgattcatggttcttgggtgcaaatcgcaacacggttacaagggttctgagggtggccaaggtgagtccaagagggttagtcttggcatgcaaggcagagaaactattcttgagaggggtgtgcgtgaggtgaagcaagaaacattaactgattctgagggtcctagccgttga

SEQ ID NO: 91825 - DNA, 1098 bp, Glycine max
  Peptide Sequence Number=SeqID_208603
atggaggcaaagtcactgctccagggttcatctcttaaaccttcttatccgctccctaagctttcaaaaaccacgatgatgacagctaattgcgttagattcagtttcaactacaacaacccatgtctcttattcgcaaatgggtacccttcttcttcttcacttccactttctcttcagaataagcccagaaaatcagcatcagtgattgtgagtgcccgaaagaaagataagaaagaagatacccatagctctgttcccaaacccgatgaggtcacgggtttcttccccgaagccgtgctccttaaaaagagaacagttgaggaagaaggtaagcttctcccggagtttgaagacgctgaggaaagacaactctttgaagcgctgatgcttgagctagatagtgatatggatgttgaaatattgcgccactacgaggttatgtacttaattcatgagaagcatgaagaagaggttgcagctgtcaatgagaaaattcaagactttttgagggagaagaaagggcaggtttggagactgaatgattggggtatgagaaggctagcttacaaaataaaaaaagctaacaatgcccactacatgctgataaacttcgagttggatgccaaatatatcaacgatttcaagactctgttggaccaagatgaaagagttattcggcatcttgtgataaagagggatgaggcaatcactgaagattgccctcctcctccggagtttcatacactgcgtgcaaatgcagatgataatgatgatgaagaatttgatgaaaattatgatgatgactgggatggtgaagatgaggaggatggcaatgacggcgatgatggcgaaaatggtattatttttgtagatgacgacgatgacgatatagattctagaaatgagacaccagcaaatgttagacaaccagatataagaaaattgagggctgagaatgtaggtatgaaggttacattctcacttgaaaaactgccattgaagatcaccagcccagagaactgcatgcttggtaggttaggtgttgattctaatccatttcgttctaaatcatccaaacggataaaaagaaactaa

SEQ ID NO: 91826 - DNA, 762 bp, Glycine max
  Peptide Sequence Number=SeqID_208604
atggccatagtccaaagtttgaagctggtgtatctgctgcaattgcaattagaacttgtatatcttattttctgcctacatctcgtagaattgttcagttctcaaatgggagggaatgagtctttgagacgtagagaaatgagtagagagagaaacagtgagagagagtgggttagtgttaggaacagagggaggggtagagagagaggtggacagtgggagagaaaggatccccgacgtaactacgtcggacacaaggatgaacaacatactacccttactcgggcaaattggagggagagatccgacatctcatccttctattttacaagattcccaaaagatgcaactgaagaggatctttggagaaatataggtggtaggaggtatggttttgtgcggtttagaggggtgaataatgagcgcaatctggaaaggcagttggataacattatggttagaggattgaagttgtatgtgaacattccgaaatacaagcgagagatgatgagaaatgcagaatacaaaaaacaaatcaaaatgcaggggaacgatgacaaacatgaactggaagcagctcaacaaaggcaaccacaacataggataccttcgatatcatacccgacggtggtggctaccaacacctggaacacaaggaaaaggcggccttatgagaacgcgatctacagatacaatagatcacaatcaacagtccagattgatatcctgatgggggagaagaagtggttcagtgatgcttgg

SEQ ID NO: 91827 - DNA, 430 bp, Glycine max
  Peptide Sequence Number=SeqID_208605
ttgtacaactcgagttgtgctgggcaggagcaatctgctccggtccgcaggtatacttctcgcaaggcgctcaaatcggcatggacatgttcgcggctgccatggataacccaccgcagtgtttcgatggtgaaaccacgcttcagtcgtatttcaccgatttcgattatccaaataagcccgccgcgtgttctctcacgggttccggcgtagcgtcgggcatcggcgcgtactatcaagtgccgaagcccgatgcccttgtcaagctcgtcacaactttaagtgcaccgtgtgaggccgatatcccggatctcgtgctttacgaatccagcaaagaagatggtttttctgctcaaggtcaaattttctcgccgcaatgcgtcgccgacatcaagtctggatctgcgccgccaccggacaagtgctcgac

SEQ ID NO: 91828 - DNA, 321 bp, Glycine max
  Peptide Sequence Number=SeqID_208606
atggctcttccaagacaggatacagtgtttgattcagtttctctgacatgcggccacatattctgctacacctgtgcttgctcaactgcatcagttaccattgtcgatggacttaaggcagcaaatcctaaagaaaaatgtcctctatgccgagagggaagagtttacgaagatgctgtgcatttggaagaattaaatattctgctaggccgaagctgcagggagtactgggagcaaaggcttcagatggagagggtagagagggttaagcaagttaaggagcactgggaaacgcagtgtagggcgttcatgggcatctaa

SEQ ID NO: 91829 - DNA, 4506 bp, Glycine max
  Peptide Sequence Number=SeqID_208607
atgtcttctgcggcagcttcaacttggatcacgtccttctcgtgttcacccaatgcaactccaaatttacctcactggctgagattcattttcctctctccgtgtcctcagagggctcttttgtctggtgttgacattcttctcctgttgactctctttgtgtttgcgctaataaagctctattctaggttcacttccattggcaaccacaactcagagctcgacaagccccttatcagaaacaacagagtttctaaccgaacaacagcatggtttaagttaactctaaccacaaccgctgtttggactattttgtacacggttgcttgcattctggtgtttaccagttccaccgatgggacgtggaagcaaactgatgggttcttttggttacttcaggctataacacaactagtccttgcagttttaatcatccatgagaaaaagtttcaagctgttgttcaccctttgtcgcttagaatatactggattgcaaatttcatcttggtttctttgttcacagcttctggggtcatacgtttggtctctgtgggagtggaagatgggaaacacttcagcttcctggttgatgacacggtttctttcatttctctacctttgtctctttttctgctttgcgttgctgttaaaggttccaccgggattgtgtccggggaagaaacacaacctcttattgatgaggaaacaaaactatatgacaaatccaacgttactggctttgcttcagcttctgcaatatccaaggccttttggatttggataaacccgttgctgagtaaagggtacaagtcaccgttgaagattgatgaaattccatacctttcacctcagcatagagctgagaggatgtcggtaatctttgaatcgaagtggcctaaatcagacgagaggtcaaagcacccagttcgaaccacgttgcttcggtgtttctggagggagatagccttcactgccttcctggctgttattaggctatctgtaatgtttgtagggccagttctaattcaaagttttgttgatttcacggcagggaaaggtagctctgtgtatgaagggtactacctcgtgttgattctcctgtgtgctaaattcgtagaagttttgacaactcaccatttcaacttcaactctcagaagcttgggatgcttatcagatgcaccctcatcacttctttgtacaagaaggggctgaggctaaccggttccgcgagacaggatcatggagttgggcctattgtcaattacatggctgtcgatagccagcaactctctgatatgatgcttcagttgcacgccgtgtggatgatgccatttcaagttggtattggtttgttcttgctgtacaactgtctaggagcctcagtgattacggctttacttggacttcttgctgttattgtatttgctgtggtgtctacaagaaagaacaagcgttaccagtttaatgccatgatgagccgtgattcaaggatgaaggcagtgaatgagatgctcaattacatgcgtgtcatcaagttccaagcatgggaggagcatttcaatgggaggattttgggtttccgaaagtccgagttccagtggctttccaagttcatgtactcaatctgtggcgttattattgtgttgtggagcacgccattgttgatatcaactctcacgtttggtactgcgcttttgcttggagttcgactcgatgcagggacggttttcaccaccacaactgtgtttaagatcctgcaggaacctattaggaccttccctcagagtatgatatctctttcacaagcgctggtgtcacttgggaggttggataggtacatgtctagcagggaattgatggatgattcggttgagagagaagaagggtgtggtggacacactgctgtggaggtcaaggatggaaccttcagctgggatgatgatggccaacttaaagacttgaaaaatattaacttgaagattaataagggggagcttacagcaattgttgggactgtaggctcagggaagtcttctctccttgcttcaattcttggcgagatgcacaaaatttctgggaaggttcaagtttgtgggagtactgcttatgttgcacaaacatcttggattcaaaatgggaccatcgaagagaacattatctttggtttaccaatgaacagacagaagtacaatgaagttgttagagtttgtagcttggagaaggacttggaaatgatggaacatggggaccagacagagattggagagcgcggaatcaacctaagtgggggtcagaagcagcgcatacagcttgccagggctgtgtatcaagactctgatatatatcttcttgatgatgtttttagtgctgttgatgcacacactggcactgaaatattcaaggaatgcgtgaggggggctctgaaaggcaagaccgttattcttgttacacaccaagtagacttcctacataatgtggatcttatagtggtgatgagggacggaatgatagtccaatcggggaagtacgatgatctacttgcgtctggaatggattttagtgctcttgttgcagcacatgacacctctatggaactagtggagcaaggtgcagtcatgactggggaaaatttgaacaagccattgaaatcaccaaaggcagcttcgaataacagagaagccaatggtgaaagcaactctcttgaccagcccaagtctggcaaggaaggttctaaactcatcaaagaggaggagagagagactggaaaagttagcttacatatctataaactctactgcactgaggcttttgggtggtggggcattatagcagtaatctctctttctgtgttgtggcaagcatcaatgatggcaagtgattattggctggcatatgaaacatcagaagagcgtgctcagttgttcaatccttccatgtttatttccatctacgcgattattgcggtagtttcagttgttttaattgtgctaagatcctactctgtcacagtcctggggttaaagacagcacagattttcttctctcaaattctccacagcatcttgcatgcccccatgtctttctttgacaccacgccatctgggagaattctaagcagggcatccactgatcaaaccaatgttgatgtctttatccccttgttcatcaattttgtggtggctatgtacattacagtgatcagcatcttcataatcacgtgtcaaaattcttggccaacagctttcttgttaattcctcttgcttggttaaacatttggtaccggggttattttcttgcttcatctcgcgagttaactcgtctggattcaattacaaaagcaccagtgattcaccatttctctgaaagcatttccggggtcatgacaattcgcgcattcagaaagcagaaggaattttgcggagaaaacattaaacgggtgaatgctaatttgagaatggatttccacaacttcagttccaatgcgtggttgggtttccgcttagaattgcttggaagcttagttttttgcctttctgcaatgttcatgatcatgttacccagcagtatcataaagccagaaaatgttggtttgtctctctcatatggcttgtcattaaatgccgtgatgttctgggctatatacatgagctgtttcattgaaaacaaaatggtatctgttgagaggatcaaacagttcacaaatattccatcggaagcttcatggaacattaaggatcgcctgcctcctgcaaattggcccggggaaggccatgttgatatcaaagacttgcaggtcagatatcgtccaaacactcctttggttcttaaaggcatcaccctaagcatcaacggaggggaaaagattggagttgttggtcgaacaggaagtggaaaatcaactttaattcaagttttcttcaggctggtggaacctacaggaggaaaaataatcattgacggcattgacatatccgccttggggcttcatgatcttaggtcacggtttggtatcatccctcaggagcctgtcctttttgaaggaaccgtcagaagtaacattgatccaactggacagtacacagatgaagagatatggaagagtttggaacgttgtcaactaaaagatgcagtggcttctaagcctgagaaacttgacacttcagtggttgataatggagataactggagtgtggggcagaggcagttgctttgtttagggagggttatgcttaagcaaagcaggctgttgtttatggatgaggcaacagcttctgttgattcccaaaccgatgctgttattcagaagatcatcagagaggactttgcagctcgtaccatcatcagcattgctcatagaataccaacagtaatggactgtgatagagttctagttgtagatgcagggcgggccaaagaatttgattcaccagccaacttgctccaaaggccatctctctttggggcattagttcaagagtatgccaaccgttccagtggcctataa

SEQ ID NO: 91830 - DNA, 630 bp, Glycine max
  Peptide Sequence Number=SeqID_208608
atgggaaggtcgagaagaaagtacaagcaatcgagaaccaaggtccgtgtgggactccctaagaagaaccctaggcttttcaaaccctctttctccgttccacccaagctcttgcaatccctcgaccaagagcctcaatgggacgaccaaggcaccgttaacaccaactactcctcctttggcgttctctctgaccctaactccctcaccgaactctcttccgatcctcaaaccatcgattccggcagcgatctcgaagaagacgacttgaaatctgccctaggaaagaagcgaagggatgggaggagcgcgccgcctcagcctctgactgcaatgcaacggattcatatcagtcgtctcgtcgctaaatacggagatgattatcagagtatgttggtggatataaagctgaatccgatgcagcattcaattggaactctgcagaagctgtgcatgagttcctataacacttaccaatttgaattttggtcgatggggaaagagggggatttggatttgtgggtcgatggggaagtagggaaaatagaagggttggatttgggtttgtttgttggtggtgctgtgaggtgtgaggcagtgttatcttctttgcagccatggtggaattag

SEQ ID NO: 91831 - DNA, 1239 bp, Glycine max
  Peptide Sequence Number=SeqID_208609
atgtgggacgattccgacgaaccaatcgcgcgcgtcacacgccgactcggccgacgcgccgtcgctcacgccacgatgcgcgcgacgaacatgcacgggaccgcggtcgcctcgcgcgcgcgcgcgacgccgcgcgcgtcgcgcggggtggctcgatgctcgatgatgccgatgatctccagcgccaagacgggtgcgggggcgacggcgcgcgcggtgacgatgccgacgcgaccggcgcgcgaggcgagcgtcgcgcgcgtgagacgcgcgcgcggtcgatcggcggtcgtcgtcgcgtcgtccgcggcgagcggggacaacgagccgaagaaggatgaggggggcgcggatgccgaggcgagcgacgtcgaggcgagcgacgtcgagggcaacgagggcgcgcacgcgggcgaacgagcgcatcccacgatcgatgaactcaaggaggaggtgatcgaagaagaaatggaggaggtgacggtgatgggacgcgtttcagagggattgcgctcggcgagcgagaatccgggactgcgcaacttgggcgggcttggtttcttcttcttggcgagcacgttcgcgtattcgtgttacaaggtgttccgaaaggcaacgagcggacgggcgaggcgtaagcgcacggtgaacaagaacgtcgaggtcgtcgagcgattgaagcacttcttcccgcacgaacgcaacagtctgaacagaggcgtcgtgaaaggcttatctcttaagactgggtacacgtccgctgagattttccgcaagtacctcaggtacaagctcacagaggagcctttcaccctcgatttcgtcgcggacgtgctcgccctgaagaacgcgtgtgaattggatggtgaagagatgaaggagattctcgtcgagtcgggcgagcgaatgttgaaaaaatatggaactctcatgaccaacttggcgggtcttacgcagtccggcatggagcgtaagatcgacggcgccggcaagtttgctaagttgatgtacctcgccgacttggatgaattcatcgacaagaccgccggcggcgaggtgcagctcaagctcaaggagatgttcggcgccacggacgaagactacaacaaggtgaaaatcaccgccttgggttcggacgaggtggacgtctcctccttgaataccatgatcgcctccatggacgagtcttccgagacgggcgaggagacgacggacagtgaacggcccgccgaagagtga

SEQ ID NO: 91832 - DNA, 438 bp, Glycine max
  Peptide Sequence Number=SeqID_208610
atgacgaaggacgacgaaccgaaaccgttccttctcatcgctcggtgccgggccaagcccgagaacgtggacgcgtacgtcgacgccgcgcgcgtcgccgatgagggcgtgcgcgcgtccgagcccggcatgttacatcacaccttcgtccgcgacccggacgacgcgtgctcgttcgcgtggagcgaggtgtacgccgacgcggacgcgttgctgtttcatctcgagaacccaccgttggtggagttcgtggcgcgacacgaggcgctcggcgatcggttctcgatcgaggtgtatgggactttggatgcggcgaccaaggcaaagttttccgccaccgggttcccgatcaagcgaggagaaccaccgtccacgccatcggcgcgcgcggcggcgacgtcgctcgagcgtagtagccgtgaggggatttaccctcgg

SEQ ID NO: 91833 - DNA, 678 bp, Glycine max
  Peptide Sequence Number=SeqID_208611
atgtgcaatatgaaaaaatctcaagaaatactaatctccgcagctggaaacccttcaagctccaacaagacgggccccaccctaaaccctactaccacaaacgcccctgcctctccgatcgcacaaccacctcgttttccctcgacatgtccaaactcaccctcgccgccgacgacgacaccattcacaaccccaacaacaaccgcgccaccaattaccgcctcgtcgcgcgcaagaggcgccgccgcggctcccgatccctgtccggcccgcagcagcgaccggagcgggacgcggcgctgctgctccgtgggggcctccgccgcttacggcacctgctccgatttcccggtggccatgggcaccgattccagtggggagctcttcggcaacggggatccgaattggtcttcggacgtgagcgaggcgaagaattcgaggagggagagagagagggatggcgagaaggagaatgtgggtgttgggtttggggtgagtggctgctctgatgcaaatggtaacgaatctgggtatgggagcgaaccgggttatcgcggggatgctgagtttggatatggggatgagtttgatgaggaagaggatgatcccagattgttgttctggggtgaccaacttggagcagcatgtagcagtgagccccgaaaacgctatagctga

SEQ ID NO: 91834 - DNA, 588 bp, Glycine max
  Peptide Sequence Number=SeqID_208612
atgactcacgattttgatattttgtccctccagcgacgacccgaaaaaagatattttccttttctccagacgacgacgacgacgtgcgaacgaaagacgtgtcggcgaacgacggcgcgacgcgcacgatcgagagggatgtgggcgacgcgcgcgatcgatgacgatttcgatggcgcgcgatcgccgtcggcggggcgagagcggcgtcggcgaggcgagaaacgcggacgcgagaggcggatgatgcgagggcgaattgcgttcctcgctgcgctgacgttggcgctgacgttggcgcccgcctggggatgggcgaagggcgaggacgatgcgacagaaggaaagacaacggacgacgagagcccgatggtagaggacggcgttcccttcgatgcgccgagtcagtctttcgcttccaaagaagagttacgcgcggcgctcgagaaagaagcgcgagagcgcgggtttgaaatccctgaaaacgttttcgaaatgtcgtccgccgaggagacgatggcttcgctcggtgtttcgagcgcgggaaacgagacgggcgatctcggcatttttcgacttcatttacaa

SEQ ID NO: 91835 - DNA, 204 bp, Glycine max
  Peptide Sequence Number=SeqID_208613
atggcagaaatcattatcgcaagtacagcacttcatacttggatcaatgtctacagaagcggattgatcccacatcatattttcatactcgctaaaatacttcggattggcaaatgggtcaggccgtgggtaagcaccaaaaccacttggtcagggattcatgcacaaaaccctggaaagattggactctgttcagtctgttga

SEQ ID NO: 91836 - DNA, 180 bp, Glycine max
  Peptide Sequence Number=SeqID_208614
atgaagactgttgtctgcctggtaatgttatgcaaccaaagggttatggtgccttggtgcaatgtgagactagaggaagccagaccagcaataccggcaaagtgtgagagacccagaacaaaaaagacatgcaaaagcagcaatgatatgatgtgtgactgcgaaaccagcaagccctag

SEQ ID NO: 91837 - DNA, 510 bp, Glycine max
  Peptide Sequence Number=SeqID_208615
atggaggtaggcggagcttggatggcaacaattcacatcaagcagtctccaaatggtgataaatgggtatggacaaatgatacgagtggaaaatacacaattagaagtgcataccaattaatggacatgaactcaaaagatgataatacagatagaatttttcatgccatttggaagctaaaaataccaaacaaggtagatctggtgggaatcattgtctttgatcaatatggtgggctctttttcgcaacaccaaggcaaaatttcatgcaacactctgtctgcaatacacgccttggtatcaagtcacagggatggttaatttggtgggtggcactaacttggagtaaatggaactatagaaacataatcatattttcaaacaatagtcccaacaccagggtatcaatttgtaccataaacggggatctccaaagggactatcctattcagggtcccgcatatagggaatattttcccacggggacggggataaatatttcgccatag

SEQ ID NO: 91838 - DNA, 198 bp, Glycine max
  Peptide Sequence Number=SeqID_208616
atgcggaatggactgagttccgagttgggaagagaccgcgactcagtcgccggggacgggaatgagatgcgggtcaacgtgtgtgggaggggggaagggaaggctttcggtgcaaagacggaactgcccctgtcatttggtgcgaggtcaaggttgggtgagattttgggtcggggggttttcagaaatttgcactag

SEQ ID NO: 91839 - DNA, 180 bp, Glycine max
  Peptide Sequence Number=SeqID_208617
atgggattggctaataggtgtaagattttaatgcggtatctgaaatatttgaccaagaagtacttgaaaaagcacaatgtgagggattggcttcgcgtgattgcatccaacaaggagcggagtgtctatgaattgagatacttcaacatcgctgagaacgagggtgaagaggaagactga

SEQ ID NO: 91840 - DNA, 1707 bp, Glycine max
  Peptide Sequence Number=SeqID_208618
atgcgtgcttccgcgaaggcgatatcatgcacgcacccaagtcttcatctctcccaccccaacatcgaatcgttcgtgtggaacaacctgattcgagcaagcactagaagcagagttcaaaatccagcgtttccgccagcactctctctctaccttcgcatgcgcctccatgccgtgcttcccgatcttcacaccttcccattccttctccaatccatcaatacccctcatcgaggtcgccaactccacgctcaaatccttctccttggtctcgccaacgacccttttgttcaaacctcccttatcaacatgtactcttcatgtggcacccccaccttcgcccgccaagcgttcgacgaaattactcaacccgacttaccctcttggaacgccatcatccatgcaaacgccaaagccggcatgattcacattgcgcggaaactgttcgatcaaatgcctgaaaagaacgtcatatcgtggagctgcatgattcatggttacgtaagctgtggcgagtacaaggcggcgctttctttgtttcgcagtttgcagacgttggaaggaagtcaactccgacccaatgagttcaccatgtcatctgtgctctcagcttgtgcgcggttgggtgcgcttcagcatggaaagtgggttcatgcttacattgacaaaactgggatgaaaatcgatgttgtgttggggacttctttgattgacatgtatgccaaatgtggaagcattgaaagggcgaaatgcatattcgataatttgggtcctgaaaaggatgtgatggcatggagtgccatgattactgctttttccatgcatggactctcggaggaatgccttgaactgtttgcaaggatggtaaatgatggtgtgaggcctaatgctgtgacgtttgtggctgttctttgtgcttgtgtgcatggagggttagttagtgaaggaaatgaatatttcaagaggatgatgaatgagtatggtgtaagccctatgattcaacattatggttgcatggtggacttatacagcagagcaggtcgtattgaggatgcttggaatgtggtgaaatcaatgcctatggaacctgatgtgatgatatggggagctctgcttaatggggctaggattcatggggatgttgaaacttgcgagatagcgataacgaagcttcttgagttggaccctgcaaatagtagtgcctacgttcttctttctaacgtgtatgccaagctgggacggtggagggaagtgaggcatttgagagatcttatggaggtccggggaatcaagaaacttccagggtgtagtttggttgaggtagatggcgttattcgtgagttttttgctggggataattctcatccagaattgctaaatttatatgtaatgcttgatgagattatgaagaggttggaaaagcatggttatgaacgtaacactggggaggtattacttgatttggatgaggaagggaaggagtttgcattgtctcttcatagtgaaaaactggcaattgcatattgcttcctcaggacaagcccgggtaccacaattcggattgtgaagaacttgaggatatgtagcgattgccatgttgcaatcaagattatatctaaggaatttaatagggagattattgttagagattgcaaccgatttcaccattttaaaaatgggctttgctcctgcaaagactactggtaa

SEQ ID NO: 91841 - DNA, 291 bp, Glycine max
  Peptide Sequence Number=SeqID_208619
atgtttagtgacctcgcagtcttgctcccaagcctagcacaacttgtagtcttgcactcggcacagcagccaatactcgagcttgctcatccttggcccgagtgggtccaactcatgaagtgcttgctctacaagggatacttctgtcgtgaagagggaaaaatgttatgcaatgctggtatgggcatgaaggatttcgatgtcattagaaccgtgtgcctcaattttggtagagaccactttcatcttttaagatttggccgtgatttagaactctgtgacagactgtga

SEQ ID NO: 91842 - DNA, 810 bp, Glycine max
  Peptide Sequence Number=SeqID_208620
atggaaaatgtggtcaagcacacaaggaaggtagtggaggtagatcctgttactaaaactgaaactattaggcatgaaaaagtttggaattacactattgcggatattagcttgttgacctttggaactagctttccccagatatcattagccaccattgatgctatacaaaacatagggaagctgtatgctggaggtttgggacccggaacacttgttggttctgcagcatttgacctgttccccatccacgctgtttgtgtagtagttccaaaagcaggagagctgaagaagattgctgatctaggagtatggctggtggagctgttttggtcattctgggcttacatttggttatacataattttggaggtatggactccaaacgttgtgactctctgggaggcattgttgactgtactgcaatacggattactattgactcatgcttatgctcaagacaaacgttggccatatatttctctacctattgcaagagatgagaggccagaggattgggtgccggaagagactccttattttcaacatgaagcccatgcggaggtggatttctctgatataaagcatgttaatgaagaaaatggggacactgttgatattttttccattcattcagaaaaccccacggatccattatatgccagagtaccttcaataaatgatgaggctgaaattttggacaaagctaaggaaacgacattggtggatacacacttgcttacaatttggagacagcaatttctggatgcactgagggtatttcgttttatgttgcaagtgtatctttaa

SEQ ID NO: 91843 - DNA, 298 bp, Glycine max
  Peptide Sequence Number=SeqID_208621
gtttctgtttgcatttgttcctccatgccaaattgctcatggatggatctccttcatttgctctctgcttttcatctctgggatagcttacgttgtgactaagatcacagatgttataagttgtgtcacagggataaatgcttacgtgatagcatttacagccctagccagtggaacctcatggcctgatctagtggcaagcaaaattgctgcagaacgtcaaaaaactgctgattctgcaattgcaaacatcacttgcaggttttccatctcaacatttacctcattcttgctttag

SEQ ID NO: 91844 - DNA, 1857 bp, Glycine max
  Peptide Sequence Number=SeqID_208622
atggttccgtttattattggcgcggcagcgatgggcaccagcactttctttgctcacaacgtggcgatgaccgtgctgctgttctcgattgcgcaggcgatgattatcggggcggtgccggtgtttttcagtctgcccgctacgttcctgaaaggcacggcggccgcggcgggttttgcgctggcctgttcgatcgccaatatcgccggactgcagcaacggcgcgctgtggttcttcgccgtatgcctgctgctcagctcgctgttggtggtcgcgctgccagcgaagctggtgaatcggtagaagatacctgcgcgttaaagcacttgttattccctgggccgccattcatggcgacccggttgcataatctgcacaaccaagtgcgcatcaatgcgcaccctacaaaacagtgcgaattcgttgtaattatcgccgtagggtcgccattcatggcgacctggttgcataatctgcataaccaggcgcgcatcaatgcgcaccctacaaaacagtgcgaatttgttgtaattatcgccgtagggtcgccattcatggcgaccgtctcacagccgcaggatgcagctccacaccccgccagaccgtcacgcccacccgcacccaatcctcctcgcttatcggttatccataagattggttctaccaacaccggggagtctatttcgatgaaaactacaattccaaagctgtcgttcatgatgttcttagagtggtttatctggggggcatggttcgtgccgctgtgggcgtttctcagcaaaaacggcttttcgccggttgagatcgcctggtgctacgcctgtacctccatcgctgccatcctgtcaccgattctggtcggctcgctggctgaccgtttcttccaggcacagaaagtgttatcgctgctgaccatcgccggcgcgatcctgatgttctttgccgcacagcagacgcacttcagcagcttctttccgctgctgctgctgtatgcgctcacgtacatgccgaccattgcgctgaccaacagtattgcgttttcccacgtcggtgacgtggagcgcgactatccgcgcatccgcgtgatgggcactatcggctggatcgcctccggcatcgcctgcggtttcctgccgccgctgctcggctttggcgatatctccgccagcaatgtaccgttgctgatcaccgcggccagttcgctgctgcttggcctgttcgccctgaccctgccagccaccgaacccaaaagcaccggcaagttcagcctgcgcgtggcgctcggcctcgacgcactgcatctgctgaaagatcgcagcttcctcgtatttttcgtctgttcattcctgttcagtatgccgctggcgttctactacatcttcgctgaggggtatctgaccgaagtcggtctgccacacgccaccggctggatgacgctcggccaggtatcagaaattttcttcctgctggcgctgccgttcttcattaaacgcttcggcatcggcaaagtgctgctgctcggtctggtcaccgccgcgctgcgctacgtgttctttgtgttcggcggcgatcaaaacctgctgaccttcggcctgctgtttatgggcattctgctgcacggcgtcagctacgacttctacttcatcaccgcctacatttacgtggataagaaagcgccggtggcgatgcgtaacgctgcgcagggcctgatcaccctggcctgtcagggcatcggcagcctgctgggttaccgcctcggcggctatctgatgcaggagatgttcgcgtatgaccagccgcgcaacggccagacattcaactgggcggggatgtggatgtttggcagcgtgatgatt

SEQ ID NO: 91845 - DNA, 625 bp, Glycine max
  Peptide Sequence Number=SeqID_208623
atggaagacatttgtaagaggtggactgagtatcttgacagcacacgatcaagggtcaatcacccacaatcgataaattgtgatttttgtggagaagagcatttcaatgacaactgtcatctctactccatgaaaaattcttggtggggacaagagttatacccttacaatcaatatgaagaaagaactcctaatcttgaaagtgtgttcacgaaattcacggcataccatcctagctctactgccaatcaaaactcaatgcaaaatcaggaaattcaggttggaaacagctactccatggaaaattatcaatgggagcaagagttacaaccctacaatcaatatgaagaagaaagaacttctaatctggataatttattgatgcaattcaaggaagtcactgaatatactcaacaagcatttaaaagttttgaaattcaagttggtaagctagcagaagaagtgactaaatttatggccagaagagaagaaaactttataaaggttgaagctcaagaggaaagccctgtacgaaagcatgattcaaaagaaaaagatgaagataaaagtgaggagaaagcacaacaatgggagaagtactcacaagtagaaattcaacaagaaa

SEQ ID NO: 91846 - DNA, 516 bp, Glycine max
  Peptide Sequence Number=SeqID_208624
atgccgccctcacatccgttgaatcagcgattccaacacggacgaagacaagggacaggatttggacagtgcagtcgccaacacagtgaatggtgcttcttcttcggtagagagtcagtcctagaagcgaaggacgaacgtggctgggggagtggttttgccggttggtttcctcacccctctccctttggcgccggcgcctcctcccactgcagtgttgtcccactgcgctgcatccttttacatggatggccctgcattgtcatggtaccaatggatgtcctggaacgggtttttcccttcctggcaggccatgcttcaagctctggaatcacggcgatcgatctcgcacgactccaggaagataagatgctggaccgccatcatggccagcgcagtttttcgactcaccattcacccttgttgcctaaacccttgacccctttttctaccccttcgtctaagcttcccgtcaagagactcacagcggaggagatggcagtctgccgtgaatag

SEQ ID NO: 91847 - DNA, 285 bp, Glycine max
  Peptide Sequence Number=SeqID_208625
atgtcgaaggtgttgctcgcagatgctttaaattttttagttgcatccaaaaaatatatccatatcaaacggagtcatggaagacgttacctttggaagatgaccatggataacggtctcccatctgttgttgatccatggtacaaatacttgacgaaaaatgatttgatgtcgggcgatgatgttgtcttctactacaggttcaatgaacgtgcatgggaggtcatgtttcggaagcaggttaaatgggatgaagccgggtgttcgcttttgtttgatgattaa

SEQ ID NO: 91848 - DNA, 636 bp, Glycine max
  Peptide Sequence Number=SeqID_208626
atgggggagcagtggagacaattcaagtatgatttgacatcgaaatgggcatttgcagacgacaaggaaagtgtcgacgacactgatatgcgcaagaaggcacaagccaaccagaaacataacattgcccctcacgtgttgtctcgtgagggttatgaatattcagaaaacaagttgatggatgagaagagaaagaaaaaactagaggaagttgctcaatccggaagcactgacaccgtgattgatcctctatctcccatcagacaacacatgaaatggaagatggcccgcacaaagaaaactgggcaaatgacgtctgaggcagcaaaggaaattgctgagaagattgaatcgttggaggagcaggcgtcatacggtttcttcgttgccattgggcgaccagaacaccgtagtcgtgtaggtgttgttggagttggtgtcacgatcaagaaatactttggactggctccaaggacctcccgtatgtcttcctccatggctcccgaagacctggagcagctgatgcaacaaattagggaccagttggaggagtcgatcactgaaaaagtgactcaacggctaatgttatcctttcaagccacagtccatccagagatccgagcaattgaaatttga

SEQ ID NO: 91849 - DNA, 429 bp, Glycine max
  Peptide Sequence Number=SeqID_208627
agacgatacttatcataccgttgtctacaactgagatctggaccaaccagccattgtggctgggtggacaacactacctcatttttaccagctaaccgcagatcatctcattttgttgcatcattatgggttccttgcctgccgaagtcattccccaagtggcactctttgtataatcaagtgtcaggttctgtgaccttcaaggtttttcttagtgagcagaaaatttcctgcagcagtctggacattccaacagaatgtcggcttgtgttcaatcatcataggaagtcactcaaaattggagccggatggagacaattctgccagaccttgtctttggatgctggcacagaaatagtgtttgagttcattaatccccgtgttaaccgcgttctgtattggctctgctctgttgatgaaatgcgttag

SEQ ID NO: 91850 - DNA, 435 bp, Glycine max
  Peptide Sequence Number=SeqID_208628
atggcagtcaaacgtccctcacgagactggcagcacaaaccgaaaaaagctcattgggttaaccatggcttcccgaaaccaaactggtggaagaataaacaaattggtacattaaacatgtgggtacaagtgtacaaccaaataaattgccgaactggaacgggaactggtgctaactcgaactccaactctaactcgaacgggaatggagttgacgaggacaaacgacctgagcgatttaggtcaatcaatgtgtggggggaaaaaggattttcgggctttgaacttatgaatgacacaacatcgagaagatgcattggcgacatgttggggatatccatgcgaataaggcaagtgcagctgaatgacttgatcaattacccaaataaaaatgggtacaatgcttcgatgaggggaaacgttggggacatatga

SEQ ID NO: 91851 - DNA, 366 bp, Glycine max
  Peptide Sequence Number=SeqID_208629
atggttgaattcccagacaacgaacacggccgatacgtcgtcaaggtggacggcgtgacggatgcggcgggtaacgccgctaaacgatttgagttgacggttgatgctcactgctctcgcgcttctccgtcgaagagcagcgcacttggtgtgcaggatcgtagcgctggtgcgccatcatcagcgaagagcgtgcgaacaacagcggacgcgtggatgtccattggcgtcgtcgcatcattcgtcgtgattgtcgcgatcgcggcgcttcgccgtcgaggaggcgaagataacgacgcgcagacggaaacgctgttgtgtgccaacaagggcatcgctgccggaggttacggcgcgacgctttaa

SEQ ID NO: 91852 - DNA, 588 bp, Glycine max
  Peptide Sequence Number=SeqID_208630
atggattctccttatgtacgccgcgtggcggtctccctggaactttatggcgttgcgtttgaaagccagccgctgtcggtattcagcacatttgaggaattttcccggatcaaccctgcggtaaaagcgcccacactggttctggataatggaacacgtctgatggactcatcgctgatactgaattattttgaggcccaggctgcccctgaacggagactgctgcccgtggcaccggatgcgctggcaaacgatctgcagacgctgggctttatcctcgccgccgcggagaaagcggtccaaaatgtgtatgaacaccacctgcgcccggcggagaagcagcacaatccatggatagaacgcatcacccaccagttgctggctgcctgccgggaatggaacaccctgctggaacggcgtccggataatgcggtggccgatcaggttgcggtcaccagtacggttatctggacatttattcagtcaatgatccctcacgtcgttaacgccggtgattttaaaaagattcaggcggttgccgacgttttcgaaaaccaggcggcatttaagaagtaccctttcagttaa

SEQ ID NO: 91853 - DNA, 543 bp, Glycine max
  Peptide Sequence Number=SeqID_208631
atgttgaccctaggtaaaatcaaggatgctacaggtgtgtctggtggggacaagtatcccctaagcgtgcaaaatatcaaatttggatctaaattgtatgtcaatgctgacattacaaagatacacgaatttcgtcaaagtttgtttgtcccattttattctggtgggataatccatgataaagatggttctcagtcccaatctagccagagtaatgtggtggaaaaaattttgcaaaatgctcaggtggtcagtataggtgaaatcaacaatctcagacaggattgttactgcttaactcttggaacagttgacgaaatcatcattgatgctccatggagttatgacagttgtcctaactgtacaaccacatttgatccatcaaaaggtggctcagcttgccgttcttgccatactagtgtgatcgatacagttccacggatgaagcataatagggacaaaggaaacttccttctctgggatgcaacatgtatcaagctgtttggtaagactgctggagaatgtcgagatgagttgatagcg

SEQ ID NO: 91854 - DNA, 264 bp, Glycine max
  Peptide Sequence Number=SeqID_208632
atgggaaactttagggaaaaggaagtgttcccgttgatgttcgaagatatcaaagcattgctttttgagtgtgttaatagaatgaaacacattgagattgatcgccactttataaagaagaaattggatgctggaattatttgcttgtcatttatgtcttccaatcagcaaacatctaacatcttgaccaagagcctagcaagacccattcttgagtgtttagcaagcaagttggacatgctagatatctatgcaccaacttaa

SEQ ID NO: 91855 - DNA, 1656 bp, Glycine max
  Peptide Sequence Number=SeqID_208633
atggcgtcaagtaaaatgagggtggaggagctgcgaacggagctcctccaccgtggactctccaccaccggaaccaaacccactctggtccgtaggcttgaagccgctcttcgtaaacaaacgacgagtgacggtggtgcttgttctcctcgtaggactagaaagagagcaagggattcgaaccactccgaagaaatcgaggttgcagaggagacaaaagatgaggaggaggaggaggagaagatagtcaccgctacccaaaagggcgtggcggttctcgaccagtggcttccggattacgtgaagacaaactatcatgttctgcaactgggtggtgacgtatatgatgccatgttgaatcagacaaatgttcgggacaacaataacaagttctatgtcattcaagttctcgaatcagataatggcagtgacttccttgtttacaatagatggggaagagtaggtataaagggccaagatacgatacatggcccttttaaatcacgtgagagtgccattcaggagtttgaacaaaagtttttagctaagaccaagaatgattggtccaataggaataattttgtttcctatcctaaaagttatgcttggttggaaatggactacagtggcaagaaaaatgaatctactgttacagaaaatcctggccattctttaggaaagcagcctcaggaatctaaacttgagccacgtgttgcaaaatttatatctcttgtttgcaacatgagcatgatgaatcagcaaatgatggaaatagggtacaatgcgaagaagttgccccttggaaaacttagcaaatcaacaattttgaagggctatgaagttctcaaaagacttgctaatgtgattgataaaggtgataggaaagttctggagcaattaagtggagaactctacactgtaattcctcatgattttggattcaaaaaaatgtgcgagtttgtaattgacacccctcagaagttaaaacgaaagttagaaatggttgaggcacttgctgaaattgaggttgccacaaagctcttgaaagatgacacagaaatgcagggagatcctctgtatactcattatcaatgccttcattgcgaactggtaccagttgaatttggttgtgtggaattttctatgattgaagagtatatgaagaacactcatgcagaaacacattcaaactatacagtggatattgttcaaatattcaggacatcaagagaaggtttgcgcatagctcctcctgaggcacctgtaactggctacatgtttggaaagggggtgtactttgctgacatgttctcaaaaagtgcaaattattgctatgctactcgaactgctaaagatggtgtgctccttttatgtgaggttgcactgggagagatggctgagcttctaactgcaaaatatgatgctgatcagttgcctaatggaaaactgagcacaaaaggattaggaggtactgctcctgatccttcaaaagctcgggaacttgaggatgggctcgtagttcccctaggaaagcccaaaacaaaatcaggcaaaaagggccatctattgtacaatgaatacattgtttataatgtggagcagattaggatgcgatatattgttcacgtaaatttcaattttaagactagaagttag

SEQ ID NO: 91856 - DNA, 789 bp, Glycine max
  Peptide Sequence Number=SeqID_208634
atgcatggtgaaatttgtgctttagaaaggaatcatacatgggtgcttactgatttacctcagcataaaaatgtgattggttgtgaatgggtgtacaagatcaaacataatgcagatggctctattgaacggtataaggctcgtttggttgctaagggctatactcaaattgaaggtctggactatttagatactttttctccagtagccaaaattactacggttcgacttttgttggcactcactgctttgagtatgaaatatactaaacttggtcaagtttgtaagttacaaagatctctctatgggttgaaacaggccagtagtcaatggtatgctcgattatctacttttcttgtggctcatggcttcaaacagtctagtgctgactattctctttttactttgaaaagagaaaattcattcactgcattattggtctacgttgatgatattgttctgagtgggaatgatctctctgttatttctcatattacaaaattactagatgacacttttaagatcaaagaccttgataatttggagtattttcttggatttgaagttactcatggaacctctgctaatcttatcttccatgaaagaaccaagcatattgaaattgattgtcacttggttcgtgataagctgctttcgggtttgatcaagctcttgtctattgctttagcacaacaacttgttgatgtttacacaaaggctttagctcctggtgcttttcattttatccgctccaagctaggtatgaatgtcattcattccctagcttga

SEQ ID NO: 91857 - DNA, 249 bp, Glycine max
  Peptide Sequence Number=SeqID_208635
atgaagcacttcactgacaccctcatcagtgccaacataggaacaaaagctggtaccgggccccccctcgaggtcgacggtatcgataagcttgatgtcgctgataaagcgctcgcggtcgagccgccgctcatgcagcaacgtggcgatctgtttgtattgatccggttcgaggtagcggaaggacaagtcctccagctcccacttgatatggccgatcgaattcctgcagcccgggggatccactag

SEQ ID NO: 91858 - DNA, 851 bp, Glycine max
  Peptide Sequence Number=SeqID_208636
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcggccatatcaagtgggagctggaggacttgtccttccgctacctcgaaccggatcaatacaaacagatcgccacgttgctgcatgagcggcggctcgaccgcgagcgctttatcagcgacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 91859 - DNA, 273 bp, Glycine max
  Peptide Sequence Number=SeqID_208637
atgatcctcatccccatccttgtcgtgcctgaggtgaaatatttatcctcgtccccgcgagaaaatattccctgtctgcggggccctgaaaagtacagtcccttcagggatccccatttatggtacaaattgatacccctattgcagagtgggaatcaaatgttgatcaccgaaggtcaatttcaggtaagttttggtacaagtcgtactgtgatttttacaatcatcaatgaagtctcccatgtggaggtttggttccctaatacaaactaa

SEQ ID NO: 91860 - DNA, 174 bp, Glycine max
  Peptide Sequence Number=SeqID_208638
atgaagaaaaagtgtcagaagatcagaggtcaagaagatgaaaggtctaagcaaggtgaacaaccaaaaaaggtgctaatgggcaaaaattctcctccccaatcagtttgcgaggtagagaaacatgtttctattgagggtgtagaaacaaggttaaaaggatataaatggtaa

SEQ ID NO: 91861 - DNA, 585 bp, Glycine max
  Peptide Sequence Number=SeqID_208639
atgcgcgagtatgaatctgtacatgccgttacatcggctctcgatgatccacatgcccaaatcctgtcatacatcaatacgaagagttctgacacgctcaatcgatgtgtcactttgtctgctcttacttcacactgtgagtgtacatcgaaattaacggcgaagcaggtgatggattcagtgaggcttttacaacgttgtgcttatctttcagtgagtcatcttcatgatgtctctgacgaggagtgggttagattaaatcctgaacacgcacttcatacagccctttcccacttagctcagaccacagtcaaacatcggtttggggatattgcgtgtcgtttattccgccttctcctcaaaacacctcaattggaacaaaaacaaatctcagagctagcgatgatcccactgaaggattgccgcgaaattttaggcaagcttttgaagcacgagtatgttcgcatgcaggaggttgctcgaacaactgatcatgcaccttctcgaacgaactacctttggaaagttcatttaccatcggttatctcaaagatgaaacgagaactatcagagacgttttgttaa

SEQ ID NO: 91862 - DNA, 1144 bp, Glycine max
  Peptide Sequence Number=SeqID_208640
atgaccaacttgtacacgtgcctcgatggctttgcgtacagcaaagggcgcgtgggggacagaatcgagaagaagctgcttcaaatatcgcatcacgtgagcaactcgttggccatgctgaacaaagtgcctggagttgagaaattaacaacttcttcggaatctgatgaggtgtttccagaatatggaaagatgcaaaaggggttcccttcgtgggtgtcctctaaagaccgaaagcttcttcaagctaaagtgaatgagaccaagttcaatcttgttgttgccaaagatggcactggcaacttcaccactataggggaagcactgtctgtggctcccaactcaagcacaactaggtttgtgatacacgtaacggcgggggcatacttcgagaatgtggaagtgataaggaagaagacgaatctaatgtttgttggagacggtattggaaagacagtagtgaaaggcagtaggaatgtgaggacggcaaagtttgctctttattgttcatttatgaataatgatccaaaatctaatcctaacagcgttgacaataatggaaaatggtatgttgcagctgttgtaggagcaggattcatagcaaagggtataacatttgagaagtcagcaggacccgacaaacaccaagctgtggcactgagaagtgacttcattttcggcaatgcagctgtggtattccaaaactgcaacttatacgcacgcaagccaaacgaaaatcagaagaacttgttcatggcacaaggcagagaggaccctaaccaaaacactggcatatccatcttgaactgcaagattgcagctgctgcagatttgatccctgtgaaatcctcgttcaagagctacctaggacgtccttggaaaatgtactctatgactgttgtgttaaaatcttacgtggatatagacccagcagggtggttggaatggaatgaaacatttgcattggatacgttgtattatggggagtacatgaataggggtccatgttcaaacacaagtggtagggttacgtggccaggttatagggtcattaacagctccattgaggcaagccaattcacagttggacagtttattcaagacaatgattggttgaacaacactggcatcccattcttctctg

SEQ ID NO: 91863 - DNA, 804 bp, Glycine max
  Peptide Sequence Number=SeqID_208641
atggaaagcaaaagaaacttgttgtgggtgatgggcatatgcatgtggttggttctagcacatcaccgaagcggtgcggcggaagaaaaaataggcaaggagctaattaagagcatatgcaaaaacaggggaaacaatgaattgtgcatgcaggtgctttcctcggacccagacagtgatcacgcggacctagaggagctggcaatgatatctctgaaggctgcggcgtcaaatgcgagcagcattctaaatgattgtaagagaatgatcgacgaccagaatttggaacctaaggttcaacagggtttggctgattgcaaggagaatctgttggacgcagagagtcaaattcaggatgctattgcgtccatattgtccaatgacaagcttgatgctcaggtatggctcaaggctgcattggctgctattgatacatgtgacgattctatccccggcgatgatgatattctctctagaaagagtgtggcgtttcgccaattgtgcaacattgccgtcgccatcaacaaggccattttgagaagtgattatgggagtcatgatggtgcctatgagctggacgcctcacaaacgggacggcgtaggaggtatgtgttgactaaggtcaaggaaatgacggcttgtgaaagggatcttatgaaggagacgctgccgttttggggagggaagagggagttgcagaaggatgggtcgaataatgaggggaggaggagaaaggttgatattgttgggagggaattacgtaacttgtttgccattgggaggacttggttagattgctcatga

SEQ ID NO: 91864 - DNA, 963 bp, Glycine max
  Peptide Sequence Number=SeqID_208642
atgactttccagataaccaaaaggcaagagagaatattggcactctatgaagctaataatagcctaatactgatcaatgacagtaacaaaggaaagggagggttttcggtttcccaaatcgagtttcctaattcgaaaatcatcgcaatccaagccgcaaccacactgcggggagacgaagaagttatcgaggggaaaggaagcggaggcgacgccgacggagaaatcgaggtcttcgccgacgcgaacgacgtcgagaatgttgagccagaagaagaggatcttcacgctaatcccgcggagttcggtgagcctgccttcggatacgtagccggtgatggttttctggtagctcaactggtacgaaccttcgagggagaaactgcacgaaccgttcagatcggcgctgaatttgccgctggacggatccagctcgtaaccggtcactcccttggggagaatacccgccggaaagtgaaagctctccagcatctcgtacgccgtcggggtggcggtgatcgccggcgagaggaggaggaggagaaggaaggtggtgatggacatgctccttctattattggaatcgaattgaaatctggtgggttcatggaggtgtatatgaatttaccacttggttatcatgtggaggattcaggcttggcctgcaaacttcacaagtctctttatggcttaagacaggccttaaggttgcttgatcttctaaaggaatttatctttcatagagcaaatatactttatctctttgaagatactaatcttttggcttccaaactctccattcttcttatggatcgaggagttaagcttactgcatttgatggccagccatcggaagatgctttgatttggcgcctgatgaatctacttgtgttgctcacaaactcagcctatctgcaagttgttcataatcttctgagacatttgaaagactcacctacctag

SEQ ID NO: 91865 - DNA, 1680 bp, Glycine max
  Peptide Sequence Number=SeqID_208643
atggccaacaacaagttaacctttgtcatcatcctcatcttcctaccctcattgttagctttggctgacatcactcccaacacttccgtttctcccggaaccatatgcaaatccactccagacccttcttattgcaactccgtgctacctccccaaaacggcaacgtttacgaatatggcaggttctcggtaagaaagtccctttcacaggccaccaatttcttgaacttagttaacagatacctccaactccaacgccgttcttctctttccacccccgcaatccacgcgctcgaagattgccaaagcctcgccgaactcaacatagactttctctccagttccttagaaacggtgaacagaacaaccaaatttttacccacttcacaggctgatgacattcaaactcttttaagtgccattctaacaaaccaacaaacatgcttggaaggccttcaagccaccgcctccgcttggcgcctcaagaacggactctccgttccgctctccaacgacactaagctatacagtgtctctctggcactcttcacaaaggggtgggtcccagaaaatgctaatgtcaccgcgtttcagccaagcgccaaacatcgcgggtttcgaaacgggcgtttgccgctcaagatgtcgagcagaacgcgcgcgatctacgagtcggtgagtcggagaaagctcctgcaggcgacggtgggtgacgaggttaaggtgaaagacattgtgacggtgagcaaagatggaaacgggaacttcaccaccatcagcgacgccgtggccgcggcgccgaacaagacttcatccacggcggggtacttcctgatctatgtgaccgccggtgtttacgaggaaaatgtttctattgataagaaaaagacgtacctgatgatggtgggagatggcatcaacaagacaattattactggaaatcgcagtgttgttgatggctggacaacctttaagtcagcgacatttgcggtggttggagcgagattcgtgggtgtgaatatgaccatccgcaacactgccggagcagagaagcaccaagctgtagcactccgcaacggcgcagacttgtccacgttttacagctgcagcttcgaagggtaccaagacacactgtacactcattcgctgcgacaattctacagagaatgcgacatctacggaaccgtcgatttcatattcggaaacgccgcggttgtgttccaaaactgcaacctctatcctcgtctcccaatgagtggccaattcaactccatcaccgcacaaggccgaaccgaccctaaccaaaacaccggcacttcaatccacaactgcacgattcgaccagccgatgatttggcagcgaacatcgatgccgctgaaacttatctgggaaggccttggaaaaattactccaggacagtttacatgcagagctttatggacactgtcatcaattctgctgggtggcgcgaatgggacggtgattttgctctgagcactctttactatgcagagtttaacaacactggacctggatctaccactgccaatagagtcacgtggccgggttaccacgtcattaatgccactgttgctgctaattttaccgtcgctaatttcttgcttggagataactggctgccccagaccggagtgccttacgccagtaacttgatatag

SEQ ID NO: 91866 - DNA, 726 bp, Glycine max
  Peptide Sequence Number=SeqID_208644
atgcttgctaatcaaaatggaaacatcttcgactatggtcgtatttcttttcgaaagtccttgtcccaagctcgtaagttcttgaacttagtggactcatatcttcaaggtagcttgtctttgtctcaatactcacttggtgctcttgaagattggcaattcgttgttgaacaaagtctagaatacttatcaaacatctatgccactgctaaccaagttagtggttttcttcacacttctgaagctaaagattttgaaacctatctcagtgccgttttgactaaccaacaaacatgtttaaatgggttacagagttcagacgcaagagcgaagaatgagttgtcctcatctttctctgatgacttgaagcttcacaatgtcacattggctttgttcataaagggttgggtgcctgagataaaaatcatgacaccattgccccaaaatgggaggcatttaaatttaaaaaatgaccacttaccagtgatcatgtccaaccgagtgcgtgctgtttatgattctgctagacatcacaggaggaatctactaaaaacagatttaagtgttgtggtaagtgactttgcggttgttagtcaggatgaaagtcgaaacttcaccactatcaacggtgcaattgttgttgcaccaaataacacagttgttgataatggctacttccttatttttatcgttaagggacactcacataatttaggactaatgtga

SEQ ID NO: 91867 - DNA, 3006 bp, Glycine max
  Peptide Sequence Number=SeqID_208645
atgggggaggcttgctggtgcgtgtgggtcttgtggtggtccttggtggagaagatgatgactggtggacagtttaacacatttggaaatgattcctatgctggaaatccaatgctatgtggattccctttgtcaaaatcctgcaataagagtgaagatcggctaccacattcaacatttcagcatgaagaatcaggatttggctggaaagctgtagcagtgggatatgcatgtgggtttctatttggaatgcttttgggatataatgtttttatgactggaaaccacaatggctcgcgagtcttgttgaagatcatatttacctctgggtatgactctgttgtgagaatgtgggacatggagaatgggttgtcaattgcatcttcacgacccctaggctgcaccattggtgaagacggtgcaattcacatgtatgagattgttaatgatggctatgagtctaaagcttggcatgtagctgtttgggttcctcactcggatttaagagcaatcttttctctgtggaggatgaatatcaataacagtctttgctggcttctactcccctactttatcttccttctttctcttccttcttcttctttctctttctgcaaccatcatgacagttctgccttgctacttttcaaaaactcacttgctctcaacacttcacatcattattattggtttgttgatcattttccttggcttcatgtttattgctctttttcttcaaagacagaatcatggaaaaacggcacagattgttgtgagtgggatggggtcacgtgcgacatcatctcaggccacgtgattgggcttgaccttagctgcagtaatcttcaaggtcaactccatcccaacagcaccatcttcagcctaagacaccttcaacaactaaacctagcctataatgatttttcaggctcttcattatattctacaattggtgatctcgtcaatctcatgcatcttaatttgtcatactctcaaatcagtggtgacattccctccacaatctctcacttgtccaaattactgtctcttgatctcggttgcctctacatgacatttggagatcccaactacccgagaatgagagttgatcgatacacttggaaaaagctcattcaaaacgcaactaatttaagagagctttatttagatggcgtggacatgtcttctatcagagagagctctttgtcattgctaaccaatctgtcttcctctttgatctcccttacacttagagacaccaaattgcaagggaatctatcgagtgacatcctctgtttacccaatcttcaaaaactatctttcggtcctaataataacctgggaggtgaacttccaaagtccaactggagtactccattaaggcagttgggtctctcttatactgctttctcgggaaacattcccgattccattggccatttgaagtctcttaacatactagctttggagaattgcaattttgatggactggttccctcatcattgtttaatctaactcaactatccattttagatcttagcgacaaccacctcacggggtcaattggtgaattctcatcttattctttggaatatttgtcactctctaataacaaactgcaagcaccacttcaaaatcttctccaactagatctttctcataacattattcgtggaagcattccccagtggtttcatgagaagctcctacactcctggaagaacattgcttttattgatctcagtttcaacaagctgcaaggagatctcccaattccacccaatggaattgaatactttttagtctcaaataatgagctgacagggaactttccttcagcaatgtgcaatgtaagctccctcaatatactcaacttggctcataacaacttggcaggccccattccacaatgtctgggaacatttccttctctttggacattggatttgcaaaagaacaacctttccggcaacatacctgggaacttttctaagggaaatgcattggagactataaagttgaatggcaaccaattggatggaccattacctcggtctttggcccactgcacaaatctggaagttttggacctggcagacaataacatagaggatacatttccccattggcttgaaagcctgcaagagttacaggtactcagtttgcgatcaaataagtttcatggtgtcatcacttgttacggagccaagcatccgtttctcaggctgagaatttttgacgtctcaaataacaattttagtgggcctttgccaaaatcatacatcaagaactttcaagaaatgatgaatgtgaatgtcagccaaactggttcgattggtttgaaaaatacgggtactaccagcaatttatataatgattctgtagtggttgtaatgaaaggtcattacatggagctggtgaggatattttttgctttcacgaccattgatttatcaaataatatgtttgaaggagaacttccgaaagtcattggagaattgcattctctcaaagggcttaacctttcgcacaatgcaatcactggtaccatcccacgatcctttggtaatttaagaaatttggaatggttggacctctcgtggaaccagttgaaaggagagattcctgtggctttgatcaatttgaattttctagctgtgttgaacctttcacaaaaccagtttgagggtatcatacctacaggtggacagtttaacacatttggaaatgattcctatgctggaaatccaatgctatgtggattccctttgtcaaaatcctgcaataaggatgaagattggccaccacattcaacatttcaccatgaagaatcaggatttggctggaaatctgtagcagtggggtttgcatgtgggctggtatttggaatgcttttgggatataatgttttcatgactgggaaaccaccattgcttgcgagacttgttgaaggagtgcatatttcaggattgaaaagaacaaataacagaatccatgcaaactga

SEQ ID NO: 91868 - DNA, 603 bp, Glycine max
  Peptide Sequence Number=SeqID_208646
atggctgcagcaacatctcaaaataacagcaccgggaaacagtccggacacagacggcatgcacataagcacaagcgacaggatcaaggttttcaattgcgtcattggaacaggcgacaacctgggactgcacctcaggcttgtactctaacatacatttccattggatacagcaccaccgacattgccatcaccaatatcacctgcgcccacagtcatggcgtcagtattggaagccttggtaagtggccagaggaacgcagcgtgaacggcatcagcgttacgaattgcacgttcctgaacacgaccaacggtgccagaatcaaaacgtggatggggacagtgccggcggaagccaaaaacattgcctatgaaggcctcattatgaagggtgttcagaatcctatcgttattgaccagagttatggcttcaaaaagaagagtgtgtctctgcaatgtagcacaagcaacccctgcgagggagttgagatagccgatgtagatttggcttatgctggccgtcctcacaatacaagttttgtatcctcttgctccaatgctaaaactatttttggagggatactcaacccaccagcttgctaa

SEQ ID NO: 91869 - DNA, 432 bp, Glycine max
  Peptide Sequence Number=SeqID_208647
atggagaaagacgattttcgtttgggagagacacgtgaagcaggacagaaagagctgctgctaatcaccacggctacggggagggccctttttctcttaggcgttgttttcctctcttgcaccttgataggtgcatcttcgtgtggctttgagactcgccgtagcctcctccttccagttccgaaaaacggtcctgcaattttttatgtgacaaaatttggtgctgtggcagatgacaaaactgacaatattgatgcatttagggctgcatggggagaagcatgcagaaacagtactactcaagcaaaggttttgatcccagcgggaacatttcgtgctgcacaaactatgttcgcggggccatgtaccagcccaaagcctataaccattgaagttataggaactgttaaagctagcacagatccatcttag

SEQ ID NO: 91870 - DNA, 3816 bp, Glycine max
  Peptide Sequence Number=SeqID_208648
atggctgaccacggaaccaggaagaccactacggaccgccttgaagaggctattgtccgactaaccaatagtcatacctcaatcaatgaccgctacaacaaccttgcgggcaaggttgatgcaatcttagagcacttgcggctgcgcgattctggtgttccctccaccactgcgccgacgccttctccgagccatcaacgaaacacagttaagcttaatatcccaaaattcgatggccatgatccgttaggatggatttttaaaatcacacagctgtttcaatatcaaaacactccggaagaagaacgcgtcaccatcgcatccctgtacctcgacggcgccgccttgagctggtaccagtggatgttcagcaacggtctgatcacctcctgggatggttttcttcaagctctcgagtctcgtttcgcgcctacgttctatgaagatcctaagggagctttgttcaagttaacacagcgcgggaccgtgaatgagtatctcacggaattcgaacgtctcgctaaccgtgtggtaggtcttcctccccctttcctcttaagctgttttgtttctggtctgaaccctgatctccggcgtgaagtaatggcgtttcaacctatttccctcctacaagctcaagcgctggctaagctccaagaggaaaaattacgtgataagccagttcccatacctcgcagcttctctcatcctaaacctctcattaaccaaaacacaaccctaacctcaaaacctaagtcagctttcgtccaacgcactccggcagagatggccttccgacgagagaaggggctttgctataactgtgacgagaaatggcacgccggtcatcggtgtaagggcaaggtgatgttgttcatcgctgaagaacaagccccaagtccggattcagtagatcatgagaccatagctgatcccggcaccaccatgcttgatgatcacgaacctccgacggactcagactgctcgcatataagcctccacgccctcgccggattaccctcatcggagacctttagaatctatggtcacatccgaaacgctaaattgacaattctggttgatagtggaagtactcacaacttccttcaaccgcgaattgcacaatttctccatctccaagctcaacacacgcctccacttcgggtcatggtgggtaacgatgcaatgttgacttgcgatcaagtctgcccagagacacaagtctccattcagggtcataccttcatggtttcttttcacctacttccgatcagcggagtcgacgcagtgctcgacattgactggcttaaaggactgggaccagtcacaacggactatactgagtccatcatgcgattccaacactgcggccacgacatatcgttgagggcagatgttgcaattgggccggaacccacttccgcgacccaattaaaacgtctactccaaacgggctcagcagctgggttctaccagctacacgtgttggacccaacacctcttgaacctcctttcgcgccacaccccattcaatccgttgaacaattacttcgaagatacgatcacctctttcagcctccttcgcggttacctccggctcgacaggtagtacaccgtatcactctcaaaccctccactgccccggtaagcgtccgtccttaccgttacccgcatttccaaaaaaatgagatcgaaaaaaaaatctcggagcttctctcggcagggctgatacggccaagctccagcccttattcttcaccggtgttgctcgtgaagaagaaagacggtacctggaggctctgcgtcgactatcgagctctgaactccgtaactgttcaagatcggtttccaatcccaacaatagacaagctattggatgagttgggacgcgcttcttggttctcacggttagatctcaggcaaggattccatcagatattgatggaagagaatgacatcgagaaaactgcatttcggacacataacggacatttcgagtacttggtgatgcccttcggtctatgcaacgcaccatcaactttccaatccgccatgaacacgcttcttcgaccatttttaaggcaatttgtcacggtgttcttcgatgacatcttaatctacaacagctccttatcagcccacttacatcaccttgaaaccattcttcgtactctccaacatgaaagcttggagtatttaggccatatcgtgtccagtagaggggtcacaccggaaccctcgaagattcaggcagtgatagggtggccgcctcccaagacgaccagggatttgcgtgccttcctcggcctcaccggcttctaccgcaaatttgtcaaaggatacgcatccattgctgcgcccctcacaaagctattgtgtaaagactccttccagtggacacaggaatcccaaacggccttcgacctcctcaaaaccgccatgaccaccatcccagtgctagccttacccaacttctttgaaaccttcgtgctcgaaactgatgcatccagctctaccattggagtcgttctcatacaaaacggacaccccttggcatactttagtaagagcttaggacctcgattactccacgcctccacatatataagagaactccacgcaattgtcgccgcagttcggaaatggaggcaataccttctgggaaggcccttcacgatacttacagaccataaaagcattcgtgaactaatgacccaagtaattcaaaccccggagcagcattattatctttcgaaattactgggatacgactattccatacagtacaaatctggtgcttcaaatgtggtggctgacgcgctttcccgagctccggcagtcgacggcgagctgcttatcctctccgttcctcagcttgatttcctccacgacatcaagagatccttagaaactaatttggagttccagcagctcacgaagtcactccaggaggaccccgcatcttatcctgaacataccctctgtgatggtctaattttattcagaggaagggtttggttgaacaatggcaatccttctattcccagccttctctttgagtaccacgcaacccctctggggggccatctgggcatcgctaaaacaacccatagactggaatctaacttctattggagtagcttgaaggccgatgtgaaacgcttcattaaggaatgcgttagttgccagcaaaataagaatctccatcaacgtccgtcggggttgctacaaccactaccggttccggccaatgtgtgggaagacctgtctatggacttcattacgcatcttcctccttcccacggttttactgttattttagttgtcgttgaccgctattctaagggaatacatcttggtgctttgcccacgggatttactgcgttcaaggtagcaaccttgttcatggacatcatctgtaagttgcacggcttcccaaagagcatcatttcagatcgcgacctcgttttcgtaagcagcttttggaaggaattgttccgcttgagtggcacacggttgcggctgagcaccgcctaccatcctcagaccgacggccagactgaggtcctcaaccgcgtcttggagcaataccttcgttgcttcgttcatgatcgtccggcttcgtggtttccctacttagctctcgcagaatggagctataatacttccagacattccggttcaggctttaccccgttcgaaatcatattcgggaaaccccctccaacaatagttgactaccttcccggtacaacaaagaacgaagtagtccactcagtgctgcaagaacgtggcgaccttcattcaaagctttag

SEQ ID NO: 91871 - DNA, 273 bp, Glycine max
  Peptide Sequence Number=SeqID_208649
atgtatctgtttaaaagtcatgcaatagtgccatttgaacgtagagtacaagtagaagtgacaaagggacaatacgaaactaggtctggcggaccaagaggaatcgactcggatctggaagacaaaactcagatctcgcacgccattttcgcctcggatttggatgaagctcagacgcagaggtggttgcagatctgggctgagggagtggtgggaagatattcatgtgtccgtgttgtgtctggtgtccgtgtcaatatcggtgtttcatag

SEQ ID NO: 91872 - DNA, 348 bp, Glycine max
  Peptide Sequence Number=SeqID_208650
atgctttggcacgtagccatacagtggacttcctttggtttagcacaagctacaatcatgaaccagggaagctacagccaccagtctcttaaccaacaactaccccaagtttctgagactatgcagctgttgcaactgcagctgaatgaggacactgctctccaatttacaaaatcctccatcattttttccctccttcggcaaagaagtacgcgcgctcagcgcgcgtccgcgttaaacgggtcaggaagcacaagcgctaagcaaggcgttaagcacgaagatgcagaatctgttactcgcactgagcacgcgctaggcgcacgatccaatagaagcacacgctga

SEQ ID NO: 91873 - DNA, 753 bp, Glycine max
  Peptide Sequence Number=SeqID_208651
atggtgtccttgaagcttcagaagcggctcgccgctagcgtcctaaagtgtggcagaggcaaggtctggctcgatccaaatgaagtcaatgaaatctccatggccaattctcgacaaaacataagaaagttggttaaggatgggtttattatcaggaagccaactaagattcactctcgctctcgtgctcgtcgaatgaaggaggccaagaggaagggacgtcactctggctatggtaagcgtaagggtacaagggaggcaaggcttcccaccaaaatcctttggatgaggaggatgcgtgtcctcaggcgcttgcttcgcaagtacagggaatcaaagaagattgacaagcacatgtaccacgatatgtacatgaaggtgaaaggtaatgttttcaagaacaagagagtcttgatggagagcatacacaagtccaaggctgagaaggcaagagaaaagaccttgtctgaccagtttgaggctaagcgtgccaagaacaaggctagcagggagaggaaaaatgctcgtagggaggagcgcttggcccaaggtccaggagagaggccaccagcagcacaaactgctacacctgcaacagcatcccagcctcctcgtgaagccttttttatgcagagcatcgaagaaatccaagaagtgagtcgcatatacagagatttggtggatgggcagctgggaaaggagaggataaccaatgattttagtttcgaccctcccaacaaagcatacccttga

SEQ ID NO: 91874 - DNA, 732 bp, Glycine max
  Peptide Sequence Number=SeqID_208652
atggtgtctctgaaacttcagaagcggcttgccgctagcgttctcaagtgtggtagaggcaaagtttggcttgaccctaatgaggtcaatgaaatctccatggctaattctcgacaaaacataaggaaattggttaaggatggtttcattatcaggaagccaactaagattcattcccgttcccgtgctcgcagaatgaaggaggccaagaggaagggacgtcactctggttatggtaagcgtaagggtacaagagaggctaggctccccaccaaaatcctttggatgaggaggatgcgtgtcctcagacgattgctccgcaagtacagggaagcaaagaagattgacaagcatatgtaccatgatatgtacatgaaggtaaagggtaatgtcttcaagaacaagagagtcttgatggagagcatacacaagtccaaggctgaaaaggcaagagaaaagaccttgtctgaccagtttgaggcaaagcgtgccaagaacaaggctagcagggagaggaaaaatgctaggagagaagagcgtttggctcaaggccctggagagaagccatcagcagccccaagtgctccatctgcaatagcatccctgccagcccaaagcaactatcaaaagaacgaacaggatttggattggatctcattggagttgcctatccctgacttagcttctctcctcgtggctgatgacataggagttcagtttttgcgggtttag

SEQ ID NO: 91875 - DNA, 504 bp, Glycine max
  Peptide Sequence Number=SeqID_208653
atggaacacaaagtagccacaacaactgaaggacaacccataagatgtaaagcggcggtttgtcgcgaagctggtgagccactgagtattgaggagatcattgtggcaccaccaatgcctggtgaagctcgcattcgtattacatgctccactctctgtcaaaccgatatcagtttttggaacatgcaggaccatcctgtcatttatccaagaattctgggtcatgaggcaatagggaagcctatgtttcttgtagaaaggtctctctctctctctctcaaagtgtgcacaaacatgcctcgcactatgggttggggaaaaacaatagttttgggagtggacaagccaggatccaagttaaaccttagctgtagtgaggtccacgtttgtgggaagagcctcaggggatacttatttggaggactcaaacccaagtctgatgtacccattctccttaaacgctacatggacaagggaacacccagatatttgggtcccttgtaa

SEQ ID NO: 91876 - DNA, 1536 bp, Glycine max
  Peptide Sequence Number=SeqID_208654
atgcaaatcaaatatgctaaatgggttaatgggaaggatgtgtacttggttggcattatatacgaaatagcacttgctctcttccacttcttgttctgtccttatgttcttgttctagttcttctaccctcttcttcactcttgttccatcactgctttcagagcttgctatttctctttgaagaagaggggcacagacccatgaagagtctcgtagctgtgcttttagttatagtattaagcactgctctggaaagcaatggagaagatgatcatgaacgatgtaaacaggaagcagtggatcctaggcctcacagcgtgtcaatcttagagttcggagcagttggagacgggaaaacgctgaacacagttgcattccaaaatgcagttttttatgccaagtcatttgctgacaaaggtggggctaaactatatgttccatctggcaagtggcttactggaagttttaaccttaccagccacctcactctcttccttgagcgaggcgcaaccatcattgcatcacaggattatgcacactggactgcaatggaccccctaccctcctatggtcgaggaattgatgttcctagtgggagatatcgcagtttaatttatggacagaacttaagtgatgtgggttctgtctggtgggacctaatcggtactcattccttaaattacagcagaccacatattatagaacttgttggttctgataatatcacaatctcaaatttgacatttttaaactctcctgcctggagcatccatccagtatattgcagtaacgttcaaatccagaagataacagttcatgcaccaactgagttcccttacacaagcggtatagttccagattcttctgagcatgtttgcatttacaacagcaatattagcactggtcatgatgcaattgtgctgaagagtggttgggatcaatatggagttgcctatggcaaaccaacctcaaaggtccacatccggggtgtttatctacaatcttcatctggcgctggcctagcatttgggagtgagatgtctggaggcatatctgatataattgcagagcagctccatattaccaactcaactattggcattgaactgaagacaactaagggtagaggtggttatatgaaaaacatcttcatttctgacgcaaaattggaaaatatttacttgggtatcagcatgacgggaagctctggctcccatccagatgacaagtacgatcctaatgcagttccggatgttggtaatgttacttttgagaatgtgattggtacaaatattgctattgctgggaatttttcaggaatagttgattcgcctttcactcctatctgtcttttgaacgcgaccttttcttccagttctgagtcatcatctccttcatggttttgttctgacataatgggaatctccgaggaagtgtttcctgagccatgtcctgatctgcagaacacgtattcaaacttttcctcttgcttttcttccctacatccgtcgtctagttatgtctcaagcgcatga

SEQ ID NO: 91877 - DNA, 315 bp, Glycine max
  Peptide Sequence Number=SeqID_208655
atgggagtgctgcatggtctaaagttgaaagattgctgtcctaatgtcggggtagtgttttggattcatctcaagcattttgtaattgctagacagagctacatggtgacagtgtaccgggattggatcgagcggaaggagttagtcttttacagcgtggtgaaccaagtgtttgatggtgctcaaagaggatttggagactgggaaacaaaaaaactttcttatggaagtagcactaaactggcatatgacatgcaaaacatggtgatcattatcatcaaatctacgggtgacactttccatcaattagtgtaa

SEQ ID NO: 91878 - DNA, 600 bp, Glycine max
  Peptide Sequence Number=SeqID_208656
atgtcgatgacattatttgtgaaaaatacgacattagcaaggataaatgagcccaattttgtcaaagctgcagagacccctcatgggacgtatgatgtgcggaaaaaggcacaggccatccagaagcaaaacatggtcccccacgtgttgtctcgagggggttatcaattgttagaacagaagctgatggttgacaaaacaaataaaaaacaggaggaagtttctcaatccgaaagcactgaagcggtgttcgatcctccatctcccattaaccggcacgtcaagtggaagatggcgcgcaccaagaaaataggacaaatgacgtttgtggcagcaaaggaaattactaacaaaattgaatcattgggttcttttgttccacataggcgtcaggatgtcctgaccgttgccatcaggcgaccagaacacggtggtcgtgtgcgtgctgctggggccggtgtcaccatcaaacatttctttagaccggctaaaaaaacctaccgtagttcttcctccattgatccaaaagaactagagcagctgactcaacaaatcagggaccaactagaggagttgatcactgaaaaagtcacgcgatag

SEQ ID NO: 91879 - DNA, 174 bp, Glycine max
  Peptide Sequence Number=SeqID_208657
atggaacccaggggaatacctaattgtggatccagtgaaaagtcagcattatgggtcctagaatggatgcaaatggaggagtcatttgtgagtctcttgtatggagtggctacagcaacaacgttggttttaccaaacaacttgtcagacaacttaacatcgtcgaaggtatag

SEQ ID NO: 91880 - DNA, 578 bp, Glycine max
  misc_feature (422)..(422): n is a, c, g, or t
  misc_feature (556)..(556): n is a, c, g, or t
  Peptide Sequence Number=SeqID_208658
atggcgtttatttctcacaggagagaaatcatgctgtactggattttattagcgttagcgattgctgccgaaattacaggcaccgtgtcaatgaaatgggccagcgtcaatggcggcagcgccggctatatttttatgctgttgatgatcgccctgtcatacatcttcctcacctttgccgttaaacgtattgcccttggcgtggcttatgccatgtgggaaggcgtcggtattctgtttatcaccctgttcagcgtgatgctgtttgacgaggcgctgtcagtgatgaaggcggcgggtttgatcacgctgatcgcgggtatcgcgctgatcaaagcagggacattcagccgcagtgaaggggatcgatctctcggtggcctacgccttgtggggcggtttcggtctggtggcgaccgtancggcaggctggatcctgttcggacaacgcctgaacacccgcggctggctgggcgtggcgctgctgctggccgggatggtgttgatcaaatttgcctgaggcagcgcaatactgcctgccttgctttcccaatantgggagagaagggcaggcatgc

SEQ ID NO: 91881 - DNA, 465 bp, Glycine max
  Peptide Sequence Number=SeqID_208659
atgggagttttgtgcggttttatctggctacgtgcggttttctgccctcaccctaaccctctcccacggggagagggaatagttaagtgtgttgttggaggccgaatactcaactcatcccacgcacaatcggtcccttctcccgcttgcgggagaagtcattcatctaggccagcaatcgctcactggctcaagcagcctacccgggttcagtacgggccgtaccatgtgaacccctatttggccttgctccgggtggagtttaccgtgccacggactgttgccagccgcgcggtgcgctcttaccgcaccctttcacccttacctgatcccattactgggccatcggcggcgttacctggcaccctgccctatggagcccggactttcctcccctctgcccgtctcccccgaaagggacgacgacaaagcggcgactgtctggtcagcttcggcgcgggataa

SEQ ID NO: 91882 - DNA, 1253 bp, Glycine max
  Peptide Sequence Number=SeqID_208660
gcgaccacgtgatcatgttcctcaccgacaaaaagtttgtgccggacgttgagcccattggccaaggcaaggagataacaatgagtttattcaaagagtttcgtgattttgcgatgcgtggcaacgtggtggacctggcggtcggtgtgatcatcggtgctgcgttcggtaagatcgtatcgtcactggttgcgaacatcattatgccaccgctcggtttactgattggcggcgtcgactttaagcagtttaaatgggtacttaagccagcagaaggcgatatcccagcggtggtgatggaatacggtaactttattcagacggtatttgatttcatcatcgtggcatttgctatcttcattgccatcaaagtaatgaataaactaaggccagaggtaagcactgttgcttaccgctggcctcctgattcgctcccttcgcatgtttatctttacgccggtagctgcctttccccttctgattgcgcacaacacgctggcgatacagcggatcgtgtaacagggcttccagggctccctgcgcgccagaattcaatccttgctacaacaaatttcaggatgcggatcttcgccggtttccagcgcctcgaggatcgaacagcaggcgctactgtgccggtcgccacaacaggtgtgatgctctggatcaatacggatcgacagcaggtcgcggatcgattccaggctgaaaccaagctgccggccgtaacggataaaacgcaggcgctgcagatcgttatcgctgtacaggcggaagccgccctcggtgcgtacctcatgatccatcatctgctgcttttcataaaagcggatggtgtccggcgtcacgtccgccagttttgccagctggccaatgcgatacatactatttctcctgctgtagccgctgaccgatcgccgggcggtattcgccacgcagaaaatcggtgctcatgccagcctgctgtagcttcacttccagcagcgatcgagttcgcgaagcaaatcgctcagtgccagcgcgtcgcggcgcatctccagttccggtgggagatagccggcgtttttcagcagtcgccaggcactgcgcaattccgccggcacaccactgtcatcgtccagcgtgagcggcgcaccttcaccaggcagattgctcagctcgcccttttcctgagcggcgcggatgtgttgctcagccagctgatcgataagccacatagaaacctcctgcaggcatgtctgccaacagcatag

SEQ ID NO: 91883 - DNA, 348 bp, Glycine max
  Peptide Sequence Number=SeqID_208661
atgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcaggcaggcttatatttcttaatttcaattag

SEQ ID NO: 91884 - DNA, 1047 bp, Glycine max
  Peptide Sequence Number=SeqID_208662
atgatcaatcacagttgtgagccaaacgcatccacgatcgagctactcacgccagtcgaattttcgcctattgtgcagcagcagtttcaagttgttccccgaatcgtgttcatagccatcacgggcatcgaggcgggagaggaaatttgcatagactactgcccgcgacggcagccagatcaaatgcgcagaattctcaaatgcttctgcggaaagccatcatgcagggcgctggttcagcttcggttggcggtggacagggggggcgagccacgactcgaacggtatagttcggcgccacagagcacgcgcgtcgcgctttctctcgtcgcgcgtgaaaaattccgcatggacaaggttgcggcagagcgcgcagagcgcctgcgagccatgcgtgaggcggcgacgtccgccaagacgcaggagaacgcgacggaatcctcgagcgcaactctcccgcaacctttcgcgggttcggaggatggcaacacccgagctcctgggttttatacagaagttggaagccaagcgagcgcgaacgatgcgcgcacgctcttcgaagcgcggaaaccgcctcctccgccgcctcctccaccgccactgcgctggttacaagaccagcgcccgccgtcccaaggcggcggttgcggcgtctctcgcgggcgtaaagctccgcgagtgggaggcgttcgccacgaccaaaagcctttcaacgcgagtgtttattacaagactgacccgaccgctcgcgtgcgtgcctctcgcgcagccgacgatgtgcgtcgacccgtggatagcgctcgaacgaaactcctagtcagagccgtaccggcgatagaacgtagcgatatagcgttagaatcgatgaattgtgcccgatcgacgacccacgtcgcgctctttgagcgtgtatcgttgaatttgagcgtgtatcgttgcgtagtgcgagcgaatgtctgtcaacatcatcatcattcaattcatctcgaggacgccacaggtcgaccgcgcgtgatgggcgccgccgcggcggccgacgacgagccg

SEQ ID NO: 91885 - DNA, 252 bp, Glycine max
  Peptide Sequence Number=SeqID_208663
atgggggagaagcttgccacccagctcgcccaggcgagcaaggttgcttcctccagaagcaatagccttctggaggaatcttctggagggcccaagtgggcctggttgctatttgcacccccttttttactaagtgcacccccctttctattttttggaaccgatccgaaaaacaacagaataacgtgtttcccagtcaccagagacttcgcgcttgataatggaggacacatgaacagcgcttggcaataa

SEQ ID NO: 91886 - DNA, 288 bp, Glycine max
  Peptide Sequence Number=SeqID_208664
atgatttgtcttattgggagtatgttgatgcgttacactctatccaaaatagtaattcttttagtgaaatgtagtgcatcatcatttgagcaatcaatacagagacagaatattccaatgttgaatcaatttcatgcgataaaccaggattctattgaaaacattgttgatgtcaaagcgtatggtaactgtggttattgcgcaatagcggccttattgggtttttctacgaaaccattgtcctttaccaccattggtgttgttgtggaatacacattaccattatga

SEQ ID NO: 91887 - DNA, 432 bp, Glycine max
  Peptide Sequence Number=SeqID_208665
atggctctctccgcaacatttatgcctccttcatccccaaaattgaacctttattccaaaattcgtagacccttttaccctcactctgtcagactccttaagcccgtaaagatttgggcttcaactactctggattattccaacgtctctaccaacgacaaatcctcccctttgaagactagcaattggcaatggaagttcaaggacaattttataaacatttattacgaggagcacgtaaaggagagtccggagcctccccaaaatatcttgatgatgccaaccatttctgatgttagcatggtcgaggaatggagactagtggctggagacattgttcaacgtaatggcaacaccaattggcgggcaactattgttgattggcctggcctgggttattctgatcggccaaagatggattacaaacgctga

SEQ ID NO: 91888 - DNA, 657 bp, Glycine max
  Peptide Sequence Number=SeqID_208666
atgtgctccaagaaacctcatctctcagaggcatttcagaaaaaactctccttgccaatccaagctcgcctgctttggcataaccagcaagcatcgcattccacgaggtcacgtcccgcgcgccttccacgtgaccacgtttggttcagacatttcatcgaacacctatcgcgcggaacgggagtccccgcattcagcatacatgctgatcaacgttgtcccgacaaagatgtgggcgtcgaagccgtggcggaaggcttgggaatgcagctgaatgccgggtctgaggtggcgggagttggcgacgcctttgagggcgaaggcgaagatgaaactgtcgggggagagggtgggttgacggcggagttggatgaaggggtggagggaggaaagaggggtttgggagagggagagagcacgaatgagggtgttgtgcatgaaggtgtgggggttggggaagtggtggaagagacggagagcgtcggtgatggtgatagcgcaggggagaaggagcttgccgaagacaaaagggtctgtgaagaccggttttgcagatttgggcgtggatctgcttcgtgggtttcaggctgctgcacctgctcagcagtgaaacccatgcttcttccatttcctaaacggataaaacataagtcttga

SEQ ID NO: 91889 - DNA, 1194 bp, Glycine max
  Peptide Sequence Number=SeqID_208667
atgcttgctggttatgccaaagcaggcgagcttggattggcaaggagagttttttctgaaatgcctctgagagatgaggtgagcctcactggggtgctgtccgcttgtgcacaggctggggcgtttgagtttgggaagattttacatgggtttgtggagaaagctgggtttctttatgttggttctgtaaataatgctctcatagataccatagatacctactccaagtgtgggaatgtagctatggctaggttagtctttcagaatatgccggtggcgagaagcattgtgtcttggacatcaataatagcgggacttgcgatgcatggttgtggagaagaggcaatacagctttttcatgagatggaagaatccgaagttaggccagatggtattacttttatatcgctactgtatgcttgtagccatagtggcttggttgaggaagggtgtgttatatgtgaaatgccagtttctcctaatgcaatcatttggaagactctccttggggcttgtagcattcatggtaatattgaaatggcagagcttgtgaaagcaaggcttgctgaaatggatccagaaaactctggtgatcatgtactgctctcaaatgtttatgccgttgcagggaaatggaaggatgtcatttatggttttgtggctggtgaaaagcctaatgaggttacggaagaggctcgtgataaacagagggaaataatgttgagactcagaacagaagcaggttatgcaccacagctaaggagtgtcctgcatgatattgaagaggaagaaaaagaagattcagtttctaagcacagtgagaagcttgctgctgcttttggaatagcaaaacttcccaagggaaggattttaagaattgtgaagaacctgaggagattactggtgacagaggtgattgagactctagagtacatgacacctgttggaagacaaaaagaggcctcccaaatgccacaccacttagattttccagccacttcaattcttcatggtgatgatgatcaccatagtgatcccttgctccttgttccagtgcacccgcctctaaaccaagtggtaattgttgcctatagggacattacggaggacaatgcccttggtccattatcacggcttgcagaaatagtttggccgggagaggttgcagttgttgtagtagcagcagtgaaatga

SEQ ID NO: 91890 - DNA, 333 bp, Glycine max
  Peptide Sequence Number=SeqID_208668
atgactaacatagttcatgttaaactagaaaatgatttgataatttttggaggaggacacgctgcaactatagtagcccgtgctgcaaaaaagggtctggtgaagcccaaagctatagctgctgttgcaccaacttgggctggtccactccctattgtgtttggtcgagactccaatatggaaacaagggtaaatttctttgtaattgttgaggcaatagaaggatacagtgctggttttattatatctgtgtctatcaaatttggattcgtgaatcttcaggctcattttttaatcctgaattgtaaatctattgaattgtgctcgatgtaa

SEQ ID NO: 91891 - DNA, 1176 bp, Glycine max
  Peptide Sequence Number=SeqID_208669
atgcaggctgtgaaaaccatcgagaacacgcttaaacagaaatcgaaggaactcatagactgtgaaaagcgatctcgtgccgcgacgaatgagcttcagcaggcgaaattagatgctgatgatacgaacacttccggcatcgacgtgagcacgcttcaggaggcgttggactctctcaatgcagagctttccacccatcaacgggcgctcaaagaagttgaagagaactggtcgagagcgaaacaagcgtttgacacctccgcgagtgaaatcgcggaaaaagtgtccctggcggcttcgtacaagagggaaatggaacaacacatgggcatcatccggaaagttgaagctgcgtatcgcaaagccgccaaagacatcgaagaagtgaaggcggagattgaagcgggcacaaaagtcatcgcatatgaaaagggtagattgaccggtcttaaggaagaagctgagaaggtggctatggacactaccaaggaggtatgcgatcgcgaggtggcggaagccgctggcgacatcacgctgaaccccgattctttgttgcgcatgtatgaatcaaccaaggtgcaaatgcgtgcagaagaaggtagacacaagagaccactcgaagaagtcagcgacgagctgtcagatagacgaagaaagcttctcaagctggagaatggcgtcgggagctccgaaaagattctccgtaaattgaaaactggcatcaagaaacgacaaaagaccatggaaaacaaggctcatttcgtagctaagaacgtttcacacagattcaattggcacatgacgagaaaaggacacgcgggccaagttattatcgactatgagaactcaaagttgactcttcacgtcaaggatggagcgaagtctaagacgatcaccgacacccgttccatgagtggcggcgagcgctcgtactcgactttggcgtttaatctcgcactcggagatgaatccgactctcctttccgcgccatggatgagttcgatgtcttcatggacgctgtgaatagaagagtgtccatcgagactctcctcaatttcgcgagagagaacgtcgacaagcagtttttgttcatcacgccgcaagacatcagcgccgtggacgccacggcggcagatatcaagatccaaaagatgcgtgccgctcggccggagtag

SEQ ID NO: 91892 - DNA, 876 bp, Glycine max
  Peptide Sequence Number=SeqID_208670
atgctgctattgctcacgttgtttgtcgatggggcaatagcggagcaaaaactcacggcctcgcatcaggcccaatatgactattttggcgccagtgtgtccgtctccggggactacgctgtggttggggcgtatggcgatgacgacgacgggagtatgagtggtagtgcgtacgtcttcgttcgctctgggtcgacctggacgcaacgaaaactcacggcctcggatgcggccccaaatgaccagttcggctggagcgtgtccgtctccggggaatacgtcgtggttggagcaccgggtgataactctaacgcgggtagcgcgtacatcttcgttcgctctgatacaacctggacgcaacagcaaaaactcacggcctcggatgcggcgtcagaagacaattttggcgccagtgtgtccatctctggggaatacgccgtggttggagcatgggccgatgatgacacttgggagcaaagtggtagcgcgtacgtcttcgttcgctctgggatgacctggacgcaacgaaaactcacggcctcggatgcggcctcaaatgaccagttcggctggagcgtgtccgtctccggggactacgccgtggttggagcaccgggtgataactctaacgcgggcagcgcgtacatttccgcgatcaaattcgaaaaccgtgccgctttgaaagccgcagtggacaattgtttggcggcagatgacacaggcaactgcgattgcagcagtgcttctgtggactgcggtgccgctggaagtcttcccatctcgcagtgggacacgagcttgatcacggatatgaatcacctgttctacgacgaaagttcattcgacgccaatatcagcgcgtggaatacggcgaag

SEQ ID NO: 91893 - DNA, 520 bp, Glycine max
  Peptide Sequence Number=SeqID_208671
atggacattgacaaggatcccgagaagtgcatgcaaaatgttcacaaacaactggtcaagctcgcaaccaacagagcggttgtgagcatgttcgctttcaaggcagatttcgacattaagcgccgtaaagcacgcgcgaggctggaagatacccgccaagcgatgttatcgcgtatcgatatcttgaagtcacaacagaccgacgaggaccattccgataaaattaccgcgctgtacgaagtggcgaacgaaatggcacgcatcgtgaatacgatcgtaccccaatcacccccaacagatccaagtgcagaagggtgtatcgaattgctggacgaacaactggcatcacttctcaaggacgtcgacgtccgagcgcgggcgaacgcgttagacgccccgaattctgcggcggtacatatcgtgatgaaggttcacgcgttcgatgcaattatatgtcgacttaacgaacatttgctcgaattcgcggcggcagaacttgagtctgagctcgccgagctcg

SEQ ID NO: 91894 - DNA, 1215 bp, Glycine max
  Peptide Sequence Number=SeqID_208672
gaagcgctgaagacggttggcaagaagttcgatttcaccgaactgttcgagaagcgccaggaattccgcgacgagatcatcacggtgatcggcaacgacctcaacggctatgtgctggaagacgtggcgatcgattacctggagcagaccccgaagtcgctgatggaccagttcaacatcctggacgcgcacggcatccgcaagatcacggagctgatcgccgcgcagaacgtggtgaccaacgagctggagcagaacgagaagctcgccatctccaagaagaacgtggaagcgcgtgaagcgctgctggcgctggaacgccagcaggccgaagccgaggcacgccagaagcgcgagatcgagaccatccgcgcgcgcgaggaggccgagaccgccaaggtgcaggaagagcagcgccagctgtccgagaatgcccgcatcgaagcgcagcagctgatcgagatccgcgaccagaaccgcctgcgcgaagtggaagtggccgagcagaaccgccagcgtgccgtggccatcgaggccgagcgcgtggagcgtgcacgccagctggagcaggtcaccaccgaccgcgaagtgcagctgcagggcgtggagcgcgacaaggtggtcgagcagggcaagatggacgtggccaacatcacccgcgaacgcatctccatcgacaagacggtggcgcaggaagaagagcgcatcaaggaggtgcgtgaagtctccgaggccgatcgccagaagcaggtgctgatcctggaagccgaagccaaggcgcaggattcgctggtgcgtgaggtgatggaagcgcaggcacgcgaaaccgcctccaagcaccgcgctgttgaactgaccacgttggcccaggccgagcatgaagcggctggcaagcaggccgaagccaagcgcctgttggccgacgcgctgcgtgccgaacaggccgcgccgggactggccgaagcgcaggtgcgtgaggcgtccgcgctggccatcgtgaaggttggcattgccgaagcgcgcgtgatcgaagccaaggccgaagccagcttgaagcagggcagcaacgaggcccaggtgctggcgcagtcgctgcaggcacaggcactgggcgaggagaagatgggcctggcccgtgccaccgccaccgaatcgctgggcaacgccgaagccggcgtggtgcagaagaagctgctggccgaggctgaaggcctg

SEQ ID NO: 91895 - DNA, 192 bp, Glycine max
  Peptide Sequence Number=SeqID_208673
atggttcaagttgaagaagtggggggacattgtcatgaaattggtggagtggcctatgggatatggatcaagttgaagaagtcagagaccttaatatgggtggtctttgtggagtgtcctaagcctatggttcaagttgaaaaagtggggaccttgatatggatttggtggagtagccagcgatttgtctag

SEQ ID NO: 91896 - DNA, 261 bp, Glycine max
  Peptide Sequence Number=SeqID_208674
atggtatccattcctttagccaggcatggaatttcgatgttttgtacgggatcagagattaattggaatttctcaaggggagactgtattcacagtgaaggcaatgatatggagtttagaattgtcgaagatcgttgtgctgttaggccaggccttaaaacagcagttccatttgattacttggataccagccctgggtgtgtttgggatcaatttctaaggaaagcagatgatcgaagagttaagacggaaatcaactga

SEQ ID NO: 91897 - DNA, 213 bp, Glycine max
  Peptide Sequence Number=SeqID_208675
atgtccgattcagatgcatcacatatcgagacgctcgaaattgaacaacgggagctctcgagaaattcaaatggtcagaaattttcacagggaggcacatcacatatcgtgacgctcgaaattgaacaacggaagctctccaaaaattcaaatggtcataacttttcacacggaggtcccattcaggcacatgatatatcgggacgttcgtaa

SEQ ID NO: 91898 - DNA, 393 bp, Glycine max
  Peptide Sequence Number=SeqID_208676
atgacagacatagtcataatcttaagtaatagaggtgcacataaaaagaaagggtggggttggaaccgggtcagggcgacccggcccaaaccgcatttaggcaacagggttggaaatgccctagatgagacaaatcccaaaacaatgcaagacttggggaaccaccacgaagggtggtgtgccttctctgaatgccactggccgacgatgcgagatcgcgataggggcagtggcaacagagctgaggcactaccagaggcatggtggcacaaccaaaacaagaagaaaggaaagtcgaaatttgtcggcgacaaagtccgtcgacaagatagcattgaagaagcaacatcacgaaaggaaaaaaacaaagaagacagaaggaagaaagaataa

SEQ ID NO: 91899 - DNA, 252 bp, Glycine max
  Peptide Sequence Number=SeqID_208677
atggggtgccccaaacgcttatctaaaattgaatctaaccagcattcactaagaaagtcatcgcataaggaacattcatacatgcacatacacatgcatattttgtggtacatagggacggatgcaaatggggatagggtcacgaccgaccgatcgttgccccttcccggcgctaaacaagcagagaacgtcactgcaaggcagcccagtatcctttgcattcgtagtttcttttactattgtttgttttaa

SEQ ID NO: 91900 - DNA, 372 bp, Glycine max
  Peptide Sequence Number=SeqID_208678
atgacaaaggctaatgtttctgtcccaagaaccataaaatgggatgaggtaactcttcctgaaaaatgggtcatggacaaggccacaccgtcagtccccagacccgctccaacaatagaacaaatcagaataaaagcctcaagatccgagtatgaatcggcaagaaggtctttctcgataagaacccggtcaattccagtaaggttatctagatctgagtcacagaaccagtttcctagtataaacctccaaggattatatacaacttctagtatacctagaaccacatataatcaagaacaagaggatgaccaaaagccgatccaatctccaacatattcctttatgcatgaaccttatgatgttatctga

SEQ ID NO: 91901 - DNA, 240 bp, Glycine max
  Peptide Sequence Number=SeqID_208679
atgtcagtgaaaaacctcgtcgggcgcctagaagtacatgacaaaatggaccacacaccagaagtcaggtcactctcactaggtaaaatcatagggaaaccagtcaatgtcacgctgttttgcgagaatgtttctaccatgtacgatcgacacaagcttaaaagagcactcaaacatggtgtatttaccccaaggcctagactccgaagagtctgtcagggtctctccctcttgattcag

SEQ ID NO: 91902 - DNA, 426 bp, Glycine max
  Peptide Sequence Number=SeqID_208680
atggttatgggagatttcatcggcagactctccttccccgcatgtttgcattttagtggagaaaacaacgagactttttcaagtctcacaagttatccagaacgacgtaggtctgagttcctcattggaggatacgtaggagcaagagcctcgcttttgtcgaccacaccgccttttgttgccatgactcaagagctggtagcccgcggagacaccttacagttatccgcacctcgtcattcagtgaccccaagtgtgattgacgagcagaggccaatgtggtcatctgcgccctttccggagatgtcagcattttccgatggagacttttcaagtctcacaagttatccagaactacgtaggtctgagttcctcattagaggatacgtaggagcaagagccttgcttttgtcggccgccccataa

SEQ ID NO: 91903 - DNA, 1387 bp, Glycine max
  Peptide Sequence Number=SeqID_208681
atggacaacgaggacgacgatttcggcgatgaactgcgcgaaataatgacggagacctacctcgcctggttccaggcggcctggcgcgacgcgcgagacgccaaccgggaggtgcgtggctttctgtccgttcacgacaccatctggcgcacggacctggatacgggagaagcattccgcgaggacgcgggccggggcgggttgttgattgcgaggccagccggctcagaccaccacggtctggggcatgccttcggtctgcgcgacgatctcgcccagcttgctgacggtttcgccctgctcgcgcagcgtggcggcgatggcgtcggcctgggccggatccaccaccaacaccatgccgatgccgcagttgaagacgcggtacatctcggtgtcctcgacgccgccctgctcctgcagccactggaacagcttgggcatttcccagctgtcgcgccgcaggcgggccgacaggccgtcctgcaggatgcgcggcacgttgtcgagcaggccgccgccggtgatatgggccaggcccttgatggcggtgccgtgcttggccagcgcggccagcacctgcttgacgtagatgcgggtcggggccatgaccacgtcgaccagcggctggccgtggaagtcgtcgtcgggcttggcgccggcgcgttccaggatcttgcgcagcagcgaatagccgttggagtgggcgccgctggacgccaggcccagcaccacgtcgccgaccttgatcgacttgccgtcgatgatggccgacttctcgaccgcgcccacggcgaagccggccaggtcgtattcgccatcggggtacatgcccggcatttcggcggtttcgccgccgatcagggcgcagcccgacagttcgcagcccttggcgatgccgcccaccaccgacgccgccgtgtccaccgaaagcttgccgcaaccgaagtaatccaggaagaacagcggctcggcgccctgcaccaggatgtcgttgacgctcatcgccaccaggtcgatgccgacggtgtcgtggcggttccagtcgaacgccaggcgcagcttggtgccgacgccgtcggtgcccgagaccagcacgggctccttgtagttcttgggcacttcgaacaggccgccaaagccgccgataccggccagcaccccggggcgcatggtgcgcgccgcaagcggtttgatacggtcgaccagggcgtcgcccgcgtcgatgtcgacaccggcgtcacggtaggtcaggggagctttgggttgattcgtcatgagaaatgccgtgggatatgtaacaattgctgggaattggggtggaacgccctgcattttacgatgttgcggcccgatcctggccggcgtccggtgaaactcgccagcggcg

SEQ ID NO: 91904 - DNA, 309 bp, Glycine max
  Peptide Sequence Number=SeqID_208682
atgacacatgaagtggaagatgactcgcaccaaaaaatcagccagatacagtcccagatgcaatccctgggagtcgtacctcctgctaagcctaaggtgaaggtgggtgttgaggaagttcgagatgttgatgctcacgtccctgtacccactgaagaggataaacatagaccaaagggaccgacgaagcctgttaataggccagaacctaatgactatcccatataccagatgacattgatggtcccacaacttttcctcaagcctatgcaagtgtcatgggatgcaacttgtgtttggggtgtataa

SEQ ID NO: 91905 - DNA, 612 bp, Glycine max
  Peptide Sequence Number=SeqID_208683
atgttagaagttggcaaggatacgatatcagcaagtatttgttctacaccaaatcacaagacaacaagagtacaatgcaaaacagtgggcaatatcgatgtgcgaaatgatgattttagatttactttggtagatgtgaagaagctagcttatcagaatgagcttttcatcgtggcagaacaagctaaacatgtgtttgatgttcaagatccttgttatgaaaggtggtcagtggttctacaaggaaaaaccattggtcttaatcttgaagatgacaattcaacccttgatacttgtgacactcctttctctataaacatgcccagcgtcaatggagaagaagttgatgacgcacatgcttcaccatcgagctcctctcctcctaaatcaacacctttgttgtctatgttaaagaggattagaaaagccacacggctcaaatcattagctgccagacccgtcaaggtggagggatcagtggttcatgtggatcctaccactgagaaaactgatggtccctacataaagaaattaagaacctatttcggggtcatcgctcgagaaaaggtgaatgttacatatgttaattggaaacaggttcctgcaacttag

SEQ ID NO: 91906 - DNA, 492 bp, Glycine max
  Peptide Sequence Number=SeqID_208684
atggacttcttttccaatgagagttttgaatgcattcaggcatttgagaactcaaatctcattccttttatgtctttgaaattgtctatctattctgaattagttaaagccttttattctaacctcaaaattcaagaaagcactttgatttctgaggttttttggataaaaatggtcattgaccaatccctattctctgacttgacccaattatctagtgaaggtgtaccatttgaaggtacactgaatgatgattggaaatttgatttctctgtgcatgatgcccgccggttggtttgcaccaaccaagcggatatgaccggaaggctactttccggatcattggcttttgaaagtcgcatccttcactatctcattgtgcgtattttacttccaagatcttcaaaccttgcacaggtttttgaagaagatcctattgtcatgtgggcttatcataccggccgaaaaattgattgggcacacttagtttga

SEQ ID NO: 91907 - DNA, 192 bp, Glycine max
  Peptide Sequence Number=SeqID_208685
atgcctgaatatgcacgtatgcaattttgtttttgtagccaaaatactttgagtatgcgtatatgtaaatttagcaaaggaaatgcatgtgaattaggtagcgaatacgccttcgaagtgcatatatgtgatctaggaaatggctccgagaaagcttcctgcaaagagatccaggaaggacaaagcggctga

SEQ ID NO: 91908 - DNA, 219 bp, Glycine max
  Peptide Sequence Number=SeqID_208686
atggggatgtctactccacctttagaaacctcacgaactctgaaaatctcattcaaagctctgcaggatggcttcctcttcaagctcatgccagttacactcgctcagcttggaggtgaagatggtgcacttagcgatttgtgctcgctcaacgcctctatacagctcatccttcttccagaattgtccttgcgcttagccatcagatggtgcgcttag

SEQ ID NO: 91909 - DNA, 216 bp, Glycine max
  Peptide Sequence Number=SeqID_208687
atggcacaccctccaccccgtgagaggactctaagggaattggctgcaggtgaagacccacacaagcatctgaaagaattccatattgtctgctccaccacgaaaccaccagatgtccaggaggatcacatatttctaaaggcctttcctcattctttagagggagtggaaaaggactggctatattaccttgctccaaggtccatcatgagctag

SEQ ID NO: 91910 - DNA, 129 bp, Glycine max
  Peptide Sequence Number=SeqID_208688
atggttggagcattcttgcataatagcatgaccctgactggtctccttatgattttacctggtgaaagtgatctgacttaccagtgctcgacgaggtttttcactaacacggtaccacattgcatatag

SEQ ID NO: 91911 - DNA, 726 bp, Glycine max
  Peptide Sequence Number=SeqID_208689
atggaagcatggaccgatttgggcccttcgtttctcgagctagcggcgttggcgcaaataaacaaaaatgccctagccgtgaattacttagaggattcccaacagccggagagagcgtgtccaacagaaattgagaagtgcactgctgctcctgctgaggaagtgcatacctcaacagatgccgaggtccaaaaggttggggaatgtggatctgtggagttgcaaaagttggccgaggattctctacttaattcgttggaagtgaatgaggaggcacctattgaaagtagagatgcagatgtaccttgcccacttgttattaataacaataacaatgaggctgatctgatggaaaaagatcaaacttctatccctcataatcatgaccataagtcaagtttaatggaaagaaatagtaccgctcgcatttatgagtgggacgattcaatagatggcttggaggatggaacatcagatcatgcaactagatttaatttgcctagccccaaggggagagaagtttctccattggataagtacaaacctgcaagcattacaaagaggagaaaagtgaaaaaatggagtcagttggaagaggagactctaaggactgctgtagacaagtttggcaggggaaattggaagttaatcctagattctcacaaagatatatttgaagagagaactgaagttgatttgaaggacaagtggagaaatatgacgtaa

SEQ ID NO: 91912 - DNA, 682 bp, Glycine max
  Peptide Sequence Number=SeqID_208690
gtcgactctagaggatcccacctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggggatcttagagtgtctaggggttgtgccaggagggtctcttaatgccttcctttttcttctcatcggagttatttcacaaagacttgccatggaatctattgattctctcccaattggttggactgtaggtgcgatgatttacttcacgggcgaggtctctgctcagttggtagagctccgctcttgcaattgggtcgttgcgattacgggttggatgtctaattgtccaggcggtaatgatagtatcttacgggctgtcaagaacgtagaggagggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggg

SEQ ID NO: 91913 - DNA, 246 bp, Glycine max
  Peptide Sequence Number=SeqID_208691
atgaagagttcgaacgacttttcatccaatgggttcgggatgcattccagattggctttactgcaaaactatcaatctgaggatctggtgtataaaaagatcaatgccaatggttttaactgggctggattttcgaaatttatcagtggtgccaatattgaaaatattcttgaagagaaaagctttttgctgaaaaaggttttgacgggacttctacaagggaaatctcaaaggcagcgaatgtaa

SEQ ID NO: 91914 - DNA, 240 bp, Glycine max
  Peptide Sequence Number=SeqID_208692
aaataaccctcctactcatttgtcatttgtgatcaacatttcccacactcaaggacaagtctttgtcagcgttattggtggtagagctataatgagtataattgtcattgtcaaggcttatactttcaacaatactgaggttcacaaaatagttgtcctcaagaaggcgagcaagtggagaacacaagattgcttcaactctatgcctaccagtaacgctgcccaagacttctccttagc

SEQ ID NO: 91915 - DNA, 474 bp, Glycine max
  Peptide Sequence Number=SeqID_208693
ggggatgaggaagaagatcgaagaagaacaagatatgttgcttggaaaacgtcctcgggcaccgattatgaaaagaactacaagcatgagtggtggtttggccgtggaaaccaaaacaaccaacgaggaagtagtagtcatgtctgattcgcaacatgatgaggtggccgctaacaacaaactcgtcgatccacatgttgttgttgccatgggaacaccaaataataatgaattcgtgcctgaccacaccaaacatgtttctgaggccaaaggatcatatgtatatgctgatcgtttgatgggcatcaacatgagcatgcccctttctcccacaacctcaaataatcatcgtcacactcacatccacaaccatacaacaaacactaacaacatacacactacttctcactttcttcggacttgtggcctctgcaactgtcatttggcacctggtcgagacatctatatgtatag

SEQ ID NO: 91916 - DNA, 267 bp, Glycine max
  Peptide Sequence Number=SeqID_208694
atggtggtggtggcggcaccgggactcttcaattacgtcaattctatgccaaatttaatgggacatgatttacgacttcttccttgtcaccgtatattcaacgcagggggttgtcggaaattttgtagcaacgtgagcgagtcccctgtccaaagttgttggagtgaattttggcaatttgaaagtttgaagctggagtttggtggtagcaatggcaaaggaagtgaggaacacgcacgttcacttgttcaagtatcatattcatag

SEQ ID NO: 91917 - DNA, 207 bp, Glycine max
  Peptide Sequence Number=SeqID_208695
atgaggggtggaggttgcacagcagctcgcctggcgagctgcttgcttcctcctgaagtaactttctcgcccagaggacatattgcttatgactgtccaaccaggaggaccatgattatgaaggcagatggagcaatcacaagtgaatatgaaatcagtgaagaagagaaagaagtggaagaagagcttgaggaggaagctatgtag

SEQ ID NO: 91918 - DNA, 861 bp, Glycine max
  Peptide Sequence Number=SeqID_208696
ggaacataccaagtagctaaatggaatggcacaaaggttgcagtgaagatacttgacaaggacagttattcagatcctgataccataaatgctttcaaacatgaactcacattattagaaagggtgcgacatccgaatgtggtccagtttgttggagctgtcacccagaatatacctatgatgattgtgcgtgagtaccattctaaggtaggcttaccctctctgttcctctgtatctttgcaaaggtgacctggcaagctatcttcaaaagaaagggcgtttgtctccatcaaaagttctacgctttgctcttgatattgccaggcaagggcatgaactatcttcacgaatgcaaaccagatccggttattcactgtgatttaaagccaaaaaatattttgctggataatggagggcaattgaagatagctggatttggcactgtgagattttcgctaatctcacctgatgaagcaaagctggtacagccagagcctaacattgatctttcaagcttgtacgtggcaccggagatttacaaagatgaagtttttgatagaagtgtggatgcatattcttttggtctcattatatatgagatgatagagggtacacatcccttccatcccaagtcctcggaggaggcagttagactgatgtgcttggaagggaaaagaccagcattcaagatcaaaacaaaacattatcctccagagttgaaagagttgatcgaggaatgttgggatccaacacctgttgtgaggccaacattttctcaggtcattgcacggttggacaaaatcgttgcaaattgctcaaaacaaggatggtggaaagatacttttaaactcccttggtaa

SEQ ID NO: 91919 - DNA, 1827 bp, Glycine max
  Peptide Sequence Number=SeqID_208697
atggcatcaccagcaattttgagaaggagaagtttaatccatcaatacttgaataactgttttgcttcttctccgtctcctagtaatcgctctctggaacgcgctatagctacgacgtcatctctgtttccttgtaagcacggaacgacgccgtacagagatgacttgttcaatcctttcggattgggacaagttgttcgaggattcgggagcgcggttccgtgggacgctttttcgagactgaacgcgccgataggtgtgcggtggttgtcgcagtcgtcggccgcggcggcgaaacgtcatcaaccggataagaacgatgagacggtggcgaagaagcggaaagaagcgtcaccggaggagtgcgatcaagccgtcgaaggcttgaccactgcgaaggccaaagccatggcgaaacgggcgcaagaagaggcgcagaaagacctgcaaagcgtgttgcggagagtgtggactgcgtttttgggaatcggtcctgcgttgagagctgtcgcgtctatgagtagtgttgtggctgcaattgctatttgctgttgcagattgaaatttgaaacggtgaaatgtttgttcgttggtgatttggcgtttagggaggactgggcaaaaaaactggttcactggaaaggggaatttgtgtcgaccttgcagcattattggttgggttctaagctgctgtgggctgatgtgaggatcagttccaggttgttgttgaagcttgcgggtgggaagaatctctccagaagggagaggcagcaactgacgcggactactgccgatatctttaggctagttccttttgctgttttcattattgttccctttatggagttcctcctgcctgtgtttctaaagttattccctaacatgttgccatcaacatttcaagacaagatgaaagaacaggaagcattgaaaaggagactcaaggcaagaatagagtatgcaaggttccttcaggatacagtcaaagaaatggcaaaagaagttcagaactcccgcagtggagaactaaagaaaacagctgaagatcttgatgaatttttaaacacgattagaagaggtgcaactgtctccaatgaggaaattttgggctttgctaagttgtttaatgatgaacttactctagataatataagcaggccacgattagtcaatatgtgcaagtacatgggaatcagcccttttggcactgatgcatacttgcgttatatgctaagaaaacatttacggaggattaaggaagatgataaattgattcaagcagaaggtgtggattctctttcagaagatgaacttcgggaagattgtagagagcgaggcatgcttgggttgctttctgttgaagaaatgcgccaacagcttcgagattggctggacttatctctgaatcactctgttccatcatctcttttgatactttcaaggtcatttactgtgtctgggagattgaaaccagaagaagctgtacaggctacactttcttctctccctgatgaggttgtagatactatacaggttacatctttgccctctgaggattctgtctcagagaggaggaggaaattggagttccttgagatgcaagaagaacttattaaggcaaggatggagaatagttctagtcaagatgataaggccctgaaagagatgaatatttcaacagcaaaagaggctcaccaacttgctagagacagagcatttgaaaacaaagaacaactttgtgaacttagtcgtgcattagctgttttagcttctgcatcgtctgtaagttcagagcgtgaagattttcttagactggttaacaaagag

SEQ ID NO: 91920 - DNA, 183 bp, Glycine max
  Peptide Sequence Number=SeqID_208698
atggcagcggggccaagagcaaccccactgaggcagcaatgtctcataaaaaagaatgtgaacttcttagtgaatttgtcctatctaatatgggaaaagaaattcaaagaagacacaagtgattctaatcctgtaaaactatctagatgcaatcctgcaggagttgaggaaggcatagtgtaa

SEQ ID NO: 91921 - DNA, 825 bp, Glycine max
  Peptide Sequence Number=SeqID_208699
atgggtacatgtcaaagggggatgatggatggaagtataagggagtttaatgattggatcgcggagttggaggttgaagaagtgccatgggtgggaaagagatttacatggttcaaaccgaatggtactactaagagcaagctggacagaattttcgtctcccctgaatggatttccaaatggcctgggtccttccaacacacgttgcataggaacttctcggatcattgtcctgttctgcttacatctaagagtgtcgattgggggccaaagccgtttagaatactagattgttggctttcagacaattctttcaagaaattggtacaagatagctggacatctaatcatctgagtgggtgggggggatatgtgctaaaacagaaaattaaaaccctcaaagataagatcaaggtatggaacagagaacaatttgggaatactttcaagaaatacaagaagatcgaagatgacttgaataagttggaagaagaatcaaatgacagacagttagatcataatgaattgatagtcaggaagcagcttcaacaggcattatgggaggcagctcaagcacatgagtccttattgagacaaaaggcgagatccaagtggattaaggagggtgattgtaactccagatattttcatctgatgatcaattccaggcgtagagttaactgtttgaatggagtgatgattgatggattgtggaaggatgagccagcaatagttaaagaggaaatcaggagtttttccgaggggattgaacgcatcttttatagccctaattccgaagctagtggatccccaagtgctgaatga

SEQ ID NO: 91922 - DNA, 1817 bp, Glycine max
  Peptide Sequence Number=SeqID_208700
atggtgggtgggagagagttaggagtagaagagagcgaagagagagcggcagagagaaaacgacggagggcccatgcaacagaaaaagatttgtggattcacttcaagcaggtgggagacgtgagggagattttcatatcccggaaacgtaacagaaatggaaagcgatatgggtttgtaaggttcaaagggctgcgagatgtgcatcaggtggaaaagaagctagacagtatgatctttggagggttaaagatgtatgtcaacacccctaagtttgggagagcaaaatgggacaagtcaccaccaacggctaggggaagagctgactctaaacaacgaaaggaggtaaatagagacacgtacctcagaatgcagccaaaggagaacatcggagcacagcaagggtcgtatgcggaggtcgtaagaagacacataccagtaacaggacagaagagaacaccagataaggagaaatatattggttacagctcgcggtcatcggtgatccttgacactccgctgagagggcagcaatggcttcaggaggcttgggtggggagattaaaaaacttggctatgtttgatagaatagaggatgagatgttatgggatatcggagaaaacatatcaccgaaatacattggggatgatttggtcttgatcctgggtcttactgaagaaaaagcgctgagagtcatggaagaaggagatacaggatggggtgatctgttcacttccttggagaaatggaatccaaagttgcggcccgggtacagactgacatgggtccattgctggggtataccattgatggcttgggacatacctcatatcaagcagatagtgtcgtccattggcgatatggtggaggctgatgacgatgtagaggatctaaggaagctggacagggcaagaatactagtcaaaacgccgtggaagcctcttatacagcacgatgtgaatgttcagatagaaggggagacttttgtggtacacatagtggaagaaagtggggtatcatgcgccagatgccagtgccggcgacagaatgaatttagttcatccgaggagatttattcggacgaaagtgaactcggaacgccgctcgaaactagctcgaagacgtggaggaagatgatgcgaacccagggcatagcggctaatttcggggcagcaagtgggggctcaactaagtcgggagaaggagaggagggcgaacctaggtcggcgggagcaaacaaaccgccgaacgatgacatgcaacgatcgtcggaaactccaacagcggtttgcacggcgaccaaggggggagctgactcacagaaacggtggaacgatggtatgcaggaggtggcggaaaacccaatagggggcttcgcgcaaggcaagatcggagaggattcgaagcggacgacagctgcaatgcacgggtcaccggaaaagatggccgaaggtaccagtacgggcagggtgagggcggtttcacagaatggaaccaacggatattccgacggacttgatccaaaggacaaagacgaggtccagctgcatgcacagtctgacacagtgcagaccacgtccatagcgttgcagatgcatggcaggttggaggaggagaccaaccaaacatctttgcatctagatgggggaagctggtacaaggaggtgtgtgtcaactctgatgacttagagcagtttcacgaaaatggaaataaggaggcgcaggtgaacgttgaacatttgggaagatttaaaactgcagctgataggtcacgtgataaggaagtggaagggctaacagatttgggctatgatat

SEQ ID NO: 91923 - DNA, 1848 bp, Glycine max
  Peptide Sequence Number=SeqID_208701
atgacaggagtggcaggtgccatatgtgttcttgatgatgagccaacagccagtggcaaacattgtggtccaattgattccagtctatgtcaaagtcaaaaagttagcttctccattgcattgatgattcaacctgaatctggtcctgtttgtcttttgggcactgagtttcagaagaagatttgctgggaaattcttgtggctggatctgaacaaggtattgaggctggacaagttgggcttagattgattactaaaggtgataggcaaacaacggttgcaaaggagtggagtattagtacaacaagtattgcagacggaaggtggcatattgtaacaatgtcaattgatgctgatttaggtgaagcaacatgttatttggatggtggatatgatggctaccagagtggattaccattgtgtgtgggtagcagcatttgggagcaggggacagaagtgtgggttggtgttaggccaccaacagatattgatgcatttggtaggtcagatagtgaaggggttgaatctaagatgcatattatggatgcttttctctggggaaggtgcttaactgatgatgaggtttcttctctttataactcaatggcttcggcggacttcagtgcacttgattcccctgaagataattggcagtgggctgattcacctacgagggttgatggttgggacagtgatcctgctgatgtagatttatatgacagagatgacgtagattgggatggacagtattctagtgggaggaaaagaaggtcagagcgtgatggcatgatggtggatattgattccttttcgaggaagtatagaaaacctagaatagaaacacaagaagagattaatcaacggatgttatctgtagaattagccatcaaagaagctctctatgctagaggagagagacgttttactgatcaggaatttcctcccaatgatcactcattgtttgtggaccctgcaaacccccctgcaaagttgcaggttgtttctgagtggttgaggccaggtgagattggcaggcaaaaccatcttgactgtcgtccgtgcttgttttcagaagctccaaatccttcagatgtttgtcagggccgtttaggtgattgttggttcttgagtgctgttgctgttctggcagaggtttcacgtatatcagaggttatcatcactcctgattataacgaggagggaatttacactgtttgcttttgtgttcagggtgaatggatccctgttgttgttgatgattggattccttgtgaattaccgggtaaacctgcatttgctactagtaagaagggctatgaactttgggtctccatattggagaaggcatatgccaagttgcatggctcttatgaagcactagaaggtgggcttgttcaagatgctctggtggatcttacagggggtgctggggaggaaattgacatgaggagtggtgaagcccagattgaccttgcaagtggtagattgtggtctcaactgttgcgcttcaagcaagaaggttttctcctaggtgcaggaagtccatcaggttcagatgtgcacatctcttctagtggcattgtgcaaggacatgcatactcaatactgcaggtaagagacgtggatggtcataaacttgttcagatccgaaatccatgggccaatgaagtggagtggaatggtccctggtctgactcgtcgcctgagtggacagataggataaagcacaagctgaagcatgttccacagcatctctttatgattgagctgactattttctcttacctcaagcttatcgataccgtcgacctcgagggggggcccggtaccagcttttgttccctttag

SEQ ID NO: 91924 - DNA, 1628 bp, Glycine max
  Peptide Sequence Number=SeqID_208702
ttattcttgtggcattttgtggggtgtcttatttagaagttatcaaaaccagggatgaccaagttccaacaaacggtgatttcttagctgctttacttcctttagtctgcattccagcagtgctgtcactttgctgtggattgctcaagtggaaggatgatgattggaaactttctcgtggtgtatatatttttgttataattggtcttttgcttctgcttggtgctatttcagctttgatagttgttgtcaagccttggactataggagtagcatttcttttggttcttcttcttatggtattagcaattggtgccattcaccactgggcatcaaacaatttttatttgagccggacacagatggtctttgtttgcttccttgcttttctgttggctttggcagcatttcttgttggatggtttgaaggtaaaccatttgttggagcatcagttggttatttttcatttctttttcttcttgctggacgggcattgacagttctgctttcaaatcccattgttgtatattctcctcgagttttgccagtgtatgtgtatgatgctcatgcagattgtggaaagaatgtcagtgtggcctttctcatgctatatgggattgccctggcaaccgaaggctggggggttgttgcaagcttaaagatatatccaccctttgctggtgcagctgtatcagcaattaccctagttgtttcatttgggtttgctgtatctcgtccttgcctaactcttaagatgatggaagatgctgtgcatttcctcggtaaggaaactgttattcaagcaattgctagatcagcaacaaagaccagaaatgcattatctggaacctactcagcaccacagaggtcggctagttctgctgcacttttgattggagaccctaccattatgcgtgatagggcaggaaattttgtgcttcctagagctgatgtgatgaaattgagagaccgcttgagaaatgaagaattagttgcaggttcattctttagtagattaagatatcataggacattccgccatgagccaaccagcgatgtagatcatagaagagtaatgtgtgctcatgctcgaattctggcactagaagaggccattgatactgagtgggtgtacatgtgggacaagtttggtggttatttgcttttgttgcttggtttgacatctaaggcggaacaagcacaggatgaggttcgtctgagactctttcttgatagcattggattttctgatttaagtgctaagaaaataaagaagtggatgccagaagatcgcaggcaatttgaaatcattcaggagagttacataagagaaaaggagatggaagaggaagtcttcatgcagaggcgtgaagaggagggcagagggaaagaaaggaggaaggctctacttgaaaaagaggaacgtaaatggaaggagatagaagcttctctgctctcctccattcctaatgctagcagcagagaggctgctgccatggcagcggcagtacgtgcagttggaggcgattctgttctagatgattcctttgctcgagagagggtttcaagcattgcacgtagaattcgtgcttcacaattgtctcagcgtgcacttcaggtttattaa

SEQ ID NO: 91925 - DNA, 505 bp, Glycine max
  Peptide Sequence Number=SeqID_208703
atggccccttatggttttattgcttggctactcagcacttgtgttggattgttgctctcctttttaagcaaatcatctgttctcctcggtatatccttgactgtgccactaatggtggcatgcctttctgttgccattcccatatggatttgtaatggttaccaattttgggttccccgcctgaattgtaatggaagtgctggaaatgatcgaattcctcgaacaaaggagggtattgttcttcttatcagtatgtcagtatttgttggatctgtactggctttgggagcaatagtttctgcaaagcccttagacgatttaagatacaagggatggaatggtgatccaaaaatcttgggttccccttacacatcatctgtttttcttggctgggcaatggcatctgcaattggtttagttgttacgagtgtgcttccaataatttcatggtttgcaacatatcggttttccctttcctctgctatctttattggactttttgcag

SEQ ID NO: 91926 - DNA, 291 bp, Glycine max
  Peptide Sequence Number=SeqID_208704
atgaacccagatttcaaccaaccacgaggcgggtgctcgcgggaggtcagcatacaccccgcgcagcaacattgcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccaagagtcattgtatgtaaatgttgtgtcgtgacgactcccgcgggacaccgtctccgggcccccgggagtcgcacttaa

SEQ ID NO: 91927 - DNA, 267 bp, Glycine max
  Peptide Sequence Number=SeqID_208705
atgggtcttcattcttcatctagtgttaatggtgaggcttctactcctaaggaccccctgtataagatattagatgagttgagaacccttaagttctggaaagaaaaacaagcgagaaaagaaaaaggaaaaacaagagtggaagaaataagtctagatgaaaaagagaaaataagagaggaagaaagaaggaaaatactaaaagagttaagaaaagaaaagcatgcctcctatagtagtcataacccttgcaagagcctaagttaa

SEQ ID NO: 91928 - DNA, 1926 bp, Glycine max
  Peptide Sequence Number=SeqID_208706
atggccaatatctgcatttttcttttgacaggggctgttgcaatcctgcttcttttggctgttgctcttctttgtgcatatgaactttgtgcagtatatgttacaactggatcacgagcatctgatcgctattctccttctggtttcttttttggagtctctgcaattgctttagcaatcaacatgctatttatttgcagaatggtgtttaatgggaatggcttggatgtggatgaatacgtgcgaagggcttacaaatttgcttattctgattgtattgaagtaggtccagtggcatgtttacctgaacccccagaccctaatgagttgtatccgcggcaatctagaagggcttcccatcttgtactgctctatcttggttcactatgtgttctgttagtatactccatcttatatggtctaacagcaaaggaggagaattggcttggagcaattacatcagttgctgttattattcttgactggaatttgggcgcttgcctgtatggttttcaacttcttgatagtcgtgttgcagcattgtttattgctggaacatctcgtgtgtttcttatctgttttggagtgcaatactggtatttaggccactgtatcagctatgctgttatggcatctgtactgctaggagcggctgtttctcgccatttatcagccacaaacccattagctgctaggagagatgccttacaaagcactgtagttcgtctgagagaaggattccgtagaaaggagcacaacagttcttctagcttttctgaaggctgtggctcaagtatgaaacgaagtagtagtgttgaagctggtaatcttggtaatgtcattgaagttggcagggctatggctgcaggtgatgggagcaattggaataatgtcctgtctcaaactactagtttaccggatggaatcaatagcgataaaagcatagatagtggaaggtcaagtttagcattacatagcagctcctgtcgctcagctgttcatgagccagaagttggaacatcatccgatgatagaaatttggatcacaataattctttggtggtttgttctagtagtggtcttgatagtcaagggaatgagtctagtgcatcaaactctgcaaatcaacaaacactggatttgaatttggctcttgcattccaggaaaggttgaatgaccctagaattgtaactatgctgaaaaggacaagacaaggtgatcaagaattgagtagtttattacaggataaaggattggatcctaattttgctatgatgttaaaagagaaaagtttagaattagatccaaccatactggcattgttgcaaaggagtagcatggatgcagatagagatcataatgaaaatactgataacaccagtgttgacaatgccatgcctaatcaaatttcattatctgaagaattgaggctacacgggcttgaaaagtggcttcagttgtgcagacttgtattgcatcacattacgggtactccagaacgagcatgggttctgtttagttttattttcatacttgaaaccatcattgttgccatatttcgtccgaaaacgatcaaaattattaatgcaacacaccagcagtttgagtttggtttggcggtgctcctgttatctcctgtgatatgttcaattatggctttccttcgatcacttacggcagaagaaatgtccatgacatcaaaaccaaggaaggaagtgcttttgttgccttataatgtttttggttttgatgcggcagtttgtcttttaagttttatacattcttatagtgcacatgtattagttttagctgagaaggctaactttactggtggtatcatgataccattctcttgcctatataagctcttggggtgggattattgggaaactctttggaaaagtgggattgtcctagtttgttga

SEQ ID NO: 91929 - DNA, 336 bp, Glycine max
  Peptide Sequence Number=SeqID_208707
atggccaaatatcttgcaaggtcctcaactccatttgctctgtggtatcctgaatctttctgcatgggtagttgttatttctccaattctggtgcttatcatttggggctcttggttgattgtaatattgggtcgagacctgattggtttggctgtaataatggctggcactgctcttctattggcattttattcaattatgctgtggtggagaactcagtggcaaagctcaagctttactggattcagtgcaaacctggttcccaaaaaaaaaaggtcaaaaaggttgctggacttgttggagatagtattgccttggttagtgaaaagaagtaa

SEQ ID NO: 91930 - DNA, 318 bp, Glycine max
  Peptide Sequence Number=SeqID_208708
atgttgcagttgaataagcatggacaagcaaaacggattaaacaaagagctgaggttgagcgagaggacgaggttgggccgttggggatactaagcccgatctcagggaaggttcagggtcagtgggtaggtctaaggatggttcctcagttaaaaagagaagaaacttgtgggcacatttgtgaccggtgtttaatgggaaaagtttggagtgggttagggttgtctgtaagcgctaaaggtggtgcctttggaacgaatgtgtggatggctaaggcaacaaatgtgccttttggtgtcccgaaacttggtctctaa

SEQ ID NO: 91931 - DNA, 279 bp, Glycine max
  Peptide Sequence Number=SeqID_208709
atgggttggattaaggggaaaggtcaatatattggtggtgttggtaaagataggaaaagtagtgaaaggggtgaaacggtggaaaaagaagttggtgaggttgacgagttttggggaggtagtttgggtaggcgttcaaggatccctaatagggttttggcgggggtctcatgtcaagcatcctggacagcatggggacaacaaaaagccaatttcgtgggtaataggggtgagggcgttatcgaggtctttgttggacttggtgaaaggcatggatag

SEQ ID NO: 91932 - DNA, 282 bp, Glycine max
  Peptide Sequence Number=SeqID_208710
atgacattcatggggctccaaaaagaagttgagagaattggcgaacagttgtacgcaataacttcgcggggctccagactcgttggtggaggatgcatgaatagcgctaggcaatggcattcatggggctccgaaaaaaaggcgaggttggagaattgcactaagcaatcactacgtgtggctccaaactcatatcgctacacaataacttcgcggggctccagactagttggtggaggatgcatgaacagcgctaggcaatggcattcatggggctcctaa

SEQ ID NO: 91933 - DNA, 411 bp, Glycine max
  Peptide Sequence Number=SeqID_208711
ggtccagcggctggaagagcaccgcacgtcgcgtggtgtccggtctccaaggtgaacagcctctggtcgatggaacaatgtaggcaagggaagtcggtaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttctccgggcgtctaacagtcaactcagaactgaaattcaaccaagcgcgggtaaacggcgggagtaactatgactctcttaagcgaaaccacagccaaggaacgggcttggcggaatcagcggggaaagaagaccctgtttga

SEQ ID NO: 91934 - DNA, 621 bp, Glycine max
  Peptide Sequence Number=SeqID_208712
atgataggaagagccgacatcgaaggatcaaaaagcaacgtcgctatgaacgcttggcttccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacatgtcttccgctcggatcgaccgggcttccgattcacggaataatcggattccccttgtccgtaccagttctgagttgactgttagacgcccggagaagaggccccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgaggttacggatccattttaccgacttcccttgcctacattgttccatcgaccagaggctgttcaccttggagacctga

SEQ ID NO: 91935 - DNA, 567 bp, Glycine max
  Peptide Sequence Number=SeqID_208713
atgattgaggacgtacctgcacctggtgcagagggattagttggtgatggtgctgagggattagctggtgatggtgctaagggagtagctggtgatgatgctgagggattcccaggtgggccacgtgacccatcagtgctgacttcgtttgctgaccatgttgcacatagcatatggaatggagaggaacgtcctaaattgaagttagccttccacggaaggaaagttgagaaatttgggagcccagctcttgagattgaagggttagtcgttgccatagaattaactcctttgatcgcgtgttcagtagacactggcgatcggggagatatatccgcttttttcgagaagtggcacaaggagactagcagcttccatcctccagtaggagagctgaccatcacattggatgatgtggcgtcactccttcatctttcgatcataggcaccttccacagcttcgagcctctacatgtggacgaggcggtcatcatgttagtggagttgcttgaggtctcgggtgaggaggctagagctgagactgcacagtgtcatggggcatattaa

SEQ ID NO: 91936 - DNA, 732 bp, Glycine max
  Peptide Sequence Number=SeqID_208714
atgagcgggctgagcgagaaggccggcgatcgtttcgaaacgctctcttcgccgttcaatcacgtcgaacagggcaagattgtcattccgcagatgcgctttgaaccggcgctcgccaacgaggcggagcaccttgaggagatggcgcgatactttcctcagctacgtgaccgatctgcggctgatgctgctggtgcagggcgaccagccgcgctaccggctggtagaagagcaccgcaagcgggtggagaagggcgtcgccagcgtgctggtggggctgcaatcgttcgccgaagggctggatctgaaaggcgagctgctgacccaggtacacattcacaaaattgcgttcccgccgatcgacagcccggtgatcattaccgaaggcgagtggctgaaatcgctgaagcgctatccgttcgaagtacagagcctgccgagcgcctcgttcaacctgatccagcaggtcggccgcctgatccgcagcaaccaatgctacggcgagatcgtgatctacgatcgccggctgttgaccaaaaactacggttcgcggctgttggcgtcgctgccggtgttcccgatcgaacagcgcgcggtgccggaggccgacaaggcgcatctggcggcgttgaaatccgccgccgacgcggccaaaaaagagaagaagcgcggcaacccgtttgcccgcaagcggcggcgttaatcagagcagcggcggcaggcggcgcttga

SEQ ID NO: 91937 - DNA, 239 bp, Glycine max
  Peptide Sequence Number=SeqID_208715
gacgcgcgcgcgtcgttgaagacgctgagcgcgcaggtggggctgtcatcgccgagcacgtcggaaaggctgcggcggctggaggaaagcggcgtgatccagggttataccctgaacgtcaacctacaggcggtgggctacgccttcgagtcgctggtgcgcatcaagccgctgccgggcatgctgaagaaggtcgagcagctgattcaggcgataccggaagtggtcgaatgcgataa

SEQ ID NO: 91938 - DNA, 630 bp, Glycine max
  Peptide Sequence Number=SeqID_208716
atgcttccgaatccaggatttgctcgcaggtgtactgcgaggaacggcccagctgcacgtcggggcgacagacggtgcgtagaagtggatgtagtagaagtgggccatgtcggtgacgttgtccacgatctcgcggcagttggacccctcgatgaagatggtgttccagtcccaggtggtccagccatcgtcggagtactccggaatttccgggatctagacgtcatcggtggggccgttgccttcggcgtcgtgccaaacgaacagcagaccgctcttgacgtcggtgatccagctgcgtgtgcgggccagcttcggggtgcgcttggcgtacggaaccagcttgcacttgccgtcgccgccccagcgccaatcatggaacgggcacgtgacgttgtcgcccttgatggagccctgagacagatcgccacccatgtggcggcaatagccgtcgagcaccttgatgtcgccctgggtgtcggcgaataccaccagcttggtgccgaacgcgtcgatggcgtggggctcaccgtccctgaacgactctgcgacgcccaggcagtgccaaccgcgtgcgtagcgggtggggagctcaccgacgtcgatctcgcgaacgccgattcatgcggt

SEQ ID NO: 91939 - DNA, 2511 bp, Glycine max
  Peptide Sequence Number=SeqID_208717
gaaattggagttcctacctttgaggcatctgatctggaacaaggaggaaaatcagccaggattgtgaacagcgtcttgggtcttaagtcctatagtgaatggaaacagactgggggtaatggtgtgtggaaatttggtggaactatcaaacccgcaatctcttcaaaatcttttgtgagaaaaacctctgagccatttactaattccttgtcaaggaactcgtctatcaatgaaaaatccatgactgttcttacctctgatgttgagtctaataaaatggttggtaagctgtctgggtctcattctttgagtatgcttgttcgtgcaatactattagataagaagcctgaagaagttccattgttagttgaatcagtcttgaataaggtcgtagaggagtttgagcaacgcattgccagccagggtgaacagataaaaatttcaagaggtgctgtgtcccaaggcaatggatctgtatcaaagtttgttatggcagataaaaagatggatagcaagattcctatggtaacaaagaaagaaggattcttccataaaaaccatgttgatgatgtggaatcgaaaagacaacttctgaagcagcaaatgctctttgataatcagcaaagagatattcaagaactaaagcatacaattcacaccaccaaagctggtatgcagttcctgcaaatgaagtttcatgaggagttctccaatctaggcaggcatgttcatagcttagctcatgcagcttctggatatcacaaagttcttgaagaaaatcgcaaactatacaatcaagtccaggatcttaagggaagtataagggtgtactgtcgagtaagacccttcttatctgcacaaccaaattattcaagcacagtagataatatagaagatggaactatcacaattagtattccttcaaagaatgggaaagggcgtagatcctttaacttcaacaaagtctttggaccatctgcatcccaagcggaggtcttctctgatatgcagccactcattaggtctgttcttgatggttacaatgtttgcatatttgcttatggccaaacaggatcaggaaaaactcacactatgactggaccaaaagagatcacagagaaaagcagagaaattcgtagtaattctcatagagggctcagcgtaccagatgcatgccaagtcccagtttcatcaacaaaagatgttattgaactaatgaacctgggccaaaggaatcgtgcagttggagcaacagcccttaatgaccgtagtagtcgatcacacagttgcttgactgttcacgttcaaggaagagacttgacttctggaactatcctacgtggatgcatgcatttggttgacttggcaggaagtgagagagttgacaaatctgaggccacaggagatagactgaaagaagcacagcacattaacagatctctttcagctttgggtgatgtcattgcttcccttgctcagaaaaaccaacatgtcccatacagaaatagcaaactcacacagttacttcaagattcacttggaggacaggccaagacactaatgtttgttcacataagtccagaggttgatgctattggagaaacaattagcaccttaaaatttgcagaaagagttgcaacagttgaacttggtgctgctcgagtgaacaaggatggggcagcagatgtcaaagagctcaaagaacagatagccagcctcaaagcagcattggcaagaaaggaaggtgaatcagaacattctttatcaggtagctctgaaaaatataggacaagggctggtgaggtatcaccttatcatgcaaaccaacggggtgctgatattgtgagcctagggtgccggcaaccaatgcttgatgtaggcaatatagagcttcacagtaataccccattgagacaaaaaactcagagctatgattttgatgagatgtcgacgaattcaccaccctggcccccattgaataatcttggactaaactatggggatgatgacagagaaactggttcaggagagtgggttgataaagtcatggtaaacaagctagatgctacaaacaaaactgagaacatcttagggtgttgggaagcagacagtgggaacttatctgaggtattttatcagaagtatctccaagatccttccaaaatggacccagaaagatcccacaacatgttcatgggaggcaacaaccagtttaacgttgctggttcagatgacatggatgatcttgatgatacaaccactgattcctcggaacctgacttgctttggcaatttaatcattccaaacttgccagcatagccaatggcaatggttcaaaggctaggagacctgtctcaaagccaacaaatagcccaatattgagcaagaataatgttcattcttctcttggtccttcaccttcaaggaaacaacaatcaaacggtgtcaatcgaacagcaagacatccagctccagttgacatgaaacgtaaaactgggagtagaaagtaa

SEQ ID NO: 91940 - DNA, 207 bp, Glycine max
  Peptide Sequence Number=SeqID_208718
atggtggttcggaaccagagcaatgaggttcgggagcatggtaaggggccacgccacgcatccaaagcgggacgggacccacacgctggattgcatgtaatggtaacggagtgggaaaaatcgtttggacgtggcgcctttctcttgcttcatcataaccgccggcaacgtgctactcactacccactgcgcgtgcctaatgcctaa

SEQ ID NO: 91941 - DNA, 156 bp, Glycine max
  Peptide Sequence Number=SeqID_208719
gatgtgcggaaaaaggcacaggccatccaaaagcaaaacactatcccccacgtcttgtcttgtggaggttatgaatatttagaagataagctgatggatgagaaaacaaagaaaaactggaggaagctgctcaatccggaagcactgaggcagtga

SEQ ID NO: 91942 - DNA, 2478 bp, Glycine max
  Peptide Sequence Number=SeqID_208720
atgaagagtaaaggggtagttaatgatatgactggagctgttttaaactcaaatgaggattcggagaggccagatagagctttgagtgctgcacgaccatggctggatcctaggattaacatgcttaataatcagcacacacatagagatgtatttaatgattctgttcctgaaaagagcatggatgggtcatcatacggaggcagtgaatatagttctgtcatttcaagtaatttggtctcaggggctggaagaactggaagtaagctcattgatttaggacatgacaaaacatggttcaaaacagatggtggtgatccagatactacatctgggcaaagaaatggtttcaatctcaagcgtagttattcaaatcgtgaagcaccaaagctcacgaatttggatgcacatcgtcagccaagacaaagcacaactgacatacggaacaatttgatgtcaggtaactggaaaacttctgaagaagaggagttcatgtggggtgagatgaacattggtttgactgatcatggagccaatgtatcaagcaatttgagcacagacacatggatggcagatgatgagaatttggaaggtgaagatcacctccaaatcacacgcccttttggagcaaaggtcgatagagaaatatccactgctaagaaacaaccacctggttttgggggtcatccaccgtcatcctggcaattgcagaagcaccactcaattgataagttgaatctaaagccaggttactcagaaggatttgtgtcaactcttagtggattaccagccaacccaagttctttggctgtcaagaaggggaaccaatcctttacatcgaatgcagtagtaggaatggccaaatttgtgggacaacaatttgattctggggaaactgaatccccttctgggcagtcacctttgcggcaacagtctccatcactgccaggagcagtacaccatactcattcaatgcaaaattttgctgaccaagaattgccccagaatctcaaaacctctcgatttttgggaggtccgataagtcagcatattagagatcgctcacctaccggtcatccaattgttcaggttggtaacttgcgaagatcacaggaaagggacatgcacggcccattatcttccatgacttcttttcgaccaaagcttcagcaaaagcagctgaacccatctcagactgaagttactgctaaaactaagctgccccagtctaaagtttctttaaccagagaaacttcagaacagttgagcacaaataatttgtcagctgtacctgtcaagagtggaatcatccccaagaaatcaatttccagtaatctggattcaagggaggatccatctcagactggggttcaacctactcagtctggcaggcctaccacattaatttcttcagggtctgctgtggcatcaccatcttcattagatcctctgcataatgattcatctactctgccaaaaaaacctcaaggaaaggctggacaaccaccacaaaggctttctactcaaccacctgcttcctctagtgttagcagttcctcagctccaaccttaaatgctgccaaaaataataaattaaatccaattgcaaaccttttaagctcattggttgcaaagggcttgatatctgcagaaacagaatcaccaactacggtaccaagtgaagcgccgaagggatccaaagatcaaactgaaataattaccaccagttgttctttaccagttacatcaatttctggttctgcagctatcccagtatcatcttccggagataaggtagatgctgctacaaaaatctctcatgcctcacctcaatcaactagcacggaaatcagaaatctcatcggctttgattttagacctaatgtaattcgagaattccacccatcagtaattagggaattatgggatgatttccctcataattgcaaagtttgtggtattaagcttaaacaagaactgtttaatagacacttggagtggcatgccgcaagagaacatggtccaattaaggcatcaagaagttggtatgctaagtcaattgattggattgctggcaggacagaatattcatctgagtccgagtttactgactctgttgatttacaagacaaaaaaatagacagcagtcaattggatacgatggttctagcagatgaaaaccagtgtctgtgtgtattgtgtggcgagctatttgaagatgtgtgctgtcatgacaggaacgagtggatgttcaaaggggccgtttacatgaacttttcagatgtcaattgtgagatggaaagtagaaatgtgggtcccatcattcatgccaaatgcttatcagagaactcagtgatcaccaattcgaatggagtgctgaaaggcatgcttaagaatgcgaaattagaagccatgcttaacctatgccactggcatgtcgtgcaccatggaaggcagcgtgagcaacagataatataa

SEQ ID NO: 91943 - DNA, 513 bp, Glycine max
  Peptide Sequence Number=SeqID_208721
atggacggagaacacaccactggtacactcttggcattttcccttctttcactgtacactgagagcgttgcaccaaacagcaacacggcggaggacattgctgccccaaacggcatcgtcattgtggaagataaagaagccccaaacgacgtcgttgcggcatcgaaaattgaagaaccagtggtgcagaatgcgggtgcgggagaggaagaggaggccaaggagaagggtatagaggaagaagaagcgaaggagaaagagagaagatggataacaagatgcaaagacggtagggtttgtggaaaagaaggccaacagggtgagttagggattttaaaaggtaaagaggggttaggagtaaaagatttggaaaggttcaatacaactatgttaggaaaatgggcttggtggcttctaactggggaagaatgtctttggaggaaggttgtggtggaaaaatacggaccattagagttggaaggttctatatctgtgagcgagggtaggggatga

SEQ ID NO: 91944 - DNA, 478 bp, Glycine max
  Peptide Sequence Number=SeqID_208722
atggaaatgggagcagaatataagcctgattggaactctgattgcactctcttaatgatcaatattggtcctcaaatctctaaggatagccggcttaacgacactagcctgactggtcttattcccatgccactaagtaatattacaactctccaaatgctggatttgtctaacaaccaactatcaggtgtggttcccgatagtggctccttctcattattcactcctatcagttttaacaacaacttggacctatgtggcccagtcactgggcatccttgtcccgggtctcctccattttctcctcctcccccttttgtcccaccatccccaatctcaactccagaaggaaatagtgccactagtgcaatagctggaggagtagctgcaggtgttgctctgttatttgctgctcctgcaattgtgtttgcttggtggcgtcgaaggaaaccacaggagtttttctttgatgtgccca

SEQ ID NO: 91945 - DNA, 291 bp, Glycine max
  Peptide Sequence Number=SeqID_208723
atgtccatacaggcgaaaaatgtgggattctatcgagtcctttcacttgcaaaacctgaggctggaaaattaatgattggtatagtggctctattgattgcagccacatcaagtatattgcttcaaaaatttggtgggaagataattgacattgtctcaagggaaatgcaaactccagaggagaaagatgaagctttgaatgctgttaagaacaccatactagaaatctttctaatcgttgtctttgggtatgatccttgcttgagtaccttccaaattaatcagacatag

SEQ ID NO: 91946 - DNA, 1062 bp, Glycine max
  Peptide Sequence Number=SeqID_208724
atggttttggtttccattgttgaaggagattatgaagttgccttgtcaaattatcgcctaatttccaccgaatacaagattgataaagcctggaagcgttatgctggtgtgcagatgcagtccaagattagcgctttcttcaaatctactacctccgattcctcttccgtctctgccgacaatgacgacgacttgtccatctgggagaagcagcaacaccatatcatcaacacctacacccgaaggcctccaaaccctaacgccgttattccttcggtggtcaaaaacaagaagaggagctacgcccaattccacctcgatttcggccaatccgatttcctcttacgcgcctgttccacttgcggaatcaatttcactcccggcgacccagacgacgagaaatcccacaaccactttcacaaatcctacacccaggggatacaattcagaggttggaccaaagaaaatgttatccctcttcccaccctcgaagcgggtcgaatcattttggtttcggagatcgacctcacttctcacagaagaatagttgagcaggtcgtgagtatgatggaaattgagcttgggtgtggatggatccttcacgacctctttaaggtgtatctgtttgtttctcttcacagggttgttgggtgcctcgttgcagaaccaattgaaaaggcattcaaagttgtgtctggctctcctgatagcgtgaagaaaagggaagtgaggacgcgttctaccacttttcggtttgggaatgttattttccaaagggaggttgaaaaaaaagttgcttccttgagtgattctgaaaggatggaaggtgcaatcttctgtgatagcaaaccaaccatcgctgcttgtggcattagggccatttgggttgctccctctaacagaagaaaaggaattgcaagcaaattgcttgatgccgtgaggaagagtttctgcaaggatcttgagcttgaacgttctcaactagcattctctcagccaacctcagctggaaaggcattggcaacaagttacactggcactggatcattcttggcgtattaa

SEQ ID NO: 91947 - DNA, 798 bp, Glycine max
  Peptide Sequence Number=SeqID_208725
atggcctcatcaacaaggttttcccctctgccccaatccgaacctgatcgtgacaaccatgaagaccaattacccctctcaatttccgtggaatccacaaacactaggtctggcatttcgtccgaacattattacgccgaagaaatattcagcatcagcgcacgcacatgcgaaatgattcaagacctccttggcctcacgttgttgatgatgctaatattattacctctatacaagcgtttggggacgccaaaggaaaaccctattcccccacttttcgttcttaattcaatgtatctttccaacttcaccaccacggggagtactggaggaatttctgccacgtgggatgccaagtttacggtcacaaacaccaacgtgtcgtgcatctatttccgaagcattgatttcactatattctataagcataacccagaagatgctctttctgtggcgtcttcgtaccccttttacttggacaagggggagtatgtgaaattgcatttgaagttcacaaagggaggagaagggtgggaggataatcaaccctctgtggagaatcggttggtggaggagatgggtaaagataaagcgaaaaatggggctctgagttttggaatgcaaatgaaagtgcaagctatttactatggggaaacgtgggtctcggatgtggtgatgaatcctcattgtgaagacttgagggttcagtttctgcctcatgaggattctggaaggatggctaaccctaataggaacttctcggttcctttacattggaagccattctctttcttttga

SEQ ID NO: 91948 - DNA, 408 bp, Glycine max
  Peptide Sequence Number=SeqID_208726
atgaagaggatcctgaagtacaccttgggcagcttaagaggttctcattacgataactgcaagtttcaacagatactttcaacaataagaacattcttggaaggtgcagagaagaaaccatctgtacccaaaaaatcatcgaagcacattgaaagagaacagccttcaacatcaactgcctctataaaatcaaagggaaaagacactgatgttgctaggaaatgctttgagccttcggaagtgaaaaagtgggccattgatgatttgaataaaataattcagtggctgcaaagtcaagaagaaaagctagatccacgtgagttgacaaaaatagctacagaggggattctaacatgtttgcaagatgcaatatgttatttagaggaaaaacaagtaatgtacacatag

SEQ ID NO: 91949 - DNA, 471 bp, Glycine max
  Peptide Sequence Number=SeqID_208727
atgtgtgatgtcaagtttctcaataaagagcttgttcgtgtggcttccttttcagaccatgaagcatttgaccatcctgtgatatgtcttgtagctgtttcatcaaaggatgaacaacctattagcagatttgttgacctttttaataccaacaagcttccttcccttcttaatgatggtgcaatggatccaaaagtttcaaagcattacttgttagtgcatgataatcaagatggccctgcagacagagcaagtaaaagattgacagatatgaggagtacatttggggcaagtgactgttcgttgctttgcattaattcttccctggatgctccaatcaaaaatcaagataatccttgggcttcatatataactgatgcctcacctactcctagtcaagatcttggttgctttctcaacattgatgatatcaacgaggtttctgcaacacgaaaaggatttaaaaactaa

SEQ ID NO: 91950 - DNA, 798 bp, Glycine max
  Peptide Sequence Number=SeqID_208728
atgccattatcaacagctcaagtcgaatcaagaacccagttctcgcctctgccccaagacgttgaacaagggcacaatcaaattcaggtaaatgaccgtcacatagtgctagagccatacgaagaacgtgtagattgggatgcccttgtgataatgctacgtttggtcatgattggaatgttgctcgttgggttttccctacgccaaagggaattgtacgaaccaacattcgatcccgtggcacccaagttcttcctcgactcgttccacattcctcaccttaaagtctccgagggcgaggtttcatccacgtgggacgtggcactaaccatctccaacgtcatgaactactccaacgtcaacatcctaaagctggaagcgaaagtaagctacgaggaaaacgaaacgctagcggtgatcactctcagtatgcccaaatacacgttagaaagcgatgttttattgttggacgaggaggagacgaagagggtgcatttgaagttgagtacgacggggtgggaggagaaccaacccattgtggatgacaacgttgttcaggccattgcaaaagatgtgcaacgtggagttactaggtttagtttacatatgatggttacgggggaggttgggttgggtgatgggttggtcgcaatttttgctatgtatcctaaatgcagtaatttggaagttaagtttgtagccggagatcagctgggtgaggcggcgtatatgatcgatcgcaagcctagagagtgtgtaggtcttattgaatggggacctgtgaaagaatcgatatag

SEQ ID NO: 91951 - DNA, 846 bp, Glycine max
  Peptide Sequence Number=SeqID_208729
atggatccatcccatgatgaaagaggacccccaaatgaatcattaacccaccagtcctcttcccgtaggcatggggatgcaccaccaccgacggtggcaccaccgcaaatgatgtattattacccgcaagggtatgccccacaacccatgcctcaccaaggttacccaccaggttatgccccataccctaatgagtaccatcaacaaccataccattaccccgcaggtccctactttagcactccaccgacctatcacaatggtggcggaagcaaagccttcattcgtggcttcataatgtgttcatgtttaatattcacatgcctctttgttgccacccttattatggcgctagtgttgcacccccaattacccgtttatacgattaattccttgtctgtggcaaatttcaacaccactcaattgttaaccgcaaattggaacactagcatcatgatccataacatcaacaataggctaattggtttattttctgattttaaggtggatttgttgcacaaaaattacatagtagcagtgagttatgtgcctaatttcgagttgaacaagaacgaggttaagcgaattgatgcgacaccattgtcaaatggattctcattcccaaagtcgaacttggatgacatggcaaaggagcaagccggtgggtccgtcacatttgctttgaggatgacttccatggtcacgttcatgtctagcacaatgtccacaagaaacacgttgatactagcactttgcagtggcttgaaggttgtgtttcaaaacaacactggcaacggagtgttggacaatgcgggaaagcccatcagttgccaactttatatgtga

SEQ ID NO: 91952 - DNA, 153 bp, Glycine max
  Peptide Sequence Number=SeqID_208730
atggttgctagtgggtggctatgtggaaaggatgacatggaaaggggtggttcgacaggtggtgtgggttgcagtggctggagctggtttatgtttgaagtacaagtatttacagacatgttgaaaaaatatgatgggtacaagtccaattaa

SEQ ID NO: 91953 - DNA, 516 bp, Glycine max
  Peptide Sequence Number=SeqID_208731
atggagttggagcgccagtgttggggcctgggtggtggcgtggcggcgcaatggtggcacggggtttggggaatgggtccggggaaggctatccttgttgctgatgagtcaagtgcaaataggcgtgctcttcgggaactcctattcaccacacctggtgcttttgagtgcctcaatggtgtgatcttgtttgaggaaaccctataccaaaagacagcttcaggaagacccttcgtagagttgttgaaggaaggtggagttcttgctggtatgaaggttgacaagggcacagtagagatcgctggaactaatggggaaactactactcaagttcagcagagcactctcaaggcatggggtgggaaagatgaaaacattaagaaggctcagggtgccttcattgctaggtgcaaggcaaactcacgtgcaactttgggagaacttacaagggtgatgctacccttgctgagggtgcctccgagtctctccatgtcaaggactacaaatactaactag

SEQ ID NO: 91954 - DNA, 207 bp, Glycine max
  Peptide Sequence Number=SeqID_208732
atgactgcaagtatgccttcccaacccttgcattttggttttcctttagcaggaaacttctttactctttcccaagtacggattctgcctgttcaggagcttgtagcggtagttgtgccagtaccacatagccttaaaatgcaacaaaatacttggactgcagataaggctcagtgtcatgctactgtcactcactcgcttctgtaa

SEQ ID NO: 91955 - DNA, 699 bp, Glycine max
  Peptide Sequence Number=SeqID_208733
atggtaactggaattcagaaccacagtgaaaaccagaatgaagatgggagtgaaatactaaatagcactactgccagaggtgctgaaagctggacagaatctgagattgcaaggcttcaacagttgagagctgagatggagacaaggtatatgcaaagtgggtgttcagaagaggttatgtgggaggaaatagctaccaaaatggcttgttttggttacgaaaggagtgctgtggtcttcaaagagaaatgggagagtataagtaactatgcaaggagtgtcaaggatggaagcaagaagcgcaaggaagactcaagaagttgtttttacttcgataacagtgaccaatcttctctgtataaccaaggaggtgcctattgtgatatcaacgatcaaaggcacaagactgggaggctgcaaacaaatgatggctcttcaccttccaattcaaatgttggaaatacagttgcggttgataactgctttcccttcttgatgactgagagtggaaatttgtgggagaactatagcttaaagccttttatctcagatgatctcacattatgtaagcaagagctaactgatgagggtcgtttatgtatagagactgatgatgataagggagactacacattggcaaatatcactgaattgttggggtgtgagtatgacactaattcaggtgaatttctccattag

SEQ ID NO: 91956 - DNA, 168 bp, Glycine max
  Peptide Sequence Number=SeqID_208734
atggcacgacggtggtggacacggcctcaatggcggcaatggaagtggaggatggcggcgacacgacgccaaacggagaacaaaggaagaacgtgggctgttgggacgaatgaacgaacacacaagatggagggggtcgagctagaaaaattaaaaggttatgggtaa

SEQ ID NO: 91957 - DNA, 495 bp, Glycine max
  Peptide Sequence Number=SeqID_208735
atggtgtatatatctccttgctcatggtatggtcttctaagaggcacgttaaaggcccctgctgttggctggatgatgtataacatgcttgtgagcaacgagaacgcaatccagtcacagtacaaatcccatgtatatgccaaccctgacaatgtgactccaggaattgtggaaagcagatatgcattgaccaaaagaaagggagcacgttacttgcctgccgcgttcctgactggtcaattagatcctgttacatctcgcgaggagttccttgagctcttcgcggctttggagggaaagacacctgtgctggttgtatcaaccaaaggatctcccaagaggtctaaggctgagatggaagctctcaagggagctaaaggggttagcaagtttgtggaagtgccaggtgctcttcttccccaagaggagtatcctgctttggtggcagaagagctttatcagttcttgcaagaatattttggcactgttgcttag

SEQ ID NO: 91958 - DNA, 310 bp, Glycine max
  Peptide Sequence Number=SeqID_208736
gaacaacaagttgggtggtaaacgtgcagagatgaattatgcgccctttatcattcaagagcagcaagctggatttcgcaagtcgagtgataaacgcgcagagacagattctgcgccctttgtcatttggggacagctcgatcgtgtccaacaaaacacagagacaaagtatggtcattctgcgtcttgtatcaaccaagaggaacaaattcgacagtatcaggatgatgtgtcggggcaactgtcataccctaatttcatccggggaccatccgttgttgggatgcgaccctcgtttgaccacttcgag

SEQ ID NO: 91959 - DNA, 312 bp, Glycine max
  Peptide Sequence Number=SeqID_208737
atgattcttgatgaccatgaaggagaagagcattgttgtggcataggaacaaatgcgaggagtgtttcttttttgccaagaagccaagagaagatacgagattcgactaaagttgtgataaaacaagacatgaagggaggagagcataaatatgggtttaacaataatagacgtgagaagccagagaaggtaagggtggtggatcatgaaactggcgacaaacatgagttgtatgaagtcctaaggatgtcatctagatgtgtaaaaactaatgcctcaagttttttactgagggcaggaagggtattataa

SEQ ID NO: 91960 - DNA, 231 bp, Glycine max
  Peptide Sequence Number=SeqID_208738
atgacgaggatcaccacgacgcgattagctcagcagtccagcacgacaacgatgacgacaaccaccacgacgcgagtagctcaacgagagtcattttgggtggttagtagcttgaacaagattttcataaactcgtggactcagagcagactcgcgagtctacccaaactcgtccaagtctacgcaaaatcggacgagtctactccggtttcaattctacttccgatttaa

SEQ ID NO: 91961 - DNA, 642 bp, Glycine max
  Peptide Sequence Number=SeqID_208739
atggatgagaacatgaaacagttccaaaagaaattaacagaactggaagtggaagctgagcatcttcttttagcccgacatcagccaaccccacctagtggtaaaaaggctgaattgttgtttaaagattttatgctggttgagaacgatagattgagaaatgggaatagagaagcacttactgcattaaggaaaagggctcgaacaacaaagagcagtgttccatctccttttgaatcaataatgaagggagttgcagggtccagctcaagacctttggtgcaagaggtttgcaccacctgtggcaaacatgactcttctgagcagacgtggatgatgtttccaggaactgatctgtttgccagaattccatttcatgcggctcatactatattggaaacagatcaaacgcagcttgactttgagtcaaagagactacagagcattgtgaaggaaaaatcttacattatatcagaggcaggtgttcttgcagacaagataagtcctggagtgctcaaatcacttgtatccttaaacgacaagccaaatatcaactgggtggaaaatggcaagtgttttctggaagtctttcatgaggcatttaggctgaggtttatctattctgttgctgtgattgtgtaa

SEQ ID NO: 91962 - DNA, 267 bp, Glycine max
  Peptide Sequence Number=SeqID_208740
atgatgcagatggaattggtgctagtgcttatgctaatggaaatattcaatgttggagaatggattggagagtatgactatgatgtgttggcctgtcaaaactcggttagacttcgtaagttggaacattcgcacattggttgcgtgatttatctccaacactttgcttcaacgttcattggtgaggccaagaagggttcaacaaggctagccatcctgttttctgtggagaaattcttaagtaatttccaactactgtgtttatga

SEQ ID NO: 91963 - DNA, 276 bp, Glycine max
  Peptide Sequence Number=SeqID_208741
atgaatgtaattgggttacaagacaatgttaacctcgtatgggataagatgtttaagaagaccaggaaagttgctaaaagagaattggacgaattaaaaggttttggtttgagagataaggaatcttgctggtgggatgaagaggttcaagataagctttcatgtattaaaaggcaattgttgaaacaaaactccttgaaggagaatcagcagatcatagaaggggttcttctaaattggtttttcaatatgcctttacagaagaagattccttaa

SEQ ID NO: 91964 - DNA, 336 bp, Glycine max
  Peptide Sequence Number=SeqID_208742
atgcaaacattgcaaaacaatgacagagcctttgaatcacacgtggcacaccccggtgaatatgcagcatcaacttcaaccaatgggtacaatttcagctccaatattccctacttgtttaaacagagcaagggcaacctatataattcttctcataattgcacgccatatccaaccacaaagaagcgtttaattctaaccaaaagggcttattcaaccagaactcgtggtcgttctggtcccctacagtcgctggctcgaaaacttggtcgattcaaggtccgagcagtaattgtagatgatattgcaagagaggaaagcaatcgaaaaagatga

SEQ ID NO: 91965 - DNA, 270 bp, Glycine max
  Peptide Sequence Number=SeqID_208743
atgagtctttcaaggtctttgaaatattctataaaagatcaacttgcaaaattctattcaaaggtggataaaggaatcttcctaaggtattttgacacatctaaggcttacaaagtttttaactcaagaactttagtcgtggaagaatccatccatgttaagttcaatgatggtctaacaactgatagaaagctatcagatcttgaggatgattttgtagatacgcatattggtctgtctgttgcacccaaggtagacgaagtgaaatag

SEQ ID NO: 91966 - DNA, 1722 bp, Glycine max
  Peptide Sequence Number=SeqID_208744
atggctcagaggtacttgcaccagctacttgaagaggatcaagagccgttccttctaaacaagtacatttccgataggcgaagccaaatgaaaaggccttccccgatgacgagtttgcaagtgaagaaacgcaaatcaaccaatccaaacgcaaacttcccgagaaatctctgcaaaagcgcttgtcttttctccctcacagacactccagacctcagaaaatcaccactcttcgaattcgcttccccagtcaaaagcccttacaaatcaccaaaccctatttttcttcacatcccttctagaaccgctgctctgcttctagaagccgctctcaggatccagaaacacacttcaaagcccaaaacaaaagcccaatccttcggcctctttgggtcactatacaagagactcactcagcggagccataaaaggcgagagatagagtgtggtggtggtggcgttaaggtctcggtgaaggatgttttgaagtgggattcctctgtggggcgaagaaaagcttctaaagccaacgggaaatgcaaggaaacagggaatgtgaatacgaatgcgagtgaagtggggtttgcgtgttcttacaatattggtaggcctagtagtagtgctgtttggtcagagagcaatgaagataaatcactagacattgaaacctcaagtagtggctactctgaaaagattcacttcgtaaccaatatacacaaacactactccacgtgcttctgcgaaagcccgttccgttttgttcttcaaaccagcaccccttcctccggccaccacacgccggagcttccctcgccgagtcgccacccaactgagccggaatgttgcttttcggtgacaatcatagctgcccagtctttccgaaaattgttaaagaacagggcctgtgggactgtggggagggagaaagaaagtaatgaaggtgagagtctgaagaaattcgaatcaggggaagaagaggaggaagataaggaacagtgcagtccagtgagtgtgttagacccaccattcgaggacgacgaagaagggcatggaaacggtgatgaagaagaagaggaagaggaggagggtggttttgatttggagtgcagctatgcgattgtacagagagccaagcagcagttattgtataagcttcgtagatttgagaaactggcggagttggatccagtggaacttgagaaaagaatgcaggatcaagaagaggacgaggatgacacatttatggaagaggaagatggtcatgatgagaaaaaccaagcatcatgcaaagaaaatgactttagaaaactaattttccaagctctgtgccagtcaagtgtccatgacagacagcaaatcccagaggactttaagaagctggtttctgatctcattttggaagaagagagagcacttgattccttagaagataaggacatggtgataagcaggatatgcaagaggctggaattgtggaaagaagtggagtctaatacaattgacatgatgatagaagatgacttcgctagagaggatagtgagtggaagagaaatatagagcatataagaaatatggctggggagcttgagcttgctatctttggctttctggtggaggaattttcagaggaactactggctgtggggatgctgaagggatgggatacagataaaattcaaggcatacccctaacgttgatgttaatgtgtcacaactcataa

SEQ ID NO: 91967 - DNA, 294 bp, Glycine max
  Peptide Sequence Number=SeqID_208745
atgacgcaccaaaggaaaagccaaaaaaaacacaacatcaacttcatgggagaattatgtccatgcggtgccagtgccaccaagcttccatggcaaaagaagaagagggagaaaggaaaatggcccgtgttggtaattgtgaatcgcgttttggacaagggcgagaaacttccggtgagttttagagaccacataaatttagaagaaatgttggcaaagaaaaggaagagacgtgctgaaacacaaaacaccacttcccgtggttcctcagcatcttatttaagagaagcttga

SEQ ID NO: 91968 - DNA, 414 bp, Glycine max
  Peptide Sequence Number=SeqID_208746
atgtcgaatatatgggctacattccatgatttcatctcaattatactccgttgccaaagcacgccgttgaaatttgaaactgacgtgctattctgtctagttttcgaccaggcggaagatgtcactttcatactttctagaagtttgaaaaccgccaaagaggagactctagaaggaagagaccctcctagtagcaaccctctactcgttcatggcggatctacaactacgacaccagatttgtgtcaactgctgtcgcgaacgagagaaatcgacaaccgctccgtcgtcgagaatgagggttctgcaaaccttaactctttcgctcagttgccgtcaacacgcaacattgaatccgagccaccgtcgtcaaaaccctactacgaacgagggagatctgcaacttcttcatga

SEQ ID NO: 91969 - DNA, 447 bp, Glycine max
  Peptide Sequence Number=SeqID_208747
atgagggagggatgttgtacgcaaccttacccttgcatatgcaaagaggctgtttccggattcgaacccatgaccaacaagtcaccaaggcacaactttaccactgcaccagggctcgccctcagaagactttctacacatatacctaccaaattaaaatggaggttaacactcaacagtatgtcgagggaatggtaccataaaccacctatgaacatgtgggcagaaagggtattaggctgtagtggaccttggacgccgagacagaagagcacgcagaaaacaaaaggcagtgatggttttaattcgacggtggtgattaggggtgaagacatggaatcagagatgcccatagagcaaggaatcttcaagtgggggccactcctcatggtggatgcccaaacaaagtatcagtcgcctgcggcatgggattttttcttcagctaa

SEQ ID NO: 91970 - DNA, 4443 bp, Glycine max
  Peptide Sequence Number=SeqID_208748
atggcatcggcactggcgggggatgatttggccgtatcaactagcagtcgccggagctggacaacggcgagtttcagggatgcatggacggcagcgccggacgtgttcaacgtgagcggccgccacgtgtatgaggacgacgaggaagagctcaaatgggctgccatagaccgcttgccaacttttgaacgcatgagaaaaggcgtcctcaagcacgtgctcgacgatggacatgtgatgctcgatgaagtcgatgtttccaacctttgcttacatgacaagaagctcttaattgacagcatacttaagattgtcgaggaagacaatgaaaaattcctacgcagacttagaaatagagttgatagagtagggattgaaattccgaagattgaagttcggtgcgagaatttatctgtggagggtgatgtgcatgttgggagtagagcacttcctaccctgcttaatgctactctcaatgcttttgagagtgttctgggaatgtttcaccttgcaccatccaagaagagggaaatccagattcttaaagatgttagtggaatcgttaaaccctcaaggatgactctccttttgggtcctccatcttcggggaaaacaacattgcttttggcgcttgcagggaaacttgatcgtgatttaaggtttacttcaatcgtatctcctcatcatcatatgagtattttgtttaaccacaaagtgagctttatgttgagatgtgatcaggtgtctgggaggatcacttactgtggccatgagctaaatgaatttgttccacaaaaaacctgtgcctatatcagtcaacacgacattcactatggagaaatgacagtgagagagacattagatttttcaggacgttgtctaggtgttggtactaggtatgaagcattagtggaactgtcaagaagggagagagaagcaggaataaagccagaccctgagattgatgcattcatgaaggctatagccttgtcaggtcaaaaaaccaatttggtaacagattatgtactcaagatccttggattggatatttgtgccgacattgtggttggagatgagatgagaagaggcatctctggtggacagaagaagcgagtaacaacaggggagatgctggtaggaccggcaaaggcactatttatggatgaaatatcaacaggattagacagttccaccacctttcagatatgcaagttcatgaggcaaatggttcatgtaatggacgtaaccatggtgatttcgcttctacaacccgcaccagagacatttgaactctttgatgacattatcctactttcagaaggtcaaattgtatatcaaggtccacgtgagaatgggttagagttctttgaacacatgggtttcaagtgtcctgagagaaaaggagttactgattttttacaagaagtaacatccaagaaagaccagcaacaatattggtctagaaaagatgaaccttacagatatgtttccgtttcagaatttgtgcaagcctttagttcatttgacataggagagcaacttgccactgagcttggagttccctatgataagagacaagcccacccagctgccttagtgaaagacaagtatggtataacaaactgggaactatttaaggcatgtttttcaagggaatggctactcatgaagcgcagttcttttgtttatatattcaagacaacacagataacaatcatgtctattattacatttactgtgttccttagaacagaaatgtcagtgggaactgttgaagatggacaaaaattctttggagcattattcttttcgctaataaacgtgatgtttaatgggatggcagaactatctatgactgtttttaggcttcctgtcttttacaaacaaagggatttcaggttctaccctgcatgggcatttggtttgcctatatggcttctcaggatccctctgtccattatggaatcagggatatggattgcccttacatattacaccatagggtttgctccttctgctagcagatttatccggcaattcttggcattatttgccattcatcagatggctctctctttatttcggttccttgctgcagctggtagaacactagttgttgctaatacactgggtaccttgtccctgcaattggtatttgtgctaggaggttttgttattgccaaagatgacattgagccatggatgatgtggggctattatctatctcctatgatgtatggtcagaatgccatagtaatgaatgaattcttagataaaagatggagtaaaccaaatacagaccctagaattaatgcacctacagttggaaaggtgcttctcaaatctagaggcttctatacagaagagtattggttttggatctgcattggagccttgcttgggttttctcttctcttcaatctcttattcattgttgctttaacttatttgaatcctttgggttattcaaaagcagtcattgccgatgaaggtgacaaaaagaataacaagtcatcctctagccaacatattcttgaaggaacagacatggcagtgaaagaatcttcagaaatggctagttctttgaaccaagaaccaagaaggggaatggttctaccatttcaacctctttcacttgcattcaatcatattagctactatgtagatatgcctgcagaaatgaggagtcgaggaatcaataaagatcgacttcaactactacaagatgttagtggtgcttttagaccaggaattttgacagcacttgtgggtgttagtggtgctggaaagacaacccttatggatgtattagctggaagaaaaacaggaggatacattgaaggaagtattagcatctcaggttacccaaagaaccaagcaacatttgctcgtatcagcggttattgtgaacaaaatgacatccattctccacatgttactgtatatgaatcactattattttcagcatggcttcgccttccttcagatgtaaatgcacaaaagcgaaagatgtttgttgaagaagttatggagttggttgagcttaaccaaatcagagatgcactagtgggtcttccaggagtggatggtctatcaacagaacaaaggaaaaggcttactattgcggtagaattggttgccaacccttcaattatcttcatggatgaaccaacatctggccttgatgctagagctgctgctattgtcatgcgaactgtgagaaatacagtagacacagggagaaccgttgtgtgcacaattcatcaaccaagcatagacatttttgaagcttttgatgagattttgttgatgaaaagaggaggacaagttatctatgctggacctcttggtcgtcactcacacaagctaatagaatattttgaaggtatcccaggggttccaaaaatcaaggatggttataatcctgcctcatggatgcttgatatcagctctacaacaatggaggctaatcttgaggtagattttgcagagatttatgctaagtctaccctctaccggaggaatcaagaacttattgaggagctcagtaccccagtaccagattccaaggacttgcacttcccaaccaaatattcccaatcgttttttgttcagtgcaaagctaatttctggaaacaatattggtcctactggagatatcctcagtataatgctgtccgattctttatgacaattgttgtgggagtaatgtttggtgtgattttctggaataaagccaaaaagacccataaacaacaagatttgatgaatcttttgggaggcatgtatgctgctatgctttttcttggagccatgaatgcttcatcagtgcaaccagttgttgccattgaaagaactatcttctatcgtgaaagagcagcagggatgtactctgcattgccctatgcatttggccaggtggcaatagaggcaatttataatgcaattcaaacagcagtttactctcttatcctttactcaatgattgggtttgattggaaggcaacaagcttcttttggttctactactatatattaatgtgctttatgtacttcacgttgtatggaatgatgattgtagcactaacaccgggtcaccaggttgctgcaatttgtatgtccttcttcttgagtttctggaacttgttctctggctttatcattcctaggacgcaaattcctgtgtggtggagatggtattattgggcttctcctgtttcttggacactatatggccttattacctcacaactgggtgacaaaaatgcagaattggagataccaggtgctggaagcatgggattgaaggaattccttaaacaaaacttgggttttgactatgatttccttcccgttgttgctgctgctcatgtaggctgggttatcctcttcatgttcgtttttgcctatggcatcaaattcttgaatttccaaaggagatag

SEQ ID NO: 91971 - DNA, 348 bp, Glycine max
  Peptide Sequence Number=SeqID_208749
atgtcttcttcttcttcttcttcttctaatagaatgcaattcccttataacatttataaaaaacttcgtaccccattgcccggaggctcttcgttatgcgaaggtatgggggagggatgttgtacgcagccttacccttgcatattcaaagaggctgtttccggagtttccggattcgaacccatgaccaacaagcctttggttgaatgcattgggctgttcatttctggtgagcatggcttctcttgtttgtctgattatcctgcctgtaatttttggcaggagctatgttgggggatgcatttcttcaccaattaccacatgcttttggtatggaaagcatcataa

SEQ ID NO: 91972 - DNA, 1080 bp, Glycine max
  Peptide Sequence Number=SeqID_208750
atggaaccgacatctcttacagtgccctttgtccaagaaattgcaaaggatgccttgacgagggttccagagcgttatgttcgtccacttcatgagcgcccaatattattatcagccactactacacctttaccccaagttcctgtcattgacctaagcaaattgttgtcacaagatctcaaggaacctgagttggaaaagctgcactatgcctgcaaagaatggggattttttcagctgataaatcatggagtgagcacttcattggtggaaaaagtgaagagaggtgctcaagatttcttcaatcttccaatcgaagagaagaaaaagttagggcagagagaaggagaaggtgtggagggatatggtcaggcctttgtggtctccgaggagcagaaattagagtgggcagatatgtttttcatgctcactttgccaccacatataaggaaaccctacttattccccaacatccccttaccattcagagatgatttagagacatattctgccggattaaaaaaacttgcgatccaaatcgttgaacttatggcaaatgcccttaatgtggactccaaggaaattagagagttatttggtgaaggggttcaatcaatgaggatgaattactatcctccatgtccccaaccagagcttgtgatgggactcaatccccatactgatggtggaagcctcactatccttctccaactcaatgaagtggaaggtcttcaaattaaaatagatggatcatggattcctattaaacccctccccaatgctttcatcgttaaccttggagatatgatggagataatgacaaatggaatttatcgaagcatcgaacatcgagcaacagtgaacttagaaaaggaaaggctttccatagctacattttacaaccctggcatggaagtaaaattaggtccagcaccaagccttgttactccaacaacaccagcagtattcaaaacaattagtgtacccgaatactacaggggatacctctcaagagaactccgtgggagatcatatcttgacagcatgaagatccaaaatgaagatgagaacagctcttga

SEQ ID NO: 91973 - DNA, 2466 bp, Glycine max
  Peptide Sequence Number=SeqID_208751
atggatactccctctggaatcaaggactcaattcctgcttggattaagttttctgtacaggctcctggtgaaattccatacagcggaatatactatgatcccccagaagaggaaaaatatgtcttcaaacatccacagccaaagagaccaaaatcacttagaatatatgagtcacacatcggaatgagcagtccgtcaggttggggaagaatggagaatgcagcactgtacttgaaagaggtgaccaacaattatggattacaacctcgttcatgggaattcaccattcctgagcccaagatactgaattggttgatggagatgtgggtactcgattgtgatgaaaaagggtggagaaatagggactctagtgaggaagtaagggtagcagatggcatcatagagctgtgtgaggctgttgagaacaatagttacttcacgaagcctatagccaatgtttcaggtcaggcagccagaacatgtggtggcttcaatgttgtggaaaacatgttgtggagcccacctatgctaatattggccactgctccgccacttccaaacccactaaacttgaccattgtagcaatgttctacaagatcaccgagatcaggattatacagagactgattacacccctaccatcaccagacacaagctcgcatacagaagccagtggattgttaccagcagagccaccatgggtgtgcacaagagagatatgtattgctgggttagaagaaacagaaaggaggagcagaatggcattctgcaaaatgggtcttattcttgacctaatgggccaagcccaaccttgtctcagtatttgggtttgtgaagaaagaggatctctatttggtcctcaagcagatggagacacttaccgtccagcatctcatctcagaacaggcccacatttatggtaccatgttacaaatttctttgcacctagcagccgatttggaactccagaggaacttaagtctctgatagacagagcccatgaactgggtctgcttgttctgatggatattgtacacagccatgcatcaaataatacattggatgggctgaacatgtttgatggaactgatggtcattacttccatcctgggtcacgaggttatcattggatgtgggattctcgcctttttaactatggaagctgggaagttctaaggtatctactttcgaatgcacgatggtggctggatgaatacaagtttgatggatttcgatttgatggtgttacatcaatgatgtacacacatcatggattggaggtagcatttactggaaattacaatgagtattttggttttgcaactgatgttgatgctgtggtttacctgatgctgactaatgatgtcattcatgggctcttccctgaggctgttacaattggtgaagatgtgagtggaatgcctacattctgccttcctacacaagatggtgggattggctttgattatcgcctgcacatggccattgcagacaagtggattgagattctcaagaagaacgatgaagactggaaaatgggtgatatcatccacacattaacaaacagaaggtggctggaaaaatgtgtagcttatgctgaaagtcatgaccaggccttggttggtgacaagacaattgcattctggttgatggacaaggatatgtatgacttcatggctttagacagaccatccactcctattatagatcgtggtatagcgttgcacaaaatgattaggcttattaccatgggccttggtggtgaagggtatttaaattttatggggaatgaattcggccatcctgttaagtttagcattgctcattcattgttgctcacttcagagtggattgatttcccaaggggtgatcaacatcttcctaatggcgtagtagttccagggaataacaacagttttgacaagtgcaggcgtagatttgacttgggcgatgcggactatctaagatatcaagggatgcaagaatttgatcaggctatgcagcacctagaagaaaagtttggtttcatgactgctgagcaccagtatatttcacggaaaaatgaaggtgacaaaattatagtcttcgaaaggggcaacctcatctttgtcttcaattttcattggaccaacagctattcagattacagagttggctgctcaacccctgggaaatataagattgtcttggattcagatgatgccttgtttggtggcttcagtaggctcaatcacgctgctgagtacttcacctcagtatggaacttctctaaacttgtatctgagtgtgcaccatgctctggcatggacacaccaagatggtatgatgaccgacctcgatcctttcttatctatgcaccttctagaacagcagtggtttatgccctagcagatgaagctgaacctgccctagcagatgcaactgaaccagagccagttgatcttgatgacaagcttctgggatga

SEQ ID NO: 91974 - DNA, 852 bp, Glycine max
  Peptide Sequence Number=SeqID_208752
atggaagatgaggataaatacaacattagtgaagcagctagcagttacagacatattgaagatggacaaggttctgttgtatcatcacttgtagatgtgaacattccggccaagaaagcgtcggtatctgttggtaggaaatcaaagatagtaagtgatgaagttaaacctaagatcattcccccccctgccactggacagaaaatatatgagatagatccatctttgctagctccccgtgaccatcttgatttccggcagcatgtggttccaacttccaagcacacaagaaatactggttggaaagattccaatgaccagcacatggtggtgcatatgtggtccaacagctgcaagcttccagcaacaggccagaatgaggatggtgaacaaggtggtggggatcagttggtgagaaacatacatcttcaagatagagattgcagccatgagaggagagaaaaagtgaatgaatcggtgaattacacctctagtgttaaatttttaatactaagtaatgttagtacaggcattacttacagagagtgggcacctggagctaagggagaagccgtgagtggcaaagaaggcaaggacaaagtcgtgtttctggggggtgtggaaatctgtcgaaaggaagaagatgagattgttccaccaggaacgtccaatggctctttcgtgtctctgcctttgctgactagcatccagaaagtggcgggactgacagagggtggcgaggactgtgctaatgatgaagattgtggggcggcagcgctccgctgtggcttcctccagggaggagatggagaggagacggaagtagacagtgggggatttggtgttaggtga

SEQ ID NO: 91975 - DNA, 261 bp, Glycine max
  Peptide Sequence Number=SeqID_208753
atgaagaaagcaaataataattataacaatagtaataatatcaagataaacaacaacaacaacaacgatgatgatgatgataactgcaacaacaataaaaacaaatcaaatcgagaaatagcaagtactattcacataactcactcgacaatagaggaatgtaacggaatcggtttagtttccgagagattgagattcaagaagagaatgttgtctcttagaagcagaagaacagatccagagtttcgaagagtgtgttga

SEQ ID NO: 91976 - DNA, 939 bp, Glycine max
  Peptide Sequence Number=SeqID_208754
atgggctatctgaaaaataaagtatatccagcatttgtaagggaaaggagagcaacgaagagggattatgaagaatttaaggtgaggattaacagtttggtggcaacaacacaaaaggttcctgaggatggatggaccatgcaagatgggactccttggtctggaaataatgtgagggatcatcctagcatgattcagcctctttgtatatgcaagggtaaggctgcgtacaatattcctcccccatatcttcgcatagcgaagagtttctgggcaatggggaacggtattaaacaatggaagaattcatggcaagatggagttttgggaaccaactgccccattcctccaaactcaaattacacatacaagtttcaggccaaggatcagattggtacatatacatactttccatcaactcaactgcataaagcagctggagggtttagagcactcaacgtttatcacagatctgtcatcccaatcccttatccaaaccctgatggagattttactttactcgttggtgattggtacaaaaccaaccacaagaacctatacgattcacttgatgtccatgttggccaatcagttgctgtgttagtaaccttaaaccagcctccaaaggactactatattattgcctcaacaagatttacagagaaacctctcactacaactgttgtactacactatgcaaactctatttcctctgtatttggacccgtgcctgccccccctgttgataaatatgactttgactggtccatgaagcaagctagaacctacagatggaatctgacagcaaatgctgctaggcctaacccacagggtcattccattatgggaagatttctcttaaacagtgctggtgttaggagagtaacaaggcttggtgctggaccaaaaatagaatccaaaccgggttgtaaaacgtga

SEQ ID NO: 91977 - DNA, 1167 bp, Glycine max
  Peptide Sequence Number=SeqID_208755
atggacttccatctgaaggaatggagaaaccagcatgagtcagaggaacaacaacattctacaaagatgccaaaacttctccctgaatcccatcatcaacagccatctgccactgcactccctttgtttgtacctgaacccaacagcagcagcaaagtcagcaccctgtcagattcaacattagcagctgaaactgaaacaatgaccactacaaccactaacagattatttcccaggatggggagctacttcagcttgtctcagtggcaggagcttgagttgcaggctttgatattcaggtacatgttggctggtgctgctgttcctcctgaactccttcaaccaatcaagaaaagccttcttcattcccctcactatttcctccatcaccctctccaacattaccaacctgctgctttgttgcaatcagggtattggggtagaggagcgatggatccggagccagggcggtgccggagaaccgacggcaagaaatggcggtgctcgagggacgtggtggctgggcaaaagtactgtgagcgccacatgcatcgtggaagaaaccgttcaagaaagcctgtggaactacccacaccaactagtgctaataattgtgatggtggatctctaggactaggtgcttcttcatcttccatttcttcaccacccctagcttctgcttcactcaaatccccatttgatcttcttcgtcttaatgaacgttcctctgggaccaagaatgaagacgaagaccatgtgggtggggatggcagatcaggtggagggggtggccatatgctgaggcatttcttcgatgattggccacgatcactgcaagactctgacaacgttgaaaacaatgctgctggccctagcctctctatttcaatgcccggaaatgctgctgctgcttcctcggatgtgtcattgaaattgtccacgggctatggagaggacccaggcccaagaaatgagaatgtgggcctcgtggcagagcagctgcagttgaattgggccggaggatgggcctcgtctaatcaagtggcttccatgggaggaccactggccgaggcactcagatcatctatttcaacttcatctcccactagtgttttgcatcacttgcctcgtggttctggatctgagaccagcattattagcacctga

SEQ ID NO: 91978 - DNA, 330 bp, Glycine max
  Peptide Sequence Number=SeqID_208756
atggcggcaacgttacgtgtttcatttaagtttctttacaacaaaccaaacagcaccaccgaagtggctgactgcctactctccatggaggtctcagacgacgatgacgaactcgttatcctgctttgcactaacactgatccgattgaaacaacggaaaccctaaacgacgagattctcgtgtccaacactgatatcctcgcttgggatctccctatgattctcacttttccggcgattaaagttcaggcacatcgcaataggctcattgaacaatctctgtatttccgtggcctcctcagcgggagcttcctgtacaaaatatgttaa

SEQ ID NO: 91979 - DNA, 2621 bp, Glycine max
  Peptide Sequence Number=SeqID_208757
cagtttgtcttgtaatgggttcattctctggcacttgtgaaatagttgaagcaagggaggaagagctaaatacaaggaaagctcctggggtttatcagtccagttctgagtgtagcacgtctgagaaaaatcagaaattttcggtgctgaaattgggatacaaggatgatctagatgatgatatcaacaagctttttgaatcaattgctcttaaatcttcatcaagggatttgagccttttccaagatggtacaagtcctaggctgaaaagtgcattaaaaaaaccaattacaatgggtattccacggtccccaagagttgggacttctgagcccgctaatttgaagcaagcattaagagacctttgtatatctaaagcatccgaaatggctgctatgaaacgattatcaaagtcaacaacagcttctccaagattatctgaagttgggaagatacagacattgtacaattcagttgtagctgaaaccagtcgatctgggtcttcctttgttgagagcaatgggcgtcaaattgaaatatctctagtgccagaaaaaggcaaatccctttccttggagaaaacctctcaatcttcccaaattgcattgttgagccgaaacattcattcttctcgggaaattgctgttgcaactactaaatatgatgctgggacttcattgatacaaagtgatttggcaggctcgtcaagtaaagttgggattcaatcacaacgagtggtacctgttgaaacagaagaacaagcatctgcctcttctccctctctttataatacatctggatgcaaatcagaggtgcccaaaaatgcttcttcccctaaaaagttgggaaataaaacatctgtatcaaatactgggaagaaaggtaggttgcaaacagtatcttcatctaatgctgtaaatggcaacagagttaacaaaccgccacgccatgccccctggactgttaaatcggtcatcaagaacaagaatctgagtaagaagaaacaaaaggaggattcatgctctactttatgtggtcctacgcccaatgaagttaataagcctgttcctggtacacctcggctaatttgtgagagatgtaggtgtgctttggaaaatactagtgaagaaaaaaaccaagatattgtggcattagactctaccagtcctgaaaacggagtaaacttgagtaatgtgcactctggttcaaataaacctggtttggtgtcaagtagtgttaataaaagcaaaacagttgcaaaagtgaagaacaccaagttgaaagagcaaattgaattttcacaaagttcaaagagtagtcaaggtgagtacagcagtagtacaagtactagtgatgagagcaatgtgagtggttcaagtcgtagcactaggcctcacatgtcaaaggatgtcaggtgggcagccatacgacatgctcaagtgcagcatggagtcttgggcttgagacacttcaatcttttaaagaaacttggttgtggagacattggcactgtatatcttgcggaactaattggcactagctgcttgtttgctattaaggtcatggacaatgaatttttagaaagaagaaagaagatgcctagggctcaaactgaaagagaaatattaaggatcctggatcatccttttcttcccacaatgtatgcacaatttacatcagataatctatcgtgtctggtcatggagtattgtccaggtggagatcttcatgttctacggcagaagcagcttggtagatatttctcggagccagcagcaaggttttatgttgctgaagttctccttgctttggagtacttgcacatgcttggagttgtttaccgtgatttgaaacccgaaaacattcttgttcgggaagatggccacattatgctcacagattttgatctgtccctgaggtgtgctgttaacccaatgcttctgaaatcatctgatgttgaccctgcaaaaatctctggtttaagtgcacaagcaagttgcattgagccattctgcattgaaccatcttgtcaagttccatgcttcagcccaagattgctacccaccgctgcaaaagcaaggaaactaaaagttgatcttgcagcccaggtcagatcattgccacagcttgtggccgagcccacagatgcaagatcaaactcatttgttggcacacatgaatacttggctcctgagatcatcaaagaagagggacatggagctgcagttgactggtggacatttggagtttttctctacgaacttttgtacggcagaacaccctttaaaggttcaaacaatgaagaaacattggccaacgtagtgttgctgggtcttcgattccccgagcacccaaatgttagtttccaagcaaaggatctgataagagggttgttggttaaagagcctgaaaaccgtttgggttcagagaaaggggctgccgagattaaacagcatcccttcttcgagggccttaactgggccttaattcgctgcgctatgcctccagaacttccagacttctatgattttggagtttcagacatgatgaactcgcagtgcaagggtgctaagtacttagagtgtaaagtaggagagcatgtagaattcgagttgttttga

SEQ ID NO: 91980 - DNA, 177 bp, Glycine max
  Peptide Sequence Number=SeqID_208758
atggccttgagaatacttgtaaggttgaactctaaagctcaaaatgctcagccaagtgccctctttgaggaagaatatacaaagcaagcattcgctaagcgcgacactcagtgcctaagcgcgaggaagtatccagaagaagatgagctatcaggttcactgagcgcaccgctctag

SEQ ID NO: 91981 - DNA, 959 bp, Glycine max
  Peptide Sequence Number=SeqID_208759
agttggatgaatttaaggttgaattggagaggcgtaactaccataagcgcctcaccaatttagctgatagtagcattgacctagcattggtgaaggagttctacgccaacctctacagtcctgaggggctttcaccaaaacaagtcagaatacggggccacttgataaaaattgatgcagacagccttaatgcctttctagaaacacatgtggtgcttgctgagggtgaatccttacccgcttactcaagatattgcaggatgcctactaacatcagggaaattgaggatgctctgtgcatacccggccgagggtttattttaaatgctgaaggtcaccctgggaagatcctcagaaaagatctaaccactcttgctcaggtctggagtgttctctcatactccaacctggctccgacttcccacacctcagatttgactgtggatagagctaggttaatctttggcttagttactcagctggacatgaatgttagagctctcatctctggacagatcacatcaatggcccaatctaactcctctagactcgggttccctgctcttatcacaactttatgtaggtccagaggagttgcttccgacagcttggtctttgaacgtttgagcccagtcattaatttggcctacataaggaaaaactgttggaacccggatgacccaacagttattattaggggggccagaagaccaagggcaaggccaattgaggcagcttctacattagtagctcctcatccagcttctacatcatcagctcctcctccagctcgtatgatagcagctccttctaccctacctcttgcagattttcaatgttttgaagccatgcttcgaagcatacatcaagggaaaattattttactgcaaagcttacagctggtagcgcctccagactccatcccgacggtagagcaatttaatgaatgggtagcctag

SEQ ID NO: 91982 - DNA, 228 bp, Glycine max
  Peptide Sequence Number=SeqID_208760
gtcgactctagaggatcccacccactatcttctcctgagtgtgaggtagttcccccatctccacctctgattatcatcttcaatgcatcatcagacgaagcggtcgcccctcctgattcatcagcaggagaaatagctgaccttcctacttccccagttggaggaattttcgatctttctgattcgtcatctggagaagttgttgctctcactgattccccagtttag

SEQ ID NO: 91983 - DNA, 514 bp, Glycine max
  misc_feature (36)..(36): n is a, c, g, or t
  Peptide Sequence Number=SeqID_208761
ggcttcccggtatcaacagggacaccaggatttatntattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagaattcgattatccagctgcaactttatccgcagcacctcccattaaaggtatacccgagtctaggaaacatgcccggaaactacggccttttgttgaagcaaagtattctaatgtgtatgtgcaattggagaatggtgattgggagttttctcattgcaatgccagtgggcaagtcgtcgctgtctatcacatcaagaagcatctcatttag

SEQ ID NO: 91984 - DNA, 195 bp, Glycine max
  Peptide Sequence Number=SeqID_208762
atggttagagataaaggaacgaatgctgatggaggagaggggtgtgggtgggggagaggaggaatcagagaagggggatggaggttcataagcactgtcccgatggtggagatttccgtccttaaatttgatgtaaaatcgagtagcgaagttagtaacttcttcatgcttcaaaactacttgttgatgaagtaa

SEQ ID NO: 91985 - DNA, 243 bp, Glycine max
  Peptide Sequence Number=SeqID_208763
atggatgatgcaagccaaggtttcttttaccaacctgaccttttatatggagccaagtctaatgatattggtttggggaatgataatgatgaaaatgtgggtggtgatgacactgatttgcaagcacaacctagttatcccgacttttctagttatttcatgactgatgagctttttcaagagtgtggtgatttgttaagttggcacaacatgttggaaatgagcatgggtttgtggttgtga

SEQ ID NO: 91986 - DNA, 261 bp, Glycine max
  Peptide Sequence Number=SeqID_208764
atgatatggtggcaccacttgggcaccacaaaggaagacgaaggagatgtcaaatgcgtagtggcacggccacaaagggtttcctacaaggtaaaggagaatggaacaaagatgtatcccggcagaaaaagaaaaattgagcacgacactggaacacgagacgagacgattctggggtcaacattggttagcagcaaaggttttctcatgggatgggatgtctcaaaggttgtaatggagagggagaaagatcgtggctga

SEQ ID NO: 91987 - DNA, 909 bp, Glycine max
  Peptide Sequence Number=SeqID_208765
atggcatcatcacacgttttggaaggttgtccctccgaagcctctagcatctctgccacctcggaaggcatttctcataaaccaagtgctgaagaagagaataatcatgatgaggtggcaaaaatgaaggagaagggtgtcaaatctgaacaatatcaagcttccaattccaattcccgcatggtgttggattttgttaagctctcccaagatgaatcaattcgagggtcgaaagtggaattggattttttcaatccaatgaacttggggggttcaccttcttctagggttaaaaacaccgaaggaagagatgagaacaacaatgaagagaaatcatcagaggctaagactttttcttgcaatttttgcaagaaagagttttcttcatcacaagccttgggagggcaccaaaatgctcacaagcaagagcgtgctctcgcaaagcggcgccaagggattgatgttggtgcttttagaaaccctcattttctttattacccttatcaccccgcacactccttttatggaacatataatagggcacttggggttagaatggagtctatgattcacaagccttcatatccttcatcatcactaggttttaggtttggtcaagggtggtcaagatcacaagagatgctaaacccttctcttgatagattgaggattgagggtttgcatgcaaatagtggaattaggatcctagggagtgacactagtttgaggacaaaagatgattgtggtactattggacacaacattccattccttggagaatcttctacaaatgttgctaccaaatcaaacccagccccattgagtaccgtgggtggtgatcatctcaagcaagaagcatgctctagtcctgattcttctgatgagattgatttatcacttaagctttag

SEQ ID NO: 91988 - DNA, 291 bp, Glycine max
  Peptide Sequence Number=SeqID_208766
atggaagttggatgggagcttccaaattgcaaacggcactccaatattgaaatgagcagctttttgacacatgtctcaggacagcaaggctccttcacacttcactggcacagcagtaatcagaaaactcaaaagctccaaacgcttgagacgagtaaaagtcctttggagtttatctggttcttgtttcttctagagaggggaagttgggtgtggctttccaactctcaagttgtgtgtaccttggccttcaaggcaaagtctataaccatccctttcgccgtaagttag

SEQ ID NO: 91989 - DNA, 1200 bp, Glycine max
  Peptide Sequence Number=SeqID_208767
atgagggtatttaaaagagccagtggagccatcaaggacaggaacagcatatgggttgcgaaattctcaccaaagggtccattccacaaccctgatttagaaaccgtgataatcaaagccacaagccacgacgataagcacatagattcaaagaacgtgcaaagagtgttccaatggctacgaacctcgcccttgtacctgaagcctctcgtgtggatcctctccatgcgcatgcaaaagactcgaagctgggttgtggcgctcaaaggcttgatgctcatccacggcgttttctgcattgacattcccgtggtgcaacgcatggggaggttaccctttgacctttcaaacttctccgatggtcatttgagccccgctaaggcttggagcttcaacgctttcgttcgcgcttattttgcttatttggataagaggtctgcgtttgcgtcctccgagacgaagcagaagaatgttagtaataaaatgaaggaggtggatgagactttgatggaagagcttgaaaagctgcaaaagttgcaagggatgattgacatgcttctccaaattaggccaaagaatgagaacttgaacgttggtttgattcttgaggctatggattgtgtcatagtcgaggttttcggtgtgtatagtaagttttgcaacaagattgcaaaagttttgttgagaatatatgaggttggtgggaagatggaagcgagtattggcctcaaggttcttcagaaagcatcgattcaagtggaggagatgtctttgttctttgacttttgcaaggatattggggtcctcaatgcctctcagtgccctaagattgatagaatatctcgggaagatattcaagatcttgagaggataatcagtggtgcttcttccaagaagggttgtggtgttgtgggaaatgatgaggataataataaggccattgtggtgagagattgttcttccactgcatcggtttcacagcagaaggggtcagagaatggtttgatgactgtgatcacgcaacaatgggaggtgtttgatgatgatcatataatggttggtgctaaaggaatggataatgtgtctaatggtgataaggttataattggcaccacaaccaacccttttgaggaatcatatggcatcgtaccttatgtacctgctcactatcaatctcttcctgatctaattagttggtag

SEQ ID NO: 91990 - DNA, 180 bp, Glycine max
  Peptide Sequence Number=SeqID_208768
atgacagtccacagccacctcagtgacctccaggtaaaggaagtcatgttaaaggacagctgggtcctgcaagctgatatcgtagctgttgacattgaaggaaggactatcacagccatgttcaaactatttctcaagctacttgatgcatgtttgctcacacgtctagaggcagattaa

SEQ ID NO: 91991 - DNA, 879 bp, Glycine max
  Peptide Sequence Number=SeqID_208769
atggaagttcaaactcactccctctcccccacctttcatttccaccttctctcccaatccaccaccgacaccaaccaaccttctctcggccatgccaccgccgccctcaagctgcaaaaggtctaccggagttaccgtacccgccgcaggttggccgactccgccgttgtcgccgaggagctatggtggcaagccatagactatgtaagactaaaccacagcaccatctcgttctttaatttgccggaaactgctgcgtcacgctggagtcgggttaaattgaacgctgccaaggtgggtaaaggtttgtccaaggacgccaaagcacaaaagttggctttccagcattggatagaagctattgatcccagacatcgctatgggcataacttgcaatactactacaaagaatggtgtaaaacagatgctggccagccgtttttttattggttggatttaggaaatgggaagaatcttgatcttgaacaatgctctcgatcaaagcttcaaaaacaatgcatcaagtatctgggacctcaagagagagaacagtttgaatacactgtacgcgcgggtaaaattatcaacaagcaatatggagatttacttcatacaaatgaagactctgaagatgcaaaatggatatttgtaatgagcacctctaagaaactttatgctggcaagaaaaagaagggattatttcatcattctagttttttggctggaggagctacattagctgctggaaggctggtggccgagaatggaattcttaagtccatctctgcttatagtggacactaccggccaacagatgacactcttgacggtttcttatcatatctcaaggaaaatggtgtcaagcttgatgaagttgag

SEQ ID NO: 91992 - DNA, 597 bp, Glycine max
  Peptide Sequence Number=SeqID_208770
atggatgcggaatcggacaagcgctctgcttccaccttttctccttcttcatcttcttcttactcctcttcctcgtgcctccgtttggatcggctcgtcgactccgaggagattgaggcggcggagactctggcgcagttggcaaactgcaacactcactcctccgataaatggtgcaccaaacaagacacaacccgagtcatgcgcgagtcgccgactcttcttcactcggatctctctcttgggcctgggggccaagctattgcaggtcagcagccagatgaaaaaatatccactacatctgtagaaacagaaatgtttcagcaggatgactgctcgaggcacatgaaggtcgagcaggatgctgatgtattacctaacacaagttactctttagttcgaaccaccaagtcaaggcgaaatttaaccgaggaagaaaaagaagcaaggaggatacgcaggatattggcaaatagagagtcagctagacagacaattcgccgtaggcagctaggcagtcagaacaaaaatttggttataaacaacttgactcctccttcgtgtcccaaaatacagaagttgacaaatagtcaatag

SEQ ID NO: 91993 - DNA, 387 bp, Glycine max
  Peptide Sequence Number=SeqID_208771
atggagcttgtgattaatggaattgatatggacatttctggtctacctactccggtttgttcatgcactggggctcctcagcagtgttataggtggggctgtggaggttggcaatcggcttgttgcaccacaaatgtgtcaatatatcctttgccaatgagcatgaaaaggcgtggtgcaaggatagctgggcggaaaatgagccaaggtgcttttaaaaaggttttagagaaacttgctgctgaaggttataactttgctaaccctattgatctgaagactcattgggccagacacggcaccaacaagtttgtcactatcagttgcagttctagtaaactatggtttaacctgacaagtccttccaaggatttagaggttgcataa

SEQ ID NO: 91994 - DNA, 921 bp, Glycine max
  Peptide Sequence Number=SeqID_208772
gagaaagaattggctttgaaagagtatgagtctttggagactacaaataagaacttgaagacacagatagccaagtcaataaacactgaagtggagaaaactcctgttgagcctgtgtcatctgtggctgagataacaccttcatccggtaatggtccatggttcctttataaccattttccagtttcacaaatattttggccttccatccttcagtcttctaatccagttcatctacaaaatacatcatttaattccatcgccattccacctaatgctaatgttccatgttcttctgagtctgaatcacgtcacaagcaaaataaccttataaatgataatcgaactcaaaatccattttacatgtttccgtgtccttggttattccctcttccacagtttggaaatggacaatcatctccttccaatagcctgaaagatgaacaagataatctttctctatgtaaaccttgtagttctagttcatctttgaatacactggcaaatgtggattatcaagcagctttacctatcaaacttaaaacagaagcttgtggctggacagaggccatacctattaataaccctggttgtgccactccaagatcatctttggatggaggtgagaagaaaacaggatgttacattatagaaaaatatcatggacctgcactcggttgtaatggtcatgcttctgctgtcaaacaagaacatgattttcaattactttctgctcctaacaataaagtatcttcaatagcttatatttcaacttcttcactggaaaagaaacaagaaaagttcatttgccaggagaaaaatctagtggatgcagttgctgctgcagaagcaagaaagaggagaaaggagctaacgaagcagaaaagcatccataaccgccagtcccggatgcactgttga

SEQ ID NO: 91995 - DNA, 288 bp, Glycine max
  Peptide Sequence Number=SeqID_208773
atggcagagaagatatattggtgctgtgttgttgtgtttgtggaactagtgctagtgttgagcggctgcgagtcaagcacaaacgagttcagtgttccaatgttgatgcagatgaatatcaacaaagcgtgtgatgagatatacgtggttcgtgagggagagactctgcaaacaattagtaacaagtgtggggatccatatatcgttgaagagaatccacatatccaggaccctgatgatgttttccctggtctcgttatcaagattaaccctttcacgaatcgataa

SEQ ID NO: 91996 - DNA, 534 bp, Glycine max
  Peptide Sequence Number=SeqID_208774
atccatggggacccggaagccgcagatattgtgtttacctctggggcagatgttgttgttgttggaataaacattacaacccaagtccaattcacagatgctgatctccttgatctgaaggaatccaaaggaaagtatgctcccttcttgagtgacatatgcaaattctatagggactttcatgtaaaatctgaccgtgtccatggtaatttttcattctacttcaatgtcactagttatgcttctactaaaaaagttgccatgggaatgatgatttggcttctttcaggaattttcctccatgatcctgtcagttttgtggcagttgtgcgtccagatcttttcacatacaagaagggggtagtgagggtagagacacaaggcatctgtgttgggcacacacttctggaccaaggattgaaaaagtggaatacgagtaacccatggacgggttattctcctgttgcagttgcttggactgtgaatgtcaagggagttcttgattatatcagggagctattgatgaaaccctga

SEQ ID NO: 91997 - DNA, 288 bp, Glycine max
  Peptide Sequence Number=SeqID_208775
atgatgaactcgcacaaacaactcttccccctcttctcacttttcttagttctctacctcttaggacaaagggtagtgctgcaagctgaagcaagtcctcaacatggtccaacaaaattgttcgttttcggagactcgtatgctgacacaggaaacattcagagaactgtctcaaattcatggaaggacccttatggcatcacctttcccggcaagcccgccggtcgtttctccgacggaagagtcctaaccgattacatcggtaagtgcaactctaacacttcttaa

SEQ ID NO: 91998 - DNA, 195 bp, Glycine max
  Peptide Sequence Number=SeqID_208776
atgccttctagcgtgcaaacgttgagtaggtcttgcacagtggacaaaagtttttcggccgtcagatccagatggaacggaatgttaggtggactgaagctacaaaggaagatcccaccagcccagtcgcgtagatgcttctcggttgtgtcaatccgaacgaccacacaaagtcacaataagtggaaattttaa

SEQ ID NO: 91999 - DNA, 603 bp, Glycine max
  Peptide Sequence Number=SeqID_208777
atggcctctctattcaacaatgctaacggcgttctcggaaaatccgagaagctcattatcgacaccgaccctgggatcgatgatagcatggctatttttatggcttttcaaagtccagacgtggaggttctgggtttgacaaccatttttggtaatacaactactgaagtttccacacgcaatgctttgcttttgtgtgagatcgcaggccgtgaagatattccagttgcacagggaagccatgagccattgaagggtggaaagcctcgtgttgctgattttgttcatggtaaagatggactagggaacacattcctacccccacctaaaggtgagaaaattgagaaaagtgctagtgagtttttggtagagaaagtctctgaatatcctggtgaagtatctgtgctagcacttggaccactaacaaatttggctttggcaatcaaaagggattcttcctttgcaagcaaagtgaagagaatagttatacttggtggtgcattctttgccttggggaatgtgaatcctgctgcagaagccaatgaaaaagaatgcagactaattttctttgggcctttccatttatattttgtatatctttga

SEQ ID NO: 92000 - DNA, 249 bp, Glycine max
  Peptide Sequence Number=SeqID_208778
atggaaggttcccaacaaaacactcactatcctaaggaaatattgcctaaaattattacacacaaatggaagtttggtaacctattggagactcccaacacacttccaatgaaaggcctttttgttacaaaacttgaaagcaataaagtgcttcttagtccaatagctcttaaggtggttgaccccttgcttcttgactcaaattcttcaagggatgacaccaatcctcctttacaattccctatatga

SEQ ID NO: 92001 - DNA, 549 bp, Glycine max
  Peptide Sequence Number=SeqID_208779
atgccctccaaactctatttccaacgaccaactgcccctaacctcctattagatgagaaaggcaagtgtaatttcaaaatctttagtgcaaataacatctatgagtggaatatagatgcccaaatggagtacaatattatgaatacactccagcacatgaccatggtagccatggcttaccaaacatcccatgagtgttcggaggaaacaatcattgatatcttagtggcaggattttccggccaattaaaaggatgcacagtcaaaatggatctcaatggaaaagtcattactaatgacgataataaggagattcctgacgctattaatacatatatttttacaatagcccaacactttattggcgacccatccctttggaaagatcggtccatagaattattatcaaatcttaagtgtagaactttagtagattttaggtggtatagagataccttcctaactagagtttacaccagagaagatagtcaacaacctatctggaaagaaaaatttctagccggtcttccaagatcattaggagataag

SEQ ID NO: 92002 - DNA, 336 bp, Glycine max
  Peptide Sequence Number=SeqID_208780
atgagggtgtcgtggataaccgaagacaagcacgcagaatctgtggtggagtacggaacaaaggcaggggaatatagcgcaaaagcaacgggggtgtacacctcgtaccaatattttttctataactccggcaagattcacaacgttgtaattgggccattgcagcctggttcgacttacttctacaggtgcggagggtcaggtcctgagttttccttcaagacaccaccacccaggtgtcccattgaatttgtcatcgttgtgagtgagttgatgagttcttcaagccaacgcaacgataccgtggggcaggataaggtagcttttaaggattaa

SEQ ID NO: 92003 - DNA, 180 bp, Glycine max
  Peptide Sequence Number=SeqID_208781
atggatccaaatattacccaactggtgggagattcggcgaataagaacacccttgcctttgccttgctgcctgcctctacagatagatggcagtgtggtgatgagcacgggaacatgcatgagtcattatgtgtgaagggatgcacaattcacccttcttccttgatgaaccatatctaa

SEQ ID NO: 92004 - DNA, 330 bp, Glycine max
  Peptide Sequence Number=SeqID_208782
atggatacctatggagtcgagcttgagctgagaaagctagaaggagaagtaaaggccatccatgagaatttgctctatcttaagggaagggaagctgaaatgaggactgtgagtgaaaaaacaaatggcagagtggcatggtttagcattatatccttggctatgtgcattgcagtttctgaagaagatgaaaaacttcttaggcatattactaagtacggtcatggtcatggacatggagctgagttccctaagcaagaaggtttgcaaaggtgcggcaaaatctgcaggttgatgtggatcatttatttaaggcctgatttgaagtga

SEQ ID NO: 92005 - DNA, 231 bp, Glycine max
  Peptide Sequence Number=SeqID_208783
atggaaaggctgaactcagagttgtactaccagaactgtcacataatgaaagagaatgaaaggctgaggaagaaagctcagcttcttaatcaagagaatcaacaacttctgtctgaactcaaaaagaagctctccaagggaaatgcaaaaaccaatgctgctccaaacaccattcatgacctgaaccttggctcaagtactagtcaaagtccttctggttccagcaattaa

SEQ ID NO: 92006 - DNA, 177 bp, Glycine max
  Peptide Sequence Number=SeqID_208784
atggcgaacgacgacggagcttgcggcacaattcgaacctcacggcggagtgaaggaggtgacgacgaagcttgcggcagcgttcggaggtttccagaaaatgcctttactatgtcaagagaactcggacgtaccttaagtgacatgaggatcttgaagaaacagcttaagaactag

SEQ ID NO: 92007 - DNA, 1080 bp, Glycine max
  Peptide Sequence Number=SeqID_208785
atgggtgaggcagaacaaagagtttgtgcactccatggagtctttggccaatgtaagggattgacatggcttcttcctgaacggttttctgaatcagagattggaccagaagcagtaacaactattctgggaatcatcacagctctcaatgaacatataattgatacagctcctaagcaaaatattacaggctctgtcgagccttattcatttccttatccattatgcttatctgcattaaaggatttggaaacattagttgaagttgtggcacaacaatactatggtgatgataagaaatggaatttccttgccattactgaagcaaccaaggtactggttcggttatctttgtttcggaagagtggatataagatgctgctacaaggaggggaaacacctaatgatgaggagtattcagatagttttacttcacaacatcatatgggcttaaagcccgatgtgcatcataggcctggttatatgaaaaacaatcttggtgcaaaaccaatgaatcaggaaggaagagcattatctgctttggttagatttggagaaaaagcaaaggggtcagatccagtgtggttacgcagggttgaacaccaacaagcaactatggagcctacaacttcaagggtggatagaccaacacttctcaccatattgtctgaaaggggtctttgtggggctctgttttttattggagaagttctacttattagtagaccacttatttatgttttatttattcgaaaatatggtattcggtcatggaccccttggttcctttcgctggctattgattgcataggaaacagtattctttcactcattacatcgtcagtggctggtgggaaggaccgaatgtttcatctgtctgccctagaaaaggatgaggttaaacggcgaaagctgctatttgttctttacctaatgagagatccatttttcagcaagcaaagacttgaaagcacggagaaagttttggagcctattcctgtcataggatttctcacagcaaaacttgttgaacttataattggagctcaaacacgatacacttacatgtcaggatcgtga

SEQ ID NO: 92008 - DNA, 333 bp, Glycine max
  Peptide Sequence Number=SeqID_208786
atggcggcatttgtggtagaggtggttggtgatgaagagataattcaaagaagtagagggggattggaacttctttgtgactccaagaagattcataatgtcaatattgagcaacacaatggagaagacaagttaatcatgaaagatttgctttcttgggtacagaccaacttgattaaggagaggcctgaaatgtttatgaaaggagatactgtgagacctggagttcttgtccttgtgaatgattgtgattgggagctaagtggtcagctgaacacatcactggaagacaaagatgtggtggtttttatatcaaccctgcatggtggttaa

SEQ ID NO: 92009 - DNA, 219 bp, Glycine max
  Peptide Sequence Number=SeqID_208787
atggactcaacaatgtcgacaaggacctttcacaccttgaccaatccaccatgccccggaatgatccacttgggtgatggggttgatgaagtattctactcagtccctaaggcctatgatcttctccacatgctggcagggcaaaggaaacaagagttggaattgaatttcattgagcaaatggagaatataatacgatataaattccgaatcaagtga

SEQ ID NO: 92010 - DNA, 447 bp, Glycine max
  Peptide Sequence Number=SeqID_208788
atggatccaaatattacccaacaaaatggtgggagattcttgcgaataagaacacccttgcctttgccttgctacctgcctctacagtgctgcacagcgctagaggctgagttattggccattaagattggagtacaaacagcagtatccaggggatacggcaatttgatcgtggagagtgattcgcatgcaagtatccagctcattaacttgggtgtccaacaaagtcacattttctatgatcttgtctcttcaatacttgagatcggtagcaaggccaatcatatcgtttggaatcatgtcttcagagaagctaattccgcagctgatggtctcgccaaacatggattgtcattgtctggtagggtagaactttttgagtttcctccaccgttcatttgggctcctatgtgtgcagacgaaatgggagtaatatacactcggtga

SEQ ID NO: 92011 - DNA, 252 bp, Glycine max
  Peptide Sequence Number=SeqID_208789
atgaggaaccgttggatttacggatgggtgggtcccactgggacagtgtacggagggcagggggtggcccatgggccatggttagcatctcagcgtgcacaccggtgcttgttggcgccaccaccacacactcgtgtgggcccaagcacccctctcttcaaccctgcctggcccccaaaaggtgcatggccaaatatggacccacccatcaccttctacatcatggatacgtgtatattacattatatttag

SEQ ID NO: 92012 - DNA, 468 bp, Glycine max
  Peptide Sequence Number=SeqID_208790
atggcaaaaatgcctttagagcctctaatagtggggagagtcataggagaagttcttgattctttcaccacaagcacaaaaatgactgtgagttacaacaagaagcaagtttacaatggccatgagctcttcccttccactgtcaacaccaagcccaaggttgagattgagggtggtgatatgaggtccttctttacactgatcatgactgaccctgatgttcctggccctagtgacccttatctgagagagcacttgcactggatagtgacagatattccaggcacaacagatgccacatttgggaaagagttggtgagctatgaggtcccaaagcctaatattggaatccatagggaccacttcaacacacgcaaattcgcagcagagaacgaccttggcctccctgtggctgctgtctacttcaatgcacagagggaaacggctgcaagaagacgctatctatag

SEQ ID NO: 92013 - DNA, 775 bp, Glycine max
  Peptide Sequence Number=SeqID_208791
atggacgagcacagtttcatggtgaatagagaaagagctgttgattatttgaactctttggacaaggtctttgtgaatgaccaattcttgaactgggacccagagaacaaaatcaaagttaggattgtctccgccagagcttaccattccttgtttatgcacaacattttaatccggtgtacaactatgaggtctagctcaattagttcagcaataagtggatacgcgacatgcaggtgcatccgacccactcctgaagagcttgagaattttggcacacctgacttcactatttacaatgctggacaatttccttgtaatcgttacactcactacatgacatcttccactagcattgatcttagtcttgcaaggaaagaaatggtgatccttgggacacagtatgcaggggaaatgaagaagggtctctttagtctcatgcattatctcatgcccaagaggcaaatcctctccctacactctggctgcaacatgggcaaaggcggagatgttgctctcttttttggactctcaggtactggaaagaccactctgtccacggatcataataggtatttaattggagatgatgaacactgttggagtgagagtggtgtctcaaacattgaaggtggttgctatgccaaatgcattgatctctcaagggagaatgaacctgacatctggaacgccatcaaatttgggacagtcttggagaatgttgtttttgatgagcattttcgagaagttgattacacagacaaatcagttacag

SEQ ID NO: 92014 - DNA, 381 bp, Glycine max
  Peptide Sequence Number=SeqID_208792
atggacactacatggggttatcaagctattcaacctcctgcttcaaagatatgtggatctcctaatgggtccactataacagcacccagaatcaaactaagagatggaaggaatttagcatacaaagagcatggtgtcccaaaagatgtagccaagcataaaatcatctttgtccatggttttgatgcttgcaggcatgatgcctatgtttccaaaacactatcacctgatgttgctgagaaattaggggtctacattgtatcttttgatagacccgggtatggggaaagtgatcctgatccaattcaaacactgaagagcctggcattagatatagaagaacttgctgataaattgggattagggccaaattctacgtaa

SEQ ID NO: 92015 - DNA, 843 bp, Glycine max
  Peptide Sequence Number=SeqID_208793
atgatgagcactgttggagtgagagtggtgtctcaaacattgaagggggttgctatgccaaatgcattgatctctctagggagaatgaacctgacatctggaatgccatcaaatttgggacagaatgttgtttttgatgagcattttcgagaagttgattacactgacaaatcagttacagaaaatactcgtgcagcttatccaattgagtacattccaaatgtgaagttaccatgtgttggtcctcacccaaagaatgtgatccttttggcatgtgatgcatttggtgtgcttccacctgtgagtaggctaaacctgtcgcagaccatgtaccatttcatcagtggatacacagctttggtggctggcacagaagagggtataaaggagccaaaggcaacattttcagcttgttttggtgcagcatttataatgctacaccctacaaagtatgcagctatgcttgctgaaaagatgcagaaccatggtgctaatggatggcttgttaacacaggatggtctggtggaagctatggttgtggaaatcgtattaaactatcttatacgagaaaaattattgatgctattcactctggaagcctattggatgcggagtacaagaagaccgagatttttggacttgagatccccaataaagtggagggagtcccctcagaaattcttgaacctgagaacacatggtcagacaaacaagcctacaaggacacactgttgaagctggctggattgttcaacaaaaattttgaaacattcaccattggagagaacaaccaagtgacagaggagattcttgctgctggaccaatcattggtgatgcttaa

SEQ ID NO: 92016 - DNA, 153 bp, Glycine max
  Peptide Sequence Number=SeqID_208794
atgcctaaatatggtggtgactggccaactgtcaaagaaattatacgtgggaatcataggctagttgtgttcacttcaaatgctactaaggaggttcgtgaaggaattccatacgtgtggaattatgctgtagaaaatcaatgtgtatcataa

SEQ ID NO: 92017 - DNA, 258 bp, Glycine max
  Peptide Sequence Number=SeqID_208795
atggttcttcatagagaactcgatcatctcttttcatccccttttgttgaccctcccaaagatgatgcgaaatctagtggcatgtcaattgaaaataagattaagttcctcgagagtttgactggaaaggctaaatacctgtctatgtttatgtggatgaagtggcggtcattgcctagcatttcaagaatacagtgctacatgcctaataatggtgagcatgtctcttcctttattaatatttgtcttttccagtaa

SEQ ID NO: 92018 - DNA, 507 bp, Glycine max
  Peptide Sequence Number=SeqID_208796
atggattcaggagaaggttttgtgaaaggggcaacattggtgttgcatttgtgggttaacaactttgagcggaagaggttgctgagggtgcataggtttcttacggttggggcacacatctacagtggttcacaaaatgacacatttagggaaaaagattgcagaagtgagggtttgagaagaagaaggggaattaggaataacatgttgcggaccattgcaaccagttctctagtgagcctcgggtttgagcagcgctacctagctaggtatgtaaactcgagaggagaggaagggatgcgatgcgaaatagcgctgttttgtattagtgtccctctcgcccaacctactcgttttcatttccatgcctgttcctctcccgtttgtctcctctcttgctcacatatctcactcttgtggcctcacttccgtgccactgccgtcgaggaagagaagctactatgtaatatagaatgcaacgagtctacatcagaagccatgcggtga

SEQ ID NO: 92019 - DNA, 366 bp, Glycine max
  Peptide Sequence Number=SeqID_208797
atggtctcaaagagcggatcgtcaagttgtggtagcgagaactgcgaggtaaagaccagaggccgtgaagactctgctaaagcagaagtgcaccgtgatgatgctaccgtgaaattttgggagggcaacaagaattacgcgcacgaaggggttttcaagggccacaagctggcggtgttgtgcctcgctaccacggggacatttgttttcaggggctcctcggacaataccttatgcatgtggaaacacaagggtttgattcacatgtgcatgacggttctcatgggccacgatggtccattgaagtgcctcgccacggaggagaatcatgaatacattgcaaggggtgaccaagataagcattag

SEQ ID NO: 92020 - DNA, 621 bp, Glycine max
  Peptide Sequence Number=SeqID_208798
atgaggaaaggtcggcttccgccattggaggacggcaaagaaggggaaggtgtttctcgtggtaaagggcaggatctatttcttcgctccttttatgaaagtttgcaactcattcaggagaagaaactccagttgccatttttgcatgctgtgatagtagggagtgatatgaatgctcagacaaagtttgaaatggaacttcgcaaatttgttgttgagaaaaagattcagaatcgtgttcactttgttaacaaaaccctggctgtggctccttacctggctgctattgatgttcttgttcaaaattctcaggcacggggagaatgttttggaaggataaccattgaagcaatggcatttcggctgcctgtactgggaactgcagctggaggcacgatggagattgtggtgaatgggacaaccggtttgctgcatcctgtcgggaaagaaggcgtgacacctctcgccaagaacattgtgaaattggcaagtcatgttgagaagaggctaacaatgggaaagaaagggtatgaaagagtgaaggagagattcctggagcaccatatgtcgcagagaattgcattggttctgaaggaagttttacagaaggctaagcaatag

SEQ ID NO: 92021 - DNA, 564 bp, Glycine max
  Peptide Sequence Number=SeqID_208799
atggaagaagtggtgtcatcttttgagatgatagcaggtttgggagctgcaaagagttacactgctttggcactccaagccatgtcaaggcatttctgcagcttgagagatgccatattgtcacatataaatgctgagaaaagaaaactctttcaggatttacctaagatcagtagtggattgtctcaactaagcttgtttgatagagacagcagacagagtagaatgtctctccaacaacttggggtgatccaaagccaacgccaagtttggagacccatcagagggttgcctgaaacctctgtggcaattcttcgttcttggctctttgaacactttctccacccttatcctaatgattctgaaaagttaatgctggcatctcagactggtttaactaaaaaccaagtctcaaattggttcataaatgctcgagtacggctatggaaaccaatgatagaagaaatgtacaaagaggagtttggagagtcttctgaagactccaacccggctggtaacaactacttgacgagggaagataccacagattgtgtagaggattga

SEQ ID NO: 92022 - DNA, 408 bp, Glycine max
  Peptide Sequence Number=SeqID_208800
atgcatattcttctccggttaagcagacgctgcttttgcacctttactccacgcccttggcttttcgtgggcttgggcaaccctggcgacaagttcaaaggaaccagacacaatgttggctttgagatgattgatgcatttgcggagtcacaggggattcctatggacactgttcactccaaagctatttttggaaaaggttttgttggtgaagttcctgttttccttgcaaagcctcaaacttacatgaatctcagtggtgaatcgacaggaccactggctgcttattataagctacctcttaatcaagtgcttgtgttccatgatgacatgaacttgccctgtggggtgcttcgtcttcacgacaaagggggtcatggaagtcacaaagggtacaacactacatga

SEQ ID NO: 92023 - DNA, 939 bp, Glycine max
  Peptide Sequence Number=SeqID_208801
atggcgaagcattcggtggcaatggcgaagaagcggtggccgataatgttggcggcattcttgtccgtctcaacagtgacggtgctcttaatgagatccaacaactccgattcctgcaacaccaaccattttactgttgcacaagataatcagattcgttcccctgtccaactcacaaatgcggcttccagtcccctaattttcatgaagtccaagctagttctcatggtttcgcacgagctttctctttcaggcgggcctttgctgctgatggagttggcgtttctgctgagaggcgttggttctgacgttgtttggatttctaatcagaaaccttcggaacatgatcgggtcgtttacagcttggaaagtaagatgttggacagaggagtgcaggtcctgtctgccaaaggtgaaaatgctatagatacagctcttaaagcagatatggtcattctaaatactgccgtagctgggaagtggctggatgccattctcaaggaaaaagttgcccatgttcttccaaaggttttatggtggattcatgaaatgcgagggcattatttcaaagtggaatatgttaagcacctcccttttgttgcaggtgccatgattgattctcatacaactgcagagtactggaagaataggactagggagcgtttagggattgaaatgcctgaaacatatgttgtacatcttggaaatagcaaggagcttatggaagttgcagaagatagtgtagcaaagagagttcttcgtgagcatgttcgggaatctcttggatgctgtcaggcaagggatatgttggtgtcttctgcaccctcttgggcctactctccctttggactgtattgctatcattacccaccgctggaaaaccaaccttgtcctcaaggttgggcaataaaaacaagcaaatacagggggtgggtgtag

SEQ ID NO: 92024 - DNA, 768 bp, Glycine max
  Peptide Sequence Number=SeqID_208802
atggagtatcaaaaccaaaatgccaaggaaggtagattctgtgagaaactcaagatcaagaacaagcctaagtttgtaggagtgagacaaagggcatcagggaaatgggcagcagagatcaaagacacatcaaagaagattaggctgtggcttggaacttaccaaactgctgaggaagcagctcgagcttatgatgaagctgcgtgcctccttagaggttcaaacactcgcaccaatttctctactcataaatatggcattgctacaaattctcctatatctctcaaactcagaaacctccttgatcgtaaagccatgtcaaatcaaagtcaaattcaaattcaacgccaatcatcctctacgataagttccactttcgaaggtgctgctgctacttcagctagtccaaatgttagtgccatcaataagatcatggtcatggaaaactactctacttgtagtagtgaaggtaattctatgtttttggttcagaatcaccaagtctctgataacacgtatggactagacacgaatttgatcaactgttcaatgggtatcacaccaaatacatcgcaatttgattgctctagggcactagcccaacaaaggattaacgaattaccaatgccaaaagatggtttgaatgttgaaaggcaattttcagattcggtatatgccaccaatgagtgccatgtggaggatacatttgaatataagtatgaatatgatttcaattatcctctctcacactttttctgcttcacctga

SEQ ID NO: 92025 - DNA, 216 bp, Glycine max
  Peptide Sequence Number=SeqID_208803
atgacgactcgtccgagttgcatgactcagtggctcactccggtgagggagggacaagggagagcagcgaggtgcagagctcgacgatgtggaagaggaagacgcggcggaggaaggaggtttcaagcggcgatagtgacgatgatgtttgatctggtttgcgcaccaaattactaccattgcctaaaacgtgccgaaaaaattgttgtaaactag

SEQ ID NO: 92026 - DNA, 527 bp, Glycine max
  Peptide Sequence Number=SeqID_208804
ttattgttaaagcaagcagcggtcccaggtatgtggttggttgccgcagtaaagtggataaggaaaaattgacttccgggacaagggtggttctcgatatgacaacactcaccataatgcgagctcttcctcgagaagttgatccagtggtttacaatatgttgcatgaagatcctggtaatatcagctattcagctgttggtggcttatctgatcagatcagggaattgagggagtcaattgaactacctctgatgaatcctgagctctttcttcgagttggaattaaacctccaaagggtgttctcctttacgggcctcctggtactggtaaaacattgttagccagggctattgccagtaatatagatgctaacttcctaaaggttgtttccagtgccataattgacaagtacattggagaaagtgccagccgtgcatcatttttatggatgagatcgatgccattggaggtcgccgtttcagtgagggaacaagtgcagatcgtgagattcagagaacgctaa

SEQ ID NO: 92027 - DNA, 452 bp, Glycine max
  Peptide Sequence Number=SeqID_208805
aaagactataggtggcacccagaagaagagcgagccattagagctgtttttgagacaaaaggttcacgcattttgaaaagtgcaatgaacaagatcagaaatggtcaagataaagaaaaatggataacaaccaatgttcgagcagccttggacaaacattggggttctatagatttcctaaacaagagctccattgccaagtcaaaggagtttcaaaggccaccaactacttgggaggtgatggagaaaactaagaaattgaagtcaggagaatgggtcaatgataagtcccgcgaatttgctgagaaatatcaacatcgtcgagatgaaatcttacaacattcgatagaggaagacacatctacacaggattcccctaacactcatacttctgttaatgataatgaaatatatttgaatgttgttggaggtccaaattacaaggcgaacat

SEQ ID NO: 92028 - DNA, 1168 bp, Glycine max
  Peptide Sequence Number=SeqID_208806
atccacgcgctcgtcgatgtcgtgagccgcccggcggtcctccttctgacacccggcaatgccagcgacgtgaggaccgcaccggatgtgctggccgaggcccccggccgcatccgccgcctgattgccgacaagggctatgacgccaactggctgcgaaaagacctgcgcgcgagcaacaccacaccgatcatccccggcacccgcgcgcgcaagcgcaagatcaggctcgacaagaaacgctaccgcgagcgctggcgggtagaggcgaccttctgccgactgaaggacttccgtaggattgccacacgctacgacaaactcgcccgaaacttcgcctcagcactcgcccttgccgccgtcattgccttctgggacgggagcgggtttgtgggggcatcacggccccttggtttaaccaggacaggcggcggcgaaggcgaggcgaacccggctggcggtctcgcggatgcgggcgccgagcttcaggaggcgcagccggagcgtggcgaactcggccgtggcgaggcggtgcgccttcgggatggcctcacgcacgctcagcatcagccagtaggccgccgtgtgcaggacgagccgcatctggttggcggcgggatgccggcacgaggtacggtcggaggcgagctggctcttgtgcagcttgatcaggttctcggcctgtccgcgggcacagtacaggtcggcatagagccattccggcgtgccggtcgtgatgtttgtgacgacatagcggatgtcgaggccgagccgggtcgcctcgatacgggcgacgacgcgccgctcctgccgccaggatttggccgcgtgccgggtctcggcaaagccgcgcaccgcgtcctcgttgtcgatggctcgcacaactctgatgtgatcggccgtctgttccaccttggccgccagcgctttggtgccgctcaggccgaagacgtagctgaccccatggttctcgcaccagtccatggcctcgggccgcccgtaatggccatcgccccggatggtgatcgcggtgatcatcgcgaccgggcggctggtggcggtgtcgtagacgtggatcggcagaaagcagcgctcatcgtgatgagcgttgaacagcgacagttgctgctggccgtgcaccacgtcgcacgtgtcgtcgatgtccagg

SEQ ID NO: 92029 - DNA, 354 bp, Glycine max
  Peptide Sequence Number=SeqID_208807
atggcggcgtcatggcggtttttcgaaaaaacgccaccgaatagtggtggcgtggcgggtttgggatggcggcgccatggccgtcgtggcggttatggcggggtggcggaaaatggcgtccctcccgcaccccacacgcgcacccagccgcacgcgcacgcagccgcgacgacctccggcagcgacgcaccggcacaaacggcggcgacaagctccggcagcgacgcatctgtcacgaacggcggcctgcagcgaggagttctcgcggagaagacgaagctgctgtcgcgaagaagaagaaggcgtcgcgaagaagaagaaggcgtaggttttagttttatttttgctgtttga

SEQ ID NO: 92030 - DNA, 462 bp, Glycine max
  Peptide Sequence Number=SeqID_208808
atggaagtgcactcggacacacatggactctgtaaccatataagcaaagttaaggaaatacttaatgaacttgaaggtctattgggggatgtaacaaatgctattcagactacagatggaaatttattagccctctctgatctggattttaatgttgaattgaatgagcagaacaacaattacacctttactcaggaggaaaaggatgctttgtcccattctcaaagtcctgatgttacaattaccaagaaaaagaaaagtgctgatgttgcatatttagcgatgctaatggctttcatatacagcatggtcaaccaagactatttgatgcaggaaaagatcgtttctgctttagatatcaagatgccatcagaagaattagaaagctactgccaaatgtggtctttgcgccccttcataaatgatgagatcatgcatcaagcttgggaacatattcactga

SEQ ID NO: 92031 - DNA, 405 bp, Glycine max
  Peptide Sequence Number=SeqID_208809
atgaggcaaatcgagaaattacttcttaaattcaagaaagaaaagataccttcagatggtggggaaaacttggtcaacaggagcaagaagtcggaagaggagaacaatgacaataacaggtctagtgacgagaatgaggaagaggaacccaattcttgtggggaggaaagaatggaggaggagcatccctctgaaatcaagataaagaaaaccattgcgggaattaaagagatcaaacaaatgctacaatttatgataaagaaaaagggcatcgttcttgagttcgaaaaagaggacaaacaacccatgcagacagtaccgactttgcagttgggatcttgtgtcaaagacaaagactcgagaaccattgaggccgaggtggtagaggagatcagggtggaagag

SEQ ID NO: 92032 - DNA, 312 bp, Glycine max
  Peptide Sequence Number=SeqID_208810
atgatccctactcctaggggttggaggattacaaagattgatgagttgggcattgctggaagcaggctgctgtctggctttcaacaagcacttgattttattaggaggcctcctatagatacgaattctaaattagttcacaagataattgtagctaatgaaactgagagagttaaagcctatattaattctggatgtaggaagctcaatgaaagtatccagagtgtaactaacttttatggagatggtaggttgtatcattccaatattggggcatgcctcaagacccaacaagggcttagtgacacataa

SEQ ID NO: 92033 - DNA, 330 bp, Glycine max
  Peptide Sequence Number=SeqID_208811
atgattgagaggagatactctattaaaggtagtcagtcagcccagcgatctaaccagataaaggcttccttcccatcacctactttcatgctaattgaatctgataaccaattaccaggacaacaagcaagggaatcaagagaagtaatatctcaccaccaaatagaggagttgaaagggcgaatagagctggaaatacttatcttgtatgcgctcatggttcccgacgaaggtgtgcccatggccatggtgttcaagtccaatccatctaaccttgttgagagcaaagtagaggctcaaggaattgataatttgactttgacaaactag

SEQ ID NO: 92034 - DNA, 687 bp, Glycine max
  Peptide Sequence Number=SeqID_208812
atggcttccaaggcgatgagcgtggcagcagagaagatagggacggcggcgcggcgccaagccgtgtcgctaacggacgccgccgcctccagaatacggcagctactacagcagcgtcagagggccttcttgaagctgggagtcaagactcgcggctgtaacggcttatcctacaccctcaattacgcagatgaaaaagggaagtttgatgagttggttgaggataagggtgttatgatactgattgatccaaaggcccttatgcatgtcattggaactaaaatggattttgtagatgacaaactaaggtgtatttgtgttctaattatctattttagaagaacatggaactacaaactatgtgtccaagtaggggaatttagtttatacaagatattcatcttggtaataagatgccgtgacactgatgctttgctttattcctctaagagggacatgcaagagaatttcttactcaagcttcttcactttgataaaattctcttcatcagaattgctcttattttaactcctacactttttgcttctcctgtcagatcggaatttattttcgtcaatccaaattccaaagtcttagcattgttgggaggaaatatgtgcgcacgtctaaccctaggaccgagggaaggtagctacaagcatgaagttcttgtgtttcgcatttaa

SEQ ID NO: 92035 - DNA, 417 bp, Glycine max
  Peptide Sequence Number=SeqID_208813
atgagcacgattacctccgtggccgaagccttcttcgaggcgtgcgagacaggcggtggctgggcggcgtgcgaacgctattgcgcaccggaagccggcttctcggctcaggcggatgccctggcgggcatcaccacgctgcgcgactacgcggagtggatgaagggccttctgacggtccttcccgacgggcggtacgaggtgaagtcgttcgccacggacgaggagcgccggaacgtggcggcgtatggcgtcttccgcgggacccataccggcgagggcggcccgtgccctccgaccgggaaaagcacgtcgaccgactacgtctacgtcatgcagttcgacggcgagcggatcgctcacatgacgaagatctggaacgacgcgcgcgccgtgaaggaactcggctgggcctga

SEQ ID NO: 92036 - DNA, 648 bp, Glycine max
  Peptide Sequence Number=SeqID_208814
gggctgaaggccgagacgcttctcggccaatgggcctacggcctcggcctcgcggcgcggatcgcccagcgaaccgggcgggcgctggagacgattgatctcggcggtggcctcggtatcccgtacttttccggcgaggccgccctcgacctcggggcgatccgcgccggcctgcccgacctgatcgcgacgctgcgggccgacccccggctcgcgggcgcccgggtggtgctggaacccggccgctacctcgccgggtcggcggggctctacgtggcacgggtgctggcggtgaaggattcgcgcggcagccgcttcgtcatcaccgatggcggcatgcaccatcacctcgcggcgagcggcaatctcggccagatcgtcaagcgcgactttcccctcgccgccgtagtcgaggaccctgaggcgccgcgcgccgccaccgccgtggtcggcccgctctgcacgccgctcgacatgctggcccgcgccgcccccctgccgccgctggccgagggcgatctcgtggcggtgctgcaatcgggcgcctacggcctgaccgcgagcccgacggggttcctgagccacccgaccccggccgaggtgctggtggagggcggcagggccgagatgatccgcgctcggggctga

SEQ ID NO: 92037 - DNA, 108 bp, Glycine max
  Peptide Sequence Number=SeqID_208815
atggaaattgtttattactgcaattatccactagcaaaagcagttcaaatgccaccttatggccattccaaatgtaaaatagaaactacagctgagaatgttaagtga

SEQ ID NO: 92038 - DNA, 1857 bp, Glycine max
  Peptide Sequence Number=SeqID_208816
atggaagctgtttctcgaagaagaggtggaggcattttcgaaagcctctacaaggtcgttatgcgtcgcaactctgtctacgttaccttcgtcatcgctggcgccttcctcggagaacgggctgtagattatggagtccacaagctctgggaggctaataatgttggggctgtggtgatctctagggaggaaggaggcgacaatgcggtcatgatgatggtactgtttgcacaccatgttcgcatcgtggtggtgtgcttggcgttgcaatatgtgatttggtggtgggggtccttgttcggtggtggcagtggtgcatggagaggttacaaaaaagagaaagaagagcttgcaaaaatgattaagctacaaagtgatgcactgagagaggcaatttcccaggtggtgagtaattcaaaggagaaaaatcgtaaattcaccgagactattgagctgcaaattggattgaagaactatgatcctcagaaagataagcgtttcagtggttctgttaagcttccgcatattcctcgccctaagatgaaaatctgcatgctcggtgatgctcagcacgttgaagaggcggaaaaaattgggctggactacatggatgtggaagcactgaagaaactcaataaaaacaaaaaacttgtgaagaagcttgccaagaaatatcatgtttttctagcttctgaagcagtcatcaagcaaattcctcgtcttttggggcctggtttaaataaggcaggcaagttgattgccttgctatttgctcttgggaagctagtgttagagatggaggaagcgcaaatttgggctaagaaggtggagctgccagcgttcataggaacatacccaattggttggattgctaggactgaaaaattctttgaggtacaagaaattccttcgttccataagctgcaatatgcattcatgagcatgaagggtgctgcgacacattggttctacatttggagccaaaacaacccagattcagattgggagtcattttccacacctttgatcaaaagattcggagatcgccatggtaaccacatctttgaaagattgagtatcttgaagcaagaaaagccaactgaaacagaaacccacatcaaaaaatgggagacttccacaaagttcttgaaagggaggaccaacatttcagagtggaaacacatgttgtgcaagatattgaatgaagaagttgattcacatgcttctcaacaagacaaaaatagcatggagggaagtgggtcagaattcagtgaagcaaaggctagttcttgggcaagaaaggtggaactacccagctttgatagaagcatagaagggggaactgatttgaagggtagcagttttgagtgtgacaatgacccattgcagttctggaaatcaggaaacaaaagtaaagaagaagaagttgatccattgataaagagggagaagcacaaggaaaatggagtgacgaatgtgggctgcgaagacgattttcttgataacccaattacagatttgatcaagaaggaagtcgaaactggtgattcaaccaagccacattgttttcaagattcagatttccataaaaagattgttattgtgaaacaaaaatcattcatgaaggtggttggaacaacaatggtgctggaatcttggaatgtcaacttgttggatgagcctttagcattaaattttgttgcatctatggctgacagcttagccatggagctaaggcagaaggaatgtactaagccagtcaagctgattaaagttatatggagtccacccttgttcctcccaccaccgaagccaccagacctcagtttgcatgcaggggcagtgggtcgttcctag

SEQ ID NO: 92039 - DNA, 357 bp, Glycine max
  Peptide Sequence Number=SeqID_208817
atggcagtgatggcatcgaagcttgcagtggccaatagcttacccgacggtgaccaagcacaagatcgaacagttcgagtgtgcgtttcatccaaaaaccgcctacatttcatttacataatcaaattcaaaatgatggaaattgacctggcaggcccagaggccagaggagagattctgctcccagattcggacggttttgtcgccgctgcaagaagcgaagacgagtgggataccggcgtgaccggtggccgggtttcaatccaagctccaaaccctatcggtggggccttcgagtctctgaatctctttcaactccatcgccaatcgattttacttagcatacaccgagtctaa

SEQ ID NO: 92040 - DNA, 1049 bp, Glycine max
  Peptide Sequence Number=SeqID_208818
atgtccttgccttcagaggactacacctcctcatcttcagagggcaacacgccctcacattcagaggactgcacgtcctcgccttcagagggcttcaggtcctcacctttagaggaatgcacgtcttcaccttcagagggctgcacgtcctcgcctttagtggactacacgtcctcgccttcagaaggctacatgccctcacctttagagggctacatgccctcaccttccgagggttacatgccctcacctttagaggagtgcacgtctttgccttcagaggactggacgtccttgcctttagagggctacacaccctcgccttcagagggcttcacatcctcgccgttgcacatcctcgccttctggggtatacacttcctcaccttcatcagagtgcacaccctcaccttcagaggagtgcatgtccttaacttcagagggctacacgtcctcacctttaggagactgcacgtcctcgcctttagagggctacatgccctcacctttagaggacttcacgtcctcgccttcagaggagtccatgtcctcgcctttagagggctacacaccctcgccttcaaagggcttcacaccctcgcctttagagtactgcatgtcctcgcctttagtggagtgcacgttgtcgcctttagagggctgcacgtcctcgccttctgggggctacacgccctcaccttcagggggctacacgccttcaccttcagagggctacatgccctcgccttcaaaggactgcacgtcctcgccttcatagggctgcatgccctcgccttcagagggcttcacgtcctcaccttcgacggagtgtatgtcctcaccttcaaaggattgcacgtcctcatcatcagaggactgcacgtcctcaccgtcagagggctacacgtcctcaccttcagaggactgcacgtcctcaacttagatggctacacgcgctcgcctttagaggactttacctcctcaccttcagaggactgcaagtcctcgccttcagagggctacacgcccttgccttcagaggactgcac

SEQ ID NO: 92041 - DNA, 288 bp, Glycine max
  Peptide Sequence Number=SeqID_208819
atggaactccatgttcacagatctatgaggtgtggaagaacgactagccactatgtctataagaaccttgctccagagagagttgcttctatcttgagtagtcatgatcttcttattgttttggctaaagtagatgccagtgaggagaagaacacgagtatgggcaatagtgagatggataaaactccaaaagagaaggagtcaaagacgttgccgccgccaccttcgtcacaggctacggagatttggatgacgccacttccagtgaaggaagataagtcagggtag

SEQ ID NO: 92042 - DNA, 336 bp, Glycine max
  Peptide Sequence Number=SeqID_208820
gttttcctgtttgcaaactcaaaatgtaagaggtatttccataatcgcctgaagccttcaaagctcacctggactgtagtgtacagaaagcaacacaaaaaggacattgctcaagaagttgtgaagaagaggagacgtgctgccaaaaagccttactctaggtccattgttggtgcaaccttggaagtaatccaaaaaaaaagagttgagaagccagaagttcgagatgcagttagggaagctgctcttcgtgaaattaagaagaggatccagaaaacaaaggatgagaagaagactaagaaaccaaatactgatatgaggatttttgttagttga

SEQ ID NO: 92043 - DNA, 396 bp, Glycine max
  Peptide Sequence Number=SeqID_208821
atggtcctaaccagccatgttcactacttggttcgccaaagagtagcaagagtgctctctaacgcatcctttattcaaaaactaaaccgcaagagcaaaatcagactccattatgataatttcatgaatccctctgtcatgaagaatcttcaaaccatggacgctccatctcctttcccacccactcaacgttcccccttggaccttcctcaatccattctttcttgccccctcaaccactccgcataccgcctccactcattcttcccagtgtcagcggtggaggagatctgcatctctcacagcttgcatgcggtcatccacttctcggaaggccacatcaatgacaaacgaaggtggaggagatttgtccacaaccaccacaacaacaaatga

SEQ ID NO: 92044 - DNA, 1197 bp, Glycine max
  Peptide Sequence Number=SeqID_208822
atgggctgcgtctcctcaaaacacatcaagaaagaccttaagcaagaagaagtcattgccaccaatggcggcagttacgtgaaccacgtcgtatccctcacttcctccacctatggagcactcatgttggacaaggagaaggagcaacaccaacttcaactccccgtcgaagaatccaaaacatctccacctcggattcgcgaagaacccgaagttatcaacgcttgggaactcatggagggtctcgaagagggagtgcccatttcaaacaaccccatgaaaatccccaagtccacacctttccttcgcggattcatctccaccgacccaaaacccaaaaccaaaaccacccccttcaaattcctcaaccaactcgggtcccccaagagtctcaggaagttcacagggaaagagaacaaaattgaagtgcaagttcaccacaatgccggtgtaagacgcttggattacaattttagcccaaagggtattctcaaaccctccaatttttgttctcctctaaacgggtccccgattcgtgctcgaaggaatagtttcgggagcgacaccaagcggaggagtcctagtcctctgttcgatccagagcttctcgcctcttacgaaaaggaactctcccaagaggaagaacagatcaagagaatggtgtgggccacccccaagacccgaagagtcagaaaatctttggattcacaaactttcattaagacgtttgaggaaaaattgccccccggaggggaaaattgcgttgtcatttacaccaccactctaaggggaatcagaaagacgtttgaggagtgcaacaaggtaaggtccattatcgagtcctattgcgtgcacgtgctggagcgtgacgtgtcaatggattcgaggtttaaggaggagttgcggaagctgatggggaccgagcaagttaaggttccggttgtgttcgtgaagggaaggtttgttgggggtgctgaggaagttgtgaagttggaagaggaggggaaattaggggttctctttgaagggattcctcccaaggctttgggggagtgtgaagggtgtggtggtgtgaggtttgtgatgtgcgtggagtgtaatggaagttgtaaggttttggatgaggatcgcaagaagactctgaggtgtgggcagtgtaatgagaatggattgattcagtgtcctatgtgtcgttaa

SEQ ID NO: 92045 - DNA, 279 bp, Glycine max
  Peptide Sequence Number=SeqID_208823
atgcatcctatcggagtggggaagaagggcaacatattcttcagaaagaatgatggtgaactagtctcgtttgatttgagtagcctgaagattgaagagcttggtatcaaaggaaagcttcactgttgtcagacactatgggaatccaatgagatattattagaattgaacttcatcctttgcagcaagcagcatgctcatctgcagatggaaagcagttgttcaaaaacagctttagacaagcgaaagcttaagttaccagtgggaaaaatatcgtga

SEQ ID NO: 92046 - DNA, 1338 bp, Glycine max
  Peptide Sequence Number=SeqID_208824
atgggatcggcttgttgtgttgctgcaaaggatcatactattcccagcactagcagaactggaggtgaaagtttaaatagaaatgctgtatgttcgccaacatggagttttcaatgggatagttggggccgtgttgctggcgaaattgaggatccttcctttcacacatctcacagagtcagcagaaatgtcagcatggagttaaaagggtcattaagctctgaaagaggcaatttatctgattggggaagcaccctggataattctgtaacacccatgtctctgaagtcccctgttcgtgagcatttggttacaagtcagatgactccatctttagaaattgctatggccaggttggttacagtaatttcagcctctgcctgccaagggggtgaagtgaggatcaatgtgaagaatctgattgaatcaccagagattgcagaatcttcaataccttcagttttcccaacacctatgtcagatccaatgactaatcataattatcacaatcttactaactcaacaccatccagatgggctcatcgttctcccgggcacccacttttaagacaaatttctgatagtcgaattctgggtctgaaatcacctgacacctcaatttctgaaggcaggccatcatttgtactctccaactgtagcaatgatatggcaacaggatcgcaatgcgggtcatctgatggctggtctatgcgcactttttctgaaatggtggcttcatctcaaaaggaaaggtggtcttttgatagcgagtatactggttcaggtcgtcacaagataagtggaaccagtagcaggttctcgtattctccctccatggatttacaatcttgtggggcttgctcaaagctcttgaccgatagatctgcatggggtagccagaaatttattgccagcagtgacctctcagttgttgctgtactggtctgtggtcatgtttaccacgcggaatgcttggagactataacgccagaggcagatagttatgatccagcttgtccaatttgtatggttggagaaaagtacatgtcgaagttatccaaaaaaggtctttggaccgagtcagagactaagaccaagaactacaagatatccagaaaccgagtagttgatagctacgtagatggtgggaatgatgtttttgatcgcctaaaagatatagtttcaaagatggagcctagtagctccagtactaggagttcatttggaaaacccttcctgaggcggcatttttctttgggatcaaagtggagccggtccttattggagaatgattctgccaggaagaagggcttttgggcgagatgtcgcagagactga

SEQ ID NO: 92047 - DNA, 576 bp, Glycine max
  Peptide Sequence Number=SeqID_208825
atggcaacaaaccgacctgatgtacttgaccctgctctcctgcgtcctgggagattggatagaaaaatagaaatccctctgcctaatgaacaatcaaggatggaaattcttaagattcatgctgctggaattgccaagcatggtgaaatagactatgaagctgttgtgaagcttgcagagggatttaatggggctgatcttcgaaatgtctgcacagaagctggaatggcagcaattcgggcagagcgtgattatgtgatccatgaagattttatgaaggctgttaggaaactgaacgaggcaaagaaacttgaatccagtgcacactacagtgctgattttgagccatggatatctaggcagtgcatcttgagttggaaatacctcaggcaagttactcaattcgtagggctaagcgtgatgttccctttgggttgttctggcttgtgttttccgaattctaaatttggaagaaggagatacacggcaacgaaagtcacgagaaaccaaaaagtgatcggtacgggtgttgctgctattagaatagacagagtgagagcagcattcgactgttaa

SEQ ID NO: 92048 - DNA, 627 bp, Glycine max
  Peptide Sequence Number=SeqID_208826
ggtggacccttggttactagtaccctcaccttcagaggactacacgtcctcaccttcagagggctacacgccctcgccttcagaggactacacatcctcaccttcagagggctacacgtcctcgcctttagagggctacacgccctcgccttcagagggctgccttcagagggctgcacgccctcaccttcagagggctacatgccctcgcctccagaggactacatggctgcacgtcctcgccttcgaagggctgcacactccctcgccttaagagggctatgcatcctcgctttcagagggctccacatctgcaccttaagagaatttaagctactatgcatattggggcaagatttcacccgtgccgttgcaaagagacaagtgcggatcgtgcgcaccaacatgaccactctcacacagatatgtatgacattgctacgtagcaccattatgcccagcgattgtaatgtcgatctccccctgcagaagggtcgcgcccacaagactcccagtggacccgaagaagtccaacagggccctggggtctccagctttggttacgggcctctattagtcctacagggtgcccgtactccccgacaaggtcatgccatcgcgacatat

SEQ ID NO: 92049 - DNA, 189 bp, Glycine max
  Peptide Sequence Number=SeqID_208827
atgatttgtggtagtttaaaaccactagaatatcctttcccagaagtcattgttaacaatgacaaagaaaaagcacttcgagacacgcaagctataaagtgtctaaaggtatcctcttacaaatacactatgttgatgaatgaaaagtcgacttcatcgaatccgattcccatcacattattctgctga

SEQ ID NO: 92050 - DNA, 126 bp, Glycine max
  Peptide Sequence Number=SeqID_208828
atgagaccgtgctttaaggaggcaaatgcgttaaggattaaggaaggtgttggtggatgctactgcgttaatggagtggtcgtggaaggcgtaatgaatttacccttttcgacaaaggatgagtga

SEQ ID NO: 92051 - DNA, 897 bp, Glycine max
  Peptide Sequence Number=SeqID_208829
atgatactgcagttcttcgtgctttcacagagaggcgataacatcgtctaccgcgactctcaaaagggaagcgctgagacatttttccgaaaagtcaagttctggaaagagaatgctgagggagatgctccacctgtttttaatatagatggtgtgaactacttccacgtgaaggctgctggattgctatttgttgctactactagagtcaatgtctccccttctcttgttttggaactcttacaaagaattgcacgtgtcatcaaagattaccttggtgttctcaatgaagattcctttagaaagaacttcgtgctcgtttatgaattgctggatgaagtcatagattttggttatgtgcaaacaacatccactgaggttttgaagtcatatgttttcaatgagccaattgtgattgatgctgcacggatgcctccacttggccctgcttccatttttatgcaagggaccaaacgaatgccaggtacagctattacaaagtctgtggttactaatgaacctggtggaaggaagagggatgagatctttgttgatgtaattgagaaaataagtgttacattcaactctagtggatatatacttactagtgagatagatggaaccattcaaatgaagagttatcttactggtaacccggagattcgacttgctctcaatgaggacctgagtataggaacaagtgattatagaggttcaggtgctgtcattttagatgattgtaacttccatgagtctgtacaccttgatagttttgatgttgatagaactttgtcattggctgaagtgaccattaaagtgcgagctgaattcaactcaagtatcaatgctaacactgttcttgtagagatgcctctgccatcatttacagctcggtag

SEQ ID NO: 92052 - DNA, 1185 bp, Glycine max
  Peptide Sequence Number=SeqID_208830
atggatgatggaagaaacaaagagaagggaaatatcaggaggtgcgagtaccggagccaaacgcggggaatggcgactcctgttgagcctccaaatgggatcagaactgaagggaagcattattattccatgtggcaaaccctgtttgagattgactcaaaatacgttcccatcaagccgattggtcgcggagcatatggaattgtgtgctcttctgtgaatagagagataaatgagaaggttgccatcaagaagatacagaatgcctttgaaaaccgggttgatgccctgaggactttgcgcgaactcaagcttcttcgccaccttcaccatgagaatgtgattgctttgaaggacatcatgatgcctgttcacaggaatagtttcaaggatgtctatctggtttatgaactcatggacacggatttgcatcagattattaagtcttctcaagctttgtctaatgatcactgccagtatttcctctttcagttgctccggggcttgaaatatcttcactccgctaacattcttcatcgtgacttgaaacctgggaatcttctaatcaatgcaaattgtgacctaaaaatatgtgatttcgggctagctcgtactaattgcagcaagaaccagttcatgaccgagtatgttgtcactcggtggtatagggcaccagagctcctactctgctgtgacaactatgggacatctattgatgtttggtcagttggatgtatctttgcagagcttcttggccgaaaaccgattttccctggttcagagtgtctcaaccagctgaagttgattatcaatatccttggtagtcaaagggaggaggatattgaattcattgataacccaaaggcaaagaagtatatcaaatcacttccttattctcctggaacccccctttcgcaactttatcctaatgcgcatccattggcaattgatcttctggcaaagatgcttgttttcgatccaacaaagaggatcagtgtcactcaagcacttcaacacccttacatggcccctctgtatgatcctaactgtgaccctccagccgtcattccaattgatcttgacattgatgaggatctaggggaagagatgataagggacatgatgtggaaagaaatgcttcattaccatcctgaatctgctatggagagtgcagggttgtgctaa

SEQ ID NO: 92053 - DNA, 1347 bp, Glycine max
  Peptide Sequence Number=SeqID_208831
atggaagttcctgattgtatctatcgggggcaaccactgatcattcccccaagtgctcctaccccaaaacattctctctatttgtctaacctcgatgaccaaaagttcctaagattctccattaagtatttgtacctcttcaagaagtctttgagcttgaatatcttgaagtcttctttggccagagttctagtggattattaccccttagctggaaggttgaggagtgtggatgatcacactcacaagcttgaggtggattgcaatggagaaggtgctgtttttgctgaggctttcatggacaccactgttcatgaattgcttgaatcttccaagactcccaacaagtcttggaagaagttcttgtatagaattgaagctcagagtttcatagatgttcctcctctcataatacaggtaacgactctgggttgcgggggaatgatcttatgcaccgcgatcaaccactgcctatgcgacggcatcggtacgtcgcagtttctacacgcttgggcagaactcaccagaaagcccgaaagcgagttgagcaccatgcccttccactggcgccacgtgttgaaacccagagagcccgcgcaggtaaagttccatcacgcgggctacaccggaccaaacccaacccctcaagtggacctcctcaagtttatacaatcacagccggtagtacccgtatccttcgccttcaccccttcgcatgtccttcgcctcaagaaacactgtgtcccttctctcaagtgcacatccttcgaaaccgttgcggctcacacgtggcgctcttggattcgatcactaaaccaatccctaccctccaaactcatcgtgaagctccttttctcagtcaacgttagagcaatagttgaccttccacaaggttattacggaaacgggtttttgctagcgtgcgctgatagcaccgtagaggagttagtggagggtaacttgcgccacggtgtgaagcttgtgcaggaagctaaagtgaggttgaaggataaagagtatataaggtcaatggttgacttgttggaggacaaaacggtaaaaacggatctttcgactagtttggttatttcgcagtggtctaaactggggttagaagaggtggattttggagaggggaaacctttgcatatgggtcctttgactagtgatatttactgcttgtttttaccggttactggtgatgctaatgccgtgagagtgctcgtgtctgtgcccgaaagtatggtggaacgtttccagtatcacatgaatgaaagttggcaaggaaaagaagaaaatgggaatcatcatgatgttcaacatcataacgaaaatggattcttctga

SEQ ID NO: 92054 - DNA, 840 bp, Glycine max
  Peptide Sequence Number=SeqID_208832
atgacacatctgcaaaacatttcaaagttctgtttcaagctcccctgtttcatttcaggtaatctaggatctagcccctgcatatctgttgagataaagcccaaatgtggatttattcctctttcaagattcatatctgaaggaactgctatcaaaaggaggataactcgctttcaaatgcaccaagctctgaaattgcatcaaggagagatatcattgctaagtaaatacaatccacttgatctgttctctggatcaaaggaaagaatttataaagctatcaaggatctcttcactacacctcaaaacaattttcgtgtatttatgaatggctctctcatatttggtggtctgggaggtggtgcagaagatacaaactttggtattgctaaagcatttgaaaatgcacttaagtctgtcattcaagctgataatggtctgtgtacagagaacttgcttactcttgttgctgaggctgtaaaaaaatcgggagtccttgatcggctcctggatgttcagaagcttgataatgttgacatagaaggagccatccatgcttattatgacattacccgtcaacagtgcataatatgtagagaattgagtgaagagcaactgaaaagatatacctctttgcattcagcttcgttggatgaaagcttgagaatacaaaggaaagcaggggattctggatctggatctatttgcagtaacatatatcttgagtcaactaagcaaacctttgacttcaaggtagacagtgcattgcatgattcatttggttcagcttctgctggtgctgttaaaaagctactgcaaaaggtcattcaggaatgttag

SEQ ID NO: 92055 - DNA, 783 bp, Glycine max
  Peptide Sequence Number=SeqID_208833
atggtgaatgaagaaaaagataaaaccaacaacgaaaaaaaagaacttaacagaagtagtgttggacatttaataaaattgttgggtgtaagaggaaatctacacctaagaaaatcccaaaagataatgaaactgttggaaaacgacaaggcccaacattcacccaaaaaaatatacaacaaggtccaacaaacccaagcagatgaaggatctgagccgcaattactggaactggacacagtagtattttttcagtgcattttagctgttaggcaaaaaagttgtcgaatggagatgattttaagggagaaggacgcaaatgagtgggtttaccgaggcgaaggagctgccaatcttgttctcgcatacaccggatcatctcctacgtttattgggaaagtgatgcgcattcgtaagtgtccaaggaatggcgcagagggtatgtgtatgaggagcccctctgctttgactgcgctcgaacgcctcctctggaaagacgttgatgaactcatttcatcttcggacaatgaaattgcatgccaattatttgcccaccacgttatgaagccattgcttggtcccaaatatgttgatgctgggatgcttgttgaggtgccaagggaatttctcgaattggttgaaaagaatgttattcgtcaacgtcctgcttggagagttgataatgctcgggtcgacatgcatcgtggttctgtgcttctcatgtctgatcattcagtcttcactcatggtattgaaatgcctttgagggctttcttctactga

SEQ ID NO: 92056 - DNA, 665 bp, Glycine max
  Peptide Sequence Number=SeqID_208834
atggcgatgacaaaagcaggagaagacaccaccaacaacaatgatgaagatgaacggagaatgaaggaggggagatcgtggcgcaaggagcaagagcacgagtataagagatggtatgaaaaatgcttcaagacgaagttgtttggggaaacgcacgtttttatatcgagcacggagtctgcaaaagtgattgtaaacaaggagaacgagggagggaaattctcaaagaggtacataaaatcaatcgcggagctgattctttgtcttccttcgttcaactctttgattcactcgttcttgaagctcacccccactagaacatgtggatctgttgtcgtcatacaagatgaaacgctcaagattgtaaaagaagcgttgaggaaggcatccgtggtacagtggttgcccagagtagcactcgaggactgtgagattgaaggatttaagatcaagaaagggtggaacattaacatcgatgctagatcgatacaccatgatccaactttgcagaatgatcctgatgtgttcaatccttcaagatttcctgtagaatcaaaactatacagcttcttagcttttgggatgggaggaaggacgtgtctcgggaagaacatggctaaagctatgatgttggtgtttctccaccgtttcatcaccaattacaa

SEQ ID NO: 92057 - DNA, 306 bp, Glycine max
  Peptide Sequence Number=SeqID_208835
atgtatgaaattgagctccaaagtcacttctcaagggattgccaaactcatcctatcccttgcaaggagactaaggatatcaattcaaaattccaacctgacgtggataatgatgacccaactcacggagaatggctggtagttaaaaggaagagtcgtaaaaatggtggggcccagaacaaaaaagggaatgctcaattggaggaccaatcattggctaagggaaaggaggacaacataggcacgaaattcacttggctgttgctaggtgcacccaacaaaattgctggtgcacccagcaattga

SEQ ID NO: 92058 - DNA, 414 bp, Glycine max
  Peptide Sequence Number=SeqID_208836
atggtttatattgaggattccgttttcgagggtttgtgtaaaccatggcaagatgcgctagtcgtgaagctacttgacaaacacattggctataatatcatgaaggacaaactatctagaatttggaagttaaaggtgggatttgacatgatagatattggcaatgactttttcgtggtcaagctgaatttggatgaggacaggaaaaagatcattgagaatggtccttggatgatatttgaccactatttgataatccaaacatggactctagcatttgtgtctccatcaacaatgattgatccaacaatggtttggattagattcccgggactgaatctttacttttatgatgaaaacaccacctgcgaaactcaatttcacacattcccaccgttggaatttacaaaataa

SEQ ID NO: 92059 - DNA, 501 bp, Glycine max
  Peptide Sequence Number=SeqID_208837
atgggaatctgccatgggaaacccattgaaacccaacaaagtcaaagagagaccaacaacccatcagaattcccaagtgaccacccaactcccacaaaaccccccaaagcctcatcaaaattcccattctacagcccaagccctctccccaattggttcaaaaactccccatcctcaaactcgaaccctagcagtgtcagctcaacacccttaaggatcttcaagcgccccttccctccgccctcgccggccaagcacattcgggcgctgctcgcccggcgccacggctccgtcaagcccaacgaagccgccataccggaggggagcgagtgcgaggtcggtcttgacaagagctttgggtttgctaagcagttttcggctcattatgagctcagtgacgaagtcggccgggggcattttgggtacacctgctctgccaagggcaagaagggggcgttcaagggcgtggatgttgccgtcaaagtcattcctaaagccaag

SEQ ID NO: 92060 - DNA, 255 bp, Glycine max
  Peptide Sequence Number=SeqID_208838
atgatgggaggaaccaaaggaagaacactggagagaaaaagtgagggaaaggaaagatgcttgcttagcagaagccgcaaggaaaagaaaaccaagcttcctttttctgctttttctgttagtgcttccttggtaaacagtttctgtgtagaaatacactttgtcacagagagagagtattcactgtattgtttcttgtctgacaataatggcgagtggggttcgctttggatccttccagcctgtacttactga

SEQ ID NO: 92061 - DNA, 495 bp, Glycine max
  Peptide Sequence Number=SeqID_208839
atggaatatccctactcgttcttcgaaaccaccgtggagcttcagcaactgttagtttgcacggaggccagtcaatcttttagtcctcccaaagcagtgcgtggaggaattccaatttgttttccacagccatcaataagagacaaccttttacttactcttgatagtgaagtgagggtagaagggttggaaactcttgactacctggacaacctgtaccagagagaacgcttcacagaacaaggagattctctgacatttgaatcagaggtagaccgggtctattttgattctagcaatattgtaattgttctagaccatgaaaagaagagaacatttgtgatacgaaaggaaggacttccggatgttgttgtttggaatccttgggaaagaaaatccaagtccatattagatttaggggatgaagagtacaaacagatgctatgtgttgatggtgcagcagttgaaaaaccaaatcaccttgtggccaggtga

SEQ ID NO: 92062 - DNA, 1770 bp, Glycine max
  Peptide Sequence Number=SeqID_208840
atggaacttattttgtgcttcgtctacttggtttctctcatgctcttccaagcacaagcaaatgcaatctctgacaagcaagcattgcttgatttcgtggaaaagttggctccttcaagatccctgaattggaacgcaagctcttccccatgtacctcctggaccggtgtaacctgtaacggagacaagtcacgagttatagccattcacttgccagcattcgggtttcacggaaccatccctcccaacacaataagccgcgtcacggggttgcgaacactcagcctcagatccaacttcataaatggtcacttcccttgtgatttttccaatctcaaaaacctttcctttctctatcttcagttcaacaacttcacgggtcccttacctgacttctctgcttggaggaacctctctgttgtcaacttgtccaataatttcttcaccggcaccattcctctctctctctccaatttgactcagctaacttccatgaatctctccaacaactccctctccggggaaatacctctctctcttcagaggtttcccaagtcagcattcgttggaaacaatgtctcccttcaaacctcctctcctgtagctccattttctaaatctgcaaaacacagcgaaacgaccgtgttttgtgttattgttgctgcttctcttattggtctcgcagcatttgttgcatttatctttctatgctggtcgagaaagaagaagaatggggattcctttgctcggaagttgcagaagggagatatgtctccggaaaaagtagtgtcgagggacctggatgcaaataataaaattgttttctttgaggggtgtagttatgcttttgacttggaggatttgttgagggcttctgctgaggtactagggaaggggacgtttggtgctgcgtataaggctgcgctggaggatgctaccactgttgttgtgaagaggttgaaggaggtggctgttggaaagaaggattttgagcagcttatggaggttgttgggaatcttaaacatgagaatgtggttgagctgaaggggtattactattccaaagatgagaaactcatggtctatgattactacactcaggggagtctctcggctttcttgcatggtaaaagaggagaggatagggtgcctctagattgggatactcggatgaaaattgctttgggtgctgcacgaggccttgcttgtatacattgtgagaatggtgggaaacttgtgcatggcaatatcagatcctcaaatatctttctcaatagtaaacagtatggttgtgtatctgatcttggcctggcaaccataatgagttcagttgccataccaatctcgcgagccgctggttacagagcacctgaagtcacagacacgaggaaagcgacacaaccatctgatgtttacagctttggtgtggtgttattagagcttctcactgggaaatcccctgtctacacaactggtgccgatgagattgtgcacttggtgagatgggttcattcggttgtgagagaggagtggacagctgaagtgtttgacttggagctgataagatatcccaatatagaggaagagatggtggaaatgttgcagatagccatgtcatgtgtggtgaggcttcctgatcagaggcctaagatgttagaacttgtaaaaatgatagaaagtgtcaggcagattgagatagtagtgaatcagccatcaatatcatctgagaaccaagtggaaagttcaacacagatccctttaaccacttaa

SEQ ID NO: 92063 - DNA, 351 bp, Glycine max
  Peptide Sequence Number=SeqID_208841
atgcaggccgatggtcaggttgttctgactcctgacaggggacaagaagcatcttcacagatactgcctatcaattttgatggactggcaaagtcaatcaagaagggagacaccaattttattggtcaatacttgctcacaggaagtgaaactacttctgtattgctagagcaactcccagtaggagatttcgtattgaagactagtttggttgcgctggacaaagtgaaccgtgcaggatataaggaggcccaatttgttattggcatcttggatgtgtggaatacaagaggtcaattggagcagacatattacagcaacgactaccggattatgtattgtaggagataa

SEQ ID NO: 92064 - DNA, 399 bp, Glycine max
  Peptide Sequence Number=SeqID_208842
atgtggaacaccttgatgaaacaaagttttgctgctcctcccggtggtccccaggtaacagggcttttaggctggaaatgggggcaatttgcgcagcagtatgacgactttccactaacaattaaagtgacagaaggatctatagcatacagaaacccgttacttcctccatcatcatttttatctcaggtgattttccgttatgataatttcaaccagcagttgattctgccacttgaatgcagggagctgttggttaggagctatgcctccttgacaatagatacttacatgctcctcagaatgttcaaaggtgttgagaaatttgcatcatggttgtctgattttgagaaactgttccttccccatttaaaccatcatttttaccacatggaataa

SEQ ID NO: 92065 - DNA, 1131 bp, Glycine max
  Peptide Sequence Number=SeqID_208843
atgtcggggaagagaaagaggaagttgaaattgttaagcgatgcaatcacagataatagaagaacagttgctgaggtgaaaagtgaaaatttggagatgcaatcctgggctgatctccctgctgaactcttagaatcgatcttgtcccgattgatcctagcggataacatccgtgcttctgctgtttgcaggagatggcattctgttgccagtgatgtacgtgtagtaaaccaatcaccatggcttatgtattttccaaaattcggtgactgttatgaattctatgaccctgtgcagcgtaagacacacaccttcgagttgccagagttgaatggatctagagtttgttatacaaaagatggttggttattgctataccggcccagaactcacagagtattcttctttaatccctttactcgggagctgatcaaactgccaagatttgagatgacataccagattgtggccttctcttgtgctccaacatcacctggctgtgttctgtttactgttaagcatgttagtcctactgttgtagctattagcacttgttatcctggggcaacagaatggaccactgttaattaccaaaaccgcttgccctttgtcagtagcatttggaataagcttgtgttttgtaatgggctattttattgtctgagcctcactggttggcttggggtgtttgacccagtagaatgtacttggagtgttctggcagtacctccacccaaatgcccagagaacttttttgccaaaaactggtggaagggaaaatttatgactgagcatgaaggagatatattagtaatttatacatgctgtagtgaaaaccccattatttttaagttagatcagacattaatgaaatgggaagagatgacaacactagatggagtaactctttttgctagttttttgtcatctcattcaaggactgacctcattggaataatgaggaacagtgtctacttctccaaagttcgtttctatggtaagcgttgcatttcattctctcttgatgactatagatactatccccgtaaacagtgtcatgactggggagaacaagacccttttgagaacatctggattgagccaccaaaggacttttctgcttgcatgtga

SEQ ID NO: 92066 - DNA, 861 bp, Glycine max
  Peptide Sequence Number=SeqID_208844
atgcgtagccggggatcacagaaccggctatctggtgactcgtttggatcacgagtttctgctctcatgctcgccatgattgctaccatggctaccgtttatgttgctggcaggctatggcaggatgcggaaagtagggcatattttattgaagagcttgaaaaaagaactggtcagggtcaatctgctgtttctgttgatgatacactgaaagttacagcctgcagggaacaacagaagaagttgtctgtccttgagatggaactagctgcagctagacaggaaggttttgttccaaagcgtttgccaggaaatcatgggaagcatcctacaaagaaggaacttttagttgtaggagtcatgacaacctttggtcggaaaaagaaccaagaggcaatccgcaaggcgtggatgccaacagaaaccttgtcagaactcattgataccctatttgtaggtacacctatgagaaaactggttgataagaaaggcatcattgtgcgatttgttatcggaagaagtgcaaaccgtggagacagtttggacaaagaaattgaaacagaaagcagtctcaccaatgatttcatcattcttgataatcaagtggaggcacctgaagaaaaagcaaataagataaaatctttcttcatttatgcagtgagcaactgggacgctgaattttatgccaaggtcaatgatgatgtctatgttaatcttgatgctcttggaggagtgctaacttctcatttggacaagccccgtgtttatattggttgtatgaaatcaggccaagttttctctgagccgacacataaatggcatgagccggactggtggaaatttggcgatggaaaatcgtga

SEQ ID NO: 92067 - DNA, 285 bp, Glycine max
  Peptide Sequence Number=SeqID_208845
atgggaagcccgccagtgagctcagacatatcgtttccaccagcagacgtggatggggaactgaatcctgggcataacgttcgtgttgaagttgatcctgaatcatcagagattgctgccacaaaaaaatcaaaggaacatgctgaggccaaacaaaagaaaagggaaaggaaaaagaaggatgccttgcagacgctaaaatcagccgttatagtttcaggcataattgtggctgtggcaggtgttgcctttgccataaccaagaagttaataagagagaaatga

SEQ ID NO: 92068 - DNA, 402 bp, Glycine max
  Peptide Sequence Number=SeqID_208846
atggatatatcaaatccagcagccttagtcaatgcagaactgttgcacttctatgttggaagcagggtaagggttgtgatgcaggttgtgcgatctgatggtgttgtgattggaaaatcaacagatgagaaacaactagttgtaaaaggatcacccccacctgctcctcatacaacttatgtcgaagtttatggtgctgagatatggaccaattttggtgatgccattgatatggatagctacaataagctctgtcagcttgcaaatggagaatttaaacacttgttcctttctcagggctatccagccaagtgttgcagtgatagcattttacatcagattctggcctttcatgcttcgcatgcagcttttactcatgctcatgcaactcatctgcactga

SEQ ID NO: 92069 - DNA, 3066 bp, Glycine max
  Peptide Sequence Number=SeqID_208847
atgtcttcgaaagagaagggcgtcaacgttcaggtcctcctccgttgcaggccctttagcgacgaagagttacggagcaatgctccgcaagtcgtgacttgcaacgaatacaatcgagaagtggccgtgtcacagagcatcgccggcaagcacatcgacagggttttcaccttcgataaggtttttggtccttctgcacagcaaagggatctttatgatcaagctgttactccgatagttaatgaagttctagagggatttaattgcactatattcgcgtatggtcaaactggtacgggaaaaacctacacaatggaaggggaatgcaaaaaggccaagagtggtcccaatggagagttgcctccaggagctggagttattcctagggctgtcaagcagatttttgacacacttgagagccagaatgctgagtacagtgtgaaggtcacctttttggaattgtataatgaagaaatcactgatttgcttgccccagaggagcttttaaaggcttctttggaggagaagcagaagaagcagctgcctctcatggaggatggtaaaggtggagttctagtaagaggcttggaggaagagattgtgacgagtgccagtgagatttttactcttctggagagagggtcttctaaacgacgaactgcagaaactttgttgaacaagcagtcaagtcgatcgcattcgttgttttccattacaatccacatcaaagaagcaaccccagagggtgaagaactgataaagtgtggtaaacttaatttggtggatcttgctgggtcagaaaatatatctcgttctggtgctagggagggtcgtgcaagggaagcaggggaaattaacaaaagtttgcttactttagggcgagtgatcaatgcactagtggagcacctgggtcacatcccttacagggatagtaaattgacgcgtttactgcgtgattcacttgggggaagaacgaaaacatgcatcatagcgacagtgtctcctgctgttcattgcttagaagaaactttaagcacgctggattatgcacacagggcaaagcacataaaaaataagcctgaggttaaccaaaaaatgatgaaatcaacacttatcaaggatctttatggtgaaattgaacgccttaaggcagaggtttatgctacacgcgagaaaaatggagtgtatattccgaaggaaagatactatcaggaggagagtgaaaagaaggctatgtcagatcaaattgagcagatgggtgtcacaatagaaactcaacagaagcaacttgaggatttgcaaaacaaatacgttgaccaaattcggcagtgttcagatttgagcaacaaacttgatagtactgagaaaaacttgaacaagactagcaagttgcttgccaacacagaggaagaattgaagaaatgtcagtataccctgaaagaaaaagacttcatcattgctgggcagagaaaagcagaaaatgctctggctcatcaagcatgtgttttacgagctgatttggagaaagctcatcaggataatgcttcgttatttttgaaaattggtagagaagataaattgaactcagataacaaagctgtagtgaacaatttccaagcggagcttgctcagcaggttggttcactttgcaatactgttgcaacatcattgtctgaacagaatgaacatctagaaggtgtgaagaagctctgtcattcttttttggacgttcatgataaggcggttgtcgatttgaaaaggaaagtcacatctctgagggccttatatatatctcatttcgaggcagtggaaaatgttgtgcgcttgcataaggcgggctctgatgctaacttggaggaactatcatctgttatatcctctaatggtcattctattgaagaatttcttgcatctgaagccactgaagctggttcaatatttgacaatcttcagagtaccctttcaactcagcagggtgaattggcactatttgcaagggaactacgcaatagattcaatctcagcctcgaacaaataaaggatatctctgatcgctctcaagaatttgtggataagctttttgaagaatcaaagaagcttgaagactatgcatcacaggctgaccaaatgcaattgaagagcattgatgagtttaagaaagcatacgaggaacaatcaaaatctgatacagagaaacttattgccaatatgactagtttagtttcagatcacattcggcgacaaatggatctggtagacgcaaagcttgttgatcttagagaaagtggcatcaagaacaagtccttcttggatggacatgtgtcatcagtgggagacattgtgaccaatggaaaaagaaaatggcaggccttttgcgagcatgcagaaaaggatgcaaaagacactgctgattattctgccgcaaagcattgtcgtatggaggtgctcatgcagcagagtgttaatactgctcaatcggctttcgaacatacaaagagaacacacgaggctataattgagatggggaccaaacatatttcagcaacagagccaattgtcagcccatctctgcatgtggagtggggagggagtgttgtaccgatatggaatgctactgataacaatgtgcaacatgtcgttgaggttgattctgcacgagttgcagcagaggaagatgtggcaaagaacagtgaggatcttcttgagcagttagatgtcacgtctgcacaagagcgggagtccatatctggcgtattaaatgtggtgagaactcatgcaaatacacttgagacgctacgagaggatcacgctggccaagctacttcaattgaacacacaacaagcgaaacttttcaacggcagtacagggactatgagcctagcggcacaacacctataagatgtgagcctgatgttccgacaaaggggacaatagagtctcttcgatcgttgccaatggaagcccttcttgaggaattccgagaaaataatccatatgaatctaatgatgtaaaggagttgaaaccatctcttattccacgatcgcctcttactcagctgaactaa

SEQ ID NO: 92070 - DNA, 465 bp, Glycine max
  Peptide Sequence Number=SeqID_208848
atgtccatctcgtcctattattccaagttgcgatcaatttgggaatcgatttctgaattaaagcctgcacattcaagcacctgcaacggcatctgtccttggcacaactatgcacagatggagtatgtcatgcatttcttgatgggcctcaatgaatcctacggttcaattcgagtggttcaagaagaaaaacaaagagaaattggtgcttttgtttttgctttcaactccacaaatgatgcttcacaatctcatacctttgttgtcaaggactccaaatatcagtctgatcacaagtttaatgctaattccaagaatcgacccctctgtgcacattgtggtcgtcttagccatactcaggataagtgcttcaagttacatggttttcccccaaattacaagaagaataagccttcttcttctaatactgacaacaacctagacaaagatctcatcctatcctag

SEQ ID NO: 92071 - DNA, 285 bp, Glycine max
  Peptide Sequence Number=SeqID_208849
atgagcaggtcagggcaaccaccggatttgaagaagtacatggataagaagcttcagattgagtggagtggagcatgtcttagcctggttgttgattcaacggtcaagctgaacgcaaatcgcatggttgttggtactctccgtggctttgaccagtttatgaatttagttgttgacaacactgtggaagtgaatggcaatgagaaaaatgacatagggatggtggtaattagaggaaatagtgtggtcactgttgaggcgcttgaacccgtgaataggacttga

SEQ ID NO: 92072 - DNA, 312 bp, Glycine max
  Peptide Sequence Number=SeqID_208850
atgacaagcattactcacaaggagaccaatctaaagtccaaaacccaagatgatgaatccatgatcatgacatccacggtgccaccggttgcgggatcatctcacaaccaaccacacatagtgattctcatcaacactgcatcaacaaccttgcattggcttcggaaaccaccacacacggcaccaccgtttgctggatcgtcgtcaaggaacaccaccaccgtctgctggagacgatttccaacgatggcatgcggtggttggctgcgaatgaaggtcgagcaaatctggacgcaatcggagagatcttga

SEQ ID NO: 92073 - DNA, 972 bp, Glycine max
  Peptide Sequence Number=SeqID_208851
atgacggaagtgcttcagttgccttcatcctcaagctgttcgcgtcgtccatgtggtagtctcacacccaatgatgggtcgcacccaatttcccttattaacgctcctcccactgtggaagatcaaagggtggaaattgaagaagaagaagagaaagaaagggaaagggagagggatcagctttctattttgacccttttgattgctacgttcaggaaatctttgattgggtgcagcaccactacaacttcttcttcttcttcttcttcttcttccatggagattgggtggccttccaatgtgagacacgtggcacatgtcacctttgatcgcttccatggctttctcggtttgcctgttgagttcgaacccgaagttcccaggagacctcccagcgctagtgcaaatgtttttggagtttcaacagaatctatgcagctttcttttgatgccagagggaatagtgtacctacaatactgctgttaatgcaaagacatttgtatgcacaaggaggtctgcaggctgaaggaatcttcagaattaatgctgaaaatggtcaagaggagtttgtgagggaacaattaaacagaggtgtagtaccagatggcattgatgtgcactgcttggcaggtctcataaaggcttggtttagagaactaccaactggagtattggaccctcttttgccagagcaggtgatgcaatcccagtcagaagaagaatgtgctcagcttgtgaggcttcttcctccaacagaagctgctttgctagattgggcaataaacttaatggcagatgttgctcaaatggaaaacttgaacaagatgaatgcacgtaatattgcaatggtttttgcaccaaacatgactcaatatacggttctgctcttagccccaatttttgttattgagttcataccagtcaaactcatcttattggatataacatcaatgagtgaaacgacattttga

SEQ ID NO: 92074 - DNA, 960 bp, Glycine max
  Peptide Sequence Number=SeqID_208852
atgacagttgagatcaaagctttagaatctaataacacatggaccttggttccccttccagctgaaaaacaatgcattggctgtagatgggtgtataaggctagcatcaatttttctgatactttctctccagttgctaaacttacatcaattagagttcttttggctgttgtagctactaaaaattggtccatcttacaacttgatttggataatgctttccttaatggcgatctatttgaggaagtatatatggaacttccaaaagggtacaattccgttgacaaaactcttgtttgcagactcaaaaaatccctttatggccttagacaagcttttagacaatggttttgtaaattctcaacaacattaattggtaatggtttctctcagttaaagaatgactattatctctttaccattgacaaaggtgcttccttggttatcttgttagtatatgtagacgatattctacttgctggcctaagtgttgcatgtgttcattctattcaggccaaacttcaagctctgttcaaactaaagatccatggtcccttaaagtactttttgggactagaaattgcaaattccagcaagggcattgtactgacacaacaaaaatatgctttttccctattagaagatactggcttccttggctgcaaaccatcttctcttccaatggatccaaatttaaagctcaacatgctcaatggtgagttactaactgatccctcaatgtacaggcgtttacttggtcgcctaatgtatctaactatttcaaggccagatattacatttgttgttaacaaactgagtcagtatattcagaatccaaggacacctcatctagatgttgtgcatcatctcctccaatacatcaaaggtactctaggtcagggtcttcattttcagccgaataattacttcaatttgtctgcctatgcagatgctaattga

SEQ ID NO: 92075 - DNA, 333 bp, Glycine max
  Peptide Sequence Number=SeqID_208853
atgggtgccatggatgattccaatcattttctcatacaacccagtgatagtcctgaattgagtcttgtgactcatcctttatctggcgagaattataattcttggaagaaagctgtcaagatgacacttcttggcaagaataagtttggttttgtggatggttccattcttgaacctccattggagcagtccagtcatgctttatggcaacgaaatgatagcatcgttgcatcttggcttctcaattctcttacaaaaaagatacagataagcattcttcattgttccactgctcaagccatttggaatgatcttaaagaaagatttaaatag

SEQ ID NO: 92076 - DNA, 600 bp, Glycine max
  Peptide Sequence Number=SeqID_208854
atgggcctcgaagcgttccatcttttccggcagggtgcctggcgtggtttccgcggttggcgagactgcggccggcgtgttgagcacgcccagcacgaagcgctcggcgaagtgggcgagttcccgcacgttgccgggccagtcgtgcgtcaacaggtgacgcttgatgtcggccggcatatcgggaatgtcgcgttggaagcggcgcgaggcgtgacccagataatgggccagcagcagcggaatgtcctcgcggcgttcgcgcagcggcgggatacggatggtgacgacgttgagccggtagaagagatcttcacgaaatttggcgcggatcgcgggattgcccaggtcttccttggtggcggcgacgacacgcagatccaggttgcggacttcgttgctgcccagcggcgtgatctggcgggattccagtacccgcagcagcttgacctgcacggcgagcggcatgctttcgatttcgtccaggaacagcgtgccgccgctggcatgctcgatacgcccgatgcggcgcttctgtgcgccggtgaaggcgccggcctcatggccgaacagctcactttcgatcacgctttcgggtag

SEQ ID NO: 92077 - DNA, 636 bp, Glycine max
  Peptide Sequence Number=SeqID_208855
atgcagggcggtggcgaccacttccttgcccgtgccggtctcgccctccaccaggacatcgacgtccgcatcggcgatgtggcgcaaggtctgcttgatgcgctgcatggccggtgtggtgccgataaagggcacttcatcggcttcgacggcgaacgccgcttcgcgcaggcggcggttttcaagcaccaggtggcgcttttcggcggcgtgggtgatggcggtgacgaggcggtcgggcggatagggcttggccaggaaatcataggcgccgtcgcgcatgcattgcaccgccatggcgatatcgccatggccggtaatgaggatgacgggaatttccggatcgatggcgcgcaggcgctggaacagttgcaggccgtcgatatcgggcatgcggatgtcggtgaccaccacgccatcgaaatcacgattcaaggtggcaagcgcgccgcgcgcgctggtgtgggcttgcacgtcgataccgcgcagcttgagtgtctgcacgttggcgcggcgcagttcgtcgtcgtcatcgatgaaagccaccaggggcgccggccggttgccggcagccgcttcgaacattgcggccatggccggctcggcctcggtgtgttcctggtgtctggtgtctga

SEQ ID NO: 92078 - DNA, 2418 bp, Glycine max
  Peptide Sequence Number=SeqID_208856
atggcttccaatgctacatctggaaatgcttgcccgcagccaatgaaagccacatcaaacggtgcgtttcagggtgacaatccacttgatttcgcgcttcccctggctattttgcagatatgccttgttcttgtagtctcaaggggactggcatatcttcttaaacctttaaggcaacctagagttattgcagagatcattggaggaataattctcgggccatcagtgcttggacggaacaaaagctatatgcagaaagttttcccacccaggagtcttccagtattagacactttagcaaacattggccttatattctttctattcttagcaggcctggagttagatcttaaatctctgcgtcaatctggaaatcgagtcctcgctattgctatggctggaataagcctaccctttgtaataggaattggtacgtcatttgttctaaagcaaactattgccaaaggttcagataatgccgcattccttgtatttatgggtgttgctctgtccataactgcatttcccgtattagcccgtattttggccgagttgaaacttctaaccacaaatgttggcaaaacagctatgtcagctgcagcaattaatgatatagctgcctggattctgcttgctcttgctgttgccttgtcaggtcatgatcgatctccactcgtgtcattgtgggtcttcttagctgggtgtggttttgtcatttgcgcaatccttattgtccctccgattttcaaatggatgagccaacgatgccatgaaggtgaaccagttgaagaggtatacatatgtgctacattagctgctgttctggctgctgggtttgtcacagatgctataggaatccatgccatgtttggtgcttttgttgtcggaattttggttccaaatgatggaccgtttgccagtgctctagtggagaaagtagaggatctagtgtctggtctatttcttcctctttattttgtttcaagtggattgaagactaatgtagccaccatcaagggggcgcaatcatggggtcttctggcttttgttatatttacagcttcgtttgggaagattcttgggactctttttgtttcacttttctgtaaagttccttttaatgaagctttggtgttggggttcttgatgaattgcaagggcttggttgaattaatagtcctcaacatcggtaaagatagaaaggttttgaatgatcagacctttgccattatggttcttatggctgtctttactaccttcatcaccactcctctcgtgactgctgtgtataagcctgcaagaaagggaaaaataacaaattacaaatatagaacaattggaaggaaaaatgcaaatagccaactgaggattcttgcctgcttccatggtgcaagaaatattccatcgatgataaatttgattgaggcttcaagaggaatacagaagcgtgatgcactttgtgtgtatgcaatgcaccttaaagaattctctgagaggtcctcatcaatgttaatggtacacaaggcaagaagaaatgggttgccattctggaacaaaggccatcatgcagattctaaccatgttattgtggcatttgaggcttacaggcaactaagccaagtgtctattcggccaatgattgcaatctcatctatgaacaacatacatgaagacatttgtgcaaccgctgagaggaagggagccgcagtcattattcttccatttcataagcatcaaagattggatggttcactaaatatcaccagaaatgattttcgatgggttaacaaaagggtacttgagcatgcaccatgctcagttggaatttttgttgatcgtgggcttggtggtacatcccatgtctccgcaagtaatgtttcttatcgtgttacagtgcttttctttggtggtggtgatgatcatgaagcccttgcttatggagctcgtatggctgagcaccctggcatcagattgctggttattcgctttgtaggggaaccaatgaatggagagattgtaagagttgatgtgggtgactccactagcaccaaattaatctcacaggatgaggaattcctcgatgaaattaagacgaaaatagccaatgatgactccatcatctatgaagagaaagtagtaaaagatggtgcagaaacagttgctattatccgtgagttgaaaagctgcaatctgtttcttgtgggttcaaggccagccagtgaagttgccagtgctatgaaaagaagtgaatgccctgaacttggacctgttggtggtttgttggcatcacaagattaccccacaactgcatccgttttggtgatgcaacaatttcaaaatggggcgccaataaattttactatctcggactcagaaatggaggaacacgtacctgatcgggattcagaatctgcttaa

SEQ ID NO: 92079 - DNA, 330 bp, Glycine max
  Peptide Sequence Number=SeqID_208857
atggtcacaactcagagaatgcaactgcggccattgtgggtgcacccacatgggccaatagaacaatcttggctgggcagaaccattttggtgactcgccccaagttggacgcgctcagggattttacatgtacgacaagaaagacgttttcaaactgcttggcttggtttttccttggtgttcaattccaccatgcacaaggagacatttcggttattggtgggactggtgactttttcatggcaaggggagtggccactctgagcacggatgctttttcatggcacggggcttatccaaggcaggagcagaggaaggaagtgccatag

SEQ ID NO: 92080 - DNA, 2010 bp, Glycine max
  Peptide Sequence Number=SeqID_208858
atgaaaagcgaggaaggtgaagcggaaaaggaggaaaaattgggagaaaagttaaggcgaggggtattggtagggaaaagtaggggcccctttactccagtgccctcttggtcttgggctcacaacaaccatagcagcagcgttctttctctttctgctagaaagctcgccgcggctctctgggaattcaaccactctttcccactctttcaaatgcatcatcatcgttctgctaacaacgctgccgcttgcggcggagtcggcgctgatcccagacttcgccgccaccaccattacatccttcataaacacagggctccggacatctccaactttttggctgatgcttctcccagttcccccgatcagcctgctagcgccagcagtttgaggaggcatgttgcagcacccctgatgcagcatcatcgggcaattgagagaaacaatcatgcactgcaacctttatctcctgcaagttatggtagttccatggagatgacaccctataatcctggagccactcctactagttccttggaatttaagggaaggattggggagccacattatagtctcaaaacatctacagaacttctaaaagtgctaaacagaatatggagcttggaagaacaacatgcttctaacatttcattgataaaagcattaaaatcagagctagatcatgcacgtattcggatcaaagagttgcttcgagaccgacaagcaggtcgacatgagattgatgacctgatgaagcaaattgcagaggataaattggttcggaagaggaaggagcaggatcaactccatgctgccattcaatctgtgagggatgaacttgaggatgagaggaaattaagaaaacgatcagagagcatacacaggaaactagctcgggatctttctgaggtgaagtcctctctgactagtgccataaaggaattgaatcaagagagaacaagaagaaaactattggaggacctatgtgatgaatttgctaggggaataaatgaatacgaacaagaggtgcatactgtcaaacacaagtctgataaggaatgggttcaaggggctgatcatgatcgtttgatcctccacatatctgaattgtggctggatgaacgtatgcaaatgcagctggaagcagttcataatggttttatggataaatccatagtcgataaactaagtcttgaaatagagactttccttaaagctaaacaaaatagtaggagtacagaaaatattgcagtaaggaattgccgtaattccttggaatctgtaccactgaatgatgccgtcagtgcaccacaagaggttggtgatgacgatgattctgtgggcagtgattcaaattgttttgagttgaacaagccaagcaacaagggatctaaggtacatgaagaagagcctgtcggcaaaatttttgaggagacatcaaaaaccaaccaaccaaagaaaaaaccaataccacgagaagggttaaaacatcgtagcccatgtagcctgcaagtggagtttgaagaacagattgcttgggccatgtcatctgattcgcataagaagtcccagtcaattgatgcagatcaggggaagaccacagatactaggccagttgaaggaattgtatctgaaaagtctgaacactttgagatttacgaaaatgatgattctgagagaaaaaatatccccactgaattgcacagctccagtaaaaatcacattattgataatctcttaagaggtcaacttttggcatcggaaggtggcaatatgcatgctgaaaataattatggtgaggcttcttgcagcaatgctggatggaggaatcaggcaagccctgtgaagcagtggatggcaaaacttgcatcccaagaccttgacatatcagaggcttccaaagtgccttcaggatcaaaggagagtaataatactttgaaagcaaagcttcttgaagctaggtccaaggggcagagatcgcgtttaaaagccttgaaaggttccttttag

SEQ ID NO: 92081 - DNA, 219 bp, Glycine max
  Peptide Sequence Number=SeqID_208859
atgagctgtcagcgcaccgcttcagctcatccgctaagcgagagaaacacgttgagccaaaaatcactaacgtacgctaagcgcacgagcacgaacaaggccacctatttaagcctgaaatcagatttgcaaggagttttggagtttttcttgaagaagcctctgtatgcacgagagtctggccctggcttgaagcttttgcatgttaggaagttctag

SEQ ID NO: 92082 - DNA, 171 bp, Glycine max
  Peptide Sequence Number=SeqID_208860
atggctgaggacgataaaattgctgatgtgagtatgggatgggcattggaagttgggagtaagctagaaatcaaaggagttttcttctggtcttcatcagcaattatcagggctgcgtctacctattctttggttttaggcaaattttatgttgagtctattataatataa

SEQ ID NO: 92083 - DNA, 510 bp, Glycine max
  Peptide Sequence Number=SeqID_208861
atggctgtatctctgagatgcagaaacagctcctcccacctcctcctaactcgcttcctccactcagtgagtctccctcgtcgaaggtggttgcaaaccgtagcctacgaagaattgcgagctcaccctgacaaaccctacacctcaacggccgttttcatccatggctttttgggatcctccagaaactggagatctttctctcgcaacctcttggcctctctctccaactcctctccctcttccaattggaggacggtgatgttggatctgaggaaccacggacaatcgacggagagggaactgaatccgcctcataatatggaaaatgcggccaaagatttggccgatttggtgaaggctgaaggttggtcttggcctgaggttgttgtaggccactccatgggtggaaaggtggctttgcagtttgctgagagttgtagccgtggtgactatggccattttgcttcgttgcctaaacaggtttctcttctctattgcaatggctag

SEQ ID NO: 92084 - DNA, 183 bp, Glycine max
  Peptide Sequence Number=SeqID_208862
atggcctggtcagaggagctgaagtctcatttgttgaatctaaagagggcaaaagcccaattggcatatagagatacaaactccagtgacctagatagggaaggcgatcttaagggcagcgccgacatattccaaaaaacaacagatcttacaacgctgtctgaaacgaaagaagaaggataa

SEQ ID NO: 92085 - DNA, 300 bp, Glycine max
  Peptide Sequence Number=SeqID_208863
atgtcccctaaacttgaaccagatccaaaggaaagtgggggagcggggctcatagatccgtgcatattcgtctttggatggaagcattggctcacaacaccaacacttgtctcggcaattcatttcaagagtgcataccctttgtgttttctctccattatacaaataagaagctggagattgtttgaggctatcctcaggatcctcttgagtgatgattccaagaaggtgacattgtcaagaatttggattgattcaaactggggactaatagatgtgttcttgttaaagatgaagtag

SEQ ID NO: 92086 - DNA, 435 bp, Glycine max
  Peptide Sequence Number=SeqID_208864
atgggtgaagtaaaggaggtgcaagagcagatcaaggctgacatggagaccatgaaagagaaaatggacataatgatggaggccaatataagcatgaaggagataatggaggtcaatgcggctgcattgctgagggcaagcagttcgtggtatacccttgcaaacactttggagggccctcattttcgcccacaaccgcaacccttgcattttgcggtgggaagagcccctcctgctatggctgaaaatggaaagttggatcagatagaggaaaggctaaaggtcattgaaggaagtggagattatgcctttgctaacctagaagagttgttcctagtacccgatatcatcacccctcccaagttcaaggtgccggactttgacaagtacaaggggactacttgtcccaagaaccatctaaagatgtattgttga

SEQ ID NO: 92087 - DNA, 483 bp, Glycine max
  Peptide Sequence Number=SeqID_208865
atggaaaaaactgtgaaagtcggagaagacgatcctagttattccaaatgggtcatcgaagatgcggttgcacagggatggttgtcgaaaaccatggaacctcatcttattggggcaagaaactatgcttggaaggaaggattttgtagtagaataatccatgcaatggtttcaaaaactgcctcagggatgcgacctcgttctttgcgagaccttgatgaagccaagaaagacaaaatccgatgcagtcattgcaatgcgactcgacataaaagggaaacttgctttgaacttcacggctatcccgaatggttcttggagaagaggaggcaaatgagagctaaaggcaagcgttcaggaccagcaaaactcattgattatgtagctggaattgctgctgtagcaacaagtcaaggtagttctgtaaattcctccaaagttcaagacaccaatttgttgtttttctcaaccaggttgatgtga

SEQ ID NO: 92088 - DNA, 669 bp, Glycine max
  Peptide Sequence Number=SeqID_208866
atggaatcaagcaatgtgaagaacaagtcaagtggaaaaagaaagatgtctagtgaggacacaagaagttacttcgaatggaacttggaaatggagcgtgtgctagctgatgtgcttagagatcaaagaaatttgggcaataaaggtgatggaaattggaaagcagtagcatacagtactacagctcaaattttgtccaagcgttttggagttcacctcatggcagataatgttaagaatcattttaagctttggagaacatggtatggaatttcacatgaagaggccaaacgatttcgattcaaagtcattcctaattgggatgatattgttgacctatgtgcaaaggatagagctattggactcggagcagaaaatgcattagatgctgatgatatcatgagcaaagaaacaaatgaagaggaagcaattcatagtgtgagttttgacttagagggatcaagttctgccacgagaaaaaacattcgcccaagtaagagtggagagaaagaagggatgatttcctcaatgaaagaagtagacgagtcattgaaaaaatttgttgaagtgactaagaagaagatggagaacaaaaaaaagatggagataaaagaagctcaagaagtggtacatgaagattataaaagctcattaagtttgcgattataa

SEQ ID NO: 92089 - DNA, 719 bp, Glycine max
  Peptide Sequence Number=SeqID_208867
cggccacgcttgaatcgcgtgcagcggttggttcataccctagctttctttccgcatcaatgactaaaaatccaagatttgcgaaaccttgccagttttcgagaccgcagggtgaagagggccggaagtgggggcgtgcggtagcttgtcacgggtcccgcatgcagtttcagcatgttcatccgtcgtggaccggagtgcccgtatgcctgccagacaagggttgccacgcggttccggcccctcaaaattggcgggtcgaaagcggcagcgcgcaaacgacgcatctcaccgcgatcgattacggtttgctgacgactgcgatcagctaccatttgcggcactcgcaacttgccgtggcaaacggtttttccgatgtgctggcggagcagggattgcggccggccgatttttccgttctcgtcatcgtcggcggaaatccgggtcttaaacaaagcgatgtggccgaggcgctcggcatccagcgggctaatttcgttgccatcgtcgacagcatggaagagaaaggtctgctcgtccgccgcaggtcggaagaggacaggcgcgttcatttcctcgacatgacggccgagggtagccgtcttctcgagcgcctttccgatgtctggcgcgaccgcgaggaaaagctgatcgaccgtatcggcggcaagaaggcccgcgaccaattgctggcgctgctcggccgcctgcgcgactga

SEQ ID NO: 92090 - DNA, 1044 bp, Glycine max
  Peptide Sequence Number=SeqID_208868
atggctgtgatcccgtgtcactgttaccgttccgtcggatccgacaaaccctacctctctggtcagagtctccgccgttgcgctccttcccccgccgtctccgtttcatttcgacgccgaatatcatgcgtcgcctcttccgctgtcgctcagaaagttgggctgaaagattttcttcacttggatgattttgataaggatactattttgaagatgttggaccgggcccttgaggtcaaggcattgctgaagtcaggggacaggtcatttcggccttttgaggggaagacaatggcaatgatatttacaaagccgtccatgagaacacgtgtttcgttcgagactggctttacattgttaggtggccatgctatatatttaggacccgatgacatccaaatgggcaagcgagaggagactcgtgacattgctcgtgttttgtctcgctataatgacatcattatggctcgtgtttttgctcataaggacatacttgatcttgcaaaatatgctactgtgccagtcatcaatgggttgacagactacaaccatccctgccagataatggctgatgcccttaccatggttgagcacataggtcggtttgaaggtacaaaggtggtctacattggagatggaaataatattgttcactcatggttgttgatggcatctgtaattccctttcacttcgtctgtgcatgtccaaaaggatttgaacccgatgcaaaaacagttgagaaggcaaggaaagctggaatcagcaagattgagataaccaatgatcccaaagaagctgttaaaggagctgatgttgtgtattcagatgtctgggccagcatggggcaaaaggaagaagctgaataccgtcgccaagtttttaaaggatttcagaataggcttgtagctcaactggcactggccgaagtcataaaagacgtgttgttccgagattatatggggatagactcattatataactatgtggtcagaattggactagatgttaacagattggaagtgtaccaattttatcacaagtag

SEQ ID NO: 92091 - DNA, 522 bp, Glycine max
  Peptide Sequence Number=SeqID_208869
atggcattcatttttcgaaatggaaccgtcattcacaacgagtgtggggtttattttcaaagttctagtctagtgcccatgcgagtaccaaacctatgcgatttttcaactctcaaaagcagaatacatagcagtgttcggctaaacaacaatgaagttgtggatgaaattcattactggcgaccaatggaagatacagctaacaacatttactttgaaagatgtagcatagatcaactgaaggatttgatcaagcaagtagcacctaaaggaaatcctcctcatgggattcacgaatcccaagttgtaaggcgtttgttttatcgacaacctagtcatttggagtattatgagaaagttttagaatttaaaattgttgagctgaaatgtgacaacgacgtgctcaaggtgctggtagagtctaattactggaaacaatttgtgccaatagaaattttggctctctttagtaaactggttatggaaaatgaggacgatgtggttacgtccttgcgtgattga

SEQ ID NO: 92092 - DNA, 497 bp, Glycine max
  Peptide Sequence Number=SeqID_208870
ggcaaggtttatggtaagttgggattttggctcaaggcttgtagaacggctggacatgatatatgtcagagtgttggtttggccagcggttcagggataaaggggatgtattttgctatatacatgcgtgtccaaggtatcttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 92093 - DNA, 180 bp, Glycine max
  Peptide Sequence Number=SeqID_208871
atgtcttctaccctaaggggaggggagttaggggagactaacctcgacggcaaaaacgcaacaacgacagctaatcgaaaatggcagcaggaaggcgcgatcgtggggaagaagaaggagcagaagaagaaaagaagcaaagcagaatggtcttccgggagctcattgcgctttttttaa

SEQ ID NO: 92094 - DNA, 258 bp, Glycine max
  Peptide Sequence Number=SeqID_208872
atgggattagctatcaggcactgggtgttcgtgaagggtgaccatactaactttgagattgagccttcttttgggattgaggcttcggcgttgtacccggatgtcaagtacaccaccgtgaagaataccttgacacgttcgtttgagaatttagaaagcaaggattcacatgatgaggttggtaatggttctggggctggtgccgaggccagttcctcttcagacttggctagcggtgatgctgtttttatgctataa

SEQ ID NO: 92095 - DNA, 225 bp, Glycine max
  Peptide Sequence Number=SeqID_208873
atgggagccataactggaattcccttcattctgggtcctgttcaaattgaagaactcgaatacatactgagggagattaaatccaaatcccagcatgccatcaaaatcaacatgacattcagtgccgtcgacctctctagactcctggttggtgttgagatatgcggtactcaacttggaggaatggaggttattcaagttttgagatattttcattggtggtga

SEQ ID NO: 92096 - DNA, 267 bp, Glycine max
  Peptide Sequence Number=SeqID_208874
atggggaaaacgcggcggacctggaacgatttcttccagaagaacctcttccggaaacttcccgaaagaaccacttcttccgtaacttccagaagaagttgttctggaaattttccggaagagcctctaccggaagaacttattccggatgtttctctggaagaagtggttcttccggaaatgactgaggatgttcctgacatgactgaggatgtccctcatatggctgaggatgcacctgagatgactgcggacgtacagaactga

SEQ ID NO: 92097 - DNA, 294 bp, Glycine max
  Peptide Sequence Number=SeqID_208875
atgtcaaatattttaagttctaaggtatgggcaggcaatcccgcaaagttcctaagaaagctagctgatgaacagaaagctttcatctcccagtcagccaccaattatactaaccttgcacaggtccacgcagccgagaattcaaagccctttgatgaaattgactttgagaaggtgctgcgaaagaagtttgcacgtatagatgaggagtacgactctatgctaggtgttgttcgtgagatcccaccagagcttattcttcctgataaagcagaaaaagctcttcaaaaatga

SEQ ID NO: 92098 - DNA, 366 bp, Glycine max
  Peptide Sequence Number=SeqID_208876
atgggtgagaaaagcaagattttgatcataggaggcaccggctacatcggcaaacatatagtggaagcaagcgcaaaggctggaaatcccacttttgctttggtgagggaatccacactctctgacccctccaaggcacaactcatccacaattttgaggctttgggcgttaatttggtccgcggggatctgtacgatcatgagaagttggtgaaagctatcaagcaagtagatgtcgtcatatccacgctgggtcacctgcagcttgccgatcagctcaagatcatcgctgccattaaggaagccggtaatgttaaggtagtaccttctcctaacttcatactttatgacttatttgttctataa

SEQ ID NO: 92099 - DNA, 1264 bp, Glycine max
  Peptide Sequence Number=SeqID_208877
atggtgcaaaagaaggacgaggaactcagaggcagtaacaacgggcccatcagcggctaccgtaggtggttgaaagcctacatgcaaggtctggattggctcctgagtttgagaaccactaagggggtggaagttgaagctccggaggaggatgaagaggtgcaggccctcagggtagaactcgagaaagcccaaacaatcaaagaaaagttcaaatcagcagctcttaagatccgaaaggagaatgccgaactgagagacgtaaatatagccaccaccaaggccttggaacaagataccaaaagggcccttagggaagaatatggccgaaacaaattccgaggggctctgtggggcagtaacagcgagcttaagctccggagagacgaaagggaccaatcacgagtagacagtttgatcttgaaagatgaattgaggatctgcctaaggtccaagagaagcttgtctcagcggttatgcgagaccgagaccaacatgttagccatcatcagcaagtaccaagaagaattaaatctagccacagcccacgagcacaaagtggcggacaaatatgcccgagtgtacgcggaaaaggaggctagaggaagggccaaagcgatggcggacacctactccgcccccaaggagatccatggacttctcggctattgtcagcatatgatgggtgatcaagaggagacacatgaacagatgaaagccgacatgtcggctttgaaagagcaaatggcttccataatggaggccatgttagcaatgagacaactcatggagaaaaacatggccaccgctgccgctgttagttcggctgccgaagtagacccaactctcctagctaccgcgcaccatcctcccccaaacgcggtaggacgagaagggagcacactagggcacaacagcaacccccatttaggatacaaccgggtggcttacccttatggattacctcctaattacacaccgccagtcatgcatgatgacgcgggtcatgtctcttcccccatccttgaaggggagcctcctcgacagcccgacgaggtccacgaagatcatcgagagtatgcccaaggggatgtcgatttctaccccctaatcctcgtcgaggggccgacacccaacacattgcctcagcacaacctcacagcacaaccaatattcttgtccacagaaggaccacccccagtggtggaagaaagatggaaactcgatctcatcgaggagagattgagagctgttgaaggctttg

SEQ ID NO: 92100 - DNA, 282 bp, Glycine max
  Peptide Sequence Number=SeqID_208878
atggagggctctgcagagatcgctgatttggacgagtccatgaacgaccattatgagatttgttatagccaagattatgtttccaccaagaaggatatcctatttttgagtaacagcaactgtaggagtgacaatcaacattgcaaatggaacaatgatattgaggctcagatttggcacctcgagatggatttgactgccgaacagtcatggtcgattgatctaagggaaaggatcgagaatctgataatgaagtggccatggagggaagaggatccatga

SEQ ID NO: 92101 - DNA, 633 bp, Glycine max
  Peptide Sequence Number=SeqID_208879
atggcgaagatatcatttgttttggtatttgcatttgtgttgttggctctgccattatgttcagttttgggccaagaagattggaaggatctcctggaccaaggagggttctctcaagattctttgaaaaaggcccagatggcttttggtgctgcttctgcccaagcagctgtcaatgattattttggaggtgacgactctcctcaggaagccgatgatggagaagcttcatccttggctgactttttagacgctgacgaaataacaaacaacaaccccatagattcaccggttggagcaccagaagatttacctgtagatgacattgacgatccggatgattctttctcacctgctggtgcaccactaaattcgcccaatgaagcaccaagcaatgcaccagtggtagcaccagcaagtggtgcaccaatagaagcacctgaattggcaccaacaacaaatgcacctggacaagcgcctacagatgaagaggatgaggaagatgaattgacacctacaaatgcacctaccgaggaaccagatgatgaagacgagtttgatgactctccatcagaacctcccacagagacgcctgaagcggaacccgcagacgagagtgatgatgaatcataa

SEQ ID NO: 92102 - DNA, 810 bp, Glycine max
  Peptide Sequence Number=SeqID_208880
atgctacggaaaaagcaacaatgtggttttaggatcccttggatctcaggtccttccaccactgaatctcattctcctcctccaaaacaaaaatcaaaatctctttccactcatcgaccaccatttcgtcctcatggaatagcctctaccccacaacaacctccacctcttcctcctaatggaacctcaaaaacaaaacctcaacaagtgtcaaattctcttccatcgcattcaccagcaccttcagtgatcattgactccccagtgtcttttcagccagaatccccttctacacctacagagccaaatgtgaaggaattggagttggatagcactcctactcagaattccaatggcaacaacatggagagaaagatgatgtttgccacgtcgactcctagcgggaaagacatcaaagttgtgccaccagcctcagcatcagcaaccatatcattatccaccaatgatgatatttcagctctgaatccaacactgaacgtggatgacaaaacagtaagtgtggtaactctggctggtgacaacagaggagtgacaatgcacgtggcgggttctcactcaactaggcccaaacctgaagggaagaagagcgcgtccaccgagaaagatgaagcggggaagacatacgtaaacagtaacattcagagcatcaacaattcgatcatgtcgaacggttccatcaatggaagagaccctggtgttcgtgttattctcccccaacaaccgtgtttggaaaaacctaaggctgaagttagcattaaccgcgcagagatggtgccttaccggcctgtg

SEQ ID NO: 92103 - DNA, 847 bp, Glycine max
  Peptide Sequence Number=SeqID_208881
cccttcttctatctctccttcctacgggttagcagagaattgcacctttgtgtccactgcgtggaggagcgttaatagtgatcataatgatagtgttggtgcctattattcttcaagcttcccagattttcccactcacaacaagctcttaccagttgcaaggctcgaaaacgtggaagaggaagacgtggagattatggttgttgatgaagaaacgttggagccagctgaggatggtgttgaaggagaaatttgggttgcttcaccaagcaacgcttctgggtaccttggccaccctagtttaacaagagaagtgtttcatggaagactaagaaacatgattagcaagtgctttcttcgaactggggacagaggcatagtgaaaggagaaaaaagatatctttttgtcactggtcgctgtcaagacgttatggaactccgaaatggtcgaaaggttcatccacattacatagaaactgcggcttataacagttgccccaagttactgagaggaggttgtcttgcagcgtttaaagtttcatcaacggtggtggttgtggcagagatgcagaggatcgaaaagggtatagaaaaaggtgtgttgaagaggatttgcgagggagttaaagaagctgtttggaagaaagagaaggtggaggttggatgggtggttttggttgagagtgagtgtgttccgaaaaccacttctgggaaattgataagagggaaggctaaggagaagcttcttgcaggggaaatggtgattctgatgaagatgcggtttggaaaagatgttactgtttttaagagagcaaagaagggtggtgtaatacctgaaaagtgttga

SEQ ID NO: 92104 - DNA, 309 bp, Glycine max
  Peptide Sequence Number=SeqID_208882
atgggttggacacgagaagagaatagacgttttgaggatgctcttgcggttcatgggcctgatgacccaaatcggtggcaacatgtggccaacgccgtgggtggaaagtccgtacaagaggtgaaaatgcactatgagatcctccaggaagatgtcattcgaatagagcgtgatcaaatcccacttcccagctacagaggtaacgaaaggcagattcacaatgagcaaagttttagagctttcacgatgatgacaacgtcatgtcctccgatatacatgctatttctgattaccttacagagcaattaa

SEQ ID NO: 92105 - DNA, 1371 bp, Glycine max
  Peptide Sequence Number=SeqID_208883
atggcaaaggatgttgcgaacccttctaacttatcacgaaagaaaagttttgtaagattagatctttctcctccatctggtggttttggcggcgaaggattttggatgagcagcgaggaggatgaaagaaaggcgttagagcagagtgaggcatcatcagaatctgaatctcacatgggcgaacagacgctaggtcaagcacaacccctccccgcccccgatgctgccacggcccactccgaactaaacaatgtccctcagccgacaacctccccagctacgaaaatccccctccgtccccgcaagatccggaaggtctctccggacccctccacctccgaagcccccatcaaacccgccaaacctgttggccgcaacaccacctccaaggctgctccgcctcgagccctgactgtggtccctcgcatagtggctcgctcactctcctgcgacggcgaggtcgagatctcgctccgctacctccgcaacgcggaccccctcctctcccctctgatcgacattcaccaacccccaaccttcgacaatttccacactcccttcctcgccctaacccgcagcatcttgtaccagcaactcgcgttcaaagccggcacctccatctacacgcgcttcatcggcctctgcggcggcgaaaacggcgtcgttcccgaaacagttctcgcccttactccccaacagcttcggcagattggggtttcggggcggaaggccagttaccttcacgatttggccaggaagtaccagaacgggatactctccgattccgccattgtgaacatggatgacaagtcgctcttcaccatgcttaccatggtcaatggcattggctcttggtctgttcacatgttcatgattttctcactccacagacccgatgttctccccatcaatgaccttggtgtcaggaaaggggttcagcttctctacaacctcgaggacttgccgcggccctcgcagatggaccagttgtgtgacaagtggaggccttatcggtctgttgcttcgtggtatatgtggagatttgttgaagccaagggaactccttcgagtgcggtgacggtagcgactggtgccggcttgcagcagcagcgccatcaccagcatcaacaacaggagcaacagcagcagcaacacgctccacagccacagcttctggatcccataaatagcatgtttaatcttggaggctcttcgctatgcgaaggtatgggggagggatgttgtacgcagccttacccttacatatgcaaagaggctgtttccggattcgaacccatgaccaacaagtcaccaaggcacaactttaccgctgcaccagggctcgccctcataaagaaaggcatactgtaa

SEQ ID NO: 92106 - DNA, 330 bp, Glycine max
  Peptide Sequence Number=SeqID_208884
atggacgctagaattgcaaatgaatcaagaggaaaattagttatagtatgtgttgaaattgatcttgaacgagctgatgttggaaaaatatggttcaaaaatcattggttttatgtagaatataaaggtttacaaactttacatctcctttataagaaacacaacaatgacaatagaagtggtcactctcatggagtggatgggcttggaaaaatgcatgagcaataccaacatgaaaccctagttgagaacaaaggtaggttgttagttgtgatgcacaaggaaaaccaatccaagtcgtgtttcgaagcagcaatcttggaaggttaa

SEQ ID NO: 92107 - DNA, 773 bp, Glycine max
  Peptide Sequence Number=SeqID_208885
atgccatacaagtacgagaattatgacccctcattccccgaccaacccgtggttgacttatacctcccagtttgggccaggttacctgccttcaagtccaagccagctttcatttgggcacaagacttgcacaccttcactgctctcacctaccaacaacttaacgccacagttgatgtcatctcctctcgactactcgctccgttacaacgaggtgacactgttcttcttctttgctctcctggacttgacctagttgagctcatctttgcgtgtcaaagagctggtcttttgagcgttcccatcatccctcctcacccttcttttgctaaagaaaactatcaccatctcataagagccatttcgcagaccaaacccaaagctgccctagctcaccctcactacatatcaagcattagacaatacgtgtcttccccccacaacaacaagaaacttgctcacatgttacatagcatccactggatttccgtagacgaactcaaacatcatcatggtgttgttactttaaataatcttgattcactgacatacagtggttgcaaagcgaatgaagtttacttggttcagtacacgtctggtgccactggggttccaaaacccgtgcttgtcacagcgggctcagctgctcacaacgttagaacagcgagaaaagcttacgatcttcatcccaacagcacaatcgtttcgtggctgcctcagtatcatgattgtggtctcatgttcttgttgctgacccttgtatcaggagccac

SEQ ID NO: 92108 - DNA, 273 bp, Glycine max
  Peptide Sequence Number=SeqID_208886
atgcggatgaggcgccactcgatgtttccatttgcctgcatgcctggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 92109 - DNA, 165 bp, Glycine max
  Peptide Sequence Number=SeqID_208887
atgtcacaaaactttacggattacgcaaccatcccctctttgacttctggaatgttacgggactttacggattacgcaataatgcttgctttcgactcccgacatgtcgtggaacttcacggattgcctaacgatgggtgtcaagagtttcgaccgatcgtttaa

SEQ ID NO: 92110 - DNA, 195 bp, Glycine max
  Peptide Sequence Number=SeqID_208888
atgaaaaaacaatgcttaacatgtctcgctttttggtttcttcaggcttacacgaatgaactggagcttgaagttgagcacttaaaggaagagaacgcaaggctcaaaagacagcaacaacagttgtatgaagccgcagtcagtgagcaaaagaagaagggcaccctatgtcgagcatctacggcaccattttga

SEQ ID NO: 92111 - DNA, 411 bp, Glycine max
  Peptide Sequence Number=SeqID_208889
atggaagaggtgtggaaagacattaacctggctaccttaaatgagcaaagcaccattagtactcgccccaacgtcgaaggcgttatgtttcaagactttctggctcgacccttcaccaccattgacccaccaaacaccaccttactttcctctgcctcttcagaaaccgccgctaattctcttttctcccctgcctctcctggcccacctctcgtcactctcagcttgagctctctccctcatcaccaccacttccgtttcgaacacccctcctcaatccctcctccaccctccaacaaaagatttgctcaacctgctgaccattgcagcaccataggcgacagaagaaataagcgcatgatcaagaatcgcgagtccgctgcacgatcgcgtgctagaaaacaggaatag

SEQ ID NO: 92112 - DNA, 363 bp, Glycine max
  Peptide Sequence Number=SeqID_208890
atggagaattgctatcaaaagaatggttttccttccaacttttcatctaatagagaagggggaggaagtcaaggatcttttggtagaggcaccacgagtggaagaggaaacaaggtttgcacacactatggcatcactagccacacagtggaggaatgttataagaaaattggataccctcctgaccacaagttttatagaccccaagggaattcaataaataatgcagtagccaatactagaagcagtgttgataatggaaatgtaactactcgtactataactaagcatgattcagttgcctggattcttgattttggtgcaactgatcatgttgcttcctccttgagcttacattcttaa

SEQ ID NO: 92113 - DNA, 712 bp, Glycine max
  Peptide Sequence Number=SeqID_208891
atggttatgaatgaagagatgcaatcccttcaaaagaaccagacatgggatttagttgaaccacctaatgatagacgagtagtggggtgcaagtggatcttcaagaagaaatttggattgtccactgaagaagtcgcccattataaagcacgtctagtagctaaaggctacagtcagaaggaagaacaactctatgtgaaaattgcttttctccatggaagactactagaagacattatgatgcaacaacctaaaggttttgatgtggaaggaggatggttcccatatctatctgctactctatgtggacaacatgctcacaacatctcaaaatttgttggcaattcaaaagttgaagtcactactcagctagagtcaaagaaggaatacatgcctcatgttccttgtgtaggtgttgaagattttgatggaacgagatctatgactgggtacacattcacgattggaaactccttacagttgaaagacaacactttggcccacaatgtccttgtccactacagagaaaaggttatcattttctacggtagtatgagtacaatctgcttagacaaagatcaagtccatcttgagaaaactgagcacattgacatcaaataccacttgatttgttctgagaaatgggtcaaggtcaagaaagtggatacaagggagaatccaactgatatgttcactaaggctgttccaagaa

SEQ ID NO: 92114 - DNA, 1740 bp, Glycine max
  Peptide Sequence Number=SeqID_208892
atggccagagtctccaagctccaacgcctcccaatccaaaacacctttctcacgcgccccatcgccatcaccaccaacacttcaccccctgaaggaaaacgaagactctcctccctcttctcacacttcgaagcgcttctccaaaactcatgccaaaacgctcgccacctccttcaaatccaagcccttctcgtcacttccagcctcttccgcaacccctacttggcacgcaccattttgagccgcgcctcacacctatgcgacgtcgcttacacccgtgtgatctttcgaagcatcaattccctcgacacgttctgcgtcaacatcgtgatccaggcctattctaacagccacgctccccgcgaagcgattgtgttttatttccgctctttgatgcgtgggtttttccccaacagctacaccttcgtgccactcgttgcttcgtgtgccaaaatgggttgcattggttctgggaaggagtgtcatgctcaggccacgaagaatggggttgattctgttttgccggtgcagaactctttgattcacatgtatgtttgttgcgggggtgttcagcttgctagggtgttgtttgatggaatgttgagtagggatttggtttcttggaactcgatcattaatgggcatatgatggttggtgagttgaatgctgcacaccgactgtttgataaaatgcctgagaggaatttggttacttggaatgtcatgattagtgggtatttgaagggtaggaaccccggttatgcgatgaagttgtttcgcgaaatgggcaggttgggattgagggggaatgctaggactatggtctgtgtggctacagcttgtggtcggtcgggtagactcaaggaagcaaaatcagttcatgggagcattgttaggatgtcattgaggtcaagtttgattcttgatacggcattgattggcatgtactgtaagtgtaggaaggtggaggttgcgcagatagtgtttgagaggatgagagaaaggaatttggtatcgtggaatatgatgatcttggggcactgcattcgtgggagtcctgaagatggactcgacctgtttgaagtaatgatcagtatggggaagatgaaacatggagttgagagtgacgagactctgagattgctccctaatgaagtaaccttcattggtgttctctgtgcgtgtgctcgggcagagatgttggatgaggggaggtcttacttcaaacagatgactgatgtgtttggtgtgaagcccaattatgctcatttttggtgcatggcaaaccttcttgcaagtgtgaagcttgttggtgaggcagaagagtttctaaggagcatggcagagtttgatggggatatgtcatgtgagtcattggtatgggcaagtttgcttggtttgtgtcatttcaagagggatgtgtacttgggggaacggattgctaagcttctcgttgacatggatcctaagaacctcacctgttaccagtttctgctgatcatatatgccgtgtctgctcaatgggagaatgtttctgaagtgcaaaaactggtgaaggaaagaaggttggagataatacctggaagcagtcttgtggacttgaaaaatattgttcacaatttcaaagttacaaacaaagggcaagagggaattgaagcagtaaacttgatgatggatgaactagctcatagattcagtttgccaagttctgatttaggtcagaaacaaagtactagctag

SEQ ID NO: 92115 - DNA, 387 bp, Glycine max
  Peptide Sequence Number=SeqID_208893
atgtatgtcagaatttatagcaacttcaaatccaagaaaatacttcaaatcaccaagatccttgattttgaaaacattatcaagcagctttgtaattgggaaatttcagtcaaatcaatgccagtgagaacaacatcatctgcatacactaatgatgttgtaaaagaggaatttaagtgcttggtaaaaaggggatcgttggagcttgcaaacttgacatggtttaagaaactgcgttccaaggggcataatcatgtcaacttcctcgttgagatcaccatgcagaaaaacattgttgacattaagttgcttaaattgaaggctgcaagagcaaggagaattttgacagtgataatcttggtcactggtgaaaaagtatccaagtaa

SEQ ID NO: 92116 - DNA, 627 bp, Glycine max
  Peptide Sequence Number=SeqID_208894
atgacacagaattacactgattcatctatgtatctcatgattcaaaaagttgaaatttctgtggaatttatcactgttaatcaagtgatttacttggaacagtcatatcagaaggctttacaagtggatccttcatacaaagcagctgctgaatgccttgccattgttttaacagatattggtaccaacataaagctggcagggaacactcaggatggaattcaaaaatattttgaggccctcaaacctgcatactataatcttggtgtggtctattctgaaatgatgcaatatgacacagccctcagtttctatgaaaaggctgcatcagagaggccagtctatgccgaggcttattgcaatatgggtgtgatttttaaaaatcgcggtgatttggaatcggctattacttgttatgagaggtgtttaactgtttcacctaactttgagattgcaaagaataatatggctatagcattaacagatttgggaacaaaggggtggaaacagtgggtgtgttgcttaaaaactgacacttttaacttgtgtcagcttaattttaaaggggctttgaggaaatgcaaatattttccttgttccttgggaattgagaagcaattttggtaa

SEQ ID NO: 92117 - DNA, 216 bp, Glycine max
  Peptide Sequence Number=SeqID_208895
atgaccaaactccttgtgggggcagaatcaataagcagagcagattttccagaagggtttgtctttggaactgcttcttcagctcaccagtttgagggagctactgatgaaggaaacaaaggagatagcatatgggatactttctcaagaataccagggagaattgtggacttcagcaatgcagacaaggcagtggatcaataccaccgatttcag

SEQ ID NO: 92118 - DNA, 1233 bp, Glycine max
  Peptide Sequence Number=SeqID_208896
atgaaagtgagggttgtttgcaggaaaatttacgactatatacgctatgatctcaaagaaatcgctttcccctcttctttgccagaccctcctcacatcaaaaagcgtcgcaaattgacctgggaccagcgtatctggagagctgcccggctttatgctgcaagctgggttcgtgacattggtcctgaccttcggcctgatgattataagaaggatggtgacatgactgatgaaacaaatggtgaaaagaaaacaactataggaaaagaaccctcaacactggaggaccttgctgtagctgcaagagggggaatggagactctcagaccagctttgcagcgtgtgtacatgaccagagcatctgcatacagagatgctcttaaaagtttcatagaagggtaccaagagggtgttcagcaaggagattttgttggtgttgatgctgatttgaatacagtgatttattcttcaagaagaaatcaaattcccatttgtgttctttattctacagcatctcctaaaggaggcgcaagccatcctcacccttgtggaggcactctcaccggaggacagagaagtcctctcctacctcatctcccactcctcctccaccttctctggcaaggaaaaccgctgccgaaatcgaccattccccttcgttcagctgcagctgcttctgctgctacatgggttattgggttaggtgggacgaatctctactgtgtttcggtgtatattgcttttgaagggcttcgtctatcttcatttcataaatttcaacctatgatgccattaatcacaattctacagagtaccgataacttttcagaagcatctaaattaggggaacgtggatttggccccgtttacaagggaattctaccagatcgaaggcaaattgcagtcaaaaggctctcaaaagtttttggtcaaggctcagcggagttcaataatgaagtaacgtttatagctaaactgcaacatcgcaaccttgagaccgcaaaccatcgcaaatcgcatcacaaaaatggtgaaacttccgccgactgccctatgcctctgcagccaccgaagccaaaagtgaagatctacaagatgatggccagaggagatgtgtgggagggtggtgtgaagaaagatgctagctggtttggcgccagagaaggtggagatggaagtggctgggtctctgaggggaagagatggaaggggttctccaaaggacaaaattag

SEQ ID NO: 92119 - DNA, 513 bp, Glycine max
  Peptide Sequence Number=SeqID_208897
atgtgggcaagcgccgcagaaggtggtgctccggaggtgactctggaaacttccatgggttctttcacctttgagctgtactacaagcatgcgccgaggacttgtaggaacttcattgaactgtctcgccgaggttactacgacaacgttaaattccataggatcattaaggacttcatagtacaaggtggggatcccactggaacaggaagaggaggagaatccatatatggtgcaaagtttgaagatgagattaaacgagagttgaagcacactggagctggaatcttatccatggcaaatgctggcccaaacaccaatggtagtcagttctttattactctggctccatgcccctctctcgatgagattgatccccataatcacaaccatattatgcaaattattctgtcagtatggctgctttactattatacaatgaagtctgagggcactggaggatgtgatgatactgataggcattggctatttgcaattaacacagttatataa

SEQ ID NO: 92120 - DNA, 756 bp, Glycine max
  Peptide Sequence Number=SeqID_208898
atgcagaatctctttatccgtagggatggtccaatgttagtggttgcatctggacgagacatttctgttgccagctccattaaacggttagctccagaaaatgtttttcttgttcagctgacctcacttgttatgtgtttggttgcatggtgggtgactccatgggaacctcctggctgcaatgtggttctcactgtgggagcgcttcatcaagctgattctgctgctcttagggttgctgcttctgcctggcatgacgagttagcaactctgccaaagcccttgcttgtggttaatgttgggggacctactggtaattgtccctgtggtgtggatcttgtaaagaagttagtggttatgcttcagaatgttctatggagttgtgggagtatcaggatatctttctccagaagaactcctgagaagttttggcttctaatcatgagcatgctcctgtttggtcatttgactgctttgatctccaaaattttggttgaagaatttgcctcaaatccaaaggtccaaatatgggatggtgaaggttcaaatccacatatgggacatctggcctgggctgatgcctttgttatcactgctgattcagttagcatgttgagtgaggcctgcagtactgggaagcctgtgtatataattggagcagaacggtgtacttggaagtttgctgacttccaaaattctttgcaggagcaagggattgctcgaccattcactgggaatgagaatatgagttgctaa

SEQ ID NO: 92121 - DNA, 1248 bp, Glycine max
  Peptide Sequence Number=SeqID_208899
atgtttccatgcagggactggggtaggcgattcatgagactatattcacagtacacatcatgggacaactcaaaagatcctgaacggcccctagtgataggctatgtatctcctgattattttactcattctgtgtcatatttcatagaagcgcctcttgtctatcatgactactccaatttcaaagtgattgtttattcagcagttgtcaaggcagattcaaaaaccattagatttagagagaaagttgtaaataagggtggtatctggaaagatatttatggaattgatgaaaagatggttgccaacatggttagagaagatcaagttgatattttggtagaacttactggacatactgcaaacaataaattgggaatgatggcatgccgacctgcaccaattcaggtgacttggattggttatcccaatacaacaggattgcctacaattgattatagaatcactgattcactggcagaccctcctgaaacaaagcagaagcatgttgaggagttagttaggttgccagaatgcttcctttgttacaccccttccctggaggctggtcctgtttgtccaactcctgctctttccaatggttttgtcacatttggtagtttcaacaatcttgccaagattacacccaaggtattgcaggtttgggtgaggatactgtgtgcaattccgaattcccgccttgtggtaaaatgtaaacctttttgcagtgacagtgtgcgacagatattcctttcaacactagagcagttaggtttagaaccactacgtgttgatcttctgccccttattcttcttaaccatgatcatatgcaagcctattctctgatggacatcagtttggatacatttccatatgctggaacaacaacaacatgtgaatctttatatatgggagttccatgtgtcactatggctggatcagtacatgcgcacaatgttggtgttagtcttcttagcaaagttgagaatagggaccagattggacaacaagtccaagagtactccttttggcagggtactgtcctaataaaattgaagtactactcctctaagacggagagctttgactcaaatagcaattacttttttaataggaaatcaatattattcaatagccaaaaaccagtcaagcttaaaagagttgacctgaaaaagtgcaggaagagaggggagagtggagcaaggagagagagagaggagattaagagaaaccaactttttttctaa

SEQ ID NO: 92122 - DNA, 1323 bp, Glycine max
  Peptide Sequence Number=SeqID_208900
atgtctcagacgaagaaattgacgccgaatctggatcagcagagcacgaaggtgctgaatctcacggtgctccagcgaatcgatccgttcatcgaagagattctcttcaccgccgcgcatgtctccttctacgacttcaacatcgaaagcaaccagtggagtcgcaaggatgttgaaggatctctcttcgttgtcaagaggaattcacaaccacggtttcagttcatcgtcatgaatcgacggaatacagctatctttctgatctttgtcctgacagataacctagtggagaatctattggattttgagtatgaacttaaaaagccgtacctgttgtatcggaatgctgctcaagaagttaacggaatatggttttacaatccagatgaatgtgaagaagttgcaaatctctttaacaggatacttaatgcatacccaaagactgctccaactacagtactgcctgttaacataagtgagtctgaggaacttcagccagtgtcaattatcccggaaagccctctagagtcgtcttcagctactgcttctgcaattgatgctgttgaagatcctgcaaatacaaacttcttaagcacattgaaggttactggaaattatgcttccaatatggaaaattttagacagcattctgcaactgtcacttctgctcctagtggtttattctctactgcacctgctgtgcaaattccatctgcctctcattcaacttcatcgatatcaggcttccctcttgactctcttgaaacagccaagagtggcaatcaaatcattaatcttgttaagccttccacgttttttgcatcgacgtcttcatcttcactgttagttccacctatttcttcatctgtgcaacctagtgcagctgttcaacattccctgaatctgccacgccaatatggcactccagtacttcaacccttccctccccctaaccctcctctttctcttacccctatttcaagctccactccaaatagacctgtattcagcagggataatgtccgtgatgcacttttatcattggttcaggaggatcaattcattgacatgatgttccaggcattactgaagttacacaccgtcacatctaacaggagaaatagccgtctgtatcttcacaatgataaaagtgtttcgatgtcagtgtcgccttattaccctttgttgtctgtactttgtggttttaaatacaatcatggttctgtcgattgtgtctttgcattaagttggacaagtcctctatcgaccaatgaagatgcatacaatctcatgcttagcatgcagttagatataaataaataa

SEQ ID NO: 92123 - DNA, 210 bp, Glycine max
  Peptide Sequence Number=SeqID_208901
atggctattgaacaccttatttgccatgtagccattaagaaacttaatgtcacacatagccatgtggacattgagtattcagaaatggcgattgaacaccttatttgccatgatgatcgctccatcaacaacaatacagcaacatgcaagttgttcttccactacttagctgatgctttccgtgctggacttcaatcccataggaattag

SEQ ID NO: 92124 - DNA, 894 bp, Glycine max
  Peptide Sequence Number=SeqID_208902
atgggtgggggaggagctatgaggtcggcggcgaagatagccggaattggcgtgtccaaggcggcgctccggccttcggcgctccctacggagcagacggtccgcaacgcgtcgcgaccaacggcggtctccggagtgtcgtcgcagtcggcgaaatccgcggaggtggcgccgctgcacacggcagctgcctgggacgattgggacttcgccgaggatggcgaattggtcgtgccgaggatggtgttcggttctgtccccactctcgatgaagctaaggaagccaccgcagagttgaaggacgctattgatcaagtatatctttgtcctgagacttctcaatattcatctcccggtggtcaagtctctgctttgtctcccactctctatgggccagtgaacagatcttgtgtcattgatgctatttcagatcctacggccccaaagcatgccattcaggcttttcatttgcttagcactagtcgtgaggcccaggctgttgtggcttcacttgcttgtgacccaaatgtatggaatgcagtcatggaaaattctgctgtcagtagtttcttccaatcacaacagtcagtggctggttttggagcagcagaaaattctgaggaagtggataagttatcaagctgtgcttctgaaacagtcgaatcccctgagaaattggaagggtcggctgagtctcacccggggaacatgtttgacgatttcatgggtcttctgcagaatgtgaagcttacagttattgaattgcatgggaggaaccttcataggtttggcagtgctggtgataatggtgatcgtgacaaagagagcttagactctaacaagcaaaactacaatttgtcgacttttctgatagttttgaaaccatgttattaa

SEQ ID NO: 92125 - DNA, 1254 bp, Glycine max
  Peptide Sequence Number=SeqID_208903
atgaaggatttgggaatggattcttacagattttccatatcatggccgagaatttttccaaatggaacaggggaacccaataaagagggaataaaatattacaacagcctcattgattctttacttgtaaaaggaatccagccttttgtaacactatatcattgggatcttccacagatgctagaagataaatatgaaggatggttaagctcacaaatcataaaagattatgagcattatgccaatacatgcttcaaagcttttggagacagagttaagcactggattaccttcaatgagcctcataactttgcactccatggttatgatttaggcattcaagcaccaggaagatgttcccttttgggtcatcttctatgtaagaaaggaaaatcatccactgagccatacattgttgctcataacattctcttgtcacatgctgctgcctatagaagctaccaactacatttcaaggaacaacaaggaggtcaaataggaatagcactagatgtcatttggtatgaacctataacagaacttgatgaagacaaagacgcagcagcaagagctatggacttttcacttggatggttccttgacccacttttctttggaaaatatcctctctcaatggagaaacttgtagctaagagattgccggagatttctgatacagcctcaaaatttcttgtgggatctttggattttattggcataaatcactacacctcagtctatactcgtaacgacaggactcggattcgtaaactagttatgcaagatgctgctactgatgctgctgtcattacaaccgcataccgaagaggatctgcaattggagaaaaggcagcttcaagttggctgcacattgttccatggggcatccgaaagttggtaaaacatgtgaaagacaaatatggggacacgccagtaattataacggagaatggaatggatgacccaagtggaccctttaggaccttagaaaaggccttgaatgatgacaagaggataagataccatagagactatctctcaaacctatctgctgctataagggaagatggttgcaatgtacgtggttactttgtatggtcattgcttgacaattgggagtggaacatgggatacaccgtacggtttggactctactatgtggatttcaggaacaatcttactaggataccaaaagattcggtgcaatggttcaaaaacatgctcagaatagagacagaacatagtgaaatttga

SEQ ID NO: 92126 - DNA, 186 bp, Glycine max
  Peptide Sequence Number=SeqID_208904
atgggatgtgatgtaaacccatttgcacaagggttgaagatggatcttcaaagagagaaagtgacgagtttatggagggttgaatgtaaggtatttggttcaatgtttgaatgtgtatgggtggaaaatgaagatgataacaatggtgttcaagtaggattaaagactgaaggtttagaaagatga

SEQ ID NO: 92127 - DNA, 1257 bp, Glycine max
  Peptide Sequence Number=SeqID_208905
atgtcacgcagaccacaattcccacgtgcatcattccacacgcagagtcagtgtcgttcttcttctaattcatcgctcccgatgaaacgagggtaccaggaatccccttcaagctcgttaggtccacctcattccagagctagacatgatcctcaaggtggtgcacactttgttgaggatgaaagcacaaagatttttgctcggaaagtagcagatcattatagtgcgagatccaaccagactttggaagaacgggaggctagtccgataattcatttgaagaaactcaataattggattaaaagcgtcttaattcagctttatgctcgtcgaggagatgcagtacttgacctcgcctgtggcaagggtggtgatcttatcaaatgggacaaggccaaaattggatattatgttggtattgacattgctgaaggctcggcaacaattaagggtacacttgttgccaatgaagcatcaatcttgcattttcttcatatcaaggactgccggacacgttacaacggtgatgctgaccatcatcagcgacgtaaaaagtttacatttcctgctcgccttatatgtggagattgttatgaggttcgcttggacaaagttcttgcagatgatgctccttttgatatttgtagctgccagtttgcattgcattactcatggtctacggaggcccgtgcccggcaagcattggctaatgtgtcagctttacttcgcccaggaggcattttcattggaacaatgcctgatgccaatgtgataatcaagaagcttagagaagctgaaggattaacttttggcaacagagtctattgggtgcgttttgatgaagaattttctgataagaaatttaaatcttccagcccttttggaataaagtacacgttccatttggaggacgctgttgattgtcctgaatggattgtccccttccatgtattcaagtcattagctgaagagaatgactttgagcttgttttcgcaaagaactcacatgaatttgtgcatgagtatatgaaaaaaccggaatttgtggagctcatgcgaagacttggtgcattgggagatggcaaccaagatcaaagtacactctctgctgatgaatgggaggcagcatatttatacatgtcatttgtattgagaaagcgaggtcaacctgacaaaacccaacagagtggcagaaggaaccgagggtcaatgcacatttcagaggaagacatcatgtacattagcactgatgattaa

SEQ ID NO: 92128 - DNA, 192 bp, Glycine max
  Peptide Sequence Number=SeqID_208906
atggacgatgacatgctttgtaaaggtccacccatgttaatggacgataattacggttctcagattttccttgatgaccataaccactttagagagggggtcccaatccgcaacttcctagcatgcgacaagttcaaagccatcttgatcttagctctccttatgccatccacacagaaaggattgtcttag

SEQ ID NO: 92129 - DNA, 492 bp, Glycine max
  Peptide Sequence Number=SeqID_208907
atggttgagaaaaagttattagagcatgaacagaatttagttattcctctgcaaaaccttgcacctgcttatgcttgtacggagatgataatgcccgtaggtggaagcaataaggagagcatattcccagaatatgagtggtcatacgaagcaagagcctcttggtgcgactttttctacaacgtacagccaagaccacactggattactactgagtttggtggccatgctattgagagagttctgaaaaggtctgccagcaacattatattctttaatggtttaagagatccttggagtgccggaggggtgttaaagactatatcaaaaacaatagttgctattgttgcaaaaaaaggagctcatcatgtagacctaaggtactcgagtaaggaagatccacagtggcttaaagatgtaaggaaacaagaggtaaatatcatagcaagttggatctcacaataccatcaagacctacaatccaatagctaa

SEQ ID NO: 92130 - DNA, 468 bp, Glycine max
  Peptide Sequence Number=SeqID_208908
atggggaggcaaagaaccagaacgcatggacctgggaactctttctctggttctgagttccttcttggacctgacgctgggcgaaggaatctcgttcatctcccagagcgtggcggcgagcttcctggcggagaccggagcttggagggacttgttagccgtctgcgacggcgggtatttgggggaggccaatgcccggagcggagatctcgagctcatgagcttccacgtgggcacgggcgtactagatccgccccgctttccgacgagaatagtcctcttgaagcggtagttgtggagcacggaggaagaggaggaggcggaggaggaacagcctcgttttcggatcttcccaggaatcatgtccatggtgcttcggttttggctcagcatcagaacactgagttttggtgcagagacatagcaagaagaggaggaaagtgtggtggaacacgtgtcgggttatga

SEQ ID NO: 92131 - DNA, 645 bp, Glycine max
  Peptide Sequence Number=SeqID_208909
atgtggaataaaagaatgctaacaccacattctttattgggtaaagtattaaaatccatgcggaacccactaagcatgtgttcgtttgggattattttggataaaaaacatcctgatgctgagactgtcaaaaccggtggctgctcaatctttaaggaactttgcacaatattctctgagccatcaaccaacggcaagcatgaatatttcgctgcatccaagggtgaacatacttatacaactccttgtccagagcccttgaacacacaccaagaggagtcctcttcagaatcccaggacgaggaagatgctaatgatcttcaaacagttcaacctactacacctactgcgatttctacccgcaaaagagggcgtaaaggaattgatgatgctattgcagatgccatatttgagatggcatctgcttcaaagatgagggcagctgccatagagcaacaaattgctagatttagcatggctgattgtattagggacttagatttgatgcaaggtgttgatcaacaactctattttgcagctttagagctgttcgacaaacctaatgcaagggagatatttttgtctctcaaaaaggataaacgcttaacttggttgcgtcgcaagtgtgctgttgcatccaattaa

SEQ ID NO: 92132 - DNA, 1521 bp, Glycine max
  Peptide Sequence Number=SeqID_208910
atggatcgatctggaaccggaagtcgccaaaaaagaactccgtctatttctcacagggctaggatcactgaacaccatgttggtcctttggattctcttagcaatgccagtctcatggagattgaaactagatcccgagcacagacccctgcttcatctgctgttggagttaaaggacatcgtccttcatctagtatgtctcttatctcagctctgcatactgagctggagagggctcgcctacaggtcaatcaacttatccaggaacaacgctcagatcagaatgagataaattatttgatgaagtgttttgctgaagaaaaggctgcttggaaaaacaaggagcaagaaattgttgaggttgcaattgaatctattgctggggaactcgatgtagagaggaaactcaggagacaattagaaagcttgaacaagaagcttgggagagaactggctgacactaaagcttcccttcttaaggtggtgaaagagcttgaaagtgagaagagagcaagagaaattattgagcaagtatgtgatgagttagcaagagatgctgatgaagataagtctgagattgagaaacaaaagagagtgtctacaaaagtttgtgaagaggtagagaaagaaaaggaaataatgcagttgaccgataggttacgtgaggagagagctcaaaagaaactctctgatgcaaaatatcagcttgaggaaaagaatgcagctgttgataagctaaggaatcaacttgaagtttttcttggaggcaaacaagttagagaaaagagtcgcagttccactcacttgaatgatgaagaaattgctgcctatctcagcagaagccgattaggttcccatctcgttgaagataaagaagatgatggaggagaggttgacaatggagtagaatgcgaggaggaatctgctgaaagtgatctgcattctatagagttaaatatggacaacaacaagagttataagtggacctaccctcctgaaagcagatttgatacaagaagatatccaattgaggaagaagtgaaaggtagtaggaggtctacctctgggaaaacttcaaggaaaagcacatctctgcaaaggagtatatcagatggaatggaatggggagtccaagctgataagcttcaaaattcaggagatgggatagattgggaaagcttttatgaactggaaaagcaagctcaaggaaaaggttacggggatgaaatgcaaggctataaatcagtgaaaggtcttagggatcagatattggctggttctaggcttgcatcttatagaggttatgccagtccaactagacaattttcccagccttggtcatcacgagatctcacaaataacttccaggaaagacctgctacagcacagggcaatggtctaaaatcaaggttaggggaagccaggggtgagggccagaatctaaggaagtcaaaaaggccatacccgtttgcttctgctaccatgatggctggtaaaaatgcaggacagagattctcatag

SEQ ID NO: 92133 - DNA, 1167 bp, Glycine max
  Peptide Sequence Number=SeqID_208911
atggcaattggctttcagttcatactcacactcttctctctattttcggttccctcactcacttttgcttttgcccctatccttcccagatttccttcttcagcagttagtgcagagctgaagcaacgctcacattcttcccaaaatgggctttacagaacaaaattcttcacccagatactggatcacttcaatttcaatccccaaagcaatcacacttttcaacaaaggtatctcatcaacgataccttttggggtggtgccaagaacaatgctccaatctttgtctacactggcaatgaagggaacatagaatggttcacacaaaacacgggctttatgttcgaaaatgctccttcttttcaagcccttttggttttcatcgagcatagattttatggaaaatcaataccatttgggggaaacaagacggttgcatatgcaaatactagcacacttgggtatctcagctcaacacaggcattagctgattatgccgctctcatcattgatctgaagaagaatttgtcagccactgattctcctgttgtggtttttggaggatcctatggaggaatgttggctgcttggttcaggatgaagtatccacacgttgcaattggagctctagcatcctctgctccaattctccatttcatgggtatggtttcgccagacatcttcatcagcatcatcacacaagacttcaggagcgagagtgagaattgttacaaagtgataaaagggtcttgggatctgatagacgatacggccaataaacccggaggaatggaactgctgcggaaaacattcagaatatgcaagagcgatgattttgggcctgattctttggaaggttggcttcgggcggcgtggatttataccgccatgacagattatccgacaccatccaatttcctgaatcccctgcctgcatatccggtgaaaaagatgtgcgaggcgattgacagctcagtaacgggaaataatagattagccaagttgtatgcagcagccaatgtctactacaactatacaggcaaagcaacgtgtttcgatttggatgacaattctgatcctcacgatcttggaggatggcaatggcaggacgagtataggaatgaatataggatgatggatagtgacattctacccaaccccgattaa

SEQ ID NO: 92134 - DNA, 324 bp, Glycine max
  Peptide Sequence Number=SeqID_208912
atggagaagatgagcaagaaagagattgaagaaaaacagaataacgaaaattgcgtattttgcggaaacggaaaagtctgggttgttgggtttatggtggtggggtttgtgtcaaggttggggtggcgacccggtggtcgtgcgccgctggtcgtggttaggttgcgcactgccgatggtggtgattccgactccgctgtgatctgtcatcctttggtggtggtgtggcatcacgttctatgggggtctactattaacacttgtttgatttttgatatgctggttgaaggttgttatgggtgtgagggagatgtaataggataa

SEQ ID NO: 92135 - DNA, 1878 bp, Glycine max
  Peptide Sequence Number=SeqID_208913
atgggttgctgccactccaaaatagagagggaagaaacggtgtcgcgttgcaaagccagaaagcgttacatgaagcagttcgtgcaagcaagacacgctttttccgctgcacatgttatgtacattcgctcccttcgcgccactggttctgcactctttcagttcgcaaatgccgaaaccaccgtcctccaccaccaccttccgtcgcgccctcatcccattctcccgccgccgccgcctagaacccccaccccgatgccgccgccacctcctcctccgatgagccctagttcctacacgtggacgtcggacaccacctcctctcccgcccttcctcagccgccgccgcctcctcctcctccggtggcgtcctccgcctgggacttctgggacccgttcatgcctgtggtggcttcccggttggcaacggaggaggagtgggaggcgacgaccaccacgggatcggaggtggtggtgatggcggcggcgagcgtgacggcgcctccgtctgtggtgagcgggttttccaaagagacacctagtgagcttgcaatggtggtgtcaaggaacagtactaaggatcttgttgaagttatcaaagagcttgatgactattttctcaaagctgctgatgctggttctcatgtttctttgctccttgaagttccaaactctggattttctgataacagtaaagcatgtaaagtgcacagctatgggtggagtttgagtccatcattgtgggcttggggttcgagtccgaagctgaatggtggtgcttttggggttaatggagttggaagtgttgggcactgttccacggtggagaggctatatgcatgggagaagaaattgtaccaagaggtcaagaatgctaagactataaagatggagcatgagaagaagctggcactcctaaggaaggtggagatgaagagagctgactatgtgaagacagagaagacaaagaaaggagtggagaaattagagtcacaaatgatggttgcttctcaggccattgatagtacatctgctgaaatcatcaaattaagggaggtagagctctaccctcaactcattgagcttgtaaaaggattaatgtgcatgtggagaagcatgtacgaatgccatcaagtccagaagcacatagttcagcagctagagtacctcaataccataccatcaaacaaccccacatctgagattcacaggcaatcaactcttcagctggagctcgaagtaaagcaatggcaccagtccttctgcaacctcttcaaggcccaccgcgattacatccaatccctcacaggttggctaaggttcacccttttccagttcagcaaaaaccctctaagccgaacccccgaggagtcaaagatatactccctctgtgaagaatggcacctcgccgttgaccgcattccagacaaggtagcatccgaaggaataaaaagcttgttgacagttattcatgccattgtagtgcaacaggcagaggagcaaaaacagaagaagaggtcagattccgcattcaaagagctcgagaagaaggtggttcagcttcggtccttggagtgcaagtatggtccatactccatgccggaatcctacggttccatgagaaccaaggaccctgtgaccgagaagcgcgccaaggtggatgccttgagagcaaaggcagaggaagagaagagcaaatatgagaagtcagtgagtgtaacgcgggcaatgacgctgaacaacttgcaaatgggttgccctcatgtgtttcaagggattgttgggttttcaagtgtgtgcatggaagtttttgagtctgtatacaacaaagccaaagctgctgaacaggagcatgacgtgaagagaatattaccatag

SEQ ID NO: 92136 - DNA, 399 bp, Glycine max
  Peptide Sequence Number=SeqID_208914
atgtcgcataagttctattgtgatgaatatttaatcctcactgctttagttttggtttctttggagagaatagaggaagtgaaggccaaatatccaaaagtttcatatgccgacctttaccagctagctggtgttgttccagtagaggtcactgggggtccaactatggactttgttccagggagaaaagattcattggaatctccagtagaagggtgtcttccggatgccgaacaagcgttatccaataacacggttttctataaagttaacgtgaaaaactctctccatagattggctttgctgttcattgttaccattttacaagagttagaatttcggaatccgcttgtcgatcgcataaatagccatttcattaccctaaacgttgttcactag

SEQ ID NO: 92137 - DNA, 1605 bp, Glycine max
  Peptide Sequence Number=SeqID_208915
atgaagttgagcacaaatggaggaaatgtccctgcgcaattgctggttcttgatggaaaaaattgggagcggtggcatattcaaatgaaggcgttgtttgaatttcaagacatgatggaggtagtgaagaatggcgtagcggcggaaccagcagaacccgctactgaggcggtgaggaatgcatacaaggatagcaagaagaaggatgtgaaggcaatattctttctgcatcagagtgtagatgatgcgaatttcaatctgatctcgaagtcgacctcagcgaagcaggcctgggataaacttgagaaatgttatgctggtggagatcgaatcaagaaggtgaaacttcaagtgttgcagcgacagtttgactcaatgacgatggaagagaatgagaagattgttgacttctttgcacgagtaaaggtagtcaccaatcagatggctacacaaggtgagactctaactaatggaaaaatttgtgagaaaattgctcgatctctactggaaaaatatgattatatagtatgtgcaattgaggaatccaaggaagtaagtgaaatgagtttagaagaattgcaaagttcactagaagctagagaacttagattactagagagaaataagaagaaaattgttgaacaagccttattggctcaatctagtaacaagaattctggcgacagtaacagaggaagaagtggttttagagaagaggtcatggtaggaacaatagaggaagaagtggctatgtttctagtagtggaagaggccagaataatgttgaaaataaacttgatcagtcgtagagaggcaggggcagaggctactatcgaggtggtagcaatggtagaggaaaaggtggtagatgagtgttatgcgaagaaggattcccaaggtgataaggcaaatcttgccaaaggtgatgatgaagaaaatgagctagtgatgctcatggtgactactgcagatgaaatgtgcaccattgatgaatggtaccttgacacaggatgttctacacatatgactggtcataaagaatggcttgtcaactttgatgcaagcaagaaaaatagaatcaagtttgctgatggtagagctatgctagcagaaggagttggaaatgtgatgatcaagatgtcgaatggtacacagtactgcatatcaggtggtaaaaacagtttgatatttgatgtttctatgtctagaaacaggacatttagagccaatctggaagcactttgccataaatgtctagttgcagaagtgagtgaagattattgggtatggcatcacagatatggtcacttgaattttagagacttgcgtgacttgaatactcacaacatggttagggggctgccattgataaatgtaccaaaagaattatgtaaaaattgtgttgagtctaaacagcacagagagtcttttaagaaatttgttgaaactaaggcaagagaaaagcttgaagtgatatactctgatgtgtgtgacccaatgcagtgtcaatctcttggtgagagtagatactttgtatcattcctagatgatttcactaggaagatgtgggtgtatatcttgaagagaaagagtgaagtgctagga

SEQ ID NO: 92138 - DNA, 1079 bp, Glycine max
  Peptide Sequence Number=SeqID_208916
gcctttactgatgcccagcaggctgaacggattgaagccgctgataatcatccagccgtcatcaatcagtacacgatccacttcgcgcaggacgcggtgcggatcctggctccaggccagcgtcccatcgccctcatcgcccacattaacctgatgcgatatggcacactggcgggtattgatttctgcgctgaggctgccaattttaagcatatgaaagccgtacagcttgccgagatacgtattcccgcgttgcaggataactacatctggacactgaacgatgaacagggacgctgtctgatcgtcgatccgggtgaagcccggccggtgctggaaaaaattcacgccaatcactggcagccgcaggccattctgctgacccatcatcatcacgatcacgtgggcggcgttagcgaactgctggagcactatccgcaacttgaggtttatggtccgcaggagaccgccgataaaggcgcgcgcactattctcagtgacggtgatgaatttacgctgctcgggctaaatttccgcgtcatcgcaacgcctggacacactttaggacatatctcatatttcagctcaccttatcttttctgtggcgatacgatgttttcgggtggctgcggacgactgttcgaaggcactgcccagcaaatgtttgagtcgtttcaagcgcttaatcaactccctgccgatacgcttatctgctgtgcgcatgaatacactttatccaatatgaagtttgctgcggctattctgcctcaggacccgaaaattttggcaagacttttgccgatctacgcgagaagaaagaccgtttttgatatttctggttgtgttgtgccggtcgctaacgcatcaaggaatgacgccagtatcccggtacagcatgcacagagtctgtcttcagctggtcaaggtgaaaatggaaagtacggagatcgcttgttgtcgccgcgctggcaagatgatggaaccagcctcgcagaagacactgatctctggaatcacattagtgacgagttgaagatggggattccggaaaacccgcgaatccgcgaacaaaaaacaaa

SEQ ID NO: 92139 - DNA, 228 bp, Glycine max
  Peptide Sequence Number=SeqID_208917
atggcgacggcagagcaccttatcagcaaccatctccccagcgtgaaacagctgcaatgctttcttgcggttgcgcacgagctgaactttcgccgggccgccgaacggctcagaatgactcagcctccgctaacccgacagattaagcgccttgaagccgtgctggagcagccgttgtttagccgcagcacccatgacgtcagtctgacggacgctggccgggcgctg

SEQ ID NO: 92140 - DNA, 999 bp, Glycine max
  Peptide Sequence Number=SeqID_208918
atgcacacccgacttttatcgcaaaccctgactgtcagttcgatcggctatggtgccatgggactgagcgaattttatggccagacagacgacaccgcttcactgcagctgttacacgcgcttatcgacctgaatattacgtttatcgacaccgcggatatgtacgggcggggccataatgagcggctgattggccactttcttgccggtctggataacaccacgcgtgagcagtttaacattgccaccaagtgcggaatcgatcgccctgcggaccaggcttatgcccggacgattaacaaccaacctgactacatcacccgctgctgtaatgaatcgcttaaaaggcttggcgttgagcgcatcgatctgttctatcttcaccgcgtgagccaggttacgccgattgaagagagcatggaatgcctgagccgcctcgttaaagcgggtaagatcaaccacattggcctgtgtgaagtttctgcttcaactctgcgccgggcccatgccattcacccgctcactgccctgcaaaccgaatattcactgtggacgcgcgatatcgaagctgagattctgcctgtggtgaaagagctgggtataggtttagttccctactctccgctgggcagagggtttctgaccggaaagtatcgtcataacagcgacttcgctgagggtgatttccgcaaaaataatgcgcgctttagtcaatccagcctcgaccataacgcccagcttcttgacgcggtgcacccgcttgctgaaaagtacagctgcacgccggggcagattgcgctggcctggctactggcgcagtacgacaagctgatccccattccgggaacgaaacagacccgctatctggcggaaaatgcgcaggccgccgatatcgcgctggagcaggcagatatcgccttactgaacgctattcatcagcacattgagatcaggggcgagcgctattctcaggaagggatgaaaagcattaatgcctga

SEQ ID NO: 92141 - DNA, 303 bp, Glycine max
  Peptide Sequence Number=SeqID_208919
atgtcgtgggggctcctccacaccgcccgctgcaacctttgcactttggccatggaagaaatggagaagttggatctcatagaggataggctgagagccatcgaagggatcggtgattatccatttgccgacatggcagaactatgcttagtcctcgatgttgtcatccctcccaagttcaaggtgccagacttcgacaagtacaaggggaccacctgcccgaagaaccacttgaaaatgtattgtcggaagatggggtcatactccagagatgagaagctcttaatgcactttttgcaataa

SEQ ID NO: 92142 - DNA, 306 bp, Glycine max
  Peptide Sequence Number=SeqID_208920
atggagagcaatgcggccatggtttccgccaccaatgccgccgctgaggcggacccgactcactcatccggcataaaccaaacaagtcgtccagtcccgaacatggtaggtcagggagaaaaggtgttaggcaacacgggcggtccccatatggtgcagaataagaattttttcccaccgtacggcctacctcccaactatacaccacccaatgcagtgcacatgcccaacgagaacaccaatcactctattcccattccccttgaaggccaacaaccccagttggggcatgcatccttcgcttag

SEQ ID NO: 92143 - DNA, 1944 bp, Glycine max
  Peptide Sequence Number=SeqID_208921
atgcttgtgaagctgcatttccaattcgaagtggtaaatgcaattgcactttggtttgcccctgtgcagtggccgcacccgcagcatctgattccctcacaatgtccaccacgcctatttaatcggtgcacgatgcgaattcccaagaggcacctctccttttctctctccaacttctctcctcaactcccacctcttttctctcctcgccttcgctttgcctctggaatctgcaccaaaccacctcgctcactcgccaactccacgtcaccaggagttaatccgttgcatgctcaatattcaatggatgggaaccatgaaattgatgtacatgattcaagattgggggatttgcctggccgtgatggcagcaaacagccatttgtctggtcatctcctgaacatggatttaaaactgaaataggcaagcagatattttgtaaccggtcactgaatatgaagaacattgttgctgtgggatttgacatggattatactctggcacagtacaagcctgaaactttcgaatctcttgcttatcaaggcacaatcaaaaagctggtttatgatttgggataccctcgtgaggtgtttttgtgtagatttactaacttccgcatggttcactttgttaaaggattttgtttatttgcatattcttttcagttactaaattggtcttttaactggaagtacatggtcaggggcttggttcttgacaaaaaaagaggcaacatattgaagatggatcgccacaagtatgtgaaagtagcctatcatggattcagagagttatcaaaagaagataaagttgggacctatggaaatactttagtacgcgattcttttgatgaaccagactatgctctaattgatacactcttttcacttgcggaagcctacttgtttgctcaactggttgattataaggattacaatcctggcaagattcaagagggtgttgattatgcttgcatgtacaaagatgttcgagcagcagttgatttgtgccaccgtgacggaacattgaagcaaatggttgctatggaaccaaaaaggtatattaatgaagacccctcaatagtgcccatgctcgaaatgctcagagactctggacgtgcaatgtttttagtgacaaatagtttatgggactatacaaacattgtcatgaatttcctctgcggatccagtatggcagatgtcagtaacaattttggctggcttcaactctttgatgttgttatcactggcagtgcaaagccaggattttttcatgaggaaaatcgtgctaacctatttgaagttgtgcccgagactggaatgctactcaatacagataatggctctcctatgccccaggtgggtaatacctctgcaaggttattcacagaagcaaagaattatgcttgtccagttttccagggaggcaatgttgctcatctgcataaactgctttccattgaatcaagttcccaggttctctatgttggggatcacatttatggagatatactacgcagcaaaaaggttcttggatggagaacaatgcttgtaataccagagctggagaaagaggttaaactcctctgggaatctagagatacccgcaaggaacttcaattcttgaggagtgaacgggaccgcattgaggatgaaatacatcatttgaagtggtctctcaaattcaagaatccagatgctgattccaagcagaagttatcttctgaacttgaaaaattggagtttcacgagccatggggacagcttatgaaaactggttatcagaattctcgctttgctcatcaggttgagagatttgcttgcctttatactagtcaagtttctaacctggccttgtactctccagacaagtattacagacctagtgaagatttcatgcaacatgaatttggtattatggcttgtgaggcaccaggcagttaa

SEQ ID NO: 92144 - DNA, 891 bp, Glycine max
  Peptide Sequence Number=SeqID_208922
atggaggtctcatcaatgggctggcacaagaggcttctaggtgggcctgggtcattgccgccatggtgcacctccaagtgtggcaaatgtacaccctgcagaccggttcatgtgccggtgctgctagggacgctggttactgccgagtactacccggaggcatggagatgcaatggtggtggcaatgacaaatcaattgttaaccatgcagcacagattgcacagattccaaatcagaatgctacaccgcaacaacaatttcagactcagcagaggcaaatgagaatgctaggggggaacttggaattggaacgtttgagaaatattaatgtacagcctctagcacaagtcatggtgaatgaaagtacaggagcaaaaaatgttgtttcttcattaggaacacaaatccaaatagtggaaccatctaatcaggaatttggagctacacagctaccgtttcctgaaatggacacaagttttgatccttacaacttccaagacaatactttgaatcagataccacatgagaacttgaacttcagcctttctgatagttttcagaaccctagttctaaaccaaacaacaactgttcacaacgtgagaccagtacatgtcaaattgacttggacatgaaagattatgtcaatagatcttatatagtagaaaatgattttgcttgtgattttgacatgtttggagcaatgaatggggatagacaaggcctctataaaaaggatgatgaagtggtgacaagcataggtgatgagaaagaggcagaagatttttgtgttatggcacgagaagaagagaagatgaagttgttgttgcaaattgaggcagggattggagaggacaggaagggtactataaacatcattttctacatctag

SEQ ID NO: 92145 - DNA, 330 bp, Glycine max
  Peptide Sequence Number=SeqID_208923
atgtggggactgtcggccttgccggtagcaggatcaatgtggaccactggtctctcagcactaagtggtctagtagacaaggatcgtagatgtgaggctttgtgtgtccgcttcacggcagacggcaaagccgatgcatcggaaggaggaggaggaggaggaggagaaggaggaggggaggcaagtggagaagccatgatcctttatacaagaacatacaacaacatacaaaatccttgggaagaccaaaaggagttgttttatgacccaatgcttgaggcacgtaggagtttgggggctgcaacatatataggagttttcaggatatga

SEQ ID NO: 92146 - DNA, 237 bp, Glycine max
  Peptide Sequence Number=SeqID_208924
atgattatcagtggaccagtgttagttatggtcttggagaaggataatgctattgctgattggcgtgctttaatgggccctactaatgcaagcaaggctaagattactcaccctcacagtattagagcaaaatgtggattggatgtggaaaataattgtgttcatggttcagactctcccaagtctgcgcaaagagagataccatttttcttcaaagagctctctgcaagtcaataa

SEQ ID NO: 92147 - DNA, 153 bp, Glycine max
  Peptide Sequence Number=SeqID_208925
atgactaaggagacttggattcagaagatgatgattggtgtttcctatctacgaaacttgtatttgacttttgttggtatcacccagacaagaatgccagcaatactgaagcttcggagctatttaaagaggttgcatattctcatgctttag

SEQ ID NO: 92148 - DNA, 402 bp, Glycine max
  Peptide Sequence Number=SeqID_208926
atggcatcgagaaggaggagggcatcgttgctgagtcaggcggcggtgcctacctggtctacgaccacgacatcgtgggtggcgcgaagggcaggaatgacaggttgcggatggcaatcgacttcgtctttagagtcttggagtagctggactagaactcgagcggcacatcagagagtagacaaacctagctatgtgataaactcactccagcacgtgctaagggaaggaaggtactatccatatttggaaggttacctttttcaaagtccaattgctgaggtacttagtcaggtttatgcagatcattcaacaaacgtagataatgctttttcacgcatcgttgaaaccacaaggcatccagctgctgcagtgtcatttgcttcgataatgcaatattag

SEQ ID NO: 92149 - DNA, 363 bp, Glycine max
  Peptide Sequence Number=SeqID_208927
atggtgcctgtggaactgttgtggcggggaatgtccctagttgtgatgcttgctgctctggttccctttcgcccttcgaccgtcgtacacgtgattgagactccgcaccttgctcgcttccttgttggccgacaggcctcctacttgactcggaagcaagatcggccaccccggccccagcattgctctaattggagctctgagctggagcagtcttgctttggctcccctgaccgacctcaggcctccagatcaagtgccacagcaggaagggggttggcggagccacgacagcgagattggcctccgcggctatatgcgaagatccttcagcaggagggtgtctggtcccttccgccgtag

SEQ ID NO: 92150 - DNA, 576 bp, Glycine max
  Peptide Sequence Number=SeqID_208928
atgtttcagcgcaggagcaatttgcagccgagccaggaaagcgaggagcattattctgaatcgaagattaaagaggttaaggatgcaatcgagcccttatctggacgaagcttgaagtactgcactgataattgtctgaggagatatctggaagctcgtaattggaatgcggacaagtcgaagaagatgttggaggacacactcaagtggagatcaacgtataagcctgaggatattcgctgggatgaggttgccatggaaggagcaacagggaagttgtacagagctagttttcatgaccgtgaaggaaggatagtccttgtattgaggcctggaatgcagaacacatcttcaatagagaatcagatgcgacatctggtgtatatgctggaaaatgctatgcttaaccttccacaaggtcaagaacaaatgtcatggttgatagacttcactggatggtcgtttagaaacagtgtgcccattaaatcagccaaagagaccatcaacatcctacagaaccactaccctgagagacttgccatagccttttctttacaacctccctcgtgtttttga

SEQ ID NO: 92151 - DNA, 1332 bp, Glycine max
  Peptide Sequence Number=SeqID_208929
atggtggtgcctgagtctcagatgaattcccaaaacgaggtagaatcgccgctacaattggaggagcagcaacaacaacaaaacaacaacaacaacaagaaccacccattctcatcactaggaagacaatcttcttcaatatactcgctcaccctcgacgagttccaacacactctatgggagaatggcaagaattttgggtccatgaacatggacgagttcctcagcagcatatggagtgcagaagagaatcaagttttgaacaattccgtctctaaccacaacaacttgtctttagaagcttcaacagagaaaggtgtgataaggaaggaaccaagccttcctcggcaaggttctctaacacttcctgcacctttgtgtaggaaaacagtggacgaggtttggtctgagatacacaaaggacaacaatctcaacaacaacagcaacagaacaataacactaacaacaattgtggcagtaataataataataatgtacagaataccgaatctgcccctcgccaacctacgtttggagagatgactttggaggatttcttggttaaagctggggtagttagggaacagggtggaatggctgcaatgcctgttcaagcttcagcacatcagcatgtgcaacaatatggcatgtatccaaataacaaccctacaatgggggcttcttttgtcggtaggccggtgatggggatggccggtggcgtccgtgttggcagtggtggtagaaatgtggttgcaccgccttaccaggcggtgcctcagggtggtgttggtgttggtgttggtggtgcaattgcggagtcttcagggtatgctggaaatggaaagagggatgttgggtatccaccgggggcgccgggggtttgctttggagggagggtggtgaatggtggcggtggctatgcggcagtgagtaatatgggagtggtggcgccggttagcccggtttcgccggaggggataggaaccggcgaaaactctggtgggcagtttgggatggacatgagtatgttgagagggagaaagagggtgttggatggtcctgtggagaaggtggtggagagaaggcagaggaggatgatcaagaacagagaatcagcagccagatctagagcaagaaaacaggcatacactgttgaactggaagcagaattgaaccaattgaaagaagagaacggccaacttaaactagctctggccgatcttgagaggagaagaaagcaacaggaagtgaatggaagagttcaaaccaacgcccagaaggccaaaaagaaattgagatcattgagaaagaccctaagttgccctttatga

SEQ ID NO: 92152 - DNA, 591 bp, Glycine max
  Peptide Sequence Number=SeqID_208930
atggatagcgatgaatctggtggtcatgtaatcgtgtcgggggtaaggttgtgggtggttggaaaattggttggtaagtgtctaggagcttttggagggccatgggtaaaggaatatctggagaagggggaagagaaggactctcgtgaagctgaagcgccggatctgggcatgggtggcctctactgggctgggtcccttttggccactaagaactactgtgggctgggtcgccaggtgaaggaaacgagctatgtgatcctgaataaaattgtgcttactcccgccgtcgacaaggatgacgactttgtgaccctggacggaacctgtgacgcgcagggtggacgatacggaatgtctggccatgacatgcagaatgggttcatctgggaggggttcgtcaggagcgacgagaaggaagaatttggctctacacctgtggtttgtggtggcgccaaaagtagaggtggagggggtggtaccaaagtaatgggaggggcgacgaaggaggaattggggtgtcaaggacacgatggccatttggcgtcgttgattttgtcttcttgtagcttcgctagtgccgcagcctga

SEQ ID NO: 92153 - DNA, 840 bp, Glycine max
  Peptide Sequence Number=SeqID_208931
atggtacttacaaattgcttgctatgggggatttatggaattcttggaacagcactagcagtgttgtttattgggtttttagcatgggcttatcaggttattcaacctcccgctcccaagatatgtggcacttctgatggaccgcctataacagcaccaagaatcaaattaagagacggaaggcatttggcatacaaagagcatggcgttccaaaggatgcagccaagcatgatactgtggttgccaataccctatcgccggatgttgttgaggagctggggctctacattgtatctttcgacagacctggttatggggaaagtgatcctgatccaaatcgtactttaaaaagccttgctttagatatagaagagcttgcagatcacctgggattggggtccaaattctatgtagttggtgtctccatgggtggacaagttgtttggaactgccttaagtacatacctaacaggctggcaggtgcagtactcataagccccgttgtgaactactggtggcctggtcttcctgcaaacttaactactgaagcattttctaaaaaaaaattagaagaccgatgggcacttcgtgttgctcactacataccgtggctaacttactggtggaacactcaaagatggttccctgcctctactgcaattgctcatagtccagataacctttctcatcaagacaaagaacttgtgcctaagatgtctaatagaaagagttatgtgccttcccctcgtataggcaaagaggctatttccagattggagcccatgaccagccagttaccaaggcacaactttactgttgcggcaggactcgccctctaa

SEQ ID NO: 92154 - DNA, 288 bp, Glycine max
  Peptide Sequence Number=SeqID_208932
atgaaacttctggctagcatggagagtaatggcaagggtgtttcaattgatggtgtccctctaccatttgaggctggtgaaattgattttggtgaaccaggaactaatgggcagcatagcttttatcagctcatacatcaggggcgagtaattccttgtgattttattggagttgtgaaaagtcagcaacctgtctttctaaaaggtgaagtggtgagtaaccatgatgagctaatgtccaactattttgcacagtctgatgcccttgcatatgggaagataaagtga

SEQ ID NO: 92155 - DNA, 840 bp, Glycine max
  Peptide Sequence Number=SeqID_208933
atggttgagactgttgcacaatttggtgtagtgtttcttctctttgctttggggctggagttttccctggcaaagttaaaagctgtgggacctgttgctgttcttggagggctacttcaaattatcatttttatgttcatgtgtggcattctttccatgttatttggagccaaattgtctgagggtgtttttgtcggttcctttctatcaatgtcatcaacagcagtggtggtgaagtttttagtggagcggaatagtaataatgctctccatgttcaagttacaattgggactcttatttttcaggattgtgcagtgggtttactatttgctttgctcccagttttgggtggtaacagtggccttttacaaggaataatgtcaatgggaaaactgttgctagtgttgtctttgtatatcactgctacgtctgtattgtcttggacatttgttcctcgctttcttaaactgatgatgcggctgtcatctcagacaaatgaactttatcagctagccgctgttgctttctgcttgttatctgcatggtgcagtgataagcttggccttagtctcgagttgggttcatttatggctggtgttatgatttccacaacagactttgctcaacatactttggaccaggtggaaccaattcgtaacctatttgcagctctctttctctcaagtattggaatgcttattcatgtgcacttcctttggaaccatgtggatatcttgctggcatctgttattctggttgtagttgttaaaactgctgttgctgttttagttacaaaggcctttggttatagccttaagacatcatttattgtaagttaa

SEQ ID NO: 92156 - DNA, 255 bp, Glycine max
  Peptide Sequence Number=SeqID_208934
atgtatcttcttcttctagggactacagctcttagtctggttacaactccacttttgtttaaattgattcctgctgtcatgaatctgggtgttctcatgcactggtttccctctgaaagtagctcacaaattgagaccattcttattgcttacgctaatcctatcacatcatacactggtttgcctataattggtataagggtgctacagatgaaactagaaaagaattcacagtgtaacttctttgaagattga

SEQ ID NO: 92157 - DNA, 477 bp, Glycine max
  Peptide Sequence Number=SeqID_208935
atgtcaggggaaggtggtgtctttcctgctttaaccacgtgtgagaagattctaggccttcttaagtctggtgggcttgggggcccacaggcttctgagaaaatgatggctttgaagtttgggtgtattgtagagggtgcgtttcgaaagaagaaagtgtggagcgtgagaaccttgttggtggctttaattgttgaaggagttcttgacttggaactacgaatggaaatgatatgctggatctataaagcaaggttgtctgctattctcactggtttttttccatctttaacagaacctgacaaaaacagcttcaatagcagtgtagctgatcagcaggctgtattggagactgtagcaaaaattactcatgataaagcaaagagaaatgatacacatgagggaaagtatggttatacttatatgttccccgatgtagtttctcagttgcatcttataatggattattggatttaa

SEQ ID NO: 92158 - DNA, 168 bp, Glycine max
  Peptide Sequence Number=SeqID_208936
atgtcagttcctgaggctccttattctgcatctcacagtaacatttttaggccagatcagtgcaggtgggttgaggaatcatgtgaggaaggaaaaaggtttcttcgaggccctgagataaaaagatatgataattgtcaaagcaaaggatcaaatctaggtttatga

SEQ ID NO: 92159 - DNA, 1032 bp, Glycine max
  Peptide Sequence Number=SeqID_208937
atggccgtggatcttccctcgcatctcttctcgcgccgaaacctgcacttccattcaacgccgctctacgacctcgccgtttacctcaaaacgacgcccgtgactgtgatttttggccacattgccaaggtttttgggggctctgtgattgcaattgtggccgcaccagttcagaaacttatctcaacagtgtttataaggggtcttgttcaatcttctgaaactgcagggcatgttagaggattttctagctcgaatttagattggaggaggcttattgtgaaccagaatgtgaatgcagatgcaaatgctcatccagattctatgcaggatatagagaaaagaaactccgaaaagtggaataatatgagacagaatatgaatccagatgcaaatgctcctccaaattttgtgcagaatagagggaacataaactccagaagctggaataatatgcgacagaatgtaaatgctcctccaaattttatggggaatagagacaacataaactccagaagccagaataatatggaccagaatgtggatgcaaatgcagatgctcttccagattttatgcaagataaagagaacataaacatcggaaacaagaattatgctgagactggctggaactctaggcctatggactttgtaagaggaattatagatgaagataattttgggaggggttctccatatcatcagtatcaatatgagcaggatgctgattttgttcatataaagatgttgcgtaataatacctttgttactgtaacagattctaaaggaaatataaaactcagtggctctgccggtccattgaaagacctgaaatcagggcaaaagctttctaggtatgctgccgaggcaaccgcggaagttgttggccgaaaggctaggggcttgggattgaaatctgttgtcatgaaagggatagaaatccaattgtatacattgaagataccactagaaaaccccataatggctgcagactcccaaagaaacgacgaatttaggtgttatgatactgag

SEQ ID NO: 92160 - DNA, 276 bp, Glycine max
  Peptide Sequence Number=SeqID_208938
atggcgatgaagctgcaggttcttcttcttctcttgttatgtattgcatcggaactgacgacccattcagtctcaaattctctcgaacgttgcgatgctgaaactgagtacaactcctatggctacattgatgagaggaagaaggcattgaacgactcatcatgtacttaccaagtggtcataggtgcaagttgttcatcgcccaatttcacaatgggggacatcattattcgctttggggatcctcttcgcaaccaggggttccaagaagattaa

SEQ ID NO: 92161 - DNA, 192 bp, Glycine max
  Peptide Sequence Number=SeqID_208939
atgaagatgaattgttccggtatcaaatgtccttcacaggaaaatgctcaacatttgatgcataaaaaacaagtttcgtgtgggaagcctagatgttggagatcagggacttttcctctatgtgatggaagccatgtaaaacacaacaaagccaccggagataatgttggccctcttcttttgaaaaagtaa

SEQ ID NO: 92162 - DNA, 255 bp, Glycine max
  Peptide Sequence Number=SeqID_208940
atgggccctgtaaaggtaaccctagagatgcacgttgctggaggtatatatattggaccaaaagttaattgcacttttttacaagcgttcagcttctctcaccattctgcttctgatcttcttcctctgctttcacaagaagcggaacctggcggcgaaacacagctcagggagcatccctctagtgtccaaggagatcaccatggtcaaggcctcggatccgaagaagatggaggaggcggaggtcaaggttga

SEQ ID NO: 92163 - DNA, 318 bp, Glycine max
  Peptide Sequence Number=SeqID_208941
atgtggttcaatcttctttccctggtcattgctaggtgttggggctggagtgccaaaagggatgggtttcagagaagcaaagggttggggcataataaatccatcaaggataattttgtccaatcacaaaaactcaaggggcgcatgaaaaaggataaaagcaatgagctcaaggtggttctccaatctgagttagggttgacacatggtagtgataaggtgttgttgggtggtttctttgtaggacaatatggttgtaaaaaggggcacaatctcaggagctttgagaatttggtatttaaggagggtactgcatag

SEQ ID NO: 92164 - DNA, 276 bp, Glycine max
  Peptide Sequence Number=SeqID_208942
atgataaagtttgttctatttttgttctgctttgcctctgcactgaccctttcagtatcggagtccaaatcagcttcagtgcaacctcatgctgctgaatctttctctgttggatatattcagatgaagactgcagcgaactgttcttacctggtagttatatctacgagttgttcatcgcctaagttcacaacggataagatcggtatcacgtttggggatgctaatggcaaccaggaaatattgatgaatattttgtttctagaagagttataa

SEQ ID NO: 92165 - DNA, 276 bp, Glycine max
  Peptide Sequence Number=SeqID_208943
atggggtgttggggagcaggggttgtgcatgacacaaaggtattggctgggttgtgccgatctagacagagaaaacattgtgcgtatttggtcttggatcctaattcggtttcggatttggagaaagagtgttggggctatagatttgtgggaagggatgaggaggagaaggatgtagctagctcagcctctccagatctaagaacgagatcacttgctgcggagtcaccgcagcagctatcgatgggggcagaagaagcggcacagccaagttga

SEQ ID NO: 92166 - DNA, 1347 bp, Glycine max
  Peptide Sequence Number=SeqID_208944
atggggtggtacagaaggggaaagctcgctcttgatcattttcgtagattggcttcaagggttacccctcaaaatccaatttttcagcgtggtgcgaggatttgctcatctgggtatttggattcaggttctaaagtagctagctttaatgggttctcttctttttgttcaacttctcagagattaggcacacggggtgttgttggagttaacaggaactttcacaattcggttctttttggggctaagagattttactatgttgaccctcgcaatgtgcgtcatttcaagccaagagggccatggcattggtttgagaatcctaggcatgttttcattgttgtgatggttggttcaggggttttaatcactgtgtattttggtaacatagaaacagttccttacacaaagcgaacccatttgattctgttgtcgaaagccatggagaggaagcttggggagagcgagtttgaacaaatcaagactggttttaaggggaagatattgcctcctatacatcctgagagtgtgagagtgacaatgattgccaaggatataattgatgcattgcagagagggttgaggaaggaggaacaagtgtggagtgatttggggtatgcatcagagcatgctatgctggttgaaggggatggaagggagacattgaatgcattggctgggagtgaagagaagattgaagggaattgggccaaggaggatgagattcttgacgataaatggattcagcagagccggaaaaagggtcaggaaagagggtcacaagctgcaacatcacatttggatgggttaaattgggagattttggtggtaaatgagcctgttgttaatgccttctgcttacctggtgggaagatagttgtgttcactggtttgttagagcattttaaaagtgatgcagagatagcaactattattggacatgaggttgggcatgctgttgcaagacatggtgctgaggggattaccaagaacttgtggtttactattctacagttgatactttatcaatttgttacacctgatattgtccacacaatgtcatcccttttcttgcgcctacctttctccaggcggatggaaatagaagctgattacattgggctgctgttaattgcatcagctggctatgatccgcgggtggcacccaaagtgtatgagaagctgggaaaaatcactggtggtaattctgccattggggattatctctctactcatccttctggtaaaaaaagagcagaattgttggcccaagctaatataatggaagaagcagttactatatatagagatgtaagagcaggacgtggggttgaaggttttctttag

SEQ ID NO: 92167 - DNA, 828 bp, Glycine max
  Peptide Sequence Number=SeqID_208945
atggctacaccactcagctcacctccttctcctactaagtcagcagcaccttcttcaccgtcttcgtcgaagaagactaaaaaagcaacacaactcaaatcgttgcctactagaccagctcgggtggagagaccagtggtttatgttgatcttgtcactaagaaagccaatgatctaacctctaaatgggccctggcacacggcaaggaagagtcaagagatccttcaggggagaaaaaaaagttgatggaggagaagcaaacaaaacgattggaggaagcaatccaatctgggagcactaaaataatcgttgatcctccatctcccatcagacgacacgtgaaatggaagatggtccgcacgaagaaaactaatcaaatgacgtctaaggttgtaaaggaaattacaggcaggattgattcctttgaggagaagggctcacaagacagctttgtcgcccatggatatcaggatgtactcactgctgccattaggcgaccagagcaccctagtcgtgtctgtgctgctagagccggcgtgacaatcaaacactactttggacaggcttcaaagggctcccgcacctcttcctccatggttgctgaagacctagagttgctaacaaaaaagattagagaccagttggaggagtcgatcacacaaaaagtgactcaacaattaattatgttcttcagccagatgaaatcacaaggactcacactgcctcctgagtctgaggttggtccttttgctgctcatgggtccacaaccgtccacaacgttcctttaggcaatgatcaagtgaaggtcggtgttgaggacgtctaa

SEQ ID NO: 92168 - DNA, 450 bp, Glycine max
  Peptide Sequence Number=SeqID_208946
atgttagatgtgagggaacaagttcgggatggttggagatggaagacaagtgattcaggactgtactctatcagtgaaggttacaaagttctacaacatcaaagctttgcaggggagatggacaactgctctgattcaatctggaagatggccactccatcaaatgtgaaggccttcacgtggaaagcattgctggatagaatccaatcaaaagcgaattatgcagaggaacttattaatgggtggtggaaggcaatatggcaagctagcagtggtgtggaatctatatggctgcataggaactcgataattttcaaagaggaagagagtaatattcgaaaagtaatagagctaataaggctatcatccaaagacaagaggcttttaaatcttcatggcaagcatggatgctgttgcagaggccgggctcctttacccgagaggtcttag

SEQ ID NO: 92169 - DNA, 335 bp, Glycine max
  Peptide Sequence Number=SeqID_208947
cgcctgtgcttcctctctcgcttagcgcttctcgcgatgtagggaagctaatatgtagcaatttgggagttgctaagttctcaagttgtggaactatgattagctttacatttgttgcagctgatgcgctctatgatataggcactggcttggaagggatggcagttgttgtagcaagagcaacaaggttgcctatatattcttcatttgccaaagaaggaaatttcagtgacctatttgctaaaggagaggcattttcaactctctttgatgttattggaattggagttgggattcaattagcatctaccatctgtgtatcaatgcagggagag

SEQ ID NO: 92170 - DNA, 474 bp, Glycine max
  Peptide Sequence Number=SeqID_208948
atgacatctgaagcttatgtacctaaaagatatgagtcgctagagaacccttttgctcataaaccgcgtaagcgttcccaccaaggctctggtttatgcgggtgccttagaaaggaaaataaggtatactctgatgttgtcattgtcgtgaaagcggataatcagaatgaagacattggattggactatttagataatgaagttgggataatgtacttaggatctcaacttagctcggggcagatccctcctttcttgcagccagggaagaacacaacaaagaagtggaaggcagaggaaattcgggttggcgtggcttacttggctttggttattgggtatgggggggttgatgaagagaaatttgcagaggcagttaaagcacgagtaatgtcaaatgccatatcatttgaggtgtatatggactctaatacaggggagaccagtttcaggcagaaaaagatagtcagatag

SEQ ID NO: 92171 - DNA, 1590 bp, Glycine max
  Peptide Sequence Number=SeqID_208949
atggggttccaacaacatgggaatatggaagtggggttgtctggaatcactttgggaacaaagaacaagtacaagaggatgaactccgagcttccggaaggttacgatgatgttttgcatcaagaagcaaggagaaacagtaccaggaaatatgtcatagcctgtgccttctttgcttctctcaacaatgtccttcttggctatgatgtgggtgtgatgagtggagcagttatatttatcaaagaagatctgaagatatctgaggtgaaggaagaatttttgattggtatattgagcattgtttctctgctgggaagtctaggtggtggaagaacttcagatattattggtaggaaatggacaatggccatagctgcagtgatttttcaaattggctcactcataatgactcttgctccttcattttcaatactaatggttggaagacttttagccggtgtgggaataggatttggaggcttgattgcccctatatatattgcagagatatcaccaaacaccaccagaggctttctcactaccttcccagagattttcattaatctaggaattcttcttggttatgtgtcaaattatactttttcaggcttttcaccacacataaactggaggataatgcttgctgtggggattttgccctcagtcttcattggctttgctcttttcatcattcctgagtcaccaaggtggttagtaatgcagaaccggatcgaagaagcaagatcagtgcttctgaaaacaaatgagagtgatagagaagtggaggagaggctagcagaaatacaacaggctgctggtttggccaattgtgaaaagtatgaggagaaacctgtgtggtatgagctgttgtttccttcgccttcgcttcgccgaatgatgatcacaggaattgggattcagtgttttcaacagatttctggaattgatgcaactgtgtattacagccctgaaatcttcaaagctgctgggattgaggataatgcaaaactcctagctgctactgttgttgtgggtgtgacaaagaccctttttatattggtagcaatctttcttattgacaaaaaaggtagaaggccactactctttgtaagcacaattggcatgacaatttgtttgtttagcataggagctagtctttctttgtttccacaagggtcatttgtgattgcattggcaattctatttgtttgtgggaatgtggctttcttttctgttggattaggccctgtgtgttgggttttgacatctgaaatcttccctttaagagtgcgtgctcaagcatcttcacttggagctgtgggcaatagggtgtgtagtggccttgtggccatgtctttcctttccgtttcccgtgcaatttcagtggctggagcattctttgtgtttgctgctatttcttctctagccattgtctttgtctacatgctagttcctgagactaaagggaagtcattggagcagatagagatcatgtttaagaatgaacatgagaggcaaggaagtgaaatggagttaggagatgttgaaattgaacaatttgtgcaggacaaaacagttttgacaaattaa

SEQ ID NO: 92172 - DNA, 477 bp, Glycine max
  Peptide Sequence Number=SeqID_208950
atggtatggaggcaccagatgattgctgcagcaagtgctggctaccaggctattgcctttgatttcagaggctatggactttctgagcatccggcagagccagaaaaagcaaaattacttgaccttgttgatgatgtcgtgggtcttttagattcattaagcattaccaaggttgtgcttgttggtaaggactttggtgccgttccagcatatattcttgctgctctccatccagataaagagccagggagagcagaagcagattgttgccactttgatgttaagtcggttataagaaacatctacacactcttttctggaagtgagatactagcaggcgataatcaggaaatcatggacttgtataacccatctactcccctgccaccatggttctctgaggaagacctggcaacctatgtatcactgtatgaaaaacctggcttcagatttgcattgcaggttccatacaggtaa

SEQ ID NO: 92173 - DNA, 1269 bp, Glycine max
  Peptide Sequence Number=SeqID_208951
atggctgcagcgaacagtggcaaattcgatgtgggagatgaaactcacaagaattcacgaaagggtagtgaaagccaagattgggagattgagaagggaaagtgcgtggattgttcaagctctcagaggcgtcaatggaagccagtttttgatgacgtttccatctcatacaatagacccttcaagaaaatccgaagccccgatcgccaaaacacaaaccaatcttcttcttcctcttcttcttcttcttcttcttcttctattccttttcaaccttcacctctctctaatcctccttcaagaatagtgttcccttttgcctttgatggttcccaacagcaccccatgcaattccctcaccaatttggaaccacaaacccacctttccctcacccttctctccaaaaccagcaacaccagatgatatcatttgggtcttcccaacaacataataatctcgcatatccacccatcatagccagtgattcttcttcacttctacatcaacatcatcatcatcaacagcagcatcagcagcaccagcagcaacttcttcagtattggagtgacgcgttgaatctaagtccaagaggaatgttaacaagattgggaccagatggaaggccattgtttaggcttccaacacagcccataaacacaacaaaactctatagaggagtgaggcaacgccattgggggaaatgggtcgctgaaatccgtcttccacgaaacagaacgcgtctctggctaggcacatttgacacggccgaagacgccgccatggcctacgaccgagaagccttcaagctacgaggagagaatgctagactcaatttcccagaattgttcctcaacaaggacaaaaaagaagaacaacaacaacaagaacaagaagcttcttcgccagttctttcagctattgcaaagcagcatgaaccttctagtgaacaccgtgacgtccccatagaagagtctaatgagaatgattcgggtgacgccacggtgagcgatgaccaggttcatgctactactgagagttccgaaggagtttctcaggaaatggtttggggagaaatgtctgcatggttcaatgctattcctgctgcttggggtcctggtagtcccatgtgggatgatttggatgccaccaataatcttctttgccaatcacacattcctttttccaatcccaatcaacaagaactcaatgatgctgagagacaagaacaaaacactggaccaggttacttgtggaaggatcaggattga

SEQ ID NO: 92174 - DNA, 2058 bp, Glycine max
  Peptide Sequence Number=SeqID_208952
atgtttgacatatttttcggttggtccaaagcttccaaatgtaagaaggcgatcaaacgagcccggtgccggctcaggctactcaagaacaagaggcaggcaatagcaaggcaactgagaaaggacttggctgagctaatacaaagtggccatgaagaaactgcatttaaccgggtggaacagcttatgggagatgaaagcttagcagctgcgtatgaattgttagatcacttttgcgaatttatccttacggaactctcctacatccggaggcacaaggactgtccaaatgatattaatgaagcagtttctagtcttatatttgcttctgcaagatgtggggatcttcctgagctcggtgtcatcagaaagctctttggacagcgttatggtgagaggtttgcaactacagctgtggagctatcaccagggaatctacaaagtgtaatatctttactttatgaaatttcgtatttattaatgatggatacatattcatggaatttcaaaacaaagttgaaagagaacctgtcagcgaagtctgtgccggatgatatgaagtacagaatggtggatgaaatagccagggataactgcctccaacaacaggttttagccatacaatactaccctgattggcaacaagtgcaggagaaagaaaataaagggtatcagctagtggaaagtgatgccaaaataattgacacaattggaggatctaaagtccaaccttcagagataaaaagagatgtcagatgtgttaccatttccaaaccaagtgattcttgttctctgccagaatctagcttagctgatacttctgctatggtgtctgctgttcagcaatatcccccatatttcctgagatatcctatggagaagaaagtagtagagatagactttcctgatctactttcttctataaattttgatttgcaaaacaagggggaaagaatggccttaatatcttctgcacaaagagtgagtttccctccctgttctgaagaaatggtagattatgtggatgacattaaggaattttctgtaccaaataatgctgcctgccaggaccaaatgctatttaagttcagatcttctggtctgtcaaggagagaaaaaactcaatttgattttgatgatagtgaaatgggtcaagatggatcagagagtgagaactcaagcacaaggacctctacaaagagcaaaaggagaccagagaaaaaatcaagaaggagatcatcctccatggaaaaccttggccttatggatattggatacgtgatatattatcacaagccatgcaaaagtccgttagctcagaagcatcgtagcagaaagcaccataagccttcactagaaggaatttccccatcaagttatggccagaagagactgatgctacatggtttctcagaagagggaaatgttttacagtcaagtcacagccaagatggcacaaggagaaaacttttcaactttaaaatgagtggctgcagcttggaccagccttgttatttttgcgtatatgatgatgaagactatttggaggctcaatcaatgaagcaaaagagagggatcagagccacacatgttcaacaaggagttttgcatgatgaatgttgttgttgccaacccttttgggatgatgagttgaaccaaggaattgaattggttaccatccctcagagaccaaataggaggaattatagtgcttcagctgagtatcatgtattcaactacacagattgccaagctggtaatggaaacaatgaaacaaaagaagaaatctctgcttctcccaaagtttccaatccaaggactggtggttcctcaccaataatagaaacagaagctacctattcaagggccatgaccatgccccaagagaggcacagaaacaacaaagataagatgttaaggacatattcttgtccttctccacatcctagtcatgttcatcctaagttgccagactatgatgacatagctgccaagttcactgctctcaagagagagcgcatggaaaacatggactgcagtaaggaccaaaacaaataa

SEQ ID NO: 92175 - DNA, 963 bp, Glycine max
  Peptide Sequence Number=SeqID_208953
atgtcacatcaagatattttcaacatatttctgaatgctgcaaatttctccaagcatgatgaagggggcactgaggagactatgtcttttgaagatttcagaagctggtgtactcatcttccctctgtgaggaagcttcttggaagcctgcttttgtcacctgattcaggtgaagtagttgacaccattattaggaggattaactttatgtgccttcaaaaactcatgtgggatgacaaaaatgctacagagttaggcactttaggatttcaactctggtgcacaggacgacctggttatcagattcctaaactattgacttcgaaggctattgattctaacattatacttttgagaaaggaatatgcttggcatattggaggagcactctctcaccaagacctggaagattggaaccttttgtatcatagttctctcaatggtcttagttttaatacattcttgggcaacatttcaaatcatgcaggcccaactgtgttaattattaaggataaagagggttatatatatggagggtatgcttctcaaccatgggagcggcatgctgatttttacggagacctgaaatgtttcctttttcaactaaatccagtggcatctatattcaggccaactggagcaaacaataatctgcaatggtgcgctatcaacttcagttcagaggacattccaaatggcattggctttgggggacgagtgaatcacttgggtttgtttatatcagcaaactttgatcaaggacatacattttcgtgtaccacgtttggtagcccttgtctctccaagactaaccgtatattgcctgaagtaatagaatgctggggagtcacacaagatgcgacacaagacaagaatgatgctgtcaagggcactattctggagaggttcaaggaagatcgcaacatgctcaaaatggtaggcctagcaaattccagcgagtaa

SEQ ID NO: 92176 - DNA, 3126 bp, Glycine max
  Peptide Sequence Number=SeqID_208954
atggtgttcatcgtgtcacccaatcacaaaaccttctccatagacctaaaccctaacaccaccactcttcatctcctcaaactcgctatacaacaaaccctaacccttccaatctcccaccagcgcctcttcctctcccacagtcgccgattaaccgccgacaatgacggttccgacgattcccttcttatctccgatctcggcgtcggaccctactcaaccctaaccctccacgtccccttcctcggcggcaccaaccctccggcggtgcccaaaccgcgcttcgacttcctcaactccaagccgcctccgaattacgtcgccggtctcggccgtggcgccaccggcttcaccacgcggtccgatatcggtccggcccgtgccgcgcccgaccttccggaccggtccgccaccaccatcggcggcacctccggcgccggacgtggccgcgggaagcccggggaggatgaggacgacgacgagggcgaggacaagggatacgatgagaatcagaagtttgatgagttcgaagggaacgacgtcggtttattcgcttcggcggaatacgatgaagatgacaaagaagcagatgcggtttgggaagcaattgataagaggatggattcgcggaggaaggataggagggaagcgaggttgaagcaggagattgagaaataccgcgcttcgaaccctaaaatcactgagcaattcgctgatttgaagaggagattgtataccctttctcctgatgattggcagagtcttgagaagttcgagagtggggggtattcgtcgaggaacaagaagaagaggtttgagagttttgtgcctgtgcctgatacacttttggagaaggcaaggcaagagcaagagcatgtgacagcattggatcctaagagtagggctgctaatgggactgagactccttgggcacaaaccccggttactgatttgactgctgttggtgagggtagaggaactgtgttgtctttgaagttggataggttgtcggattcggtttctgggatgaccaatgtcgatcctaaagggtacttgactgtgcttaatagtatgaagattactagtgatgctgagatttcggatttcaagaaggctaggttgctgctcaagagtgttacgcagacgaatccgaagcacccaccgggttggattgcggctgcgaggctggaggagttggcggggaagctgcaggtggcgaggcagttgatacagaaagggtgtgaggagtgtcccaaaaatgaggatgtgtggctggaggcttgtaggctggcgaatccggatgaggcgaaggcggtgattgcgcggggtgtcaagtccattcccaattcggtgaagttgtggatgcaggcttcaaagttggagaatgatgatgcgaataggagtagggttttgaggaaggggttggagcacattcctgattctgttaggctgtggaaggctgttgtggagcttgctaatgaggaggatgctaggcttttgcttcacagggctgtggagtgttgtcctttgcatgttgaactgtggcttgcgcttgcgaggttggagacttatgacaatgctaagaaggttcttaatagggcgagggagaggctgtccaaggagccagctatatggataactgctgccaagttggaggaagctaatgggaatacttccatggttggcaagatcattgaaaggggtataagggctttgcagagagaaggtgtggtgattgatagggaagcttggatgaaggaagcagaggcagctgagcgtgctgggtcggttgtaacttgccaagcaataattcataatactattggggttggagttgaagaagaagataggaagaggacatgggttgctgatgctgaggaatgcaagaaaagaggttctattgagactgcccgagctatatatgctcatgccttgactgtcttcttaactaagaagagcatatggatcaaagcagcccagctggaaaagagtcatggtaccagggaatctcttgatgcattacttcgtaaagcagttacctacagaccacaggctgaagttctttggcttatgggtgccaaagagaagtggcttgctggagatgtgcctgcagctcgtgctatcctccaagaagcttatgctgccattcccaattctgaggaaatatggcttgctgctttcaagctagaatttgaaaaccatgaacctgagagagctaggatgctgttggctaaagccagagagagaggaggtacagaaagagtctggatgaaatcagcaattgtggagagagaactggggaacattgaagaggagaggagattgttagatgaaggtctgaagcaattcccttcattctttaaattgtggttgatgcttggccagcttgaggaacagcttgctgagaatgcaaagaggcttgatcagcctgaaaagtggcttgatcacatgaatgcagctaagaaagtctacgaatctggattgagaaactgtcctaattgcgtaccactttggctctctcttgctaatcttgaagaggagatgaatggactgagtaaagcacgtgcagttctcacaatggctcgcaagaagaatcctcaaaaccctgaactctggcttgctgctgttagagcggaattgaagcatggatataagaaagaagctgatattttgatggcaaaagcattgcaggagtgtcctaacagtggtattctgtgggcagcatcaattgagatggttcctcgtccccaacgtaaaaccaagagcgcggatgccatcaagaaatgtgaccatgatccccatgttattgccgctgtggccaaattattttggcttgataggaaggtggacaaagccaggacttggttgagtagggctgtgacactagcgcctgatattggggatttctgggcattgttatacaaatttgaactgcagcatggaacagaggagaaccagaaggatgtactgaagagatgtattgctgctgaaccaaaacatggagagaaatggcaagcaatctcaaaggctgttgagaattctcatcaaccaacagaatccatcttgaagaaagtagtggttgcacttgggaaagaagagaatgcggctgagaataataaacattga

SEQ ID NO: 92177 - DNA, 885 bp, Glycine max
  Peptide Sequence Number=SeqID_208955
atgttcctcctcagacgctccactctccaagagtacttacccttccaagcatgcacatgcaggttagatggcaaagtagcactcataaccggcggagccagtggcatcggtgaagccaccgccaagcttttccttcgccacggtgccaaggtcgtcatcgccgacatccaagacaacctcggacactccctatgccaaagtctcaattcctccgacaaaaacaacaacgacgacatttcctatgttcactgcgacgtcaccaacgacaaagacgtcgaaaccgccgtcaacgctgccgtctcgcgacacggcaagctcgacatcctcttcagcaacgccggcatcacgggccgttccgactgttctaactccatcacggccatcgacagcggtgacctgaagagggtcttcgaggtgaacgtcttcggtgccttctacgccgccaaacacgccgctaaggtcatgattcccagaaagaaagggagcattgttttcactgctagcatcgcttctgtgtcgaatgcgggttgggcgcacccgtacgcggcgtcgaagaacgcagtggtgggtttgatgaagaacctgtgcgtggaattggggaaacatggaatcagagttaactgtgtttcgccctatgcggtggggactccaatgctgacacgtgcgatgaggatggagaaggagaaagcagaggagatatatttggaggcggcgaacttgaagggagtggttttaaaggaaaaggatgtggcagaagcaactttgtttttggctagtgatgagtcaaaatacgtgagtggagtgaatctagttgtggacggaggttatactaccaccaattcttcttccaaacaagctttcacaaagttttcttttaatgtttaa

SEQ ID NO: 92178 - DNA, 306 bp, Glycine max
  Peptide Sequence Number=SeqID_208956
atgaacattgaagataatggtggcttacgtgtacttgccattaatatcctgggaagattcttgtcaaaccgtgacaacaatatcagggaatgtttcggtaacccgtggcacccaggtggagttctaaatctggccatggttgagagtgtggacaatcagaaggtagcaaatcatcttgaccgtatggtatcaacccttggaagaaatcctctcaaggttttggtgcaagtaaatacaagtggagaagaatccaaatctggcattgatccttccaaatgtgaagagcattatttttatatattataa

SEQ ID NO: 92179 - DNA, 210 bp, Glycine max
  Peptide Sequence Number=SeqID_208957
atggatagtgcgttttcacatccatatatgcatatccatgaagcccccaaagacacgagaccacctcttatccatctgctctccgcgtacatcagatgcaagatcatcataggcaccaaccatacgtgcaacaatacaagggtaatggcttacctcggtaaggcttgtaaagaccttaacatatctaggagtttggcatccattctatag

SEQ ID NO: 92180 - DNA, 255 bp, Glycine max
  Peptide Sequence Number=SeqID_208958
atggaaagtgtcctaacagcaagtgggctatcctcattttgctgcgcttcgcctccctgcccaagtatttggagctttgagagagtttggggtgtggtgaagttagagatctctgctttggtgtgttatttatcgaccaagaagaaacttctttcacagttgaaaatttcaattgcggaagaaggttctttagtgaattcctgcggaagaacttctttcgcgagattgcacggaagaaggttcttccacaattga

SEQ ID NO: 92181 - DNA, 972 bp, Glycine max
  Peptide Sequence Number=SeqID_208959
atggcgtcgttcgaggaacaatcacatcaatcgccgacaaggggacccttcgacgatgacaacagctacacggacacggacatgggcatgggctacgagtctcatcagcattacgattacgatgatcaacaccctcaactcaacgtcgatccaaataacaacaatttcaccgataactcacattctccttctgtttatggctttggtgtttccacccctaaccccgaccacgtgtcccccttcgaacccgctaccgccgatgacaccaccttcacctccgacggtccaatgctcccggacccatctcaaatgcaagaggaaggccatgctagacgtgaatggcgacgtctaaatgccattcatcttgaggaaaaagagaaaagagagaaagagatgcggaatcagattataaaggaagctgaagagtataaggaagctttctatgagaaaagaaaggtcaactgtgagaaaaacaaagagaacaatagggaaagagaaaagatatacttggccaaccaagagaaatttcacaaagaagctcacaaccattactggaaagcaatagctgagataattcctcgcgaggttcctaatatcgagaagagaagagggaagaaagaagctgagaataagccttctgttcatgttattcaaggtccaaagccaggaaaacctactgatcttgcaagaatgcgccaaatgattttgaagcttaaacagaaccccccttctcatatgatgcctcccccacccaaagaagagaaagattcaaaagaaggcaaagataacaaaaatgcaaaggaagggaaggatgataagggtggaaaaagctcaacaccaactgcaacaacaggtgttgtaggaaataaacctacttcccctgccaaagatgttgctcctgaaggtgaagcacaagatcctgctattgttgagggtgagcaagtagctagttcggaaccaaaagctgcttag

SEQ ID NO: 92182 - DNA, 288 bp, Glycine max
  Peptide Sequence Number=SeqID_208960
atggcggaggaagcacgaagaaaagagaagaaatggacgccggaggaaaggaaggaagcgcgcggaagaagaaatttgaacagctgctgggggtatgaaaggaaaaacaaaacggggaaagtgactagactcttgacacctcttgaaaggatgattgtgaatgccattgaaaaactagatgaggttaaaaaagatgaaattgaggagtgcttattgtatccaggggctcaaaaattgaaagcaattgtgaatgagaaaatggaagaatggaaaggagataccacttaa

SEQ ID NO: 92183 - DNA, 300 bp, Glycine max
  Peptide Sequence Number=SeqID_208961
atggctatgaaacatgatgcaattgttcattttgcttcttgtttaagaaaaaatggtgcaattgatgattcggatagaatggttcgtggatctcgacttttgagcgtagttcaagatcgcgcgcccgacgtgatggttctcgaaggcgttggccgctgtccccggcgtgttcgtcgaggcgcaaaggagctaaaacgcaccgtttcgactacgtgtgacgctacaaggaggatggtggggtttgacgaagtcgttttggaagtgggatgtggtggtggcgttgttgttcgtaccagatga

SEQ ID NO: 92184 - DNA, 639 bp, Glycine max
  Peptide Sequence Number=SeqID_208962
gcattgcccgattgcaagagcagtttggtatcttgcattgccggcaaatatgcactcagatttctttcatttggattggttgttgaagaatttaaagtgactctgaagttggtgggagagattggagataattgtttgcggttgttttggacaacttatggagaaatagaaacaaaggaatgttcgagaagtgctatctcaagcagtatattgcagtttaacaaacttgtgcctggacttaattgtgatggttccaagagtggctctatagctgctgctggtggcttacttcgtgaccatatgggaaatagttgtggctataagtttctcaaagtagaatctgattctctatctactattgacttgttagccaaggattgcttagtctcacacccatgttccagtttggtgcatgatataaaggagtttggtctgaacaaaggtgtgtacacttggtctcagacattgagggagggaaaccaacctgctgacttggttactacatacgggttacagcttcaggagcaactgagagtttttgagtttgttccatcttttatttttttcgctgtacatgtattagctgatttgaactcaaccgtgttcccccgggttctagtttgtttctttgaggcttaa

SEQ ID NO: 92185 - DNA, 1506 bp, Glycine max
  Peptide Sequence Number=SeqID_208963
atggctggaaagttggaattggggcctccgaagtctgatgtttccaatccgaaggaacaagcggcgaggaagatactgaaaattgttagatctcaagggcatccgtatgttgagttgcgcgagaatgggaagaaattcatttatttctgcactctgtgtcttgcgccctgttatagtgatgatgttctgtttgatcacttgaaaggcaatcttcacaaggagagactatctgctgctaaggtcactctgcttggaccgaaaccctggccttttaacgatggtcttgttttctttgatacttcgactgaaagtcataaagagttggaagttgcagatagttaccaaaacaggttgttgaagtttaatgacaatgacgtcagtcttgcgattgtgaagtttggtgatggggttcagtcaaatgctaaaccacgttcgattgatggtatgcaagatgatgagtatgcattagtgattcctaatttgctgattggagatgaaatatttgatgtaaaagttagggaagttggcttggggaagattgccgcaagattccttgagaagtgtcacgcattgaatgggattaaaagaatatggtgtgaatggttaggcaaagaaagtaatggtgaacgagatggtgttgaggttctagagcatgattttgcagttgtgatttttgcttataattatgatctgggtcggtcaggtttgcttgatgatgtcaacacgttgctcccgtctgcttctggtggccaaaagggaaagtcatcattgtctgactttgatgatgttagcgattctgtatgcaatcagtatgattcgtctgcagaagagtcctctgattcaaacaactccagctcacgattgacactagatcaattcaacaatcatctttgcacaaggttcatttcaagcaaggctttgaggaaagaattgagacggaagcagcggctggcagcagagaaagtgtgtaacatctgtcaacaaaaaatgcttcctggtaaagatgtagcagctcttttgaatttgaagactagaagagtggcgtgcagcagtcggaatagaaccggggcatttcacgtattccatacatcctgccttatacactggataatcttgtgtgaatttgagataatcacaaatcatttagtctgtccaaatgttagacgagtagtgaagagaaaggttgcgtcagatggcaacaaaattggaaaagaaaaagatattggaaaacatataagaactgtattctgcccagagtgccaaggtactggtatgatcattgatggagatggggtggagcagccagaattttctttgtcgcagatgttcaaattcaaaataaaggcatgtgatgcacgcagagattggataaagagtcctgaagttttgaagaattgctcaactgggtttcacttcccttcacaatctgaagagatatttgaggaaaaagtggaacccataaatttactgcatttttatcgtgctgatgatcagagttgggcataa

SEQ ID NO: 92186 - DNA, 5562 bp, Glycine max
  Peptide Sequence Number=SeqID_208964
atggctgaccgtgcctccgccagcactcgcctccacatctccgccgcacctccctttccgatctccaaaggttacgccttccactttgtttctctgttcgagttcagggttttgcttcgtctccgagtggtaacactattatgcgtgtgtttggtgatacattggaaacggaagtctcaccatacttttgcgtcaatcgtgaagaaaatctcagaagccattatttgtagcttctggttgaacgtggatcaagtcttccctgatgcatattatggtgtttgccttgggatttttgtcagatttggtttgatgtacccagatttccatggccctgacaatccaattccactttcaccacagtggcttctgcctaagccaggggagagtaaacctgcaataggaactgtggaaaatcatgtgatctcaactccaccaaatggcaatcgctcagagactgttaagacatctggaaatggagaggatgttaatgatgaccataaacgaaaggatgtctttcgaccatccatgcttgactccaaaagtggatgccgtgaacgttggcgtgatgaagagagagatactaagtcctccatacacaagaatcgttggaggaatggagacaaaaacctaagtgacactcagagaatggatcagaggactgaaaatccatccacaaggcactttggagaagcacgtcgtggcacatctgatagatggaatgattcaggcaatagagatacaaactttgaacagcggcatgagagtaagtggaacacacgctggggtcctgatgataaggcgccagaaggtcttcgtgaaaaacggagcagccctggtaaagatagtgatcggcatgtagacaaaggtttgcctaacatttccaatcttgttaaggatgaaaaggaaggggatcattatcggccatggagacgcaactcctcacaaagccgtggaagagtagagcctacccaccaccagaatgggatgccaaacaaacaagtgtctgcattgccatatgggtggggccatggggaagatacacctccagtcattgcttttgggcgtgctcggcttggctctggtggtagctccattaatagcacatatatgcattctcaatatcctggaactttattggataaagttgaaagtgagcagggagaagctcgtccctttagatatagtaggacaaatttgcttgatgatgaaccattggagcctctagctctttgctcaccaaattctgaggaactgtctgtattaaaggatattgataaaggggaaataattagtagcagtgcacctcagttgccaaaagatggacggaactcaacagaatttacgcattcaagacgaatgaagcctgtaaatgcacctttccaagatagagtcgaagataatgattcttaccgaatggctgatgaggtgcctagtaataaggaatcaacctttgaagaaagtcattctgcacatcatggtgctacatggcgtggcacaccacttggtgaacatgcaggcacactcatgcatgatggcagagatgtgtccagtgatattaaatcaagaaactcagatatgagctggtcacaccagccaaaaaatactcatgctcagtgggagcataatttggattatttatctgaaaccagagatgtgactaagtggcaatctagtggagatcccattaagaggcagctatctggaattttggacagtgaatttgaatccaggagaattcaacagatttgtccagaggagttatccctcttctataaagatcctcagggtcgcattcagggcccgtttaaaggaattgatattattagttggtttgaggctggatactttggtatagatttacctgttcgtctggaaaatgcagcatctgactcaccatggttgcaacttggtgatgccatgccccatttacgagctaaggctcgaccaccacctggattttctgcagcaaaacttgactcttcagaggcatctggtcggccatattccagtacctttgggaacatgcattctggtttaagcgaggttgagatgctgagaaatgattctatgcataggagttctactacagaagctgaaaataggtttttggagtcactcatgtctggtagcaagagcagttccccactcagtagtctcacattatcagaaggtttacaagggtttcttggtaatgattctggtaatttgggcccatcaggagtagatagcggaatcaacctttacttactggccaagaggatggcacttgaacgtcaaagatccttgcccaatgcttatccatactggccagggagggatgcagcaccccttccaccaaaatcagatatttttccagatgcatcgccacattcaaatatgttgtcttctttgagtgacaattctcgtctgcttcagtcccaaagttctgaattgatgtcaataatccaaggattatctgataggtcgtccacatgcttaaatagtggcattgctggatggccaaattttcttttgcaaggtggattggatccccccattcagaataagattgacttgcaaggtggattggatccccccattcatgatcaaaattatgttcaaatgccatttggaattcaacaacaaagattgcaaacactgaatcaattgcccttaaataacttaattgctcaaaattcagatattccatctagtattttgacagcagagaaattgctttcttctggtttatcccaagatcccgaaatgttgaatatgttgcagcagcagcacttgctgcagttgcattctcaggcagcagtggctccttcacaacagttgcattctcaggcagctgctccttcacaaactatgcctttgttagataaacttctattgctaaagcagcaacagcagcaggaggagcaacagctgttattgcgccaacaacagcagctgctttctcaagtgcttcaggagcatcagtctcaccagcgctttggcaatttatcttatcaacagtttcagggaggtggaataccccttgggaatttgcatgtgaatctttctcaaattcaaccaccaaaagaaatttttcccatgagctctcagacaccaattcccagtgttcagggtgagcttactactaattctttggatttacctctgcaagtaagccaggacactagctataatataagcagtgaatcttctgcccagttgtctgaccaattatttgagaatattggtgatcagaaaagctggagtgctacacttcctgagcaaattaatgacaattaccagaaggaaacattgcctgtatcagcttctgttgaaggctcactattgcttgagcagagcagagccaaagaggaacccggcaatgcccagaaacttcttcctttttctgactatactgctaaaaccttggagcagatgccagacaatacttgtaggaatgatgatacccttgtgagtgcaacttcagagtctgatgagaattctcagccgatacagtgtgtcacacctgctgtggatatgtcttcagctgcatcttgtggtaccgagttaccactagttagtcaactgagtgaagatgtagagattaaatcagatagtcttgaagagcatcatggtggaagagagagctcaaagattgatccctcagtggttgatgtgagaagtattgaagtacgtgaacccaaaaagactgctgagaagaaatctaagaagcaaaaatcttctaaatctcagtcttctggtcaggcaaagggattgctaaaaaatgtccctttgcagcagtcaaagaaatcagaacctgagaagccaaattatagtgaagccaacaagggtgaaccagctcatgaaacatttatgcaacaaacaaagggtaaggataaacaatctgcaactgctactgcagaaacagatgataatcaagaagttagtggcctacctactaatattccaggaagcaacactaaaacagttatcgaaaatgagttaaaggcagtcagttctgttgccacacagaatactgaattaccttcagcgagagcttggaaacctgctcctggtttcaaggcaaaatctctcttagaaattcaactggaagaacaaaaaaagtcactgacagaaaagcttgtatctgaggttgctactcctgtcaattccatgagctcaacaactccctgggttggagttgtcgccaatccagactctatgaaggtgtcaaatgatggccacagagaagcagaaaatactgaatatctggctaaagctgaaaaatctcaaaatagtaaaagcaagaaaagcccattacatgatctattggcagaagatcttgtaccaaaatctagtgaaagagatggcaaggttcctgacagtatgctcccctcacaaaatatagctgttcactcaaaactggtagatgatggagactttattgaagctaaagacactaaaagaagccggaaaaaatctgcaaagttgaagagttcaggagctaaggtttcaatgccagttgcctctagtgaagtacccataagcccaattcacattgaaaaggtaaaaagctcccgttctgttcagcaggagaaagaacaactgccttccattccttcaggaccctctttgggagattttgttctttggaaaggagagccaacaagcccatctcctcctccagcatggactactgattctgctaggattcctaaaccaacatcattaagggacattctaaaggagcaggagaagaagtcctctgcagtactcccaaatcaactgcctactcctcaaaaatcacaaactgcccaagctgcacggagtagtggttcttcacgcccaatttcagcttcatctccatcaaaaactgcaccttctagccagataaactcccaagcttctctgtcaaaatacagaggggatgatgatatgttttggggtccagtcgagcaatccaagcaagaaaataagcagtcaaatttccctcaacttgctaggcaggggagctggggttctaaaagtgttcccatgaaaggtaattcacctggatcattgagtcgacaaaaatctgggagtggcaaaccaactgagcaatctctatcatcatcacctgcctcttctcaatcactgctaaaactgaaaaaagatgcaatgaccaagaattctgaagccatggacttcagagtttggtgtgagaatgaatgtgcgaggctcattgggacaaaagatacaagtttccttgagttttgcttgaagcagacaagatctgaagcagagatatttctcacagaaaacctgggattatatgaccatgatcatgaattcattgataaattcctcaattacatggacctactaccatcagatgttttggaaatagcttttcaaaccgtgaatgatcggaaagttgatgcaaatacagatgtactagagctaggttacactgatggatccttttcaaaagttggaaagaagaaaggcggcaacaaaggaaaaaaggtaagctcttcagttttgggattcaatgtcgtgagtaacaggatcatgatgggtgagatccagacagtagaagactaa

SEQ ID NO: 92187 - DNA, 1336 bp, Glycine max
  Peptide Sequence Number=SeqID_208965
atgggtgaccaagatgaggcttcagccacatcagaacacgtggttcctattccactagctgtctctaacattgctaattacgaaaatggaacaagtgccatgcatgctcatttaaagagatgcaaggataacctagataaagatggaaacaaaaggcagaaatcagctttgtcctcaacagcgattgtggaagcaaatgttagttcttccccttcatatgctaaatttgaccaagaagcttgtcacaatgaacttgtgaagatgtttgtggtcattgggcttcctttttattttgtggagaatgaaatctttcggaagtttttgagccttcttcaaccaagatttagtgttccctcaagaattgcacttgtgcgtcatattttgacactttgggatacagaaagaacaaatttaaagaagtttctttccgagcattatcaaagagtatgtctcaccattgacatgtggagttcaagtcaagtcacaagccattcagttgaggttatggctaaaactgttgaattatgcatgaatggttggggattgagtggtgtttttagtgcgacagttgataatgctttgccaaatgatgaaggattagaagatattgatggttctatttcaagaattcgtgcagcagtcaaatacataaggtgggattcaacttatctgatgttagaggctgcattgatgaaccaagaagcatttgtagagttgcaaaacaaaaagtatgatgatgagttaagaaagggtgaaggtgtgccgacatatgaagattgggacaatgctagactgattttgccatttttgaatatcttctataaagctactttgcgcatttccagtccctctgatgttactggtaacatatacatgttagagtcactttttgaagaatataatggtccaaatggagggtctttgagtggatcacaaaaaacatcatttaacgaagatggcaatgatgatccatatagttggaatcaatttttacaatcaactgggtgcaaatcaaatgccaaatctgagcttgataaatatttggaggaatccgtagagacctcttcagatttggatgtcttaaattggtggaagctcaattcaaaccgatttcctatccttgcaaacattgctagagagatgttggccataccagtctccgctgtagccacagaatatgtatttaatgtcggaggaagggtgcttgatccttatcgtagttccttgacacctaaaatgttggaagcacatgtctgcttacaaaattggctaaaaggaactcctttctcattattttcaaatgaagattttgaggagcttttaaaaattgagcaag

SEQ ID NO: 92188 - DNA, 537 bp, Glycine max
  Peptide Sequence Number=SeqID_208966
atgagtggttgttactattatcagggactggacccaaggtgcacggctaacttgttcctagacgcagaatgtgtaggagagaacaacattaacaacgaggtttgcttcatgctcaggttacaaacggatcaacacattctgcaagcacaaagcatgtccaatactgaaatcgtaatgcacacaatgctgggttacttcagccaacgcacggggctactggtgaagtttgaggacacaaagttggtgaaaatgaaggccgttaaaggaaaagagacagtgttttgggaaacaagcatcgagtccatgattgatgattatagatacatagatggcattaacatagcgcatggtgggaggacaattgccacgctttataggtacggtgcggcgcataatcacaaacatatgattgaggaaacatggacgattgaagaggttgattttaacattgttgggttgtctatggattgctttctgcctccctctgatggtgagagagagcacgaaggtgcagagcaagcagtgggaatgggatag

SEQ ID NO: 92189 - DNA, 204 bp, Glycine max
  Peptide Sequence Number=SeqID_208967
atggatgaaaaagagatggataaaaagtttttcaagttggccaaagaggaaaattggcagaaatgtcccaagtgcaccatgtttgtccaaagtagtggcggatgtgaacacattacttgcaggtgtggacgcaacttctgctacatttgtggggagaattgggagtttggacatttatgcaagaagcatccttctactacttga

SEQ ID NO: 92190 - DNA, 273 bp, Glycine max
  Peptide Sequence Number=SeqID_208968
atggagatacaagaggatcaagaagtggtgcatcaagttctgaatgagttaaagaatatactcaatcttcatgacagggatctcccatattatttgggatcagctagactggtaaatcgagaactatggtgcaccgacattggagcatgcgtgatctcagttgtctatgtaaataggcacctcgggtatgaatccttttctactctcattcttgttcattctcctcttactgacttaggcatcaaagtgtttgcgcaccacaacagacgctaa

SEQ ID NO: 92191 - DNA, 735 bp, Glycine max
  Peptide Sequence Number=SeqID_208969
atggtgcttttactctcaatcgtgacttccaaaacccaccatggcctatctctccgccaacgcttcacctccatcgtttccaacctcacctcgtcgttttccgctgctccttcctcctctgtccacgagctccgacagcccctgccaccgtggggcgagaagaagagtggtgatcatcaacttttcaaccgtgtcgtggttgagaagaaaaaaaatgccccgttgatcatcatgatcacgatgaagcaaagaagagtgaccagtcctcgaagttcttttgtgatatatgtcttgatgagaaaccagtctctgatatgttcaaagaggcctgaatgtttgcgagccgttttgcctagggaagttattgttagatgggaatgcgggatgtttgagtctttgactgttgggtcggtgaagacgtacggtccttttaaggactgttctgttttgttggtgaaagatggaggagttgttgtgaccagtgctgagtgttcctcttgtcataggctattttgtgcacaatttgcaacccaattcgcaattgctgaatactcacaaccagtgccgcaatcgcaaccgcaggctttagccaacaatacaaccacttctcctccgctggcggatagtggagatgttttcttcgatgtttggggttcagtgcgacaagggcaagggaaactcattacaagcggtggctgcaattgttttctatttgctaagagattctttaattaa

SEQ ID NO: 92192 - DNA, 891 bp, Glycine max
  Peptide Sequence Number=SeqID_208970
atgacttctaaaactcagcattgcgttatccgtggccatcacaagtccacacatttcaatggtatctgtgcctcctgtcttcgggaacgcctcgccgccatcgcttcctcctcctctgccacgccggagctcgacctcaccatcaagtcgtctttcccctttgaccccttggggctcgaaacgccacggtgctcgccgcgaagacagaagaaaaagtccctccttgatcatgatgacagtggtgaagatcaaccctcatttttcctttgtgacatatgttttgatgacaaaccagtgtctgacatgttcgaagagggtaagtgtaaccacctcttttgcactcactgcatgtcaaaatacgtgactactcaaatacaacaaaacattctcaaggtgatcatgtgtccaaacgctaattgctccgtggaattgaagcccgaatattttcacaacattttggccagtgaagtcattgttagatgggaaactgtgatgtgcgaatccatgattgttgagttggagaagacttactgccccttcaaggactgttcagttctgttggtgaacgatggagaaaaggttgtgaccagtgctgagtgcccctcttgtcataggctattttgcgcacagtgtaaggttccttggcatggaagtatgagttgtgaagaattccaagagatagaaaggaacaaagatgaaaaagtgttggaaaacaagttcttcaagctggctaaagaggaaaaatggcagaaatgtccccggtgcactatgtttgtccagagacgtgagggatgtgatcacatgacttgcaggtgtggatgtgacttctgctacatttgtgggaagaattggatgcttgtacataattgcaagaagaatccgtccacttga

SEQ ID NO: 92193 - DNA, 1632 bp, Glycine max
  Peptide Sequence Number=SeqID_208971
atggtgaaagtgcctccaacaaaagcactcttgttgttcaacaccgcaacctatcaaggccttcagcacacttcccactctatctccttcatcctaaatcatctcctttcctctggcatgctaccccaagcccaatctctgatcctgcgtctaatctctggtcgaatcccctcctccttaatgcttcaactaacacaagcccatttcaccccttgtttaacctacactcctctctatgacacaattgtcaatgcctatgttcattctcattcaaccgaccaagccctcacttttctacaccacatgattcacgagggccatgttcctttatcaaacaccttcaataatcttatgtgcttactcattaggtctaattatttcgataaagcttggtggatattcaatgaattgaagagtaaagttgttctggatgcctacagttttgggattatgatcaagggttgttgtgaagctggttactttgtgaaaggctttcggcttttggccatgttggaagagtttggtttgtctccgaatgttgttatatacactactttgattgatgggtgttgcaagtatggaaatgttatgctggcaaagaatttgttttgcaagatggataggttgggtttggttcccaacccgcatacttatagtgtgttaatgaatgggtttttcaagcaaggacttcaaagggaagggtttcagatgtatgaaaatatgaagcgaagtggaattgttcctaatgcttatgcttacaattgtctaattagtgaatattgtaacggtgggatggtggataaagcttttaaggtgttcgctgaaatgcgtgagaaaggtattgcatgtggggttatgacttataacattttaataggcgggctgtgtcgagggaagaagtttggggaagcagtgaagttggttcataaagtcaacaaagttggccttagtcctaacatagttacgtacaacatactgatcaatgggttttgcgatgttggaaaaatggacactgctgttagattattcaatcagttgaagtcaagtggactatcgccaacgttagtgacttataatactttgattgcagggtattctaaggttgagaatttagcaggagctcttgacttggtcaaggaaatggaagagagatgcattgctccttccaaagtgacatatacgattctaattgatgcctttgcgagactaaattatacggagaaagcttgcgagatgcattctttaatggagaagtctggtttggttccagatgtttacacatacagtgtcctaattcatgggttatgtgtgcatggtaacatgaaagaagcgtcaaaactcttcaaatcattgggtgagatgcacctccaaccaaacagtgtcatatataataccatgattcatggttactgcaaagaaggaagctcttatagggctcttaggctgctcaatgaaatggttcacagtggaatggttccaaatgtggccagtttttgttcaaccatagggcttctttgccgagatgaaaagtggaaggaagctgaacttctcttgggacagatgataaattcaggactaaagccatcagtttctttgtacaaaatggttcacaaagtcaagggtgatgtttag

SEQ ID NO: 92194 - DNA, 1259 bp, Glycine max
  Peptide Sequence Number=SeqID_208972
atgctgtaggcgacgaaccgtgtcgtgtgcgagatctgcaacaaaggctccagcgcgaccagaatctacagcttcaccgacgcggccacaacttgccgtggaagctgcggcagcgagggagcaaagaaccgcagaagaaagcttacgtgtgtcccgaaccttcctgcgtccaccacaaccccgcaagggcgctcggcgacctcaccggcatcaagaagcacttctgcagaaaacacggtgagaaaaagtggcaatgcgaacgctgctctaagaaatacgccgtacactccgattggaaggctcatatgaaaacttgcggcaccagagagtaccgatgcgactgcggcaccttgttctctaggagggatagtttcatcacgcacagagcattttgcgatgtcttagcgcaagagagcgcaagggcccaggaccaagcccaaggtggtagcagcaatagctacgtggttgttgtgtcttcttcgccgcctacgcctccactcactccctctgcgtctgtggtgtctccaactttgtccattcagagctcagaaattccggaaaacccatcaacgaaggtgtcaccgacgtctccaaacgcatcgtgtttcgtgacaagcagcagcagcaccccctccagtaccaccagtgtttttgcaagtgttttagcaccgtcgacaacaccaacaactccttcacaatcaccatcaaattcaacttgttcattctccaacctcatgtcaaacttggctcgttcggaaaactccaatgccttaatgagagaacccacatccctctccctctccacaccaccctatcactccaacaatgaccctcttcattacactgcattaccccaacctgcactatctgccactgcactactccagaaggcagctcagatgggtgcttcaaatgcatcccttcttcgtggattaggcttagcaagaacatcctcctccttcgggaaagacgagggtgttaacattaatgcaaccacaacattacaatggaatggccaagtgaagcaagagaatcatccagtggtggataaccttgggcttgggcttccatgtgggagtgggagtgtgccagatgtgatgatgggccctactactccatttgtgggccagcccatgacccgtgatcttcttggtctgagcgtcggtggcggggcaacaagcaggggtggtctctctgctttactcacctcttttggaggaaactttgattcgccgagtgagggaggagttcaccggtag

SEQ ID NO: 92195 - DNA, 2193 bp, Glycine max
  Peptide Sequence Number=SeqID_208973
atggagcgattttattcttctcaacgagagagccttcttttagggtacaataatgactatattaattctctgattccgaggtcgtcgtccagcgattcgaactcggaggttgatttcaccgacgtgtttggggggccgccgcggcggtcttcggtgaacgaagcgcggcagactgtgggtgaattgagtgaagaggaaggggaaagaggttggtgcaggtggccgccggagcgggaaaaaccggtgtttggggaggatagtggaaaccggaggcggcatcccacaaacaagaacagtgacttcttcgatgatatattcggaggagaggcatcagggagcgtgtgttccacgccaaagaagcgcgttggggacgctttcgcgttgtctcgagtgtccagccctctgcctctgcctcctgcggctgatcccgttgttggctctctccctgcaaccttcagccttcctgccaaattgacaaatggagtggaccttccaacatttggttcctccactaggaataggaacctcagcaacatcaacgatggtattgttgcttcaaatggattaaagccttatcgacaaagtcttctatcacaggagttttcaaactccagcacatctgataaagccgacaaaggaagcattatgaaacaaaacatatctattagtgaaggttcgcctggtgctagtaatggccagtttcatttctcaatttacaaatgggcaagtaaaggggtgccaatggtgatgcctcttaggacagagagaaactcaaggaacaaagataaggctaaacttgagagatgctcaagtgctaaggaatggatagtcagtgaaattaccactcaaaatcctatagaatataatggttcccctttgatgaataatagaaaacaagatgtgccaactacttccacacccactgaaaatggatcagattcaaatcagattgtagaacaaatagtttctgccaaaactcaatcagataaatcaagcagtcctcaaactattactaaagatgttcctacaagttctatctcgcatgacgctagagaagtagaatcaagtactcgttctacaggtgagataggcttctctggaaaaactgaggcagcaaaggaaactcagaagcgtgagcccaaaccattacaatttctgttcaaagaaagtgataagaaacaagataatgatgagacgattacaagggagagagaagaaaacaggatgaaaagctcaaaaaagttgtctgctgttttcgatgttaccgtgaatccaattaaacaagaagaaaagacagttcccttgagggatgtgggacgtagcaaagccatttcccagggttcggtaagcttaggtgagaatatggggaaaggcctagtgaaaggaaaggtcaaggaattcgctcgaattttcaaccaagaagctgtaacaaaacccaaatttgactccaactctcgatctcagggttctacatacaagaagagagaggctttaagggcaaagaatgaagtggaaggtggtccagaacaatccaagaagtataactctgccacagagaccacaaacatctctgctaacattttgtctcatgaagaagatatatcagaaccagaaattcctgatatatcatttactgttattggagataaagacgagtccttccatgggagtttcatgatacaagtattagcccaagatgaagatgaggtcttacaaaaccaagaaaatcaagaaatccagacgattgacaacaagataaaacaatggtctaaagggaaggaaggaaacatacgctccctgctatcgacattacaatatgatagttctgtagcagttatgcattccaagtatatgatcaaagtagggattatgggtgtattaggcagcttggacaaagtactttggccggagtgtggatggaagtatgtgcctcttgttgatataatcgaagggaacgcagtgaaaagatcttatcaaagagctttactctgtctgcatccagataagttgcagcaaaagggtgcttcttcagaccaaaaatatattgcagaaaaacattacaaaattctatctctttcaggatctatgtttacattccttaaaattggtcacacattccattgcatcacgttcttctattttgaacttgagacaggcagacatttttggaattttttgaagcaggaacaatga

SEQ ID NO: 92196 - DNA, 840 bp, Glycine max
  Peptide Sequence Number=SeqID_208974
atggataagagcttgaaggtaggagaagatgagtggagggagaaggagagaaggagcacgaaatactatgcctcaaatgagctatggttcagcctactaatccaagatcaagtccaagattctccactaagtgtgtttaggtgtcatgaggcatcccatggccccaaaatctaccctaaggctcatgagaaccctaggggggtaagattgcataaagcatccactcaacaagaagttcaagctgaagtaagaaaacccactagacacatcatgagaagaaataatccaaaaattcatatcataggtgatccagcagattatgttcaaacaggattatcactcagaacacaaggacacattgcacttatttctaaaatggaacccaaacacattgatgatgccatgcaagatgacaactgggtgaaagtgatgcaagaagagaagcatcaacatagagagaagaaaaataaaggttcactcaaaaagaagagtaaggcatatgtcacttgggatgacaatgaaacaaaaacatccaacgacaatagtgaagaggaagaaccaaatttgtgcttcatggcaaacaacaatgttgagagtgaggtgaacctagcaacagataaacaactatggtatcttgataacggttgctcaaggcatatgataggagacaagtcaaagtttatgtctctaaaggctaaagaaggaggatttgtaatctatggtgataacaacaaagggagaattcttggtgtagccatattggcaatacctatgcttaatgtaaaaagtgcatctcactcaaacatggcttgtttaataagtaatgttgatccttcttag

SEQ ID NO: 92197 - DNA, 255 bp, Glycine max
  Peptide Sequence Number=SeqID_208975
atggtgtggcttctccaatcatttttcttccttctccattccgctgccattgatgttcaaaaagaaaaggactccattgatgaagaagatccaaggcctacaagctccacatggagctacatcaacgctactatctctagatcttatttggacgaggtagttgctatagagctatcgtctagtcgtaaatctgcaaaagacccatctagctctgatagatctttatcagacttgttttcatcaaatcttacatga

SEQ ID NO: 92198 - DNA, 441 bp, Glycine max
  Peptide Sequence Number=SeqID_208976
atggaaaaggggcaggtaacagcagacataggaagaggtcaaaagaggggagtggctagacacaatggcaataaggagggaaaacggatagtggaagagtccaatgacaagattcaaaatcctagtcaacatgggtcggaagtttgcacaaaagctcaatccttacttattaggagctggggtagggtaatgcatggactcattgattatgtcctaagtgtttcatttgaggagccaagaaggatactaatcacgcaaggcaagaaaaagattaagaaagcaaaaagaatttacgatgatgggactaaaattggcatatcatataaagaatgtgaaggggagactgtctggcaaattgaagctatggaaaagaggggtcaacaacaattgaagaaagcaacaaacgctcagagaagggagaatgacttgagtgatcaatga

SEQ ID NO: 92199 - DNA, 405 bp, Glycine max
  Peptide Sequence Number=SeqID_208977
atggtaggaaacatgggagtgtggatcgaagatgagtggaagtgggagtttaagtggagaagaggatggtttgaatgggaaggggtgatggtggaaaatttcatgaatgaagtgaggggtataacattgcgaaaaatggagaaggatgagtgggaaaattatgcaggacatcaagttttttgtttggtcatggttaaagaatatgggagatgggtggagctactgatcgaggtcgtacccgaatcaaataaacatgaaaatgcaggagaactgccaggaaaccacattacaagggaaacctcaaagagagttgggcttcgtcctcaaaaggaaacaacaccagaaaatctagccttccatggattcaaacagaaaacacaattgaaacatgaagcagaaacgtaa

SEQ ID NO: 92200 - DNA, 534 bp, Glycine max
  Peptide Sequence Number=SeqID_208978
atggaggatgtacttatggttggaaggagatttacttggtataggccaaatggaagtgcaaagactcgcattaatagggtgttggtcacaagggaaaggattagtcagaaaggtggaagtacacaatatgtattggatagaaatatatcttatcattgttccattgtccttaaagataccaccattgattggggttttaaaccttttagagctctagattgttggtgggatgataaaggagttgtaaaatttgttgtggagttttggtcatctatggaggtggagggttggggagaatatgtactcaaagaaaaattgaagcggttgaaaatgaaattgaaagtatggtacaaggaacattttggttttgtgcaaaacagaggccaaattgttcaaaatgagataaatgatttagaaatgaggaaggtgaatttattctacccacatctatttgattacttgcccctgatgcttcacgatgacaagcctattttacctacctatctcccaaattcctttgcaaagattcaatag

SEQ ID NO: 92201 - DNA, 255 bp, Glycine max
  Peptide Sequence Number=SeqID_208979
atgagtaattggaaccatagggggtgttccagtgaaactgagataaccactggagctgcagtggacttgcaacagattacacaaatagcaagacagatggtaacaaagtttggtatgtcagagattggaccatgggcattgactgatcctgcagtgcaaggtcatcatgtgctgtactacaagcattataccaagctgattatctttgaccttgataggttgaaagaatcctatagtgttgtagtgaggatttaa

SEQ ID NO: 92202 - DNA, 1320 bp, Glycine max
  Peptide Sequence Number=SeqID_208980
atgaagataggggaggaagaggacgaggaagaggaagaggaagaggaaaaggcagatcaagaggatgaactcttactaatgacttatcttgattttaagcaaggaacgacagaggaatggtttctcaactccgggtgtagcaaccacatgagtggtaacaaagactggttctcagaattagatgagaactctagacatgcagtaaaacttggcaatgacactagaatagttgtaatggggaaaggaagtgtttggttaaatgttaatggagttatacatcaccgaaagcctatgcctaggaaaagcctatggagagcatcaaacaaacaccaacttgtgcatgcagacatatgtggacctatcaatccaatatcaagtagcaacaagaggttgaaggtgctggttgaaaaggaagatggagtaagcattggatgtttgaggacggatagaggaggtgaattcacttcaaatgaatttggtgaattttgtaaaaaccatggcatacataggcagctgaccgcaacccacacacctcaacataatggagttgttgagaggaagaacagaatagttatgaatatggtaagtcctacaacaattgtacaaaacaaaactcctgaagaagcatggagtggagtgaagcctattattaattactttcgagtatttggatgtttggctcatgtttatataccagatcaacaccgagtaaaactggatgataaaagcaagaaatgtgttcacctaggaaatgcagaagaacagtctgtagaaaatgttgtggaaagtactggtgctcaagaaatcgaggatcaaaaggaagatgctgagaacaattctacaggtactgatagttatcctaatgactctcatattattaattatgaggctctagttgaagggtgggttagaaggaataggagagaaccagtttggatgaaagattacgaaagaggagaaggtctatcagatgataatggcctaaatgtaatgatggtcaccgaggatgacccaatctcatttgaggaagctattaagagtgagaagtggagaaatgcaatgatgaaagagatggaagcaatagagaaaaacatggcttgggagctaactgatctaccaagaggagtcaagccaattggagtcaactggatcttcaaaaccaaatttaaagagactggagacataaataagcttgacacaattcgcttaatacttgctatagcaacacggtatagctggaatgtatttcagctagatgtgaagagtgtgcctttcttcacggtgaacttaaagaggagatctatgtgcagcaaccaaaag

SEQ ID NO: 92203 - DNA, 1499 bp, Glycine max
  Peptide Sequence Number=SeqID_208981
atggtagagctctcaaaaagtaacacaatcatgccttccagtaagactctcctcctcataactaatctcacccttctcagttttgcaacaactgaggcacaaaatgaccctttctatctatacaaagattgttccagcgacaaaaccagccccaacacctccttccaatttaacctcaagaacctcctttcttccctatcatccaacgccacccgcaacaccccattttacaacaccacaatcaatggcgaaaacccctctgactctatctatggacttttcatgtgtagggctgacgtgtcctctcacctctgccaactatgcgtcctgaatgcaacccaacaactatcatcagaatgctccttatccaaacaagcagtcatatggtacgaggagtgcatggtttggtattccacgtcttctattttctccagtgtggccacaacacctagtagtcccatgaagaacagtggtaaagtcccaaagccagaaagattcatgcgtttagtgttcaggacaataaaccaaactgcagatgaagcatcattccaatcaagtattggtaacaataagttcgcaacaaaggaagcaacaaacgtgtcaggaatatctcagactcaaaccctttattgtttagctcagtgcacaccgaatctttcaccacatgattgtagaacatgccttgatgatgcaataaggaaaattcaagagtgttgtgaaggaaggataggagggagagttctgtttcctagctgcaatgttaggtatgaaatgtaccctttctacaatgttcgttcagcaactcctgtaccaaagcttattcctgaaacaaaaacttcccatgcagattcaaatttatcagaatttcctatttatctttctcataattgcacaaacaaaaccttcaatgccaacaacagtgctttccaaacacacctcaccacactcttatttaacctagcttctaatgccacaaccgggaacaagttttatacggctgatgtggctaacacagtgtttggtctcttcttgtgccgagaccaagaggatcttccttcagggctttgtggtgagtgtgtcaaaaacgcaacgcatgaaatatcatcaaagtgtggctcgttccatgaggctataatttggtacagccagtgcatgcttcgctattcctatagaaattttttcaatgaaatggaaacaggtcctgtgttttctgagttgaacaccaccaacaaggatgatgaacaaaatttctttacgatgaagttagcgaaggcgttagatcaagcggcgatccaggcaggggacagtgatgagaaatacggaaaaaggacgacaaaattgaatgatttgcaaaccctttatgctcttgctcagtgcacacaaaatttgtctattgaagattgcaagggttgtctgggaattgtgattggaacatcaattccatggtctcgtttgggaagcatagggggaagagttttgtatcctagctgcaatatcag

SEQ ID NO: 92204 - DNA, 354 bp, Glycine max
  Peptide Sequence Number=SeqID_208982
atggagataatatgtggcaaaagaaatagagggcgctatagtggaaagcgatataaccttattgatcatgtatggacacactggaaattgagcaggacttccgaaataattgactcaaacattgaagattcatgcattgaatctgaaatcatacgttgcatccatgttgggctgttgtgcgtgcaacaatacccagaggataggcctacaatgacttcagtagttctaatgttggggagtgagatggaattggatgagcctaaaaagccaggtgttttcacgaagaaggaatctattgaagcaatctcaagtagttcaaccaatacactaaccataaccttaagtgctcggtga

SEQ ID NO: 92205 - DNA, 603 bp, Glycine max
  Peptide Sequence Number=SeqID_208983
atgaacggcggaggtgatgtttggatcaatgagaaccgctttggcatcgtgcgccaactcggggaaggtggctttgcctacgtctacctcgtcaaggaggctcccaacgactctgccactgccagcctcgccaagaagctcaaaggctcctctcatctctccggtcatcttccttccttaacctatttcgattcccctcactgtttttcttatttatcttctaaaattgacctcgttgatcaagatattagcctttctcttaaacagaaccctgcttcttatacgcaagttttgaatgcttcctctagagggttgcacagaatgggaactgtattcagttatcttcccatatccatggcaactgaacctgctgcagatgactcaatactttcactgctaagggttttctggcccatcttggagaaattttttggctctgagcatatggagaatgggaatttatccgtagcagcttgccgagctctttcactagctgttcgatcttcagcttccattgtcattgaagaatttggtcatctagaggagtacggacctttatttgttacttctgacgacattccagacattgataagaaaaagtaa

SEQ ID NO: 92206 - DNA, 1383 bp, Glycine max
  Peptide Sequence Number=SeqID_208984
atggcttcctacaagattctcttcctctttacccttgttagcttccttaattttgcaactattcaggcacaggaggaggaaagctccacccctgtctatctattccacaattgctccgggggcaacactactgcttacagtaccttccaattaaacctctggaccctcctctcttccctaacatcaaacgctgtcagcagcaccggattctacaacaccacagtcatcgaagcaaacccctcaaactctgtctttggactgttcatgtgcaggggtgattgcacggttcattattcgaaccgttcattcttctccactgtggacaccaagcccagggttggcctgttgaacactgccaacatctcaaaccaggaaagcttcatgcgtttattgtttgacgccatgaacgaaactgcagatgaagcagctcgtcccactaccggtaacaagtttgcaacaagacaaacaaacatttctggatttcagagactgtattgtctagctcagtgcactccagatctgtcacccaatgattgcagaacctgtctccgtacagtgataggagaccttccgtggtgctgtgaagggaagcaaggagggagagttctatatcccagctgtaatgttaggtatgaattgtaccctttctatcgttctgagggagagtgggttccttcagattcacaattttcagaagattcaaattatctttaccacaattgcaaaactaatgtaactggcagtgctttcaaaatgaatctcgagaccctcctctcttacatgtcttccaatgccatgaatcgcatggattactatgaaggtgtggaggacattgtgtatggcctcttcatgtttcgcagagaccttccctcgcggctctgtcaacagtgcatcctcaacgcaacccaaaaaatatcaacagagtgcaattcgtttcaagaggctgtaatttggtacaaccactgcatgcttcgctattctaatcgccatttcttctcccaagtggaaaaaaatccaacttttgaaatcttgaatcttatcactacttccgaccccgctagcgaccaagatttcttcacttatacattaacaaagacgttagttaatgtgacggaggcggcaagggatagaaatgagagatatgtgactaaatcaacaaagttgaatgatttacaaaccctttatactcttgctcaatgtacgcaggatttgtctaccgataattgtgtgggttgtctggatgatataaatggaaaaatcccatggtctcgcgtaggaatagggggacgagttctatatccgagttgcaatctcaggtttgaattgttccaattttacagggatcgtgacggagctcaacagccaagcccagaactagagtga

SEQ ID NO: 92207 - DNA, 384 bp, Glycine max
  Peptide Sequence Number=SeqID_208985
atggctcattctaggaaatctagaagcataaataagaggttttctactgttcgtgtggctacatctagtaaagacaaaattacagagaatgctagcaaaaataggctgaaggtgagtcctggtattcagaagaagagaaaattgattgacatgttagggccacaatggaataagaaggagcttgagcatttctatgaagcttatagtaaatatgggaaagattggaagaagattgacgacctggttgactttggagccagtgaaggtggcacgataaagatgaaacggtggctggaagcgacgacatcagtggagaggatcaacacggtgaagggacaaagaaatcgagacagtggttgcaatcgtgaggagcaacactggtga

SEQ ID NO: 92208 - DNA, 306 bp, Glycine max
  Peptide Sequence Number=SeqID_208986
atgtcactcttccactctttccctaggctctcgagaagaagcctccaccatcgaaaccaaacccactatgcaacaacatgttcaccaccaccaccttgttcttcgcatcatcctcatcatgttcttcaatcagttgactcttcgttcctccctctattcttttggatggagcccatgaacattattgggaaggccaaggaagacgcttctcttcctaaagtaggggctaaggtctgttgtcccttgtggttcatcatggtgcatgcactctccacagagggcaagagcagttggacctccatatag

SEQ ID NO: 92209 - DNA, 567 bp, Glycine max
  Peptide Sequence Number=SeqID_208987
atgtctcaaagacactgctacattcactgtggagtgtttgagcttggtttcttcagctcgggaaattccacaaagcgttacctggggattttgtataaaaatattcccactggaagagttgcatgggttgcaaaccagaataacccgatcagtgattcctcgggcatcttaacattcaccagcagaggtaatcttgaactcaaacaaaataactctgttgttttggttacaacctatcaaaaccgagtatgggatccagtggcagagctcttggacaatggcaatcttgtgataaggaatgtgggagacgcaaactcagcaacatacttgtggcaaagttttgactatctatctgatacacttttgcccaagatgaagttgggatgggacctccgaaccggtttggaaccgaaaataacctcttggaagagtccagatgatccatccccccgaaatttctcttgggatctgatgctccatgattatcctgagttttatgcgatgataggaacatgtaagtacttctgcactggaccatggaatggagttcattttagtggattatga

SEQ ID NO: 92210 - DNA, 762 bp, Glycine max
  Peptide Sequence Number=SeqID_208988
atggccaaactgaagtactcaacaggaccttggaataatatctatggtgcttcgttcatgattctccttccaagtgctacctacggcatgccccctccttccattgccacatacctggcaagttcatccacagttgaagcagttgataccctattatcatcccggcatgatctttggaagtccttgtccacacgtctgcgcaaggttcaactagccatgaaaactcaggctgaccgtaaacgccacgagttcaacaggctgtccaaatgctattacggtcatttccgtatcattgaaacaattggtgtcatagcttaccatcccgccctaccagagcactccaaaattcataacgtttttcactgttccttgcttaaacctcatcatggccccatacaagaggtctcagctcctttacctccacaagccactgataatcatcccctcattgagcctttggctatcctggacactaagtggaaccacacaaccaacccatcgtcactacttgcattagtacaatggcatggtctggctctagaggagacttcatgggagaactgggatgacttacatgcaacttatcaccttgaggacaaggtggtttttccagggactacccttagtctcaaacttaagggaaccaccgcttacaccaatgtcatgcttgcaggggccccaaagcccaaagtcttgcagctggttgagtcatatccactttgcggttggatcaaatgcaacatggatggagcagcctgcgat

SEQ ID NO: 92211 - DNA, 348 bp, Glycine max
  Peptide Sequence Number=SeqID_208989
atgagtcgcagaaacgaaagtggtccaaagcttgacttgaagctgaacctgtccccaccgagggctgatcggagactggagtcaccgacacgatcggcgacggcgtcgccgacgtcaccgccgagctcgtgcgtgtcgtcggagctgaaccaagaggacaaaagttactctaacagccctgaagccacttccatggttcttgtgggttgccctcgctgcctcattgctatgtgcgctccacttttaccctctttcccaacaattttgtcaaagcaggggatgcagagattgcagagacagaaagagacagagtggagcgtgaatagcactattttcaatcacccatag

SEQ ID NO: 92212 - DNA, 1564 bp, Glycine max
  Peptide Sequence Number=SeqID_208990
atggcacggatgggcccagggttccgattccaccccaccgacgaagagctggtggtgttctacctgaagcgcaagatgaccggaaacctctcccgctacgaccacatcgccgttgtcgacgtctacaagctcgagccctgggaccttccccctctgtcgaagctgaagacgaaggacttggaatggtacttcttcagcgcgctggaccgcaagtacggaaacgggtcgaggacgaaccgcgccaccgataggggctactggaagaccaccggaaaagaccgccccgtcacccacggcgaccgcaccgtcggaatgaagaagacgctcgtttaccacagcggccgggccccacacgggcgccgcaccaattgggtcatgcacgagtacaagatgctcgacgaggaattggcacgtgccggcacagtgccggatgtgtttgtggtgtgtaggattttcgagaagagtggttctgggccgaagaatggggcaaaatatggtgctcccttagatgagaaggagtgggatgttgaggatgagcaggaggaggaggaggaggagaatgagcagaaggacgtggctcccttgctggttcctcataacgcggtggctcctcctcctcccttgtcggtagttgctgataatgcggaggctcatcctcctttgacggcaactgttgataataaatatatggtggctcctcctccttcctttcaggctaattttgatgatgaggttttcaatgctggggcctatgttgaaaccaacgaccttgacatggagcttaattggaatgatataattgggagtgatacttttccatcactgaactttcatcatggggagtgtagtagccatgctgagtattccaaagtattcatcaaggatcaggagccatcagcaggcacttttggaatttctcggcctgaaaatgactggcctcttgatatgactgagcaacatggcgtggatacaaattcagtgaacaacagagacaatggtgagctgatcaatattggcaatcatctgaattttaatgatgcatcaaatgatatgaatctggatctgttctgggatgccaacgagaatcttccgactgatggatcattcttggaatacaatgatattgcaattgggaatgggagtagatctactgaggctgatcctcctgcgaatgacattctagacgagtatcttacactccctgatgatgatatttacaagtatatatcttttgattctcctcagattcaagagagtgaaaattttattcccaaccaaggatcacctttcactcggcagaatgtggagggagaaactgctgataaagctgtggttagtaatcataattctgaatcacaaaccagaaatgaggcttcttcagtgcagaatacacatgaggcaaagtttgcaccaggaagtacaaatccacttgttaagcaggcctatggttggttagccggcatccctgctgcgcctgcacatgctatggagtttcctgctaaggagattgctcttgggcttcatcctgtagctcagtcttcccatccagctcatataactacag

SEQ ID NO: 92213 - DNA, 354 bp, Glycine max
  Peptide Sequence Number=SeqID_208991
atgagcggaaacgattgcgagaagaccctactcctcctggccctgctcaccgacaaccaacgcctcgcccgcatccatgtggcgttcaagcaggacctcgtcgccactcaagaggagctctgctgcctctccgccactgtcgtcgaggtcaaggccgagcgtgacgccgaggtccgcggcatcgccgccatgagctctgagctggatcgcgtacgggcggacattctggagcttgtggcggagcggaaggagctcacgacacaactgcatgccgtggagagcgagcttgcaaaggcgagcacgaaggcgcagtttgtgccgacgattaaggccgatatagaggccatgccatga

SEQ ID NO: 92214 - DNA, 282 bp, Glycine max
  Peptide Sequence Number=SeqID_208992
atgagagcccagctatgtcctctgctatttcttaatgtattgaagcttaagccaacatgtgggtggatacaatgtcagtatgagtgtgtagtaaggcaattgcactttaatgcagttccaaggaacttcagattgctggaggagcttgagaagggagaaaaaggaataggagatggcacagttagttatggaatggatgatggtgatgacatttacatgcgctcttggactggaaccattattggtccctataatgtaaatatttatctaacactgccttga

SEQ ID NO: 92215 - DNA, 1272 bp, Glycine max
  Peptide Sequence Number=SeqID_208993
gtagcccgtgtgggacagtctgcctcactgtttggttcaagagtgatattgtttggtggagaagaaatgagcaggaagctgttgaatgatgtccatgttcttgatcttgaaagtatgacttgggaaatgataaagactacgcagacacctccagctcctagatacgatcattccgctgctattcaaggagagcgtgttagacctccaattacccaagtgtacactagaaaggaaaagaagaattgcagagacttaaggcatgtctgcattgatggaggactggagattgtgggaataatactcactgtgatagcagaatcagaggaatctgagatagtgggaataatatctctcctttacatatttacaactcatgcacgttttgcatcttatgcttggcaaatggagtggtcccaaccacaaactcaaggtgatttagtatctcccagggcaggacacactggtatcactattgatgaaagctggcttatagttggtggtggagataatagaagtggttgccctgaaaccctggtgttagacatgtctaagcttgtttggtcagtattgactgttgtgaagcaaaaagatccactttctagtgagggtcttagtgtctgttcagcaacaattggtggagaaaagtatttgttagcatttggaggctataatgggagatatagcaatgaggtttttgttatgagacccaaggccaaggataccatgcgtcccaagatttttcaatcacctgctgccgcggctgctgcggcttctgttacttctgcttatgcattgtctaagtctgagaagttggatttcatgcaactggatgatataaattccaagttatctgtaaatggtcatcataaagatgatgtggtggataaagttgaagccattaaagaagaaaaacggttattggaattgtcaattgcagaagtcagggctgaaaattctaagcttggaggcgagatagaagaaataaataatactcatgctgagttgaccaaggaactccagtcagtccagggacaacttgtggctgagagatcaagatgctttaacttggaggttgagtatactaatagtaatgttcgtttccaggccaaaattgcagaactccagaagttgctggaatcaatgcagtctgtggaagaggaggtacaggctcttcgtgaaaagaaatctgctctggaccaggagatggagcttgctgcaacagctgagagcaagagttctggttggcgatggtttggtgggagtgagaaatga

SEQ ID NO: 92216 - DNA, 315 bp, Glycine max
  Peptide Sequence Number=SeqID_208994
atggaggtcatcaagtcaagaatcatcatatcccttgaatctttagtggaatttctcaagaaggggtcagaaaaagcagttatcagggacatgctaggtgcacccagcaacattgcttttcggaagaaccttcttccgggaagaacaatttgtgttctaccggaagaacctttttcccggaagctttccggaagaaccttcttccggaagaaggttcttccggatgaacaatttgttctaccgaaagaaccttcttccggagaagttaccagaagaacttcttccggtaacttctccagaagaaggttcttctga

SEQ ID NO: 92217 - DNA, 396 bp, Glycine max
  Peptide Sequence Number=SeqID_208995
atgagtatagcaagaagagcatttattgttaatttgttatcaaggcaaagcatgaacactgaaaacagttcacagcccccggatgctgcagcaagcatagtagctacagagggaaaggaaaatcgagcacaccgcagaaaatcaaccagaatttcaaatccaaatggccaagtcatattcaacacgatagcatggaaattcgaaataggagcaattgagcaaatagaaacgaatggattggaattgaatgggaaaaggagtgaaacctgttacgagagagagatgtcagatctcgaaacgccgtcgtctgatgcggaggaggaggaggaggagattggaaggaggcggatggaaagccaccgtcgagatctcaatggatacgtcgtcgtcgcgtaa

SEQ ID NO: 92218 - DNA, 735 bp, Glycine max
  Peptide Sequence Number=SeqID_208996
atgaaaaatggaaaccatggagaggaaatccaaacgggagagaattcagaggtcacaatgcaaatggaaatcagaaaaatgcaaaggcgtgaacactgtagagccaatgccaacttgaaaagacaaaacaataagtgtagcgttggtggaaatgaaaaaatgagggaggccaatgcacccaatgaacagacaataacttctgctagaggacatccccttcccgcaaaaagaaaattcaaacatgaaaaggacctaccagtggcataccaaacccttctctgtcgccaacgcaacatttggatccctgaaaatggaacatggaggttgtttcaaactgcaccgagagacatttgtgacacttatagtccgtgtggttcttacgcgaattgtatggttgattcatcgccagtgtgtcagtgtttagaagggttcaaaccgaaatctttggatacaatggaacaaggatgtgtgagaagtgaaccgtggagctgcaaggtggaagggagagatgggtttagaaaatttgttgggttgaagtttccggatactacacattcttggattaataaaagtatgacactcgaggaatgcaaggttaaatgttgggaaaattgttcgtgcacagcttatgcaaacttggacataagaggagcaggaagtgggtgttccatttggtttgctgatcttattgatttgaaagttgtttcacaaagtggacaatatctcaatatttga

SEQ ID NO: 92219 - DNA, 204 bp, Glycine max
  Peptide Sequence Number=SeqID_208997
atgggatctgatggagtcttttgtgggctaaagaagagaaggtgtgaaaagctgctcatgaactcgcttagcgaggcagattggctaagcgaacctcattcgcttagcgaggcaaccagctcgcttagcgtatgcaaaaccctagaagatgataagtcagagatcagcgcgcttagcgggcagccagcccgcccagcgaggtag

SEQ ID NO: 92220 - DNA, 612 bp, Glycine max
  Peptide Sequence Number=SeqID_208998
atggtcggtggtcctttttaccccgtgaggctggggagaaaggatagcactgaatcagatgctgcgagagtgagtgcaagccttccaacaccaagcatgaccatggaccagatcattgagaagtttacctcaaagggtttcactgttaaggagatggtggctttgactggggcacacaccattgggttcacacactgcaaggagttcatccacaggatctacaacttcagcaagacctctgatgctgaccctatgatgcaccctaagctggtccaagggttgaggtccgtgtgccagaactacaccaaggactcctcaatggctgcattcaatgatgttaggtcaccagggaagtttgacaatgcctactaccagaatgtcatcaagggtttggggttgttgacctctgattccattcttgctgttgaccctaggacaaagcctcttgtggagctctatgcaaatgaccagcaagctttcttcaaggactttgctgatgccatggagaaactttctgtgtttagagtcaaaactggcgacaaaggagaggtgaggaacagaggcgaaaaacataagacttgtgatggagaagatccagttttacccatctga

SEQ ID NO: 92221 - DNA, 363 bp, Glycine max
  Peptide Sequence Number=SeqID_208999
atggaggagatggtggaggcgcagtgcgtcaagggctgggagggtctccaagagcttctgtcttggtatttgaaagtcaacggtaaaaccaaccacggctatatcgttggtgctttcgttgatttattgttcgcttcttcttcctcactagtttcttcttctgacaataactcccactctccttcttcccctttatcgttttatagctcttcctcttgcagcactcgctgtgtttcttgtttggaagctgaggtcgaggttcataataatgatatagctactacttcttctttcttgttagaacaagttagggaagaccaggcttcatcttcttcttctacttctacttcctctttgaattaa

SEQ ID NO: 92222 - DNA, 195 bp, Glycine max
  Peptide Sequence Number=SeqID_209000
atggcgatagcaattcacccttctcagcggtttctcctctccgtttctataaccctaaccctcgtccatcgtggcgcctcaaattccaaaatcgtttgccattttgagcttttgcaggatctgagcttcccatgcatagagcaacaaagaagacgacgtgttgatgggaaagagaaatggttagatgttgaataa

SEQ ID NO: 92223 - DNA, 738 bp, Glycine max
  Peptide Sequence Number=SeqID_209001
atggagtccgaactcaaagacctcaattcgaagccacccaactgcaacggcaacgccaacagcgtttgcgacgaccgtcctctgctgaagccggagcctccggcctcctccgacagcatcgccgagatggagaagaagttcgccgcgtacgtccgccgcgacgtgtacggcaccatgggacgcggcgagttgccggcgaaggagaagctcttgctcggcttcgcgttggtcactctcctccccattcgagtcgttctcgccgtcaccatattgctcttctattacttaatttgtagggtttgcactctcttctctgctccgaccggcgaggaggaacaggaagattacgctcatatgagtgggttgaggagaaccgtcattgtttcgtgtggacgcgccctctccagagtcatgctcttcattttcggcttttattggatccccgaatccaactctgcctctcaggaagaccggagtcagcctgaagagttggggagacctagcgtaataatatctaatcatgtgtcatacttggatattttgtatcacatgtcgtcctcattcccaagttttgttgctaagagatcagtggctaaacttccgctcattggtctcatcagcaagtgccttggttgtgtgtatgttcagcgggaatcaaagtcatcggacttcaagggtgtttcagttgtacctcctgatcgtttgattgtaaggcataaattagatgatctgatctaa

SEQ ID NO: 92224 - DNA, 942 bp, Glycine max
  Peptide Sequence Number=SeqID_209002
atgcccgtagccacgaagcttcgaccggctccgcaaccgcgagctatcttgaaacctgccggaaatagagtaaccgtttccgaagaacccaaaccgaagaaggagaacaacgtgaagactccacagcgtcccccgcaaattcccaacaccgttttgcaaagcaacgtgtctttgaacagcatgtgttcctctgattcatgttcatcaacaaccaaaaacgcaactgtggctggtaggagaaacgtgaagcgtaacgggtttaagcctgtaagagttgtgccagatgccgccgatgtagcaaccatatcgccgcctcttaagagatgtgaatggatcactccaaattctgacccgttttacactgctttccatgatgaagaatggggtgttccagttgatgatgatagaaagctatttgagcttctagtcttttcacaagcattggcagaacaccgttggccagcaattcttaaacagagagacatattcaggcatgcatatatgaagctttttgaaaattttgaaccgtcatcagttgctcagtttactgataagaaattgctgacactgaagataaacggcaactcattgttatcagaaccaaagatccgtgccattgtggaaaatgctaaacaattacctaaggttcagcaggagtttggttcattcagcaattactgctggagatttgttaaccacaaaccaataagaaatgaattcagatatggacgtcaagtacccgtgaagactccaaaagcagaagtgattagcaaggacatgatgcgcagaggtttccaatgtgtgggaccaactgttgtttattcgttcatgcaagtagcagggctcgttaatgaccacctattaacatgcttcaggtaccacgaatgcaaagtgacaaccaaaacagaatttaaaactgagtttaaggagaacaatgactga

SEQ ID NO: 92225 - DNA, 1006 bp, Glycine max
  Peptide Sequence Number=SeqID_209003
cctattcactacctaccgaacaatcatcaaaggtggcaagggacactcagcgaattctgcaggaagaaactggcatctgtaatgtcattgacccatgggccggatcctacatgatggaaaaaattacggcagaagtcatttatgaagtcaaagctgttttcaatcagattgactctgcgggtggaatgttacaggcccttgatgacagcttgattcagaagttaattcagacacgtgcagcaaaaactcaggccaacattgactcaggaaagcaaaaagttgttggtgcgggtaatactacgcacaacactgcgagtcttaattttgactcagatgggattcgtttacagcaaacaaccaaaataaaggcaatgaagctttgtcgtgacgatatgaaggttcgacgcgcacttaagaatctcagtagtgtagcccaacaagggcaggggaatttgttaagtgcgacgatagaggcaatcaaataccgagctactattcaagaatgcacagacgctctcacaaaagcttttccaaggcatcaacaatttcctgttttgattgaaggcatctataagggtgaaatcgacaatcatcctgaatggatgactgctaaacaggcagtgagcgatattgccgaccttcttagtagatcgcctagggtgcttgtagcgaaggttggtcaagacgggcacgatagaggcgcaaatgtcgtaacctctattttgtgtgattcgggttgtgaggttaaacaacttccattattcattcacatcgaagatattgtttcttatgcaagcaattttgaggcagatatcattgccatttcttctttggcgaatgctcataatgagctaatcccccaattaatgtacgagcttcgtacaagaaacattaatattcctgttgcccttggagggattattccagttgaagaccatcaagcgctaatagagtgcggagttgcttttgtaatggaccctggagtcacgattcaaaaagcaatccc

SEQ ID NO: 92226 - DNA, 354 bp, Glycine max
  Peptide Sequence Number=SeqID_209004
atgccaatcccaatggtggtgctgaaactgatgatgatatggacacagacttatgtgggggacaaaaaaatgaagaaattgattgctgggacatcaagcaagatggcaacagttatcaacgaaacaaccaccatagttgacctcgaagtgcaaggcaaatctagaaatgatgatcattttttaatggcaggacctggcagccaagcctaccaaggaaattttgattatctttcatggtccaagaccttatttgttgcacttcataaactaccgcaagctcagcttgacaaatttacttcagtattgtggagcatgtggagatatagaaatgacaaagtatgggatgatgtttaa

SEQ ID NO: 92227 - DNA, 387 bp, Glycine max
  Peptide Sequence Number=SeqID_209005
atgtcatttcgaccaactttgaacgtcgtgggttgtgcatgtcaatatcttgggttgggtggcgaagcagtgggtggtgttggtggggtggcattggaaattactcgaagcagtgggaggggaaggttctcgagaaaaaaagagactggagagaaaggtcaatgctggaaggtagggaagagccacccaccagtggtagttctcaaaaatccacaaatttatagtcaaccatcaactcccaccaactcaaacatgtgttataagccttctttatccaatattgtgtcccatagcaatggaattgaatcacccatcggtatagagaatattcaactagacgaaggagatcaaaattcaggtggaaaagaaagtcataccgcattctga

SEQ ID NO: 92228 - DNA, 159 bp, Glycine max
  Peptide Sequence Number=SeqID_209006
atgacggtaatgttcaacattttttactgggtggagctctctgtttggcgtgtgattacttcagaagttggttattctactgttctcatggtagaacttcagaggcatttcggtgttgaggttgacaaagatattaagaccggatccaaaaacaattga

SEQ ID NO: 92229 - DNA, 582 bp, Glycine max
  Peptide Sequence Number=SeqID_209007
atgaatgctccaaatcattacgagcgtttcgtcgtcctgaaggcaccaaaaaggtttcttatgaaagggacacgaagatcatcaatgcgacatccttcaccatcgagagataggagcacactatcggcaacatcctccgcatgtacccccgttctacttcctccttgctctcacttcccagtgtcaccgcgaaaccctaacttttctttgttttttatgttcttcaggcagctgcacagagaccccaatgtcttatttgccgaatacaagcttcttcatcctcttcaatacaaaattattgtcagggtttgcgatatggatgctatgttatcttctgtgttttctggatattgtgcaccttatagccccgctaagttttttatacagtggtgtgctactcatgttaatcttttctctcccacttggacagtcgttctagatgtgaccctgacttggaaagcacaatggagtatgtcactgtatcagagagaagaagcaaaaatacaagcttcggtaaacctccaaaatgctaaagcagagtccaggccaagaaagcttgaggtatttcattgccattcatag

SEQ ID NO: 92230 - DNA, 1296 bp, Glycine max
  Peptide Sequence Number=SeqID_209008
atggccctacttgattcgaatagtgagtggaagaagggtcagtttttgattttggtattggtggtggtggtggtcatggcaaacaacagtggaaaatccaacaaggagggtgttgaagggactcaactcaaggtgattggtgaaagtgaaggccaagattgggagaaagagaagggaaagcgtcttgatttgagctcagggaggagacaatggaagccagtttttgatgatgcttccgtgtcacataggcctctcaagaaaatccgcagccccgaacccgaaaacccgaatcaacaacaacaacaacagccatcctctatgctgtctcttcaacctccttcatcaagaatagtgtttccttttgcttttgaaggctctcaacatccaatgccattcccacacccttttggaaccacaaacttgcctctttttcgtccacctcttcatccaactcaacaaatgatatcttttttgccctcacagaacatggggtatccaccattcctagccccagaatccaccatgccacacgaacaccaacaacaccatcatcaacagcttcttcagtattggagtgatgcactgaatttgagtccaagagggaggatgatgatgatgaataggactgaagggagacaaatgttaaggccccaagcacagcctttgaatgctaccaagctctataggggagtgaggcaacgccattggggcaaatgggtcgctgagattcgtcttcctcgcaatcgaactcgcctttggcttggaacctttgacactgctgaagatgctgctatggcttatgatcgagaggcctttaagcttagaggggaaaatgcaaagctcaatttccctgaactctttctcaacaaggataaagcagaacaatccacaactgctcctgcatcttcttctaatgaaggttcaacatcgagccagaacacaaagcaacctgaaccaataccagaagggacgactaacactgagagtgaggacatgccaccaacagagacatttgcagtagaaaacgctgtaaccgaagaaggaatttcacagcctcaggaattggtttggggtgaatggttcaatgcaattcctgcaggttggggacctggaagtcctgtgtgggatgacttggaccccaacaacaatcttcttttgcattcacaacttccctttgtgaatccaaatcagcaagagttccatgatgctggtgcttcttctcggacacaacaagaagataacaacacagaaccaggttcttcttctccctcttgtcccatgaggcccttcttctga

SEQ ID NO: 92231 - DNA, 660 bp, Glycine max
  Peptide Sequence Number=SeqID_209009
atggaggtcaatgcggccacagttgttgccacaagtactgccatagaagtggacccgactcacccatctggccttaatcaagtaaatcctccaatctcggatatagtagggcagggatgtgaagtgttaggaagtatgggtggcccccattttgtgcaagttcataacaagcattccttcccaccatatggcttgcctgcacccaatgttgcacacgctcccgatgagaatgtcaataactctactcccatactcattgagagccaacaacccaatctgttcgtgcacatactgcctcctgtcgtagtggaaagggagaaatttgatcatatagaggaaagactgaaggctattgaaggaagcagagattatgcctttgttgacatggtagaactgtgtctagtgctcgactttgttatccctccgaagttgaaggtgtcggatttcaataagtacagggggaccacttgccccaagaatcacctgaaaatgtacaacaggaaaatgggggcatactcaaaaaatgaaaaattgttgatgcatttcttccaagaaagtcttattggggcagccgtcacttgctacagaacatgtgcaagaaagaatatgaatctttcaaagaatatgcctaaaggtggaggaatctggcagctcaagtag

SEQ ID NO: 92232 - DNA, 384 bp, Glycine max
  Peptide Sequence Number=SeqID_209010
gccatcatggtactcgatcccaggatgggaagtgggattggtgcaaatttgctgaagcttatcttgaaaagaagaactagtggtaaaatgtttgtgcatggcatcgatgaagatgaagatggtgaagggatggccgaggagttattgctgccatttgcggacggtggaggttatggcatggagctcgcggatctaggggtgaccatgctgagtctgaacaacacccatagccatgccggaagcatctgtctcaatggtaaatgggctggagaaatcgggccgaggaatctgcataaggattgggttgttaagggaatgggccaggacgccatggcttcaagctttgaaggattaggggccattcccttagcagacacaatatga

SEQ ID NO: 92233 - DNA, 402 bp, Glycine max
  Peptide Sequence Number=SeqID_209011
atgctctcgggaacagaagcttcgagcacactccagacatcttctcaaagatcccaatgggtgttacaaagccaaattcacctcggtctgaattgggctaagtcagagccattcgctaagcgccgaaacggcccgctaagcgagcgtgttgagaaaccaaacatctcttgctatcgcttagcgatcatactcgctaagcgagttggtcgaaaaatagataaaggcctaaaaagagaagaaaacaaagtttgttatctgcgtttttctggaaaacacgataaacttgctaagcacagctgctgcgctaagcgagttcatcaaaagtgcgtgaatctttgtgcgctaagccaccaaagctcggaaaaagacaacacgagggctaagcgagtgtcatcccgctaa

SEQ ID NO: 92234 - DNA, 243 bp, Glycine max
  Peptide Sequence Number=SeqID_209012
atgtctcctccacctctagaaacctcacaatcacaaaatctcatcgaatgctcttcaagatatcttcctcttcaatctctgttatctcctgcgccagtgatgctcagtcagcctggaggttcaagcggtgtgcttagcaaattgattctcgctgagcgcatcattgacaactcatctgcttctaggatcttctacgcgcttagccatgaactgctgcgctcagcggatggctcgctaagctag

SEQ ID NO: 92235 - DNA, 522 bp, Glycine max
  Peptide Sequence Number=SeqID_209013
atgcaatgcttggaaaattttcagaaaaatcagatgtcaggcccttttgtccaatataatcatgaccaagtgatagggagcatgactacatgcaacattacgcatgacccaggagagagacccacacacccattcttgaacttaggagaaccactgctaacatttggtctgacctgtcgacgtcctccatggttgagcataacacacgctccaagacgaccgaccttttggaggaggccgttctccgcctcacctagactcaccatgacctctcattgtgccttgactccatccaagaacagttgcaactcctacaaattcaacaccaacaccctccaccattacctcatccacaatctcctccctcttcccgccaccacatcaaactcgatgtctcgcgctttgatggcacggatgctatgggatggatctttaagatctcctagttcatcgactaccaccacacccccgacgaagaacgcgtcaccgtcacctccttttatatggacggccctgctttaa

SEQ ID NO: 92236 - DNA, 663 bp, Glycine max
  Peptide Sequence Number=SeqID_209014
atgatactcaaattttacgacgatccaacggtgaacgggttcgagatcgtcgtttttctgagactggtttggtgggctgcgggaaaaagaaagggttttgagaggagaaggagaaaaacgaaaatgagttctcctcatttgttctcctcatttcttttctcattcctccaacaacatcactcaacccttaacagtatgagtacccaatcatcattcttctctaatgcgggcccatcaaatatgatggcaagaacacgatttacagcagcatttcgtgttcagaagaacatcattgaagttccattgagttaccatagtcaatggaggtcatattacccaacttatgttttatttgactacaatgaaaccacgcattttattagggtgcgcaaatatggcactcgatgtttttttgctgatgggctgaaggagtttagaagaatccatgacattaatgacaatgtcattatccgattttttgcaacctcaaaagatacttctttggaagtcgacatcatgggacctacccttagacagacatgtcgaaggccggttgttacaaccagaaggcacatctttaccgctgatgtcacccaagacatgatcgaacataccaactctttggttcttccagcagcagctttaaattttttgtttggataa

SEQ ID NO: 92237 - DNA, 318 bp, Glycine max
  Peptide Sequence Number=SeqID_209015
atgtatggaagtatccaacttgcgaaagttggggcagaagatggatcgggtttacatagcctctttgactactaccaacacatgattgagctagtgacatacataattaagaactacagttgtgcccatcttttatttctagttacacgtgtcaagacaaggataataagtgacatagaacaagtacaagagcaaatgaaggctgatatggaggccatgaaggaacatatgacaacgatgatggaagcaataatgagtatgaggaagatgatgaaggtcaatgctgctatatctcttgctgccagtatgactatataa

SEQ ID NO: 92238 - DNA, 354 bp, Glycine max
  Peptide Sequence Number=SeqID_209016
atgggaaactcggggagtcaccatcaacgtttactcaaggaaaatgtcagaaaaacaaaaaagacaagaaatgatctacagttggagataaaggatttgggagtcgtttacgcacggggaggtgttaacaccctgggcgtccgtcatgaaaaagacagcttttattcgattgcgctaaaaataaaattttggttttgtggtaaattttgtgaagtcgagcaagtcggagacctagcatggagtgcatactcaagcaagtcgaagattcagtatgtcattcataaaaattactcacatgttattgaaatgtcaccaagaaagtcggagactcagcatggagtgcacagagcgtaa

SEQ ID NO: 92239 - DNA, 1578 bp, Glycine max
  Peptide Sequence Number=SeqID_209017
atggtagagctcccaaaaagtaacacaatcatgccttccagtaagactctcctcctcataactaatctcacccttctcagttttgcaacaactgaggcacaaaacgaccctttctatctatacaaagattgttccagcgacaaaaccagccccaacacctccttccaatttaacctcaagaacctcctttcttccctatcatccaacgccaccggcaacaccccattttacaacgccacaatcaatggcgaaaacccctctgactctatctatggacttttcatgtgtagggctgacgtgtcctctcacctctgccaactatgcgtccggaatgcaacccaacaactatcatcagaatgctccttatccaaacaagcagtcatatggtacgaggagtgcatggtttggtattccacgtcttttattttctccagtgtggccacaacacctagtaatcccatgaagaacagtggtaatgtctcaaacccagaaagcttcatgcgtttagtgtttttgacattaaaccaaactgcagatgaagcatcatcccaatcaagtattggtaacaataagttcgcaacaaaggaagcaaaaaacgtgttaggaatatctcagactcaaaccctttattgtttagctcagtgcacaccgaatctttcaccacatgattgtagaacatgtcttgatgatgcgataaggcaaattcaagggtgttgtgaaggaaggataggagggagagttctgtttcctagctgcaatgttaggtatgaaatgtaccctttctacaatgttccttcagcaactcctataccaaagcttattcctcaaacaaaaacttcccatgcggattcaaatttatcagaatttcctatttatctttctcataattgcacaaacaaaaccttcaatgccaacaacagtgctttccaaacacacctcaccaaactcttatttaacctagcttctaatgccacaaccgggaacaagttttataaggctgatgtggctaacacagtgtttggtctcttcttgtgccgagaccaagaggatcttccttcagggctttgtggtgagtgtgtcaaaaacgcaacgcatgaaatatcatcaaagtgtgactcgttccatgaggctataatttggtacagccagtgcatgcttcgctattcctatagaaattttttcaatgaagtggaaacaggtcctgtgttttctgagttaaacaccaccaacaaggatgatgaacaaaatttctttacgatgaagttagcgaagacgttagatcaagcggcgatccaggcaggggacagtgatgagaaatacggaaaaaggacgacaaaattgaatgatttgcaaaccctttatgctcttgctcagtgcacacaagatttgtctattgaagattgcaagggttgtctgggaattgtgattggaacatcaattccatggtctcgtttgggaagtatagggggaagagttttgtatcctagctgcaatatcaggtttgaattgttccaattctacaaagacaatgacaaatctgggacgtcatcatcaccaggtactttccaattcaagtaa

SEQ ID NO: 92240 - DNA, 351 bp, Glycine max
  Peptide Sequence Number=SeqID_209018
atgtttcatctagttggtcgtggaattgctactttagagtcgttgcaatttgatttggctaccattatagcagcaactaataaattctcagaccagaataaaataggcaaaggtggatttggagaagtttataagggtattcttcttgatggttcacaaatagccgtaaagagattatcaaaaagttcaaagcaaggatcaaatgagttcaagaatgaagttttattaatagccaaacttcaacaccgaaatctagtgactctaattggtttttgctttcaggaagaagaaaaaatacttatttatgaatatgtgccaaacaagagccttgattactttctatttggttag

SEQ ID NO: 92241 - DNA, 351 bp, Glycine max
  Peptide Sequence Number=SeqID_209019
atggtgacagttgcttcatatctgactagtcaccctattgaattgccaacaccacaagagcctgcatttttcttgcatggtagaatgcatgaaaatccagttgcgaatgaatcaagttccaatcaatcaatcaacacttctacaccattctcgaacaatcaaatgtctataagccaatttcttcctcggtacctaatggaaggggttttccattttgaggccgggggctttcttgtgtctgctgctttgtttatgttctatcttatatttgtttttggtggtcctaactggggcatactgaccttgtgctgtagattatatcaggaaaaactgaagtatatctcgtgctga

SEQ ID NO: 92242 - DNA, 341 bp, Glycine max
  Peptide Sequence Number=SeqID_209020
atattgtggtagtagatgttggagtccccaacatagttcgtggcaattggctaaagaaaggagctgtggtgattaacatgggaacaaatcaagttaaggtagccatagcccccattgcgataattcagcatgctatactgaaggttcattatgagccctccaaaatgctaaccattctaaaatggtcgcgtgtgaaagaccgtcttagaatgctcatcattctatatcggttcttcaacgaacgtcgtagaaaacttagcattctacatcgatcctgcagttgtgaccgtcgtagaatgctgagcattttacatcggtccttgacaaccgtcgtagaatag

SEQ ID NO: 92243 - DNA, 945 bp, Glycine max
  Peptide Sequence Number=SeqID_209021
atggcagaagaccagccgcagagggtatctctggaggactactctagttcctctacacctcagtacttgaccagcattgcccaactcgaagttcaagcagccaacatcacctatccacattccttcattcagctgattcaagacaatctctttcatggtctaccaaatgaggacccatatgctcatcttgccacatacatagagatctacaacacagtgaagatagaagagttccagaagatgtcatccacctcaatctattttctttttctttggcagctaaatatattcattgatggcttgcgaccccattctagctcacatctcaagaagagtcttcgtgagctcacatctcaagatgcattactagctcaaaacaagcttctagccaagccaattaagacccttacaaagaccctaaacaagcttcctcaacagttgcatgcagtacaacttgctccatcttcagtcatgcaaattgggggatgcaacatttatggtggggcctatgagtcaggcatgtgcatgactcaagattatgcatctaaagaaggttccatcaaggaaggcctccaggataccatcaagggggaaatttctctcaaggccaagactttagatcccattctaagaataacttcaacaaggatcaaggaaattcatctattcggcctcccaatcaagggcctaatttttacagtcaacactaagaagaaccccaaggaggagtgtatgacagttttcactaggagccagatgagggaaagcgatgggaaggaaaaaagagctgagggagtgttggaagatagtaagaagagtggtgatgaggtcttactctctaagaccaagagtcagttggctagggaggatagaaaggagatacgatcagtcccagtgaaggaagtcccatatctcttggtgccatcaaagaaagagaaggaataa

SEQ ID NO: 92244 - DNA, 441 bp, Glycine max
  Peptide Sequence Number=SeqID_209022
atgcgtgcgacgttgcccagcgaatccaaagaccggggcaccgatccgtcccggtcaccgctcattccagcgacggagaaaaagcccgccggagcatcggcatcggagaagctatgcatcgacgagatgctgcagaagtactgcggcgagttcgggcggtggcagctgaagcacttcatcttaacgagtctggcgtgggcgttggaggcgttccacacgatggttatcatattcgcggaccgcgagccggagtggcagtgcctcgacggcgcggccgggtcgggatgcgacccggccgcgaagaacgtgtgccggttcgaaccgggctcgtggaagtgggtcggggactccacggtggcggagtgggggcttttttgcggtgacaagtttaaggttggactggttcaggccgtattcttcggcggctgcatgatcggttag

SEQ ID NO: 92245 - DNA, 381 bp, Glycine max
  Peptide Sequence Number=SeqID_209023
atgaggtttttcttcgagttcgtgtcttgttgcggcctgccgacgcagcgttcgccggagccagtggttccagcgaaggaggaagagaggtcactggttccggcgacggccgtcgccgttgtgccctcccgtaagaagatgaggatgggctcggcggagtggaggccgtcgctggggtcaatctcggaggatgttacgccgccggcgccggcgctgagggatagagagagtccccggaaaggtgaggtggcctccgctggaagggacgcgaagaagaggagcgccggtggtggcggaactgccaaggtcagcaccttccatgccgacgatgataccaacattctctccgacgccatttatgttctaaagtctaaacattag

SEQ ID NO: 92246 - DNA, 396 bp, Glycine max
  Peptide Sequence Number=SeqID_209024
atggtgataatgaataacaccttgtggaaggtggttaccattggaggtggcgatggtggacatgattttcatggcctccgattttcttcctcgtacgaggtaccatctcggggactccgagacgaaggggaggacgaagacgaggaagacgagggaggagagggaggagactatgtagagattgcgccatgcggggaagatgtaggcgatggcggagaggagggcaatgccggaggagaagaagtagaaggtggacatgccgaccgtaccgcgcattttggggcccaccggctcggtggcgaggacgaaggcgcagaggccgacgccaccggtgctgcagccggtgaggaggcggaagaggacatagaaggagtagctgggagaaaaggccgttag

SEQ ID NO: 92247 - DNA, 528 bp, Glycine max
  Peptide Sequence Number=SeqID_209025
atggcatattttgttgggagggttgaaagaaggcactacgaggataccatggctgaacagagagccttatgcttactggaaaggattggtttcgagaattacaagaggggttcaacaaatcagacttgccaagtcaatgcacttatagatataaggtgtacattgaaggttctgcttggtcagtcagtcaaaaatacattctgtcatgtgactctaccactctacgtgtacgactacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgaccctccaactttgtatgcaacattagagagaaaggaaagctcaattcaacaagttgaatcatgggagagaagttattgggataatcaaaccataacatcttaa

SEQ ID NO: 92248 - DNA, 593 bp, Glycine max
  Peptide Sequence Number=SeqID_209026
gatcccactgatctcctccccgaagcttcattacctaacaggtcaacttacaaaagcaatccccaagagactcaacgtaaggatgcacatgccaaagttgagtatgtgaaaagattgtatgaccaagtgaatgtgcaaattgcagagaagaatgaaagctataccaagcaagccaacaagaaaaggaaggaagtggtacttgaacccgatgatgatcttggacatttgagggcaaatgttttccaagaaggagggaatgatgagaatcctgaaactggttcacatcatctccttccagaagcttcattgcctaacagaccaacttacaatagcaagccccaacagactcagcataaggatgcacaagccaaagttgagtatgtgaaaagattgtatgaccaagtgaaggtgcaaattgcaaagaagaatgaaagctatgccaaccaagccaataagaaaatgaaggaagtggtacttgaacccgttgatgatcctggacatttaagggcaaatgttttccaagaaggaaggaatgatgagaatcctgaaactggccaaatacaggctaaaggcccaagtggagaaggacgaag

SEQ ID NO: 92249 - DNA, 168 bp, Glycine max
  Peptide Sequence Number=SeqID_209027
atggcagaggaagataagactaaggcaaatgcagcaggtgcacttagcaatctggttcgcaactctgacaagctttgtgaagacatcgtgtgtaaaggagcggttcagcggccacacccgagcaaaaatgtacaaggaagcagaatagcagtagttggacatgactaa

SEQ ID NO: 92250 - DNA, 480 bp, Glycine max
  Peptide Sequence Number=SeqID_209028
atgataacaaaagatgatgacaaaggtgatgacaaaaagctcaaaggtcaatcaaagaatgagttcaagatgttcaagatagaatcaagaacacttcaagattcaagaggaaagttgatttcaagaatcaagaatcaagattcaagagatcaagattcaagactcaagattcaagaatcaagagaaggcttaatcaagataaggtacatcctttgtggtacaagtagagggtacatctacttgggtttgactgagaacaagagagggtgcatctcttgtggatcagttctagtggagggtacatccactaggttcaaagagaacaagggaggcttcttagccaaaagtcatcctgtgaatgaatttatcccttgcacccattttgagcctaatgtaaaagaaaaattgtcattggaacccaagcccaaaatgttgatatcgactaactacccttccttaggttgtaggagagtatgctaa

SEQ ID NO: 92251 - DNA, 747 bp, Glycine max
  Peptide Sequence Number=SeqID_209029
atggcgaacacagagaagaatcccaaggagaagtgtaagctaattttcactaggagtcagaggagggagaatgcagagagagaaaaaagagagatgatggagtattggaggatgaaatttcagtgctatgattcagaaaattttaccatagaaattcaaagacccagggaatgtaacaatctcatgctctattggggatgtagaattggaaatctaaaggttgttcctactaaaatgactcttcaactagcagaccactccattatcagatcatatggtgtagttgaagatgtcctgtctgtgtttctagaagaagatgtcaagccaattgtgaatacaacaaacccttccattgtcttcccggggccaagacgagtcaaggcccgaaccactccagatgctccacttccaatgatccctcctacaaccacctcttctaaagtcggtaagccttctcttttttcctctcaactagagcagcttttactcattctacaaagccttcaccattgccagtaccttttgatacaaagtcttcaccaattatctctccagcagctagtgatgacactagaggcattcttatctcaggttgcctggccaagagtccagcttccttctgtaagggggggtgatacctctggtactggtaatgatgatgccacaaacgatggagctaatgatgattatgttgcagacatccctgctacaaaggaagcttgggatctagggcccatacaggattga

SEQ ID NO: 92252 - DNA, 144 bp, Glycine max
  Peptide Sequence Number=SeqID_209030
atgacccaagttgggttgatcacccagttttggaaggtgaaaaaaccctttttggggatggctctggtagagccaatttgaaacctttttcgcgacctcttccttctcgtatggaggcactagctaccttaggcggcatgacaa

SEQ ID NO: 92253 - DNA, 708 bp, Glycine max
  Peptide Sequence Number=SeqID_209031
atgcagccacggcattacgggactaattttaaccagcccaaaaagttttttgcaccttttgacccagcaggatacatttattgggactatattgatgcctggaccaatgtgttttggcatcagaacaataaattcaagcattcgtggttgatttatttaaaaaataacactgtatacaattttccaaactggtttctccaatggtggacttattttggtccaatcccacaaatctttccagaagaagtccaacaaggatttcaacagttcaatagattgttcaacaaccaggaatcaagaattccagccgatctaatgtatgggaaaactgaaaacaacaagcaatatccacctttgcagagacatgcttttgtaaaatggtggacacaatttgatacctcaaaggccgctccagacaaagtcaagaactggttccaaagtcaccccgaatttctcaaacctgctaatccagaaacatcattatttctgaatcagaaatctcagcttgcggcgttcttggccagttcaaaatccaaagaaagccttgcccagaaccttaaggaagttctccagctacttcaacaagaagaagaggaggaatcttcaaagaaggatgccggatcttcagaagacattgatgacctagatgatgatcctgtctaccaaaatgaggatgattgttttggcatctcattagaagatgattaa

SEQ ID NO: 92254 - DNA, 3407 bp, Glycine max
  Peptide Sequence Number=SeqID_209032
atgaacgaaacagtactcaatagcactgagagctatttgtatctccatccaagtgagaacccagctacaactctcgtctcacctgtcctggactcgaccaattaccattcctggagccgatccatgatcacggcattaagtgccaaaaacaagctagagttcatcgacggaagcgcgccggaaccactcaaaacagacagaatgtatgcagcttggcgacggtgcaataatatggtagtatcttggttagtctattccgttgcaacctccataaggcagagcatcctttggatggacaaagcggaagagatatggcgagacttgaagtcaagatactcgcaaggagatcttctaaggatttccgatcttcaacaagaggcttcgacactgaaacagggagcactctcggtgacggaatattttactcgccttcgtgttatttgggacgagattaaaaatttcagaccggacccggtctgcacctgcaacattagatgtacctgctccaccttcaccgtcattgcacaaaggaaaatagaagatcgagctatgcagtttctacgcgacctgaatgagcaatatgctaacgttcgatctcatgtgctcctcatggaccccatacctgctatatcaagaatcttctcctatgtggcacaacaagaacgacaactaataggtaactcaacccctgatctcaacttagaacctaaagacatttctattaacgctgcaagaattatatgtgactactgtggacgtactggtcacacggaaaatgtgtgctacaagaaacacggcgtgccccttaatcgtgaaggaagaagcaagaatacaggtgggaggaagacgtgcacccactgtggtaaaactggccacaccatcgacgtctgctatcaaaagcatggttatccaccgggatacaagccatacaatggaagaagcgtgaataatgtagcagctacagatggcaaacctgaagatgatcacatacaacatcgtgaatcccaggaactcgtacgattctcaccggagcagtacaaggccctacttgctttaatccaacggccaaccgtcggaaactcagcatctgatcaacccaaacaggttgcttccatctcgtcgtgcactattgataaatcatcaagtccaggagccacagatcacgttacttcttctctcgacaatcttcattcctatgaatgcatcaacccagtcacagtaaagcttcctaacggccatcatgtccacgcaaatctacctcctggtttctggtgttacgcgttaactcatgctatatatttagtaaacatcattcctactccttttctgcatggcatatcaccatacgaaaaaattcatggtcatcctttagatatagctaatcttcgggttttcggttgcttgtgttatgttagcacgctcaaagcaaatcgaaagaaactcgatcccagagcacacccatgtattttcattggtttcaaagcaaacacaaagggatatcaggtttacaacatgcattcacatgacatcatatcatcacgaaatgtcatcttttatgagaactatttcccacaaatctctgaaatacaacaacttgactccaattctagtgcaccattaccagtctcgttctccactaaccaatatgattcacctgtagaacctatcacacaagaacccataaacattgaccacctaacggaaccttcttcctcaccaccaagacgttccacacgaactagacatgcacccacctatttgcaggattatcatcgtgatctctccatcaacaatacaagtacttccatgtttgttcgttatcccctaagttccgttttgtcatactcgcgtctttcacccacacacaaacacttcgtcttgtccatatcatcaaccgtagaaccttcttcttatgccgaagcttcacggcacgactgttggattaaggcaatgaaggctgaactacaagctctacagtcgaatgagacctggaggctcactcttcttcctccacagaaaaccgccattggttgcaggtggatttacaagatcaagtatcgcgctgatggttcgattgaaagatataaagcacgtttagtggcaaagggttacacgcagatggagggtcttgattatcttgatacgttctctcctgtagcaaagttgactaccgttcgtcttcttcttgcccttgctgccgtgaatcaatggcatctgcggcaactggacgttaataatgctttcctccacggagaacttgatgaagaagtttatatgcaggttccaccgggattgaccgtttcaaatcctcaactggtatgtcgcttgcagcgttccctttacggcctcaaacaggcgagccgtcaatggttcacaaagttatcaggtttcctggtatcccatggctttcaaaagtctaattcagatcactccctcttcttgcggtttactggttctataacaacggtgctcttagtctacgtagatgatataatcctaacaggaaatagcatcaacgaaatacaagacataaccatgctccttgatcaggcattcaagataaaggatctcgggactttgaagttcttccttggcttcgaaattgcacgcacttcaacagggatacacttgtgtcaacgaaaatatgttctagatatattatccgattcgggaatgctcggatgtcgaccaaacgccaccccaatggactactttaccaagttgcaggctatggtaggcactcccttatccgttgagtcttcttcttcctatcgacgacttatcgggagactcatgtacctctctaactctcgacctgacattgcgtatgccgtccaacaactcagtcaatacatgtctagtccgaccaatgttcatcaacaggctgcgtatcgagtgcttcggtatctcaagggaacacccgggtctggtctattcttcccggcaacaaacactcttcagcttcgagccttcagtgactccgactgggcaggatgcccagattccaggaaatctaccacgggattcctgatctacttcggttcttccctcatatcttggcaatctaaaaagaaatctacagtttcacgaagttcttcggaagccgaataccgagctctagcttcgactacttgtgaattgcagtggttaacatacctcctccaagacttccgtatcacattcatcaagcccgctaccttgtattgtgataatcagtccgcaattcagatagcaacaaatcctgtatttcacgaacgcacgaagcacatcgagatcgattgtcatattatccgtcacaaagtcaccatgggtctcataaagcttcttccggtttcatcctctatgcaactcgcagatatattcaccaaggctttatctccttctatttttcaacacctttgtaccaa

SEQ ID NO: 92255 - DNA, 2139 bp, Glycine max
  Peptide Sequence Number=SeqID_209033
atgttgagtggaactctgtcctctgatatctgtcaattgactggtttgtgtgatgtgagaggcaacaatttgactggcaccatacctgacagcattggaaactgtacaaattttgcaatcttggatctttcatacaatcagatttctggggagattccctataatattggatttcttcaagtggctacgttgtcgcttcaaggaaatagactaactgggaagattccagaagtctttggtttaatgcaagcccttgccattttggatttgagtgagaatgagctaataggacccatccctcccatactaggcaatttgtcttatactggaaagctgtaccttcatggaaacatgcttactggaacaatacctcccgaacttggcaatatgtcaagactaagctacctacaattgaatgacaatcaagtagtaggccaaatccctgatgaacttgggaaactcaaacatttgtttgaatttggcagtggtgttaacttgctttccttactgtcattcaggaatcttgccaataatcatcttgaaggatctattccacttaacattagctcatgcactgccatgaataagttaaatctttctgcaaacaatttcaaagggagtatacctgttgatttgggccatataataaatcttgacacattggatctatctagcaataatttttcagggtatgttccagggtctgttggttatcttgagcatcttctgaccttgaacttgagccataatagtcttgagggtcccttgcctgctgaatttgggaatcttagaagcatacagatttttgatatggcattcaactatctgtcgggtagcatccctccggaaattggtcagctgcagaatcttgcgtctctgattttgaacaacaatgatctgagtgggaagattccagatcagcttacaaattgcttaagtcttaacttcctgaatgtctcatacaataacttatctggggtcattcctctcatgaagaacttctcatggttttctgctgacagcttcatgggaaatccattattatgtggaaattggttgggatccatatgtgatccttacatgccaaaatccaaaggcccccccaagcttgtaattcttcacatgggcttggccatccatacctttgatgacattatgagagttactgagaatctcaatgcgaagtatattgtagggtatggtgcctctggtactgtgtacaagtgtgctttaaagaattcccggccaattgcaattaagcgaccatacaaccagcatccacacaactcaagggagtttgagacagaacttgaaactattggcaatatcagacacaggaatcttgtcactttgcatggttatgctctaactcctaatggaaatcttcttttctatgactatatggagaatggctctctgtgggatcttcttcatggtcccttgaaaaaggtaaaacttgattgggaggcacgcctgaggattgccatgggagctgctgaaggacttgcttacctccatcatgactgcaatcctagaatcattcacagggatataaagtcctcaaacatcttgctagatgaaaactttgaagctcgtctctctgattttggcattgccaaatgtttgtcaaccacaagaactcatgtgtcaacgtttgttcttggaacaataggctatattgaccctgagtatgcccggacatctaggctgaatgaaaaatccgatgtgtatagctttggaattgttctacttgagctactaactgggaagaaagcagtggacaacgattccaacttgcatcacttaatattatccaaggcagataacaacactataatggagactgtggatcctgaggtgtctattacctgcatggatctgacccatgttaagaagacgtttcagcttgctcttctttgcacaaaaagaaatccttccgagaggccaaccatgcatgaggttgccagggttttggcatcactactcccagcacctcccagtaaaaatatatttgtaccttcttcaaacaccattgattatgcacaatttgtgattcaaaagcctctaggcaattcatattcaatgtatccatcattcatgccaaagccaaaggttggggtgaagagggtggagacttaa

SEQ ID NO: 92256 - DNA, 861 bp, Glycine max
  Peptide Sequence Number=SeqID_209034
gttatcactggcatcgcacttcctgttggatccgacaaactttattctggcagcactgatgggacagttaggatatgggactgccatactggtcaatgtgctaaagtcatcaatcttggtgctgaggttacctctttgatcagtgaggggtcatggatttttgttggtctgcaaaatgctgtcaaggcttggaatatccagaccatgtcagagtttactcttgatggacccaaaggccgagtccgtgccatgactgttggcaacaatacactctttgctggtgcagaggatggtgtcatttttgcttggagaggaagctctaaagccgattctccttttgaactggttgcgtcactcactggccacactaaagcagtggtttgtctggcggttggatgcaagatgatgtactccgggtccatggaccaaagcataaaggtgtgggacatggatacattacagtgtacaatgacactaaatgatcatactgatgcagtcacatcccttatctgttgggatcaatatctgttgtcaagttcatctgaccgcacaattaaagtctgggcttgcattgaagcaggatctttggaagtgatatatacacacaccgaagaaaatggtgttgtttcagtctttgggatgcctgatgcagagggaaagccaatattattttcctcgtgcagagacaattcagttcacatgtatgaattgccttcattttcagagaggggacgtttatttgccaagaaagatgtggcattgattgagttaggtcctggtggcctcttcttcactggagatgagagtggtttgctgatggtatggaaatggttggaggtacccaaggtggcatcctcttga

SEQ ID NO: 92257 - DNA, 441 bp, Glycine max
  Peptide Sequence Number=SeqID_209035
atgtatataggacaagcattgatgaagattaaggcttcattcagcaatgtagcagatgttctgcatgattgggatgatttgcataatgatgacttctgttcttggcgcggagtcttgtgcgacaatgtcagccttactgtgttttctctgaatttgtcaagcttgaatcttggtggggagatatcacccgctattggtgacttggtaaccttgcaatccatggatttgtctgataatcaactatatggtgatttacctttctccatatcaaagctaaagcagcttgtgtttctgaatttaaagagtaatcagttgactggtcctatcccctcaacattaacccaaattccaaacttgaagactcttgatcttgcacgaaatagactcactggtgagattcctagattgctctattggaatgaagtattgcagtacctgtga

SEQ ID NO: 92258 - DNA, 246 bp, Glycine max
  Peptide Sequence Number=SeqID_209036
atgaaggccatgaaagagcaaatggccatgatgatcatgaagaagataatggaagccagtgtagttgcagttgccgctaccagcactgttgctaaggtgaatccgatgccccaatctggcctcaaccaaatgaatcatccaacctcagctatggtaggcaaagatttgggaagtatgagcggcccccatgatgtgcaaattcaaaacgagcacgccttcccgccatgtggcttgtggcgtccctaa

SEQ ID NO: 92259 - DNA, 852 bp, Glycine max
  Peptide Sequence Number=SeqID_209037
atggcagacgaaagtctgcctttttcatttctggcgctgcatttcccccttaacgcgtgccagaatctccgcgtggtcaaggttgctgtagtcacgcatccggtaataacggataccgatccgcgcgtagatttcggtcacattgccgcagaccatttccgccagcatgaaggtttcacactcgccgttctcactgctgcgccagttcatcgggtacatcagccccagcgcatcatggaaggcgtgaacgtcgatttcgacaggcgcggtcaggtgcagcatgtcggcaatctcgtcgactttctgctgaatggctggcgtggctttcaggatgcgcgtgacagcgattctgagttcccccatataacgggttgcagactcgcccagcgccgttttgtccgtattgctctggtacttcatgagggctttgctgacgcggttttgcaggttatcaagctcgctgagggcgcctttctcccatgcgtcgaagctggatgtgctgttcgtgtcaccccatctttcggaagattctttggtggcggttttgacgttgacgttctgtgtgttcatcctgcttttcctcctgtctggtggttaatccatctctcggtgagttccctggcggcaaagggcaaaggagcaacgacgtacggaggaaggaaaggggcggagacaaaagtttttgcagttcttcgcaaaaagttttggcggagtttatttaccccttggatgacgacacggcggtgctacgaccagccctccgccgggggacttaacgtgagagggctcaccggaggaaagggggtgaggatgaacacacccgacacggcggaacgacgtggcgtcacctga

SEQ ID NO: 92260 - DNA, 327 bp, Glycine max
  Peptide Sequence Number=SeqID_209038
atgcttgaggcggaaaacgcacctgtcaaaaaacaggtgcgtattaaacgcagtgatatcgaccgtgacgacatcagcgccgaaatgcgggcgctgggccgtcacatagcgcactgccggaagaaggggcgcgccgttcgtattcctgccatgcgcgggagtgagtgggggcaagcgagagaagccgcaccagtaacacccgctaaacccgtattgcccgccgtgaatgcgcagccgataccgcaccggatgatgacaatcgaccaagcccgccgccagtttatcagcgtgttcagggataccgcccgcagcctgcgccgctgggag

SEQ ID NO: 92261 - DNA, 219 bp, Glycine max
  Peptide Sequence Number=SeqID_209039
atgctcaatggaatgccccggaactcctccatgataagaacatgttgcattcgagtcatatccttagaaaaatggaggttgaggaaccttggttgggctatggctaccattgaattatcgaggtggtgtttggcattggatgtgcggcagacagactttgaggctgatttagggattgttagacaagtggcctcagatatcttaagaagggggagttga

SEQ ID NO: 92262 - DNA, 459 bp, Glycine max
  Peptide Sequence Number=SeqID_209040
atggaagacgcacccgtgagccctcgcgtcgccctcctcgcgttgccttcccgccgaaggatgaaggtcgacatggaggccatgaaagagcaaatggccacaatgatggaggccatgatgagcatgaagaagataatggaaaccaatgcggttgcagttgccgctaccagcgctgttgctaaggtgaacccgatgcccccatttgatctcaaccaaatgaatcatccaaccttagatatggtgggcaaagatttaggaagtacggatggccccatgatgtgcaaattcaaaatgagcgcgccttcccgccatatggcttgcctcccaactatacaccacccaatgtggcatacgctcccaattaggatgtcaataacttcactccgatactcattgaaagccaataacctcaatccaatcatgcacatgtgtctcaacccatgggggagacacatgtaa

SEQ ID NO: 92263 - DNA, 204 bp, Glycine max
  Peptide Sequence Number=SeqID_209041
atgaggatgaggaaatggaggaaggaattggagtatcctaagccttggagtgtcgttggcttctactcgaagaacccttgcacttctttgatggttccgccagttgagacacttattagaaatttcaatcggttaaaatggaagaggatgaaacaagatgaattttgggctttgtgggacgtgatttggataagaaatgagtaa

SEQ ID NO: 92264 - DNA, 252 bp, Glycine max
  Peptide Sequence Number=SeqID_209042
atgagcaaaaaggggtgtctcaaaggtgagagacgtgcacacacaccttcatcgctgagtggtgaagcaaatgaagagagtaacagcacaagcaccattgccacaacaagcagcagaaagtgccttctcaacttgcccacaaaagccaacaccaacacagctttttccattgccaccacacgtacaaaaaaccccaccttggtgagcaacaataaggaaagaagagagattgaagatggaagagatgagtaa

SEQ ID NO: 92265 - DNA, 360 bp, Glycine max
  Peptide Sequence Number=SeqID_209043
atgggtgccaagcacctcacaaggaccaaagaaaggtcgcatgtcaccaagcaaaggtccccggacgaaattaggggatgcaattcaccttgggtgcgctcattgatcgtgtgggcggagtgtttgaccccttgggggcatctcacacgggcctccaactcatcttggtcagccttcaattttctaagttcctattcatggcggtgttccatctttgcgatgcgggggaagttttatcatggcccctcggtgggcaccaattgtacttaccaaaatctagagcaaactgacgtcaaggttgatgtagcaaagatgggttcctcgatttcccaggtcgaatttataggtgtcctccactag

SEQ ID NO: 92266 - DNA, 231 bp, Glycine max
  Peptide Sequence Number=SeqID_209044
atggaaaaatctgacaagaggaatttcaaagagaagaaagaaaagaaaggatacatcacttgggaagataatgtcataaattcttcaagtgattcagagaataaaatcataagtctgggtatcatgatgaaagactatgaaaacggagaagagcaaagtcgatacattgatagcaatttctccaaacacatggcatgcatcaaagtttattcatatttctcgccaagataa

SEQ ID NO: 92267 - DNA, 306 bp, Glycine max
  Peptide Sequence Number=SeqID_209045
atgctttacaagcttttggtcaatctaaggagtggtgtcttcatgctgcaaattgatgcttttacaaaaataagcactgcagctaatttaaggcacaaattctgcagcatctgcagtatgtgggtggaaaaagggtgggagtggaaatttcaatggagaagacacttgtttgacagagagcttgagatggcagattgtttccgtaatgatgttgctggcagctgtattcagattcacaaaaaagatgattggagaactttgacaaggactttgccttcacctacagctattggtcgtctaacatag

SEQ ID NO: 92268 - DNA, 222 bp, Glycine max
  Peptide Sequence Number=SeqID_209046
atgtgtacctatcacttgttttcacagaatatgcagtcagacaaagaggagaacaaaatgaggtccaatctttgcatttcatctcatgccatcaagtcagaaatgtataaacagaaccagaaggactttctcaagcttgtagtgaggcttggctacaaaaattcattggtttttctaggattcaaaggtttagattctaagagagcacaagtcctagactaa

SEQ ID NO: 92269 - DNA, 957 bp, Glycine max
  Peptide Sequence Number=SeqID_209047
atggtgccaatttttgaagactcaacatgcaatatacttcaaggaagtcagctagcagaattgttaaatcagacaaatctgataatttgggatgaagcacccatggcacacaaattttgctttgaagcacttgatcaaactttaagagacattattaaagaaaaaaaaaatcccaataaaatttttggaggcaaagttattgtatttggtggagattttcgacaaattctgccagtcattccaagaggaagtcgttcagacattataaatgcaacaatcaattcatcatatttgtggccttcctgtgaagtcttaacactcacaaaaaacatgcgtttacaaggcaatgcccaattaattgatgatcaagaaactactaaatttgcaaagtggattctagatattggggatggatttattgggaatcaaaatgatggatatgctactattgaaattcctgagtacctactgattactgaatataatgacctcattgatgctatagtcaaatcaacatttccagatttatatcaacatcacaataatcctgatttcttcaaatctagagcaatattagcttccaccaatgaaacagttgaagaggtcaatgattatatactttccttgattccaggtgaacaaatggaatacttaagctctgattatatagagaagtcaaaaaccattgacagttggcatttccaatcaatcacaattgaatttctcaattcactaaacacatttggtctgccaaatcatcgtatcaagctaaaaatcggtagtcctataatgttgctaagaaacttagaccaaacccaaggactctgtaatggtactagattaatagttactagactagccaaacatgtcattgcagctgaaatcatttctggcaaaaatgttggtgataatgtttacatcccaagaatgtcaatgtcaccttcacaatcaccatga

SEQ ID NO: 92270 - DNA, 345 bp, Glycine max
  Peptide Sequence Number=SeqID_209048
atggctgaagaatttgtgaagggctctgttcatcaaaacggcgttgctcttataaccctcgatcgcctcaaagacgaatgttcgagtttttgtcagcatttcagagtcatagatgatggaaggaagagcattaacatgcagcatttcagagtcatagatgatgggaggaagagcattaacataaagattcaggacttcttcacgaggccatcagggatgcaaaaacgcaatgatttgacttctcaatataatgctggtggatatatacctcagcaagatggagctggggatgctgcacatggagtttttgaaattgaggtgctagctgaaggccccttttgttag

SEQ ID NO: 92271 - DNA, 363 bp, Glycine max
  Peptide Sequence Number=SeqID_209049
atggagccatttatgaagtacgagtcagacaacgcagagataaagcagaggaagaccatatggactcttcaacttactcaggaaatgccggatcatcctgaacccctgaaactcccccattgtacagaagttcctcttagagcttgcggcaaccacatgacagtcttaaggcggcatggccccccactgcaatggaaagttgaaacgctgaatcctgctattggtggaaaaggtgttgtccaaccatggaggcaggaagattgggaagatgatgacagtgagtacgttgtctttatcattttgctgcgattactagcgattctggctccatgcacgcaagttgcagcctacaatctgaaatga

SEQ ID NO: 92272 - DNA, 312 bp, Glycine max
  Peptide Sequence Number=SeqID_209050
atgatttacctatcttcagatctaggtctcttccctcaacacgatcttcctcacttcggacattggtcacatcaagggtttcctactgaagcttcaactactaagctagctctaacggttgaaacttgtggaagcaatgtcttccaaggttattttgatgatgccaaagaatcaagagttaagcaaattccaaagattcaagaatcaagtttcaagaataatcaagatcaagattcaagactcaagattcaagaatcaagagaagactcaatcaagataagtactaaaaggattttcaaaaacattgagtag

SEQ ID NO: 92273 - DNA, 348 bp, Glycine max
  Peptide Sequence Number=SeqID_209051
atggcgttgctacttagcaacattctgcccagcgaccgcaatgccgatctccccctgcggaaggatcatgcccgcaagacacccaatggacccgaagaaggccaacagggtattggagttgccagctctaattacgggcctctgttagttctacggagtgcccgttgcccccagcaagctggcgcagggcgaaacaccacagcagcctggggatggccaacaacaggcaacagatgcaccgtcgccacctccagagcccctcagctcatccacaaaaaggtccgtgaccgacaagtcatcaggcgtccagctcaagacgttaaagaagcgctactaggaggcaaccta

SEQ ID NO: 92274 - DNA, 402 bp, Glycine max
  Peptide Sequence Number=SeqID_209052
atggctgatgagccaagacaagtgaccctggaagattactcaagtacttatgtgccgcaattcttcacaagcattgtgcagccaaagaataatttgtttcatggcctgcccaatgaagacccgtatgcacgtctagctacctatattgagatatgcaatactgtcagaataactggtgtgcccgaggatgctattagattgatctttttttcattttctttgtctagagaggcgaaaagatggctctattcatttaaaggtaatagtcttaagacttgggatgaggtggttgaaaaattcttgaagaaatacttcccagagtctaagactgctgaaggaaaagctgccatctcatcctttcatcaatttccagacgagtccttgagtgaggctttggaatga

SEQ ID NO: 92275 - DNA, 321 bp, Glycine max
  Peptide Sequence Number=SeqID_209053
atgttggaagcgtggaagctagttcctaatgtttcggatgaagtttctccacctcctaaatcgcaatcttcatccaaagagaatgcaagtgatggccactatccgcaagtctctcaaaattcatgtagtcctcgttcaatgatggccaatttgcagaagaaatctactccttttagcaggttcactccagtagatagttcttctactagcaatgctaaaaatacgagtgcttcaagtataattttgccatctatatatatatatatatggagaggattcatttactccaccggtaaatttaaaatgttactctcaatctag

SEQ ID NO: 92276 - DNA, 1151 bp, Glycine max
  Peptide Sequence Number=SeqID_209054
atcaccgaggccaccgacgaacttcaggttctgctcgtgcaggccgccctggtcggcaccgccgaagctgccgccgatctcggcgccttcgaagttctgccgggtgatgatgttgaccacgccggccacggcgtcggagccgtacaccgccgaggcgccgtccttgagcacttcgatgcgctcgaccgcgaccagcggcaacgcattgagatcgacgaaggtgtcggacaggccgccggccgggaagccgtagttggccaggcggcggccgttgagcagcaccagcgtgttcttctgcgacaggccgcgcaggccgatgccggccgagccggaggcccagccgttgttggtggtttcgttggcggcgttgccggtgttggccgagatcgaacgcagcacgtcggccacggtggccttgccggtctgttccagctgctggcggccgatcacctgcaccgggttggaggcctcggtatcggtgcgcttgatgttggaaccggtgacgcgcacggcggccagggtattggcgtcgccaacggcgtcggcggaggtttcggcggcggcggacaacggcgcggccagagcgacggccagggccgccacgagcagggtgtgcttgggcatgacgatgtgggggaggtggtgaggacgacgaagttccgcagtagtccatgcctggccggcgcccggccaataacatctcttcatacggatataagagaaactatcatctcttcatccggatggaaagagtcacttcacggaagaccaacgtccgctcaggctgcccggcggcctgcggcgtacaatcgcggcatggaaatcttcaaagtcttcatgctcgaggcggcgcaccgcctccccaacgtgccgccggggcacaagtgcgcgcgcctgcacggccactcgttccgggtggaactgaaggtcgagggcgaacccggcgcgcagaccggctggatcatggacttcggtgacgtgaaggcggccttccagccgatctacgaccgcctggaccatcactacctcaatgacatccccggcctggagaacccgaccagcgagaacctggcggtgtggatctggaacgagctcaagccgagcctgccggcgctgagcgagatcaccgtgcacgaaacctgcacgtcggg

SEQ ID NO: 92277 - DNA, 387 bp, Glycine max
  Peptide Sequence Number=SeqID_209055
atcacgggcctctgccagtcattcggggttcccgtcaccctaagtaaagtgatccgaccgccgatcacccgggccttcatcgagaagtactgcacgcctaggcaggtgcagggtgatgcacatcaggccgcagacgcaccgccaccacctcggcaggctgatcccgctggatcactaggcatagagcgttatctacaacacttggttcgccagcaggcgaccaaccaccgtgggcagtttggggctaaggtcgcatggcttgaagactggcccgaggctcaggtaggggaggagcctgtaggatccgtcggtgaggcagaggaggcccgtatggatgaagatatgactgacttgcacagtttcttgggaggaagcggagccacgtga

SEQ ID NO: 92278 - DNA, 450 bp, Glycine max
  Peptide Sequence Number=SeqID_209056
atgaatgactatctcgccaagccgattgatgaggacaagctgaagcagctgctgcagcgctatgcgccgggcagcgtggcgagcgcggtgcgacaaccggcgatcgcaccctcacttgactgggcgctggcattgcgtcaggcggcgaataaagccgagctggcgcgcgatctgctgcagatgctgctggattttctgccggaagtggagcagcgcgtggcgcagtgtatggcgcagaatgacgtcgatgggctgcgcgagattatccacaagctgcacggcagcgccagctacagcggcgtgccgcggctgaaacagctgtgtcagcagctggagaagagtctgcaccaggagagcgacatcgcagcgcttgaaccagagctgctggagctgagcgacgagatggcgaatgtagcgcgcgaagcgcgtcaggtgctgggcgtggcgtag

SEQ ID NO: 92279 - DNA, 459 bp, Glycine max
  Peptide Sequence Number=SeqID_209057
atggcaacccctacaaagccaactaagtcaatggcaatgcttggtgtgaccccaaaccaaccaactaggtcaatgaaaatatttggcgtgacccttacccaaccaactgagtctatggcagcgcctagtgtgacccatatcgaaccaattgaccaatctatggaaattccttgcgtgacccatattcaaccaattgagcttatggaaatgcctggtttgatcccaatccaaccaactagttctatgaccatgcctggtgtcacccctacccaacaaactttgactatcgaaatgcctagtgagacacctccttctcttgagtttatgaagcagaggttggagatgatggcatcaaccatggagacttcagggcatacactttcccctcaaatgagagcccaactggattctggaattaaaaatcttctgagaagggtaaatgccaggctaaatgcctga

SEQ ID NO: 92280 - DNA, 306 bp, Glycine max
  Peptide Sequence Number=SeqID_209058
atgggtgccaagcacctcaaaatgaccaaacacaagttgcatgccaccaagcacaggtccccggacgaaattaggggggaacaaagaatgcagaagacgttgtcagtcttcgcatgctatcaggcttttcgtcttacagatagcaagaacaatgtttatacggataaccactcgggtatttccgcccgtcagcgtgactcaaatgtcagtatgacagatcttgtgagcgcggaagatgacgtaaatctccgcgtgtcaacgggcttgtcggtcgcgattgacgaaggacgcagaagacgacgttag

SEQ ID NO: 92281 - DNA, 498 bp, Glycine max
  Peptide Sequence Number=SeqID_209059
atgaggatgttgcggtggatgtgtggtaagactcgacaggataaaattagaaacgaagttattagagagagggttggagtagcgcctattgtagagaagatggtggaaaatagacttaggtggtttgggcatgtagagagaagaccggtagactctgtagtgaggagagtagaccagatggagagaaggcaaacaattcgaggcagaggaagacccaaaaagactataagagaggttataaaaaaggatctcgaacttaatgatttggatagaagtgaatttctacaagagttgctttgggctatcggagtggaaaatagggtggtggaaagatatgcagatttattgaattgtagaattttatcttggccatttgtatatcttgggataccaattgaggctaatccaaggaagttgaacttatggcaacccatctttgacaagttttccaagaagttagacactttggaagcacaagtttatgtttcttgcgggtag

SEQ ID NO: 92282 - DNA, 358 bp, Glycine max
  Peptide Sequence Number=SeqID_209060
atggcatcggatgtaacagttaattcggttagtgatgtgaacaatgctcccaatcctacaaaatctgtaggtccttcctctactccgtccctcacggcttcccttcttctccctgccaccactagcactgcttgtggtgccctcactggctcccttttcggctatggtgctggattgattaagaagaaagactttaaaggatcctttatacaagcaggatctaatgctaagacatttgcaattttatccggagttgatagtttggttgtctgcatattgggaagacttagaggaaaggatgatgccattaatgctggggtagctggatgctgcgctggtcttgctacaagttttcctg

SEQ ID NO: 92283 - DNA, 834 bp, Glycine max
  Peptide Sequence Number=SeqID_209061
atgaagcacttcactgacaccctcatcagtgccaacatactggtaccgggccccccctcgaggtcgacggtatcgataagcttgatatcttcatcattccaattccaaagccctctgcaagtgtcgattcgtcccgttttttcttcgagcgtggcctacgtcttcctcatcctcttcaccaccttcttcttcatcggcttcgtcttcctctacttccgccagttcgcctccgacgcggccactttccgccgccgtcatccgccacgccgggaggaggaggaggacgccgcggcggcggcgtcagcgaagaagtgtctgccggtggtggggcaccgcggggggtgcgcagagtgcgcgatatgtcttgaggagctgcgagagggggacgcggtgaaggtgattccgtactgcaagcacgtgttccacccgcactgcattgacacgtggctcgataagcaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 92284 - DNA, 219 bp, Glycine max
  Peptide Sequence Number=SeqID_209062
atgagggcttctggtaatcgattaccaagggggtgtaatcgattaccaggcttagaaaagggactggaacattgtggaggcctctggctgtgtaattcaagtttagcctctggtaatcgattaccaaggctgtgtaatcgattaccagagatgaaaagccttaagataccccttttaattgcatgtagtggttatgagacgcattgtgttgcggcatag

SEQ ID NO: 92285 - DNA, 666 bp, Glycine max
  Peptide Sequence Number=SeqID_209063
gtccttgccttaagagggctacacgctctcgccttcagagggctacatgccctcgccatcagaagactgcacgttctcgccttcgtaaggctacacgccctcaccattaaagggccacacgccctcgccatcgttgggctacatgccctcacctttagaggactacacgtgctcgcattcataaggctaaatgccctcgccttcagaggactacacgtcctccccttcagagaactacgggtcctcaccttcaaaggactacacgtcctcggcttcagaggactacacgtcctcggcttcagagtgctacacgccttcacctttagaggactacacgtcctcgcctttagaggactgcacgtcttcgccttcagatggctgcatgccctcactttcagagggatacacaccctcaccttcagaggactgcacgtcctcatagggctacacgccctcacctttagaggactacacgtcctccccttcaaagggctacatgccctgacctttaaaggactgcaaatcgccgtcttcagagggcgacacgtcctcaacttcaaaggaaggcacgtcctcaccttcagagggctatgcaccttcaccttcagaggactgcaagtcgtcactttcagaggactgcacgtcctcgtcttcagagggctactc

SEQ ID NO: 92286 - DNA, 384 bp, Glycine max
  Peptide Sequence Number=SeqID_209064
atggccaaaaatgcctcagtaaacagagcaacagagaagaatggagatattcacaaatttgtgtttgacctgagaggattggaagttaattttgggttgcaatggtctgaccctcaaagttctgcagaggagcggagtaactcattgaccatgggtgttgcagatgagcatatcggattggttgttggtcgtggtggaaggaatattatggaaattagtcaggttagtggggcaaggataaagatatcagatagaggtgattacatatctggaacaaccgacaggaaagttaccataacaggatcccagagagcaatacgtacagctgaatctatgatattgcagaaggttgcttatgctactgagaggggggtgatggagtag

SEQ ID NO: 92287 - DNA, 516 bp, Glycine max
  Peptide Sequence Number=SeqID_209065
atgggtgtggacagtaatttgcatgccaaacccagaaggcgtgctaattttcgatcatgcaatgtctcaagttacacttctgaagttttggagattcaatctgatgctcccactcttcatgttctgttttttcctggaaacccaggtgtaattttattctacaaagactttttggaatttctctatgagttgctggagggaactgcttctgttacagctattggccatgtttctcactcaagaaagttttcagaggcaccagattggacatttatgagagaaagggaggctcaaaaggcatttttatttggtgttgacgatcactggggaccacttcatttgcttgaagagcttttgcatcatctgaagatttcaaagcaggttcctggtatggccatatctattgaaagagaaaaccacacccatggtttctgttgtactgaggctggctcgttatgggtggctcagcatgtggtaaacttgatcaagaatccgatggcttgttcaaaccaataa

SEQ ID NO: 92288 - DNA, 2661 bp, Glycine max
  Peptide Sequence Number=SeqID_209066
atgcttcaacggggcattattcaacccagcaagagtcccttctcgtcgccggtattgttggtaaagaagtccgataacacctggcgcttctgcgtggactatcgcgcattgaatgcactgaccatcaaagatcattttccgatcccgacgatcgatgagcttctggacgagctcggaggtgcgacttgcttttccaaattggatttgttgcaggggtatcatcagatacgcatgcaaccggaagacattccgaaaacggccttcaggacgcatcacggccactttgaatttaaagtgatgcccttcggtttgtgtaacgcgccttcttccttccaggcaaccatgaacactcttttccggccgtacctccggcgattcatcatcgtgttcttcgatgacatcctcatctatagcggttccttcagtgagcacttacgtcatctgcaggccacatttcagatactctatgagaatcattttgtgcttaagctctccaaatgcctctttgctcagtccgaagtcgaatacttaggccatctggtctcacacagaggtgttcaacctgtcacttcgaagcttgatgccattgctcagtggccaataccacgttcagtccgagctctgcggagctttcttggactcgccggattctacatccggttcattcggggttatgccaccattgccgcccctcttgtgaaggccaccacggttgagcctctccagtggaactcctcgactcaggcagccttcgacgctttgaaacaggctctgacctccactccggtcctttccctccctgactttcaattgccttttacaattgaaactgatgcttctgcaatcggaatgggggctgtcttgtcacaacggggccatccaatcgcttactttagcaagccttttagtccgaagttgcttcgagcctcgacttatgttcgagaattgtttgccatcacggccgccgtgaagaagtggcgacaatacctcctcggacatagcttcatcattttaacagaccatcggagcttaaaagaattgatgagtcaggttgttcaaacacctgaacaacatacttatcttgctagattgatgggctacgactaccagatccaatattgctccggcaaggagcttcatacccagcttgctgcgaattcttccttccaacacctattccaggaggtccgggatactcccgacaatcaccctgatttctccactgccaacaagctcctgttatataagggacgcatctggttgccgccggacttaccaatcatccggaccttgctcacagagtaccacgcaacccctacgggaggccacgccggcgtcgcgaaaacagtagctcgactcaccaccaacttctattggactggtctacgagatgacgtcatgcgcttcgttgccaactgcgttgactgccaggtcaccaaatatgagactaagaaaacagctggtcttctctgccctctccctgttccaactcaaccttggtctgacttatccttggatttcatatgtgggttaccatcgtatcggggtaatacgacgattctcgtcgtagtggatcgcttctccaagggcatccacctgggcatgcttcctcagagccacaccgctcttgccgtagctcggctctttttggacttagttgttaagatccacggccttccccagagcctcgtctcggaccgtgatccactcttcattagtcagctatggcaagaattattcaaatccagtggtacccagcttcggatgagttctgcatatcatccacaaagcgatgggcaaactgaggtcttaaatagagtggtagagcagtatctgcgtgcgtttgtacacaggaaaccggcaagctggggaaaattattaccctgggttgagtggtcacacaatacctcttggatggagagcacgggcaccactccttatgagattactttcggccagaagcccttcaattttcccgattatcttgcggggtcttctaaaaatgctgcagtggaggagatcttaactgaaagagacactaccttccagttggttcgcaaaaagttgctgaaagctcaaagcaagatgaaactttatgctgatcaacaccgtcgtgatgtacagttcgcagttggtgattgggtcttggtccgccttcgtccttaccgtcaattttctgcaaaagataagaaacccacgaatgagaaactagccctccgctattatggtccttttcaagttgttgctaagctcggacctgtggcatatcgtttggcactaccagagggggtccgtctccaccctgtgttccactgttcgaagcttaagccctttcacggggacccagactcctcatcccctcttcctttaccacccactttccatgaaaatcaaccactcgtctctcccctctctatcctggattttcgttgggcaacctctgatccccaaagtccgtggcaagtcttggttcagtggcagggccttacactggaggaaacgtcatgggaagattggcatcagctttgccaggattatcaccttgaggacaaggtgatcctgcaagggccgagggatgatacgagtatagagaacacagagcttaggaaggaagatgttgaggaagaagatgatctaagtaagctgggagaagagaattga

SEQ ID NO: 92289 - DNA, 720 bp, Glycine max
  Peptide Sequence Number=SeqID_209067
atggccttaatcggtggttgccttaactgtcaaacggtgaatcgttttactttcagaagaatcctctgtaaaccttttcttcttcttcttccaatttatgattcttctcttcatgttcgagattgttgtgctgttcaacgttcttatatcatcttggatttcagactgattctggggtacgcgtatcctggatttgaatgctacaaaactgtggagaaaaacaggggtgacaatggggaacttcgattctggtgtcaatactgggtcattgtagcacttttcacagtactggagaattttacagatgtaattattggatggtggtttcccttatacggagagttgaagcttgcactctttatctacctgtggtatcccaaaactaaggggacgggatatgtttacaatactgtgctgcggccttatgtatcaagccatgaaaatgacattgagaaaaagttccgagagtggcgggctagggcatgggatttggccattttttactggaaaaactgcacagagttggggcaagctacaactttccagattctcgactatttggctgcacagtctaaaaaattctccagcaaatcttactctgagaaaaaagacaagctgggtccaactccaagtgccccaccattgtcttcgcttcgagagtctctctttgagaacaaccaaaacaaattcccaggccgcaagaacaagaaaggggactga

SEQ ID NO: 92290 - DNA, 447 bp, Glycine max
  Peptide Sequence Number=SeqID_209068
atgatttgtcggttgtcaagagtagcatctgcacacgtgaaccctgagagcgtggagcattcgactgaaaacccgggaaacgacgggaatgaagtggtggtagaagaagccgaggcaggtggcggagaggcggcggaggaagtggggtgtggaggcgccgccgggggaggcggacatgggctgaaggtaggcccaggcggcctgcttgacgaggcggttgcggatggaaatctcttggccggagtacgcggaggcggtgggggagttcacggcggcgtagggagaaggaagcacgtctcggagggaagtgtaggaggcggaaaagggggatttaagggatacaagttcgaagcttgttgtgcgctgcggcggcgtggcggggaggaagagtttgggcaccgatggggcagcgatggagttgtggcggcggaggggcggcgactctga

SEQ ID NO: 92291 - DNA, 993 bp, Glycine max
  Peptide Sequence Number=SeqID_209069
atggcatttctctcaagtttgttgaaagctgcaatagctgcatcagcatccacttcttgcagatctgatttggagaaaaggattggtctacaacttgaccaggctattcttgaagacatcctaatcgcaacaaattcacatcaaaacacacatggggctatttatgacacggattcaattttgaggattttttccaattttctgaacttggatgaggaggatgaagatgataataatggtcacttgagagatgaaagtgaaatggtttatgactttgacagccccggatctccaaaacaaagctcaattctaaaggtatccaaattaatggacaactatcttgctgaagtggcactagacccaaacttgttgccatcaaagttcatatcccttgctgaactacttccagatcatgcacgtattgtgagtgatgggctctatagagctgttgatatcttccttaaggttcatccaaacataaaggactcagaacggtaccggctatgcaaaaccattgattgccagaaaatgtctcaagaagcatgcagccatgcagcacagaatgaaaggctaccagtgcagatggcagttcaggttctatactttgagcaaataaggctccgcaatgccatgaatggagggcacaaccaattgttctttggaggaggacttaatggtccattccctcaacgctcagggagtggtgcaggaagtggagccatttctccgagagacaactatgcatcagtgagaagggagaaccgagagctgaagctagaagttgcaagaatgagaatgaggctcactgacttggagaaagaccatgtcaacatgaagcaggagctagtgaggtctcaccctgccaacaagctattcaaatcattcaccaaaaaactaagcaagctaaatgctatgtttcggattaacagtattaagccaggttctgagagtcgcttcccttttcctaagagaaggcgtcactcagtttcatga

SEQ ID NO: 92292 - DNA, 432 bp, Glycine max
  Peptide Sequence Number=SeqID_209070
atggaagagaccaattccagattcaagaggatttgcgtcttctgtgggagcagttcagggaagaaacctacatatcaagaagctgctgttcaacttggcagggagctggtggaaagacggattgatttggtctatggaggtggtagcgtggggctgatgggcctcgtttctcaggcagttcatgatggtgggcgccatgttctaggggttatcccaacaagtcttatgccaagagagataacaggtgatcctattggggaagtgagagccgtatctagtatgcaccaaaggaaagccgagatggcccgtcaagccgatgcctttattgccctccctggaggatatggaacccttgaagaattgctggaagtcattacatgggcgcagcttgggatccacagcaaacccgtaagctctactcctcaattttaa

SEQ ID NO: 92293 - DNA, 198 bp, Glycine max
  Peptide Sequence Number=SeqID_209071
atggcccaatggataaggcgctggtctacggaaccagagattctgggttcgatccccagtggagtcgagttcttaaaaagtcacaacggcaacattttgaagctgaattattgttggtcctccctcccactattagtgcagatggtgggtggtgcgaggtcagttcctggcatcacagtggggactatggattcctag

SEQ ID NO: 92294 - DNA, 1413 bp, Glycine max
  Peptide Sequence Number=SeqID_209072
atggctcctccttcttcttattacattattctctttctattactatctcttctctctcacacagcattcactttctccaactccatcactctccctctctcccctctcctcaccaaacctcattcctcagactcagatccattccactctgtcaaactcgccgcttcctcttccctaacccgggcccaccacctcaaacaccgcaacaacaactccccctccgtcgccacaaccccagcataccccaaatcctacggtggatactccatagatctcaacctcggaaccccaccccaaacctcccctttcgttctggacacaggtagcagcctcgtatggttcccctgcacctcccactacctctgctcccattgcaacttccccaatatcgaccccaccaaaatccccaccttcattccgaaaaactcctccaccgccaaactcctcggttgcagaaaccccaaatgcggctacctctttggccccgacgttgaatctcgctgcccccaatgcaaaaaaccaggatcccaaaactgttccctcacgtgcccctcctacatcatccaatacggcctaggcgccaccgcaggcttcttactcctcgacaaccttaatttccctggaaaaaccgttcctcaattcctcgtaggttgctccatcctctccattcgacaaccctcaggaatcgccggcttcggtcgcggccaagagtctctcccctcacaaatgaatctcaaaagattctcttactgcttagtttcccaccgcttcgacgataccccgcaaagcagcgacctcgttttgcagattagttccactggcgacaccaaaactaacggcctcagctacacgccgtttcgctcgaacccgtccaacaactccgtgttccgtgagtactactacgtgactcttcgcaagctcattgtcgggggcgtggatgtgaagattccgtacaagtttttggagcctggctctgacggtaacggcggcaccatcgtggactctggatccaccttcacgttcatggaaaggcccgtttataatttggtggcccaagagtttctgaggcagctggggaagaaatattccagggaagagaacgttgaggcccaatctgggttgagtccctgctttaatatctccggcgtcaagaccatcagtttccccgagtttacttttcagttcaaaggaggcgccaaaatgtcgcagccgcttctgaattatttctcgtttgtcggcgatgccgaggtcttatgtttcaccgttgtctccgacggtggtgccggtcagccgaagaccgccggtccggccatcatcttggggaactatcagcagcagaatttctacgttgaatatgatttggagaatgagaggttcggatttggtcctcgtaattgcaaaaggaaagcttag

SEQ ID NO: 92295 - DNA, 618 bp, Glycine max
  Peptide Sequence Number=SeqID_209073
atggcagtgggagcgaatttctacgcctatcccagtggagttgaagagggagatctcagcactcactttgaacgacactgtgccagacttaatcataccaaaactgcttattggtggctcacaagcgctagttcaactcatggtgctactgcaaaagtgttctcacagcaacctcgtgatgtgcgatggctctaccccactgttggttatgtcaaactcaacacgaatgagagctcagcagggaaccaaggctatgccgggccatgtgccatgactatgaacacaattgcggaactgaaggcattttatcatggtctcgagatagcatgttcaagaggaattataaatctgatctgtgaatcagactcgatgatatctactggtgtttcttttacacacccaagtgcagcgttagttgccaagattcaagctttcaaagttaaggattggaagctaatattccaacacacactcagagagggaaatttcgtggcagacaatctcgccaagaaaggggctcatctggatcaattgtcgattatgaatgtttgtcctaatgctctgcacaacctttgttttgcagatgccataggagtgtctactgttagattacactaa

SEQ ID NO: 92296 - DNA, 339 bp, Glycine max
  misc_feature (330)..(330): n is a, c, g, or t
  Peptide Sequence Number=SeqID_209074
atgtctacgccatgcaataattcagccagtgatctcaccatcgaagtaggagcttcaagctttgcacttcacaagtttcctcttgtttccaggagtggaaggcttcggaaaatgttgttagaaacaaaagattcaaaagtttcgcgcattagtctcccaaacttgccaggtggtgcagaggcatttgagctggctgccaaattctgttatgggatcaatgttgagttcactctctccaatgttgccatgctaaaatgtgtagcgcatttcctagaaatgacagaagagtttgcagagaaaaacttggagacgcaagccgaagcatatctnaaggagaca

SEQ ID NO: 92297 - DNA, 249 bp, Glycine max
  Peptide Sequence Number=SeqID_209075
atgacatcatggaaaaaggaagaagcagaacgtgcattacgtgggaagagtggggaagaaacagcttcaatagaagtgagatgtcagcgtctgaatctgaaccttttcccttttggtaaagggcgagaaagatgctggaatttggttgtgatcagcttccaagaagttaattactcaaaaaacacgttagataaaagatctgaacagcgcataactttcataaaaggttggaatatacacaaaaattga

SEQ ID NO: 92298 - DNA, 1060 bp, Glycine max
  Peptide Sequence Number=SeqID_209076
gttgctgcggcagtaagagttacaggggactacccagaaagggtgggggaacctccgtgtcagggtgagaaagaatgctcctactatttaaaaacggggcagtgcaaatttggtatatcttgtaaattccatcatcctcaacctgctggcacatcattgccaacttctgcacctcaattttatcaacaggtgcagtctcccacggttcctctgcctgaacagtatggaggagcatccacaagcttgagagtggccaggcctcctgtattgcctggttcatatgtacaaggggcttatggtcctgtacttctttctccaggggttgtccaatttcctggatggagtcattattcggcacctgtaagtcctgtgctatctcctggcgctcaacctactgttggggccacttctttatatggagtgacccagttgtcatccccaacatcagcttttgctagaccatatactcctctgtcctctactaccggcccttcaggaagcaatctgaaggatcaattttttcctgaaagacccggtgaacctgaatgccaatactatctgagaacaggggactgtaaatttggattagcttgtcgatatcatcatcctcgggatcatattgtggcacggccacttcttagccctgttggacttcctttacgtccgggggttcaaccttgtgcattttatttgcaaaatgggcattgcaagtttggctccacgtgcaaatttgaccatcctttgggatctacgagatacacaccatgggtatcttctttcattgatgtgccagttactccatacccagttgggtcgttgctctctcagctggctccttcaacaacatcttcagagcttcggcctgaactgatgtcagggtccaaaaaggaatcccttgcagccagaatatcttcttctggaaatagttctgtagcagaagcaccagacaaagccgcgagatacgggaatgcaaacttgaaaataactcattatctattggatgtgatttcacaagcctccattacttctgtctatagtcctcagtactttgaaggcaact

SEQ ID NO: 92299 - DNA, 882 bp, Glycine max
  Peptide Sequence Number=SeqID_209077
atggccgataagcaaccccacttgaacggtgcttattacggtcccgccattcccccggcggagcaaccacgctaccgccctcaccgcggcagaagctgctgttgctgtctcttcggaatcttgtggaagattctggttgcacttattgtcctcgttggccttgcaatcctcattttctggttggtggttcaaccccgctacttcaagttccatgtcacgaaagccgacctaacacaatttgattactatagcaacaacaacaccctccactacaacatggtcctcaacttcactgcacgcaaccccaacaagaagctcagcatatactacgacaaggttgaggcattagcattctacgaggatgtcaggttcgccaattacgatgtgatcactcacatgaactccttccggcagtacaagaagagcagcagccccatgagcgctgttttcacggggcagcaagtgctgatgctcaacaatgaacaagtctcagagttgaaccaagacaagaatgctggggtttatgacatctatgtgaagctctacttcaggattaggttcaggcttggggacgtcatatccaatgactacaagcccaaggtcaaatgtcacctcaaggagcaaggcctcttcttctcggactcggagacttcagctctcactacagaaaatgtggagagtgcatttctcaaatttctagaagatatcggcatggtagtatctaaaacggcattggaatgcggtactggttatgggaaggagaatggtgtgacatctgacaacaatgctacaacactgagtgaaataatggtagacataatctcagctggtcctgaattggaaaatagagatgaagaaatggtcttcgtgcgatattggtaa

SEQ ID NO: 92300 - DNA, 834 bp, Glycine max
  Peptide Sequence Number=SeqID_209078
atgtttggtggccggttaagtttgttgtttgtagattatatgacgcgctttttccaactcccctaccccacagttggttatataaccaaaccacagacacaaggaacttcaagtcttccattgattccatctctcacatcatttcccactcccgcgtttcctttatcatattcttattccgccatgtcccagttgaacggagcctactatggcccctccatcccgccgccgaaaacctcctaccaccgcccagggcgcggcggaggctgctgctgcggctgcctcttcagcctcatcttcaagctcatcttaaccgtgataatcatcgttggcatcgccgggttcgtgttctggctcatagtccgtccgaacgtggtgaaattccacgtgaccgacgccaccctgacgcagttcaactacaccgccaacaacactctccactacgacctcgccctaaacatcacggtccgaaaccccaacaagaggctcggaatctactacgaccgcatcgaggcgcgtgcaatgttccacgacgcaaggttcgattcacagttcccggagccgttctaccagggccacaagagcacgaaggtgctgaacccagtcttcaagggtcagcaagtggtgccactcaacgctgagcaaagcgcggaactgaagaaggagaacgccactggggtgtacgagatcgacgtgaagatgtaccttagggtgaggttcaagctgggggtgttgaagaccaagacgctcaagcccaaagtatcatgcgacttgcgtgttcctttcaaaggaagcgccgcctttgagaccaccaagtgccactgggatcgctga

SEQ ID NO: 92301 - DNA, 150 bp, Glycine max
  Peptide Sequence Number=SeqID_209079
atggacagaacatttagtggtctgaaacagggtaaatgtgaccaagaatttatgaagggaaatgaaagacgtcgaggagttgaagagaagctggtgattaattgtgagtgtgagagaatggataaggaactgatactgcttaatgcttag

SEQ ID NO: 92302 - DNA, 213 bp, Glycine max
  Peptide Sequence Number=SeqID_209080
atgaaacgagaacatatcaaaaagattgaggagaattctctggaggcgattttgaaaaaaaatcagcgaaggaaagggccttggagccccggaggagtggtcgtggggggcaaagcgatggttgatggagttggcaatgacactcccgttgggagaaaaacaagggaaattgatacacattttttagcggtttttaatctcccctacttttaa

SEQ ID NO: 92303 - DNA, 404 bp, Glycine max
  Peptide Sequence Number=SeqID_209081
atgaattttgacagtaaatatatttgggaatctctgccgctactgctgcagggtctgcagctgaccttgattatttcgctgtcaggtctgctgggcggttttattattggcttactggcgggaacctgccgtgctctgggcggaaaaatcgccaaaacgctgtcacttatttttgtcgagcttattcgcggtacgcccatcatggtgcaggtaatgtttatctattttgcactgccgatggtgttgccgataagaattgatcccgtcaccgccgcgatcgtgaccattgtgattaactccggtgcctacattgctgaaattacccggggcgcgatcctctcaattaataaaggctttaaagaagcgagtctggcgatgggcttatcgcagcgcagtacgctgtg

SEQ ID NO: 92304 - DNA, 540 bp, Glycine max
  Peptide Sequence Number=SeqID_209082
atggactttggcggcctgattccggggctgcaatcacggaatctggatgtcgcgatggcaggtattaccattaccgatgcgcgtaagcaggtggtggatttcagcaacggttattatgacgccgacttattaatggctgtcaaaagcgatgataacagcattaagaaattcagcgatttaaccggcaagaaagtgggcctgaaacagggcacggccgcagccagctttatgaaaagtaaatacaaggcaaattatgttgagtttcctaatatcgacaacgcctatctggatttgcaggccggcaaccttgatgcggtggtccacgactcgcccaatgtgctgtactacgtgaaaacggcgggcgatggcaaagtcaaagccagcggtgaaaacgacacgattctgccgcagcagtatggctttgccatgcagaaaaacagcagcctgacgcctaagatcaacgccgcgctgcaggccctgcgcgcggatgggacttacagcaaaatctacgtgaaatggtttgctaagcagccgaaataa

SEQ ID NO: 92305 - DNA, 650 bp, Glycine max
  Peptide Sequence Number=SeqID_209083
atggcaaaaacactcgatagtaaaacgctggcgcgcatcgcgccaaagctggcggaactcagtcagcagcctgattacgctggccgcactgacggcgctggggcgagtgcaacagctaccgtggcatatcgaattcgcgcaacaaaatggcctggcacaagaagagatcgtcgaagtgttcacccatctggccttctatgccggctggccggcggcagtgtcagcgctaagctgtctggaagaggcgtaaccctcatgccttttacccgcatcatactgcgtcagggttatagcgacgcgcaattaacgcagatttccgacatcctgcaacagagtctggaggacgaatttgccgttccacccggcgaccgctttcaggtatttgaagaactgccggcgcggctaagggtgtttgatcgccactataaaagtcgcgggcgttcagagaattttgttcagttcatgatgactgcgggcaagccgcgcagccgcgaacagaagcacaagctgtgtcgcaaattgtgtcagcaactctcgcaatcgctggatatcgatccgcaggatgtgatggtgattattcagtttaacaccgtcgatgactggagtttcagcgacggatgtctgatgtccgaagaagcgcgtttccacga

SEQ ID NO: 92306 - DNA, 404 bp, Glycine max
  Peptide Sequence Number=SeqID_209084
gcttttagtgataattcccaaggtggtcatatctcttttgatggtttctagaggtatcatccccttcgacaagcatattgcggcagtagggactactagcaacaatatgttatcaaagagaaaaactctagatgagggttcagtgttatcaagcaaatcgaagacccggcatgagcacagattcacctccactccttatgttcccctggacccgggtatagggccccttttcaactcaacgcctaactctctaaaaacagtccccagtggagtcgccaactgtcgcaacctacccttcggtgggagggcgacgcgagggctcacgggtgcatcttccatgggaggaaaatgcgcagagtcgccaccaacgtttattcgaggaaaatgtcagaaaaaccggaaag

SEQ ID NO: 92307 - DNA, 552 bp, Glycine max
  Peptide Sequence Number=SeqID_209085
atgacttcagcgtcaccgggtcatcggagaaaattctccggcaaggacccgccgcgtaaactccagccggagaaacattccgttcgtcgatttgcacccgctcctctgacgcttaagcttccgttgcaaagcagtaatgactctttccttcggccgtcgaagctgttgctgaacgttaccatcgaaagctgcttgggcgccgtacaggtgctgttgtcgccggaggacaccgtcgctgatttgataaaggctgcgttggcgttctacgagaaggagaagaggaggcccttcttgaagaacactgatcccaagtgctacgaccttcacttctcttccttcacccttgaaagtttgaaggcagatgataagttagtgagcttggggtcaaggaatttttttctatgctctaagcctccaagcgctacttgctttgagaaaaagaatatggcaattgattctgcatttccttggatgagtccacatcaacaaaaagatttgacgacacctgatgtggctccttgctacttggactttacccaggagtcgggctaa

SEQ ID NO: 92308 - DNA, 1206 bp, Glycine max
  Peptide Sequence Number=SeqID_209086
atgactaatgtgactgagcatatgttgttggaggaaaaatttgaagggttgaaggctaaaattgatgcttgcatggaagaaaagataggatgtatggaaatttccatgactgagatgctgttaaggaaggtgttgggcaaacatccaaaggatgaacatgaaagttctaactgcaatgagagagattcttccggaaatgggtctaatttggattatcatcacagttttggtgaaatatcgtgtgccagtaaaaaaggtggaaggataaagaagacccaattggatggaccacaaaggctaaaaccaattttgaagttcagagcaagtgaggttgtcaaaattaaattggaaaaaccaagtatggaagagtcaacaatccattggtttaatttattgagagaatttgaggcacctttgacttcgggaaaatttatggcagccttggttgcagggtttgaaaagcagaggcctgcgccatgtaacacaccaagattgacagaaatgaaaagcaagggtttatgcttcaggtatgctaaccacaatccatcaatggcacgtattcgaatgatgcccatagggactcctaaagtcccctataggacacctggtgaaggaacttggcaatgggttgatgtatggaatgccctttatcgagaacgtgttatcttcattggacaagagatagatgaagaatttagtaaccaaatattggcaacaatgctgtatcttgacagtatagataactccaagaagctttatatgtacatcaatggtcctggtggtgatcttacaccaagcatggctatatatgacaccatgcagagcttgcaaagtcctgtagccacccactgtgttggctatgcttatagtcttgcagcatttctccttgcagctggagaaaagagtaatcgttctgcaatgcctctatcaagagttgcccttacatctccagctggagctgctcgtggacaggccgatgacattcagaatgaagcaaatgaacttcttagaatcagagattaccttttcaatgagttgtctaagaaaacaggtcagcctcttgagaagattaccaaagacctgagcaggatgaaacgcttcaacgcacaggaagctcttgaatatggtctcattgaccgaattgtcaggccaccccgcattaaggctgatgcacctcgcaaggaggcaggcacaggtcttggttaa

SEQ ID NO: 92309 - DNA, 231 bp, Glycine max
  Peptide Sequence Number=SeqID_209087
atggcggtggcaccttacaccaccggttccgcacctcgtttttctcctcctcctacttctagtgttgccacaaagctctattccggattgaaacttcaagctgcgagttctttccgagcggcaagacctaacgtaaccgctgaattttatggaaaagttcacaacactcttcactgtcgaattggtgcattcttcgctgcgctaaaccttgctagattattcctaacatga

SEQ ID NO: 92310 - DNA, 285 bp, Glycine max
  Peptide Sequence Number=SeqID_209088
atggcttcgcctttactaccatctttttttgaagtagcgggagaagcacaaggtggctttttagagaatgcaacgtatgataaagttgatgaaagtaacgatggatatcataaatctctatttaatattgaagatgaaagtgtagacaatgttgatgaaattacaacgcaagagcaagaagaatccgatgataatctgaagacaagaattgaaagcttcatcgtgaaggtctacaaaggatggattgaggagagctactgggataaatatggcatagacatgtga

SEQ ID NO: 92311 - DNA, 765 bp, Glycine max
  Peptide Sequence Number=SeqID_209089
atggaagatttaaatttctacgaaaactcttggttaaagcttgccattggaatgggtgaatgggttgcatgctcagttggtgctaattttactccccatatcatcactgttaattctggggaggatgttactatgaaggtaatatcattttctcagcaagggccgcgagctatatgcattctttcagctaatggggtcatatcaagtgtcacacttcgtcagcccgattcttctgggggcacactgacatatgagggacggtttgaaattctgtctttatccggctcattcatgccaagtgaaagcggaggaacacgaagcagatccggtggcatgagtgtatctttggcaagccctgatggacgtgttgtaggtggtggagtagctggtctgttggtggctgcaagtcctgtgcaggtagtggtaggaagttttctggcaggaaaccagcatgagcagaagccaagaaaacagagacatgaggttataacaagtgtgataccagctgcagttgttccaatctctacccttgatccagtgccaattctatcagcagcgtcttccatccgaaacgataattggtctgctatgccagcagaggccaagaataagccagctgacattaacgtgtcgcttcctgcaggttgttggctttgctttccgttgtttgttgtgtctgtaattgttgactttctaccgggaccagcattgttttcagaggtttaccagcttcctgttcttgtagaatttgagttggctgattag

SEQ ID NO: 92312 - DNA, 822 bp, Glycine max
  Peptide Sequence Number=SeqID_209090
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcacgttggccgcggcaaaaccggcgctttccgtggcgcgcacgccgccgagcacggtgttgtcgttcatgccgccgatgatgagatttttcgccccgcgcggcagcttcaccaacgccgagttggtggcgtccatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 92313 - DNA, 564 bp, Glycine max
  Peptide Sequence Number=SeqID_209091
atgactttttatgacatcgtttctacgacggttataaagggaaccgctttagaaagtggttcggtggcaattttgaaatctagtgaaatagaaggaatgaacatcagctatatccctctgatgctaaatcgacaagtggtaaaagtcgaatatgctaccattaagatacctgaactagattttgagattccaccagaggctcaacgtggtagtctatcaacgatacttctgatacatattccaatttactttgttcttttctcattcctatcattgacagttgctccaaagacagctaaggcaattcatcagttcttggtgaaactgcgagcctatgcaaaaggaaaatcagccttcacatttattcttgatgatcctgctggaaacagcttcattgaaaacccgccacccaagagaccaaaatctgaggctgttccaaaatctgaggctctactaacagcactcggggggactccatctaataggctgccttttcctttctcaagttttattacatcacatcatattgttggatcctctgcatgcaccaatgtccccatctaa

SEQ ID NO: 92314 - DNA, 756 bp, Glycine max
  Peptide Sequence Number=SeqID_209092
atgacgaagaaattccaccaaactgtaggagagcgatggaggcaacttaagttagatttgacttctaaatgggatctagcagaaggcaagaatgatgatgatgacaaagtgtgtgagaattacagtattaacaaagacaagtggaaccaattttgtcaaagccgtagagacccttcatgggagatgacatgtgaagtggaagctggcttgcacaaaaaattgggtcagatgacatctgaggagacatgccaaatagttgataagattggaattatacatctagatgagctagatgtagctttttccggtgctcatgtcagcacaaagggaagttatgtttatccctcgaggcaggacccagatattgatgcatttgataggcatggtttatatgttgatgagaatcctcctcgcctggtttcctttatgatgaaggtgggtgttgaagaaattcgagatgctaatgctctcacctctatacccactaaaaaggttcagttagtggggcatgtcctaaacacattcattgcttggccgaaacatcttgtaaagcctttttcagaaatgctggtggttatatgtcctaaggacaatattgtcgtttggttgtgttccttgcacaataagtctaacaactacttgaaaggaatgaattttacttatccaagagccttggaatctgagaaaataaaggaaattaacattgagtgggaaaaatgtttactaagatttagaaatgaagaactaaatgtttaa

SEQ ID NO: 92315 - DNA, 249 bp, Glycine max
  Peptide Sequence Number=SeqID_209093
atgcataaatgccccaattgtggtgtatcacagtacaaagtgaaggatgacgagtgtagtagtgatgaaagcacaaagaaaggacccctaacaaaggtgttacgatatcttcctatcattccaaggtttaaaggaaatggcatcaatgtttatccaagtcccttgattgaagacttgagaaagttgtgggatgaaggggttgatgtgtttgatgggaatcaaaaggagatattcaagttgcatgcaatg

SEQ ID NO: 92316 - DNA, 201 bp, Glycine max
  Peptide Sequence Number=SeqID_209094
atgcagacagtggataatgaccttgcattgaaaatatttatcaaagccagagccacaccgaaagttgttgcagcatttgttgagaggagggaatttgacaagattatgatacactcaaagcaggttggatacacacctgattacatgttccttctacaaacaatattaagggcagatgcccaggttagtggtttcttttag

SEQ ID NO: 92317 - DNA, 270 bp, Glycine max
  Peptide Sequence Number=SeqID_209095
atgctccagtccttatatcagggacaacaggtcatcatccaagaccttcatcggttgtcccttcacctgaagatggacccacctctcacgaccccagatgcctacattcagcaggtcgcatggtcaggagtccaaccctctactgataggaggggtaagccttctagagtcggagacaccatggccggagctgaggaggacatcattgcagaccaggcagttgctggctggggcccaacagacttgggtggagaagacatagggctttag

SEQ ID NO: 92318 - DNA, 177 bp, Glycine max
  Peptide Sequence Number=SeqID_209096
atggaccaattaaagcgcctaagcatcccctcaggaatgcttagattctctaaccacgctagttaccccacgtctgggccatccgacaagctagtgccaaagaccctggaaggtcagtgcacagtgccccccacgatcatacacaacatccaacgtatgaacgtggccaaaagctag

SEQ ID NO: 92319 - DNA, 228 bp, Glycine max
  Peptide Sequence Number=SeqID_209097
atgactcggcaactgatgttatcttcatccagatgcaatcccaattacagtcacaaatccaatcacaggggcttgcactgcctccggagcctgaggttggtccctcagctacttgtgtcagcacaaaggggagttgtattgatccctcagcgaccgatccagacacgggtgactcagacaaatgccgattgtacatcgaagaaaatcctcctcgcctggttgccctag

SEQ ID NO: 92320 - DNA, 201 bp, Glycine max
  Peptide Sequence Number=SeqID_209098
atgccaaaaaccatatcaaattatggagatcatggtatggtattagccactggtcatggagctgaaattgctatggatgctaatgaagcgatgagtagagaaacaaatgaagtggaattcacgggtttaggtgctactgctactatagacttagaagaaccaagctacactactaaaaaaaggctttttaaagacgattaa

SEQ ID NO: 92321 - DNA, 1731 bp, Glycine max
  Peptide Sequence Number=SeqID_209099
atggaacatgagagtttgagattcttcgacgcgtccgtgaacgagttggctgggacgattttgacggagttatgcgagttgccactagcatcgttgaatttatacaataacaagctcgaaggggttttaccaccgattcttgcgcattctcccaacctctatgagcttaaattgttcagtaacaaacttattggaaccgagattctggcgatcatttgccagcggggggagtttgaggagagtttaaagagggttcggttaaagagcaataacctttctgggagtgttcctgatggggtgtggggtttgccccatttgaatttgcttgagctttcggaaaattctctttctgggaaaatttctaaggcgatttctggcgcttacaatctatcaaatttgttgctttcgaataacatgttctctgggtcgattcctgaggaaattgggatgttggataatcttgtggagtttgctgctagtaataataatctctcgggtcggattccagagagtgtgatgaagttgagtcaactggttaatgttgatcttagttataatcaactttctggagaacttaatttaggtggaattggggaattgagtaaagtcactgaccttaatttgtcacataataggtttgatggaagtgttccaagcgaattaggaaaatttcctgtgcttaataatcttgatctttcttggaacaaattttctggggagattccaatgatgttgcagaatttgaagctcactgggctgaatttgtcttacaatcagctttctggggatattcctccttttttcgccaatgacaagtataagacgagttttatagggaatcctgggctctgtggtcatcaacttgggctttgtgattgtcattgtcatggtaagagtaagaatcggaggaaggcgaagaaattgaaggtgttaagcgtttcgcggtggaagtcgtttcacaagcttgggtttagcaagtttgaggtatctaagttgctgagtgaggacaatgtgataggaagtggagcatcagggaaggtctacaaggtggtgctcagcaatggtgaggtggtggcagtaaagagattgtgtggagcacctatgaatgtagatggaaatgttggtgctaggaaagatgaatttgatgctgaagttgagacccaggggaggatcaggcacaagaatattatgaggtggttgtggtgttgttgcaacagtgaggatcagaggctcttggtttatgaatatatgccaaatgggagtttggctgatttgttgaagggtaacaacaaaagtcttttggatttgcccactaggtataaaattgctgtggatgctgctgaggggctttcttatttgcatcatgattgtgtccctcccattgtccaggatgtgaaatccaacaacatattggatcctatggctacattgcaccagaatacgcgtacactcagggtgaatgagaagtgtgacatatatagctttggcgtggtccttttggagttagtaactggaagacccccaattgatccagagtatggtgaaagtgatttggtgaaatgggtttcctccatgttggaacatgaaggactggatcatgtgattgatcctacattggactccaaatacagggaagaaatcagcaaggtattgagcgtagggcttcattgtaccagctccatcccaataactcgccctacaatgagaaatgtggttaaaatgcttcaggag

SEQ ID NO: 92322 - DNA, 645 bp, Glycine max
  Peptide Sequence Number=SeqID_209100
atggtcaaaccaaatatcaatgtggttcaacggcaagttactccccgaatccctcggctacgttccaataagtttgttactgaacaatttaagctcatagaggttgggagaatgcgcaagaatcggtgggatgggacccacgaggttgcagccagagaggaaaagcgtttcgaggttccggaggttaccgagttgatcggtatgcgactcggcaagaacagctttgaggttgcgaagggaagagggtattgcttcggtgaggaggttgctgacgaggttgagcgttttgaggcgggagagggcggcgaggctcggcggaatgttgccggagaggtcgaggtgttggagcgtggcggaatggggcccacgaggttgttctgggagagatcgaggacgacgaggttgcggcacaccgcagcaacgacggcggagaggggagacgatgcggcagaggatggcgggaaaggggccggagagggaggcggaggggaggctcacggcagtaatggtggcggtgagagggtcacaggtgacgccgcgccaccggcatgggttggcggcagaggagtcccaggaggagagggcgttttccgggtcggaaagctaccgtcttgcttcgaagagaaagagactgtcttgggttag

SEQ ID NO: 92323 - DNA, 294 bp, Glycine max
  Peptide Sequence Number=SeqID_209101
atgactaatgcaaactgtccgcaagagtcattgcattcagtctcaaacgggaatctaagccccaatgcctggagaggattatttattcagcatatttgtggtgcttctgcagggttgcagggaaaaagatggcagtggtggtggtttgctcttacttactcgatttggaagcataggaacaacattattttctccaatacgacattattttccctacgctgtatcaaatctctaaccaataacagcaacctatcatcctcttgggaagtcataaggaggaacggtgggaattga

SEQ ID NO: 92324 - DNA, 339 bp, Glycine max
  Peptide Sequence Number=SeqID_209102
atggtgcatgctaagttgtggggcattttgttgggcatccacattgcttggagtcaaggatgcacaagaggtagtttctcttggtctcatgctcatagggaagctaatcaagttgcatatgcattagctagttttgctcaatcctttgaggataggcttcgtatttttgatgttgttccttcgcttattgatcttgccgttatgactaatgttatttctatgataccatcgtgtgccctcagtgagattatggtcatgccgccctgccgaggtcagtcgcacaatctcaaaggtggttctcgtgttgccccgacttcgtgccttgccctagcgtcgaag

SEQ ID NO: 92325 - DNA, 255 bp, Glycine max
  Peptide Sequence Number=SeqID_209103
atgctgggtgcacctagcagcactcagaaggttttggatgatatttcttatgatatggaaaatggggatatggaagatgggagtgatagtgaatcttttgatgttgaatttattgatgatgatgcatgttcaatggaatcatttgagggatgtgagagtgatgggtcagataatgttatcattattcattttataaatgacatatatagtttggagttgagtaccatggttcctactgatgcgaagaaactttaa

SEQ ID NO: 92326 - DNA, 393 bp, Glycine max
  Peptide Sequence Number=SeqID_209104
atgtctcaattcattccaagtctaaaaccatgcatcaatgagagatgtcatcagccaagaaaggttcatgaagtggttttcttccttgccctttactgtattgcattgggaactggaggattcaaaccgtgcttagaaagctttggaggtgatcaatttgatgatgaccactttgaagaacgaaagaagaagatgtctttcttcaactggtggacctttacactgttcgttgcaatgctgtttggggcaacaatgattgtttatgttcaggactttgtcaactggggagttgctagtctcatcctcactatttttatggctctaaatatcattgctttctatgtggggaagactttgaaggaaaccctttcatgccaattctacaagtcctaa

SEQ ID NO: 92327 - DNA, 223 bp, Glycine max
  Peptide Sequence Number=SeqID_209105
gctcagcgtaagactagcgctaagcccaaacccacttactcgcactaagcgcgatggtggcgctaagcgcatcgtcagtgcctatttcgggaaaagagccctagaagcagaaagaggagcaacttgtgcattgaagtctgggttttgtaatttgatagagattagttcgttggagagtgagtgtgagatgctgagaagaggaggaggaatccttcttgtgtaa

SEQ ID NO: 92328 - DNA, 342 bp, Glycine max
  Peptide Sequence Number=SeqID_209106
atgaagggaatcacaggagcaccttacagggcacgttgtgatgctttgaccatcacaaatgtgtcatggttgtcgtacactgagcatcggggggttagggcctttgagctgatttcatcattccagggtcagttgagatggggtcctaagatggtcacagctcgactggagagggtggtatctgcggattacatggagtggtttttccggatatctcacccattcatgataccgacccaggcaggtgaccagcccagagatgcaccagccgtagaccctgaggagtacatacagccgcctagccccccggttccagtggcatttgacccccctccacatgca

SEQ ID NO: 92329 - DNA, 342 bp, Glycine max
  Peptide Sequence Number=SeqID_209107
atgccactgcagcagggaaggtacctagcgcaagatgtacctgacgccacaaagaaaccaaatagaaagagaaagagtggaatagagggaaggtacctaacaaaggcgcgagatgtcacggtggcggaagatgtcgacaccgaagttcaaagacacaaagacgctaagagtggaggcgaagagggatatgagacagagacgcgaagagtggaggtgaagaaggagctgagaccaagaagaagagagcacgagaaaatagggctttggtatcatatatttttaaatcatgttggggtaaagggtgtcacaagaggtggtggcgggagaggtggtcgtcagtaa

SEQ ID NO: 92330 - DNA, 192 bp, Glycine max
  Peptide Sequence Number=SeqID_209108
gtgaaaaagaggctaagtcatgaagtgccaaaacgtagcctcagtgtgcttagcgcaataaaagaatctggtagagcattaatatcaaggtcgcacgctaagcacgagatcagtgtgctaagcgtagtagttgtcttcagccaggctcagctcacgactggcgctaagctcaaatccacttactcgcgctaa

SEQ ID NO: 92331 - DNA, 1224 bp, Glycine max
  Peptide Sequence Number=SeqID_209109
atgaagagaatcaggaaggcgccggcgcccgcgcaggaccccggcgatatccgcgtgatgaccatcaaccatcgccgctttgtggtcggtctcacctggcagaccatccgtgcgcagcgtaaccccatgaaggagatacgccgcgtcggtaaggagcaggggctggacctggtggcggtgcggcgcagcgacagcatacaggccggcttcgcgccgaaaacccggctccgcctgcgcggcaccttctcgctgacggtgtcgctggcctcgctgcttgagggctgctgtatcgccgtggtgccgctcggcgaagggccggacggcacccagcagtacacgctggtcggcaagacggagcgcggcggcattcatccctggtccgataaggtctacgcggcggcgctgctgcgccagacgctcattgacctgcggggtgaactgcgcggcagcaagagcgatctggaggtgccggtgtacggcgatcctgccgtcgcaggcgtgaccgcgccgcttgacctggaggcggtgctggcgccgaagcagctgagcaaggatttccggctgcggccgctgacgtggggcatgacgcgggggcagctgatgacggccgcggcggtggccgcgctggcgcttgcagggctgggattctggcttcacgtggagggcgagcgggaagccgccgcccgcgcggcgctgcagcgcgaaatggcccgtcaggccgagctgaacaagcaggcacgctataaggcggcgctggacagctttcgccacccctggacggagcagccttcggtgggcgcgtttatcgggcagtgccagcgcatgctggaccgcgtgccactctccattgcgggctggatgaccgtcacggtggtctgcgcgcagggtgacgccagcgtgcagtccatccggcgcactaactcggcggccaccaccgccggttacgtcgctgaagtgaagaagctgttcggcgtcacaccggtgttcagctttgccgacagcagccaggcctcgttcacgctgtcgcagacgccgaagccggaaggggatgacccgatggtgccggtggatgagaggctcatgcagtttatctcccgttttcagtcgctgaacatcgacctggccgtgtcggctgtgccgataaaggacgttaagaagaacagcgagggggaagacctgccgctgcaggactggcaggagtatcagttctctgcggaaaccgac

SEQ ID NO: 92332 - DNA, 351 bp, Glycine max
  misc_feature (33)..(33): n is a, c, g, or t
  Peptide Sequence Number=SeqID_209110
atggaggctgctatggctgccgtggatcctatngtatatgcacaattgtgcaagccttttcctgtcttaaccgaaaggcaggaccaatcctatttaatggcggtcacttacttaatgcttacattgcgcatacacggagttgacatggcagcccccaaaaatcacaaaggcatcgcaatcatgctgtacatgtctacggagttaaacgagaagcttacagcctcggccaagaaatccggccgcgcgaaagtgacagaagcgctgtttcgcttagaagaccatctgagtttgttcgaatcgattgccacaccagggcaacgttttcctgccggaactggcagcaaggattaa

SEQ ID NO: 92333 - DNA, 642 bp, Glycine max
  Peptide Sequence Number=SeqID_209111
atgaagaggttcccgaagggctggccacatggcttgaaacgcttgcgcaggcccatgaggctctgccgccgccttccacctacagaggcaaacggtcaaccttctgacgcggccgattgtcgtcagccttcaccaacgattggattgttcgaaatgaaatacctcatagcggctcttggcctgatcaccttttcgagccccgttttcgcggcctcctgcgagaagaacttcaccgtctccggcgtgccgatggtgacggctgtttcctacaagtcctggcaggagctgccgaaggcgaaggcgccagccgtgcttcagaagctcgcccaggccgtggcagcggaaggtttttcgggcatccagatcaacaaggcgctgtcgtccatcgatgcgcaccaggagaccagcggcagcggcagaattcagacgctgcgggtggtggcccggcaaaagggtgcggctgtgcggatcgacgccgtcttcaacattcaggcaggacagatcgcggacaagaacgtgatccgcgaaggccctgcccacccaaagcttattgccggtcaggccgcgtctgccccttcgcccgacgcttgcgctggcgccgcacctgtggtggccggcatggcgttgacggtctggatgtag

SEQ ID NO: 92334 - DNA, 309 bp, Glycine max
  Peptide Sequence Number=SeqID_209112
atgattgaaagggctaaacaaaaaggctttacatttccttatttagtggatgagggacaaaaaatttatcctcagtatggggcaactaaaacgccgcatgtttttattttacaaaaagaaaatggaaagaatattgttaaatatataggagcgatcgataacaattacgacaatcccaatgatgtttcagagtattacgcacaagatgcagtcaatgctttactaaagggagagcctgttaaaatgacaaaaacggttgcaataggatgtaccgtaaaaaaaaagcaggcttccaaaaaggaagcctga

SEQ ID NO: 92335 - DNA, 459 bp, Glycine max
  Peptide Sequence Number=SeqID_209113
atggaaggatacgattatattctggaaagacaattaaagccagaggcaagaacggatgttaaaacgatccttaaagagctggatataaaaccaacttctatgatcgatatttctgatgggcttgcttctgaaatactgcacctttctgaccagtcaaaagtaggattcaggctatatgaagagaagatccctatggatagccttacgatctcaactgctgatgaaatgaatttgaatcctgttgtaacagcattaagtggaggtgaagattacgaattattatttacaatcgcaccggcagattttgataaaataaaaaaccatcctgattttacgattgtaggacatgctgtagataaagaggacgggaattttatggtggccagaggttccaaccagctgataccgcttacggcgcaaggctgggatgcttttttgggaaaccagcagggagaataa

SEQ ID NO: 92336 - DNA, 291 bp, Glycine max
  Peptide Sequence Number=SeqID_209114
atgaccacattcaaggttcccaacaaaacactcactatcctaaggaaaaatttccaaaaattattacacaaatggaagtttggtaacctattggaggctcccaacacacttccaatgaaaggcctttttgttacaaaacttgaaagcaatgaagtgcttcttagtccaatagctcttaaggtggttggcccctttcttcttgactcaaattcttcaagggatgataccaatcctccttccaattccctatatggcaacccacaaacaaggaaacaaagagacaagcaataa

SEQ ID NO: 92337 - DNA, 732 bp, Glycine max
  Peptide Sequence Number=SeqID_209115
atgaccctctttagatcgttctgtaatattccagtggttgccgcaaggaatgacgtcgtagctcctgcagaagggagcaccttgctatcacgccctgagtttatagacgatgtctttattagagaggatctatacatggtatcttatctaaccaatccgggtaaggggccttcttattgggaccccccgaagaactccgcagtacaactagccgcagcaatcactgccggctcaaggatctatatgtacaagtatatttcaagagaagactgcttatatacagacaccgactctattgtccttggtaatccacttccggaggaagatgtttcctcttctgtattaggtaaatttaaattagaagataagatcttggagggattctttttagcacctaaatgctatagctataccacagaagagtcagatggcaataagaaggtctataagtacaagggaccgggtagaaatgttataactccagaatggtataaagaacagtacgccgacccttcccgaagtctgataaagaaggtaacttatcaatttcgacccaattggaaagaactctcggttaaaaacaaagagagtacaaccactcttggaaagaagacttgtctcttgcttcactttctcgcttttccttttctccatttcccagttctcccattacggataccaaccctcaaattcattgaaataaatagtgttattgagagtgagacatcttaa

SEQ ID NO: 92338 - DNA, 225 bp, Glycine max
  Peptide Sequence Number=SeqID_209116
atggttaacgaattggggatgaggattttactgaggcttggaggggttgatggggacccggtgctcagaggaacgaggagaagggctacctacgtagtggtacctgaggatatgtcgcctggggtcaggagaccttgggcacgtcaggtggggtgctattgcccaaaaccaagcttggccgatcccgacccaacccgagcaaagtcagccagtgagaacctgtga

SEQ ID NO: 92339 - DNA, 363 bp, Glycine max
  Peptide Sequence Number=SeqID_209117
atggagggaagagagaattttggtgttgtggtgggtgatgaggctccagagagcttccatgtggctcctagaattgagaacaacttggacttttcaagggcgaccgtgccggcgccggcgccaccgacggagggaaaaaagaagagagggaggccgaggaagtatgggccggatgggaagccggcgttgggagcggtgacggcgctttcgccgatgccgatttcgtcgtcgattccgttgacgggcgagttttctgcttggaagaggggtagagggaggcctgttgaatctatcaagaagtcatcgtttaagtttgaggttgaaagcccaggaccaggttttactgttacatctgttgctaag

SEQ ID NO: 92340 - DNA, 551 bp, Glycine max
  Peptide Sequence Number=SeqID_209118
cccagtctaacacttctagacttcggtttcctgctctgatcaccgcactatgtagagccagaggggttgtctctgacagccttacttttgagcgcctgagcccggtggtggcacctccaggatctattccttcagttgagaagttcaaggagatggtagcctggcccgggacccaaccttctcttcgcagggaagatgaaggttccacaacccaggtacctcagcatgtggaggatgagtcatctgaggccaccatcccagagccatttgttataggggaggaggcaggtgagacacaagtgagacaggtagctgctgccactcctgagatatctcttgaggccacttcagagcctcctactccagtggtggacctaccctcacctcaatgtacaacagacccttccactcctattctagagatactagaggacccgaccacactagtcctggctatggacacttctcctccagctactccagtacttcatctgacagatgaggaggatgttcaaacacaagatacccaagaccagtcacaggaattctaa

SEQ ID NO: 92341 - DNA, 172 bp, Glycine max
  Peptide Sequence Number=SeqID_209119
tcctttcgctaagcacgagccttgcgctaaactcatctttggtcatgcgctaagtcgcgagtctcaagcgcttagcgcccaacccttgcatctgaggctgattcattcagctaagctagccaaggccaagctgagcctaatcgaattcgatctgaatttggctaagcaatag

SEQ ID NO: 92342 - DNA, 1053 bp, Glycine max
  Peptide Sequence Number=SeqID_209120
ctgcgcgtcggccagctggcggcacgcgccgccgatgaacggctgggcctgaagtatggccgtctcggccaggaaaccaccggtgtcggcggcttcgccaaagcgctgcgcaccattccggtgatgctggagattgcgcgcaaagtagaacagctggcacccgacgccttcatcatcaacttcaccaatccggcgggcatcgttaccgaagccgtggcgcgctacagcaacgcgaagatcatcggcctgtgtaacgtgccggtgaatatgcaccatatgatcgccggcatgttacaggcgccgtttgacgaggtggcgctgcgctttgccgggctgaatcatctggtgtgggtgcatcaggtgctgtgccgcggcgaggacgtgaccgccggggtgatcgaacagctgtgcgaaggccaggcgctgaccatgaataacatcaaagagatgccgtggtcgccggcgtttctgcgcgcgctgcaggcgattccctgcccgtatcaccgctactactggcaaacaccgcagatgctggccgaagagcaggagaaagcgcagcacggccaggccggaacgcgcgccgaacaggtgatgaaagtggaagccgagctgttcacgctgtatgccgatccgcagctgacgcacaagccggagcagctgagttttcgcggcggcgcatattactccgaagtggccgttgagctcatcagcgccatccataacaatagcgggcaaaatctggtggtgaactgccagaaccgtggggcgattcacggtctgccggacgacgcagtggtggaagtgaactgtgtggtcgatgcgcagggcgcgcacccgctggtgtttggcgcgctgccaccgctgatgcacgggctgacgcagcagatcaaagccttcgagcgattgaccatcgacgcggcggtgcacggcgatcgcggtgccgcgctgctggcgctggtcggcaatccgctggtcggcgatgtcgccagcgccgaagcgctgctggacgaagtgctgacgctgaatcaaccgtggctgccgcagtttgcgtaa

SEQ ID NO: 92343 - DNA, 210 bp, Glycine max
  Peptide Sequence Number=SeqID_209121
atgtccaaccgtaatatcatcgaacgttatgtgctgcccgccgcgctcaaggtggccgggcagaagcatgtgctgtccgtgcgggacggcatcattctcaacatgccgttcatgctgatcggcagctttttttctgatcttcgcctacctgcccgtcccggcgtggggccatctgatggccgacctgttcggcgacagctggcgcaataa

SEQ ID NO: 92344 - DNA, 276 bp, Glycine max
  Peptide Sequence Number=SeqID_209122
atgtacccggttgagcgatacatgaagatcttaaaagggtatacaaagaatctatatcatccggaagcatctattgttgagaggtacattgcagaagaagccattgaattttgttcagaatacttagagaagggtaaagctgttgggcttgaggagggaaggatatttgcagctaatgagcaactacaaatatccttccctcctcaagtgcaagcttcttgcgtagccgctcttcgtgctcagaaaatcccaaaaacaaatccctcttattactag

SEQ ID NO: 92345 - DNA, 342 bp, Glycine max
  Peptide Sequence Number=SeqID_209123
atggccttaatcatttcaatgcatacaattgcaatcaatctacaagagattcagtcaaagtctacatcaacaactcaagtagatgtaccctctacttgtaccacaaaggatgtatcctccaatgtgttaagacaaagttctcaggcggttaaacctttgaaactttgtgaatggggatacaaaagaattctcaagcgggagattggagacacaaaagaattcaggcggttagtcctttgttcttttggaaaagggagaagagagacacaaacagaattcaggcggttagtccttggcgaattccttttggcaaagggagaagggaatgaaaaagatgaataa

SEQ ID NO: 92346 - DNA, 186 bp, Glycine max
  Peptide Sequence Number=SeqID_209124
ggagctaagggaccggcgaaacctgcagataagtcggatcctgatgtcaatcccctatgcctgatgacattgaccatcccatggctttttctcaagccgttgcaggtgtcatgggatgctaccgtgtttggggtgtataatgataacttccccttgtacataggcatgaagatctttctaaagtag

SEQ ID NO: 92347 - DNA, 108 bp, Glycine max
  Peptide Sequence Number=SeqID_209125
atgcccgataactacttgaaaggaattattaacaatgctttgaaagggtttgatgatagtcaacaaagtaaatccaagcatgctactagatggattgtagttaaataa

SEQ ID NO: 92348 - DNA, 559 bp, Glycine max
  Peptide Sequence Number=SeqID_209126
ggtggacccttgggtactagtacccttaccttccgaggactacacgtcctcgccttcagagggctgcacgccctcaccttcagagggctacacgccctcgccttcaaaggactacacgtcctcgcctttagaggactgcaagtcctcgccttcagagggctacacgctctcgccttcagaggactacatgtcctcgccatcagaggactacatgcctttagagggttgcacgccctcaaaggattgcatatcctcgccatcagaggactacacgtcctcgccatcagagggctgcatgccctcgccttcagagggctacgcggctacatgcacgccctcaaaggactacgtgtcctcactttcagaggactacacgtcctcacctttagagggttgcacgtcctcgccttcagaaggctgcacaccctctcctttagagggttgcacgccctcacttttagaagactacacgtcctcgccttcagagggctacacgcccttacctttagaggactacacgtcctcacctttagagggttgcacgtcctcgccttcaaag

SEQ ID NO: 92349 - DNA, 306 bp, Glycine max
  Peptide Sequence Number=SeqID_209127
atggctcgaacattagaacgcaaggtcactcaaggggggcttccaccaactgtcaaaaatgggtctgctacttccacccatgcaaagaagtcaaccgaaagcaacctaataaatgatgttcttctgcctcattaccaaaaaattaacaaggtggaaatggctcaaagaagagctaagggcatgttgttttggattcaaatatacttggagaggacaaccatgaggatgaccgcagcagacctcttattcaaatctgaatttgagcttgaagacatgctcaaagtcagggcgagagtgatgatatga

SEQ ID NO: 92350 - DNA, 336 bp, Glycine max
  Peptide Sequence Number=SeqID_209128
atgggtatcccaattactcaccctatggctcctttagtgaaaatcattgttgagttagtttcgtctcagtggcatgttatgtttcagcacaccctgagggagggtaataaaattgttgattggctcacaaaaaagggagcttcttctgttgatgttttcaaatcatgggatgggtgtccgacccaacttaggcacacccttgtagctaaggagtctattatccaagggaaggagcatccaaccaggggtgtggaactaggtgtagccttacaagggaattcgtccctccaaaaatacaaaaacatcttaatgtttagatgtaaaacccctttctaa

SEQ ID NO: 92351 - DNA, 348 bp, Glycine max
  Peptide Sequence Number=SeqID_209129
atggatcaaagttggatgaaagcatcacgcatcagtgacgagtatgagaattgggttgaccaatttttagaatttgctcaacagaatgcacaagaattgggtgggaaatatttgtgtccttgtgttaaatgtgggaatgagagacgacatgtagtgaataacataaagacacatcttatatgtgatgggattattctgagttatacaagatggatatggcatgaggatgcttccaaaccaaaacacattgtcgaaaaggataggcgtgatgaatgtcaaggttacatagcaagatggctaaagcatttaaaaagagagatctacctaggagcttacttgaataagtaa

SEQ ID NO: 92352 - DNA, 645 bp, Glycine max
  Peptide Sequence Number=SeqID_209130
atgactttctttaagtctagttgggaggtgattggctctgatgtgtgtttggctattcaagaatttcatcacaatgcaaaattaccaaaggctttcacctcgtcattaatcgcattgattccgaagtggatgaaaacaattatctcctctagtaatatatcaatcctagtaaacggatccctaacttctgagtttttagcttcaagaggcttgaagcagggtgatccgttgtccccttttttgttcttgatagttgatcaaggtatgatgtggctagttcatagcgcggtggagaaaggactattcaaaggtttaaaggttggagaagagttccaatactcaattctccagtacgctaatgattcaattctggtgggagaggcaattcatgataatctttgggctataaaagaaacattcaaaggcttcgaattggtctctggattgtcagttaacttctataagagtgtattttatgggattggcacaaaccaaagatttaatgaggcagttgcaaatttcctttcatgcagggtcgattccccaccttttcactttctgggactgccggttggggttagtccaactctctcttcaacttgggaaccagttactatcaagttttggaaaagactcttgaaatga

SEQ ID NO: 92353 - DNA, 303 bp, Glycine max
  Peptide Sequence Number=SeqID_209131
atgaatgaagaacttcttcaatactgtcaaagagaaatcaaggatttgcttgataaaggtttaattagaaagagcaaaagttcatggtcttgcgctgctttctatgtcaacaaacaggaagaacttgaacggggtacacctcgtttagtgataaactacaaaccgctaaaccaagcattacaatggattagattgaattctacaaaaatattttccaaatttgacatgaagtctggattttggcagattcagattcaagaatctgataggtacaaaactttcttcactgtacctttcgggtaa

SEQ ID NO: 92354 - DNA, 252 bp, Glycine max
  Peptide Sequence Number=SeqID_209132
aggggtaaccctgggaaaacacctttatccggaggaaacaacacttctgatggtgttgtgatcagggaagatcagaacccaagaaacccctcctctgatgcaactgcatcaagggaacaagtgaatgctatgtatgacccggcatttgagagggctggcgttccaattgatcccattctcaggttgttcaacgcaaattcagcagagaaaccagctgaagaagggcgtgaaaatccgaattggaaatcttaa

SEQ ID NO: 92355 - DNA, 291 bp, Glycine max
  Peptide Sequence Number=SeqID_209133
atggcaaatttcaaggtattcaccattatgacaaacaaaagccatgccaagcaatccattgatactgaatatagtcgagaaagagataataccattttcttcttcaaggattccatgcaagaatctattaccttgaagtctcaaattgaacttcttcaaaaagtagcttgggggtataaatgtgcaagagaatgttcttacaagagttgcaagagtattgaattccgcaacaatgtccactcctttcaactactcggggcttccaattggagcaaacgcaaggaagcttag

SEQ ID NO: 92356 - DNA, 135 bp, Glycine max
  Peptide Sequence Number=SeqID_209134
atggttaatagatacattaactatctattcctcggagattatgttgataggggccaacacagcctggaaactataagccttctgcgtgctctaaaggttgaaaatattcagcgtccaattacgatggaagcatga

SEQ ID NO: 92357 - DNA, 147 bp, Glycine max
  Peptide Sequence Number=SeqID_209135
atggtgaagggagctcaatggtggtgcgatactttgacttcttgtgagatctttgaaaaagagcataggtggttccaatccgggttagggagaggagtgcgaggtggaaataatgtgagcttttgggaagcaaagtggttaggagac

SEQ ID NO: 92358 - DNA, 196 bp, Glycine max
  Peptide Sequence Number=SeqID_209136
atgcacggtgtgagagggtgctgccagccagtgagaaggggagaagctgcacacgatgagaattacgcggtttgcgatttcgggctggcgagcatcgcctgcaggaagattgggttgcgccgagtcgagcgccgtgcagtgtcatgttcaggtccgccttactgtcggcaatctgccagcgcatcgattgatgcag

SEQ ID NO: 92359 - DNA, 522 bp, Glycine max
  Peptide Sequence Number=SeqID_209137
atggcgaggattcctaacaagattaggtctagtgatggatcaaaagaagcgcttaagcttgctgttaggatcaccgatctttggttcgttgggactcctgacaagtctgagcaagcggaaatggtttttgttgattctgagggtgatcaaattcatgctatttgtaaatcggatcacctcaagtcttggaaagctgatttgaaagagaattgcacttatgttatgcataatttcaaagttgttaagaatgatggtcaatttagagtgtgcgaacatgagtacaagttattttttattggagtgacggttgttagagaagctgatttgcatgaactgccttttaaggaatttatatttgttgaatttgcaaatgttgctgcaggcaattttgtgtctggcctgttgtttggaagttatccagcttcagtgagcaattccttcaaggcgtcaaaactattgattaatgatcctatattggaaattcaggaatttaaagataggcttttagatttaggtgttgag

SEQ ID NO: 92360 - DNA, 1664 bp, Glycine max
  Peptide Sequence Number=SeqID_209138
atttacgtatcctggttatcgatctcgatccgcagtcttcggccaccatgttcctgaatcatgaacgttcggtcggtttggttgaagccaccgcggctcaggcgatgctgcaaaacgtcagccgcgacgagctgaaaagcgaatttattgtgccgtcgattattcctggcgttgacgtactgcccgcctcaatcgatgacgctttcattgcttcacgctgggaagagctgtgtgcggagcatctgccgcagcaaaacgtgcatgcggtgctgtatgaaaacgtggtggctaagctgaaaaaagactacgactttatctttattgacagcggcccacatctggatgccttcctgaaaaacgccattgccgcttccgatttgctgatgacgccggtgccgccggcacaggttgatttccactccacgctgaagtatctgacgcgcctgcccgagcttatcgacatcatcgaagagtcgggagccacctgcaggttgcagggcaacattggctttatgtccaagctgtcgaataaagcggaccacaagatgtgtcacagcctggcgaaagagatatttggcggcgatatgctggatgcggcgctgcctcggctggatggctttgaacgctgcggtgaatcgttcgatacggttatctccgctaacccatctacctatgtcggcagcagcgaagccctgaaaaacgcgcgttcggcggcagaagactttgccaaagccagcccgttacaaaatgaacccagcgaggatggtcactcccagacgttcatcctttccaccggtaaacgcgccctgttcaccctggaacacatcacggctaaagagatagaagaacgtacgtacgtggtgatggaaaccaacggacgtgaccagtccggtctcacgccagagtcactgcgcgatatcatccgtaccattaaactgcagcagttcttcccggccatcggcgtgaagcgtggcgatcggattgaaatcctcgatggttcgcgtcgtcgggcggccgcgctgcactgtaaaaccgggctggatgtgctggttaccgacgttaccatctctgccgaagaagcccgtcgtctggcgcaggatatccagaccgcgcgtgagcataatctgcgtgaagtcggcatgcgtttgatgtcactgaaagacagcggcctgtcgcaaaaagagattgcgcaaagtgaagggctgtcacaggcaaaagtgacccgcgcgctgcaggctgccagtgtgccgctggaactggtcaccctgttcccgaaccattcagaattgacctatcctgactacaaaacgctgttgcaggcctacgaaaaactgcaggaaaccggtcagacggtagacgctctgattgaaaccatcggtatggatgtggacagcgtctgtgcgcgtgaaggcctggcggaagatgaagtcaagaatggcatcctgaggctggtccgtaacggtagccagacactggtgcaggcgccgactaaagataaagtggtggcgacaccgctgtggaccttcgcagataaagaccgttacgcccgcaagaaaacgcgcggacgcatgtttagctacgagtttaaccgtcagtccagagagttacaggaagagctggatcgcgttatcaccgagacgctgaataagtatctcaatcagtag

SEQ ID NO: 92361 - DNA, 285 bp, Glycine max
  Peptide Sequence Number=SeqID_209139
atggggtttttcttggtgggaaatttggctttaagtgtttttggcctttttcttttttgtttttgtttggcgcgaggtgaacaagccactgacgcacagatattgtctggtccaaagacctttctgtatatttcttcttgtcgcaacgtgcccttcatgggcgagcgagggcgaggctctcgggtgcgctttccaaaggaggaaagatgcgcggagtcgccaccaacgtttatttgggaaaacgtcgggaaaaccgaaggaaactggtcaaaaggaaaattctaa

SEQ ID NO: 92362 - DNA, 165 bp, Glycine max
  Peptide Sequence Number=SeqID_209140
atggtgatcaacctgagtctcaagggagttccaaaccgagtgacatgcccccaagtacaagtattctccctcatgagaaactacaatatgaaacatgggcaccatcaatgcattgaccgtggatcattacggattctaagccatctccctccagagatggcttaa

SEQ ID NO: 92363 - DNA, 526 bp, Glycine max
  Peptide Sequence Number=SeqID_209141
atggaactgcattcagaaacctttaatcctgccgattttagctggcgcggtttaacgctgacgcccgcggcggcggcacatattcacgagctggtggcgaaaaagcccgagatcctcggtgtgcgtcttggggtcaaacagaccggttgcgcaggcttcggttacgttctcgacaccgtcaccgagcccgagaaagatgacctggccatgccgtttatcgacggtaccgaagtggactacgtccgcgaaggcttaaaccagttattcaaattccataacccgaaagcccagaacgaatgcggctgcggcgaaagctttgggacggatgaactggcgaaaggcattaacgaagatgtcgttcgggcgatctcggcaaaacgtaacgagcccgagtggatgctggaatttcgcctgagcgcttaccgcgcctggctggagatggaagagccgcactggctgaaagcccattatgacaagctgaactatcaggactacagctactactctgcaccctcctgcggcagct

SEQ ID NO: 92364 - DNA, 504 bp, Glycine max
  Peptide Sequence Number=SeqID_209142
atggtgccggtagcgaccctgccggcagcggcaatcctgatgggggtaggttactggatcgatccggacagctggggcgcaggcaatgcgctggcagcactgctgatcaaatccggttctgccatcatcgacaacatgtccgtgctgttcgccatcggtgtggcttacggcatgtcaaaagataaagacggtgcagcggcattaaccggctttgtaggtttcctcgtggttactaccctgtgttcacccgccgcggtggccatgattcagaaaatgccggtggagcaggttcctgccgccttcggtaaaatcaacaaccagtttgtcggcatcctggtgggcattctctcggcggaagtttataaccgcttcagccacgttgagctgcctaaggcgctgtcgttcttcagcggtcgccgtctggtgccgatcctggtctccttcctgatgattgtggtcgcctttatcctgatgtatgtctggccgatcattttcggcggtctg

SEQ ID NO: 92365 - DNA, 873 bp, Glycine max
  Peptide Sequence Number=SeqID_209143
atggagccggaattttgggacaaaaaccccttcaaggccacaactaaggtgtttccaccaggcttccattttagacctaatgccacaaacaaaacaagaattttttatgaattcatactcatagacacaaactcagtgtctattaaacatttcaaagacaccaatgatccaaatttgaatactcattcaaccatccaaattttaaaagtcttacaacctaaacaatttggaacaaatttgaatcaacccaagaatttctctgcaccattcgatcctataggttatacctattgggattatgtagatgcctggatgaatttcgtcaaatggtgggatttctttggaccaaattcagagatctatccagagcaagtccaacaaggatttgatcaatttaaaagaatgttcaactctcaggaatcaagaatccctgcagatatgatgtatttttccagctttgcattgtcatggatattctcatggcagtacaaatatgggaaaactgaaagcaacaagcaatttccatcattgcagcgacacgcgtttatcaagttgtggaatcaatttgatacatccaatgtagcaccagataaagtcaaaatctggtttcaagcccacccgaaattcctgaaagctactgatctagagacttctttgttcctcaataaaaagtctcaattagctgctttcttagccagctccagatcaaaggaaagtctggctaaaaatttaaaagaagtcctacaaattcttcaacaacaacaagaagaaggctcctcctccaataaggaagataacaactcctcaaaagaagaagatccgttttaccagaatgaagatgattgttttggtatctctataaatgatgattaa

SEQ ID NO: 92366 - DNA, 234 bp, Glycine max
  Peptide Sequence Number=SeqID_209144
atggaccaaaaagtaactacaggcttgtttagtaatgatcaaggggttttatgcttgtgtgaagagatagacagaaaaggacttagaattttttttgcaattatctatccgctaagcgcagaccttgtgctaagcgctcaatcttcacgcgctaagccgagcttgctcgcgctatgcgcatggaccctgattggttggctgaataattcagctaagcgcacatcattgcactaa

SEQ ID NO: 92367 - DNA, 1491 bp, Glycine max
  Peptide Sequence Number=SeqID_209145
atggcagtgcactctcctgactctggtagccataaacagtccctgcaaccagtttttattcttcatacttacccttttaaagaaaccagcctcgtggttgaaatgttcagccgcgacctgggccgtattgcggcagtggccaagggtgcgcgacgacctctgtctgcgatgcgcggcatgttgcagtcttttcagcagctggctggcacctggtcaggcaagaatgaactcaaaaccctgcacggcctggagtggatgacagggttgacattgctcaggggcgacgcgctcatgtgcgggttttacatgaacgagctactattgcgcctgctgccgcgggatgatgcccatacccagctattcgagtattacgcgcaaaccatacagctactttctaccttgcagcaagatgccgctagtggccagctggccgagatgatgcgccggtttgaactcaagatgctgcaggaactgggttatgcggtgccactgacacatgatgaacatggcgaagtgatacatgcggatgaaatgtaccgctttgaagccgattatggtgcatgcgcaccatctgccactaaaaatggcttgctggttcagggctcaaccctgctggaaatggcacgcggcaattacagtagcgccaccacacagtcacaaagcaagcagctcatgcgttacctgctacagcattacctgggtgaaaaacctttgcatacccggcaccaaagagagtctgtggctgataaatcgaaagtaactatgttaaaactaggcgtcaatattgatcacgtggcgaccattcgccaggcgcgtggcaccaaatatcccagcgtggtgcaggctgcattgcgtgccgagcagtcgggcgcagacagcattaccctgcatttgcgcgaagaccgtcgccatatgcaggatgcggatatttttgccttgcggccattgttgcaaaccaaaatgaatttggaatgtgcagtcaccagcgagatgatcgacattgccatccaggttaaccctcaagatgtctgcctagtgccagagcggcgtgaagagcgtacgaccgaaggtgggctggatgtgctgacacattacgccaaagttgagcatgcagtgaaaaagctttctgatcaaggtatacgcgtctctctgtttattgcccctgacctggcgcagattgatgccgccgccaaaatgggtgcgcctgtgattgaaatccataccggcacctttgctgatgcagagactgaaaaacaacagcaagatgaattggataaaattcaggctgcgttgaaacacgcgaaagctgcgggcttggtcgtcaatgccggtcacggattgcattatcacaatgtgcaccatattgcgcgcctgcctggctttgaggaacttaatattggccatgcgattgtggcgcatgccttgtttgtgggttgggatagtgcagtgcgtgagatgaaagcactcatgaaagagttttcagcaagatga

SEQ ID NO: 92368 - DNA, 150 bp, Glycine max
  Peptide Sequence Number=SeqID_209146
atgacgatgaccagcgtaactcagggtgaggggtcaacttcacgtagggcaactgagtctactgaggtcacgagagtcttgttcgagtcacgtgactataatgccatgccaacgacgacggtgtccagcaaagcaaggtcatcgaagtaa

SEQ ID NO: 92369 - DNA, 351 bp, Glycine max
  Peptide Sequence Number=SeqID_209147
atgcagattccaatttcagttggggtatctggatatgaggcagcttccttgtataaaggacggagacaaatttcttcagtgggagatcaagggaaaacttttacttctcagcagctaactatatattgtatctttggtgtattggctggaatagttggtggcttactgggaataggtggaggattcgtaatggggccactctttttggagctgggagtcccacctcaggccttaaatggtcttaatcaagctccaacggcctggtacaacatgtttgatgagtatcttcaggggcttggatttgttaacactctccaagtgaagctatcttatatgtcaaagaagaatgtg

SEQ ID NO: 92370 - DNA, 252 bp, Glycine max
  Peptide Sequence Number=SeqID_209148
atgtacaaagataagtgggctcatactgagcccatgggcccaaaatataccctaaggctcatgagaatcctagggccttctcctgcatctttggctcaatcttcttggagtcttctatccaatgcccctaggggtaggattgcatcagagaatatgcacttatttttcaataagtatgccatacaacgtcatctcccaccttcagtgcctaaacatgattttgaggtgatcaatctcacaatcgcattgtag

SEQ ID NO: 92371 - DNA, 837 bp, Glycine max
  Peptide Sequence Number=SeqID_209149
atggtggaaagacctggtggatcgttcggtcctgccgaccacccttttctagagcccatgaattgcgctttcgttcatgtgtcctccaccttcgagtttggagccatgcgtagtgattgcttagtgcaattctccattctcacccttttccggagccccatgaattgcgttttcgttcatgtgtcctccaccttcgagtttggagctatgcgtagtgattgcttagtgcaattctccattctcaacctttttcggagccccatgaattgcattttcgttcatgtgtcctccaccttcgagtttggagctaggcgtagtgattgcttagtgcaattctccattctcaacctttttcggagccccatgaattgcgttttcgttcatgtgtcctccaccttcgagtttggagctatgcgtagtgattgcttagtgcaattctccattctcaacctttttcacagccccatgaattgcatttttgttcatgtgtcctccaccttcaagtttggagctatgcgtagtgattgcttagtgcaattctccattctcaacctttttcggagccccatgaattgcgttttcgttcatgtgtcctccactttcaagtttggagctatgcgtagtgattgcttagtgcaattctccattctcaacgtttttcagagccccacgaattgcgtttacgttcatgcgtcctccaacttcgagtttggagccatgcgtcgtgattgcttagtgcaattctccattctcaacccttttccggagccccatgaattgcgtaacgttcatgtgtcctccaacttcaagtttggagccatgcgtagtgattgctta

SEQ ID NO: 92372 - DNA, 748 bp, Glycine max
  Peptide Sequence Number=SeqID_209150
atggcaggagatacaggttcatgcggttcaagggagtctcggatgcaaaaggattggaggttcgacagaccagttcggaatacagaggaccgccgacgattggaccgggctcgagtattggtgcggacaccgcttctgccgttgataaggtcggaggtcatcgtccgtgtgggggagcttgagtatcgggtatggattgtggaagagacagggttcgaaggtgggtcgaaccggaaaggaagctcgtcgtccgatgggtggtcggagatgataacatcggacgacggtggggaggttggcgatgttcttgacgacactaataccaatttctccttctcgtcggagctgcccaaccagaaattgtctccgtctcgtacccaacgggcagaaggagggaccgatgtgcgctgctgtgatcttagacccctaggtaatatccaggcagacgttacacccaaagaaaagtcaaaaggcactgtagaaggtatgctaggctctagctttggtaagctcaacctaggggacagcttcgcaggaacagaagaggaagctgctaacaccaaagaggtaacctgctataataccctacaggatgatcaaaggcacaggaatcacatagagggaaagtatttgaatggtggagcgaaagtagctgctgaccagacctttattggggaagaagagggacatgtcacgcagtctctctctccttctttatcgggggagattcaacaaggaattgggccag

SEQ ID NO: 92373 - DNA, 336 bp, Glycine max
  Peptide Sequence Number=SeqID_209151
atgacttacaccaagaaaactgatcaaatgatgtttgaggcggcaaagaaaattgctaacaagattgattccatggaggagcaggcttcagaggattccattgtcgctcatggacaacaccctggtcgtgtgtgtgctgctggagccgatgtcatgatcaaacaatactttgaaccggctccaaggacctcccacacgtcttcgtccatgactccgaaatacatggagcagttgaggcaaaaaatcagggaccaactggaggagtcaatcacagaaaaagtgactcgacaagtaatgttgtcctttagccagatgcaatcccagtttcaatcgtag

SEQ ID NO: 92374 - DNA, 393 bp, Glycine max
  Peptide Sequence Number=SeqID_209152
atgcagggggaaattaatatccaccaactttttactggctatacaaatggtcgtagggattggcttgcttgcccacagatattgaaattaaaagattggcctccttctaatttatttgaggaacaattgcctcgtcattgtgctgagttcatatcttccttacccttcaaggaatatactgatcctcacaaaggttctcttaaccttgctgtgaagttgcctaatggttctctaaagccagacctggggccaaaaacatatattgcttatggatttcctcaggagcttggacgtggtgattcagtgactaagctccattgtgatatgtctgatgcagtatgctctatttgcttatttctttcctgggctgttattttcaaggatttcttctaa

SEQ ID NO: 92375 - DNA, 948 bp, Glycine max
  Peptide Sequence Number=SeqID_209153
atggcgcggtggctgatggcgttcttcagcgccggctccatttccgcggcggtcaggccccgaaacattcgtgccgcgcagctcgcggatgatctggccctcccaacggccttcgcagatcagcggctgcgggtcggtggcgtggcgcagcagcacgatcaccgcatagaagcgggcgctgcgctggccgtcgggaacatcggccatcgcgtccagcagcttggcgttgttggccgcggcgttggtcgggtgaccggcatagcgcgcgctgtacaggcccggcgcaccgccgagggcatcgacgatcaggcccgaatcatcggccagcgccggcaggccggttgcttcgcaggcggcgcgcgccttcagcagcgcgttctcgacgaaggtcggcgaggatctcctgcatctccaccagcttgccggcgttgtggctggccagtaccagtttcttcattgacggggctccagcaggtcccaggtgttgccatacagatcgcggaacaccgcaaccgttgcatagggttcttcgcgcggcgcttccaggaactcgacgccggcggccagcatcgccgcgtggtcgcggtggaagtcatcggtgttgaggaagaaggcgacccggccaccggtctggttgccgatgcggctgcgctgctcctcattgctggcacgggccagcagcagggcagcggcactgccgtcggtcggcccgaccaccacccagcgcttgtggccctggtcgatgtcttccagcagcgtgaagccgagcttgccggtgtaccaggcgatggcttcgtcatagtcggccaccacaagggtggtcagcgcgatccggcggttcatgccgacagcgccgcctgctgtgcggccagcagttcggtcacgcccttttcggccaggcccagcagcgcgtccagctcgtcgcgacggaaggcatggccttcggcg

SEQ ID NO: 92376 - DNA, 1020 bp, Glycine max
  Peptide Sequence Number=SeqID_209154
atgggtgcccggccattgttcgcactggccatcgtcggcatgccgatcaacacgctgccgcaggacaccatccgcggcatcctgcagggcggcgaacgcgcctgcgccgatgccggcatcgtggtagctggcggccacagcatcgattcggtggaacccatctacggcctggccgcgatcggcgtgctcgacccgcagcggctcaagcgcaatgccgatgcccgcgccggcgatgtgctggtgctgggcaagccgctgggcgtgggcgtgtattcgtcagcattgaaaaaagaagtgctggatgccgacggctaccggcagatgatcgcgtcgaccacccgacttaacaccgtgggcatgccgctggccgcgctggacggcgtgcatgccatgaccgacgtcaccggcttcggcctgctcggccacctgctggaagtgtgccgtgccagtggcgttgccgccgaggtggacagtgcacaggtgccgctgctgccacaggcgctggagctgctgcagcgtggttgcgtgaccggcgcctcccaccgcaactggacttcctatggcaccgaggtgcgcttcgccgaggggttgccagcacattggcagccgctgctgaccgacccgcagaccagcggtggcctgctggtgtcttgcgccccggaagcggtggatgcggtgctggcctgtttccacgacgcaggcaccttcagttccaccgctgcattggacgtgcggctgtccaccgacttcgagcccagcgtgttggcttcgcggttgaactcctgcagcaggaagtccaggcggcggccgaccggctcacgctgcttgagcacgcggcggatctcgacgatgtggctgccaagacggtccagctcttcatccacgtccagcttctgcagccacagcaccagttcctgctcggcgcggccgggatcgaccgggtgcggcaggtcggccaggcgtgcggccagcttggcacgctggccgtcgcgaatggccggaatcagcatgcggacttcg

SEQ ID NO: 92377 - DNA, 183 bp, Glycine max
  Peptide Sequence Number=SeqID_209155
atggccaaaatacaaggccaaaaagaagaaaaacctattctaatatttacaaagaataatggactcaaccttgccccatgggctcagaaatctaccttgagacacatatgttgggagtgcttggtgggccctcaacctagtgctagaggttatcgatggtgcgtaactggaataagcctataa

SEQ ID NO: 92378 - DNA, 273 bp, Glycine max
  Peptide Sequence Number=SeqID_209156
atgggtgcagctttgtcaactgtttactataatcttaatctaaggcaccccacactggatttgcccatcatcgactatgatttggcactgctcattcaaccaatgctcatgcttggcattagcattggagtggccttcaatgtcgtagttgctgactggatggtcacaatgctgcttcttgttctctttttaggaacatccacaaaagcattcttcaagggtgttgaaacatggaaaaaggaaaccataatgaaagaggtgacatttaattga

SEQ ID NO: 92379 - DNA, 420 bp, Glycine max
  Peptide Sequence Number=SeqID_209157
atggaccaattaaagcacctaagcatcccctcaggaatgcttagattctctaaccacactagttacccacgtctgggccatccgacaagaaaaatcagcatgcaacagggacaggcagatatcctcatagctaggttccctgaccctaactatggtgttaaaacgaaaacgaaaggtcagattagggtttttgttctctaccggaaccgcaagccaagttggaagattccgcttcggttgaagggttcctctcggtgtgggttttcaatggagaacaatgatgatttgtggtggctaatggtggctatgggtgatggagaaagtgcttgggactttagaaatggctttggaagaaagaaagaagaagaaatgacgtttttcctaagctacacgaaagcaaaggctgaaatgcttaaataa

SEQ ID NO: 92380 - DNA, 264 bp, Glycine max
  Peptide Sequence Number=SeqID_209158
atggacatccttgctgcattggatgagatgaagtcaatgaagtctagccatggaactgtcaatgttgatgaaatggtggaggctctgcagcgcacaatagcttataagaattcagacggttttgtcagaagaattcctaatgaacatattgaaacagaggaggaattggttcagttttgtaatggacatggtgaaacatccagttctaatcctaagggtccagcacctccagaacaggaagagatgaaaagagatagagcttag

SEQ ID NO: 92381 - DNA, 282 bp, Glycine max
  Peptide Sequence Number=SeqID_209159
atggtgcaagatgacgatgaaggtgatgatgaatatgtctcgttgcatactgaacaaactcatgaaagtggcaaggacagagatgttccttctagtgctgctctgccaattatacgaccaaccttgggaatacaacattctattgcagacagggcaaagagaccaatgcaaggatatctgaatcactttctggaaaatatcagtattgtgaactctcgtgaggatttttacaaggttgaaagaaatctcaaggaccgcaggtcgcttggggactggatgtag

SEQ ID NO: 92382 - DNA, 183 bp, Glycine max
  Peptide Sequence Number=SeqID_209160
atggacatggaatttgggtggcaaattatcttgggtaccattgttggattctttggagcagcatttggaagtgtaggtggtgttggtggtggtggcatattcgttcctatgctcagccttattattggctttgatgcaaaatcctccacagctatctcaaaatgtaagagttcaaccacataa

SEQ ID NO: 92383 - DNA, 459 bp, Glycine max
  Peptide Sequence Number=SeqID_209161
atgacagaaaccgtttgtacggataaccgcttgggtatctccatacgtcacctgacttcacgggtcaggatgacagaaatcgtttgtacggataaccgcttgggtatctccatacgtcacctgacttcacgggtcaggatgacagaaaccatttgtatggataaccgcttgggtatctccgtacgtcacctgacttcacgggtcaggatgacagaaggtgcggaagacaacgtaagtctccatgcgtcaacgggatcaactgaaatcgtttgtgcggataatcacttgcgtatcttcgcaggtcacctgacttcatgggtcaggatgacggaaaccgtttgtacagataaccgcttgggtatcttcgtacgtcacctgacttcatgggtcaggatgacagaaggcgcggaagacgacgtgagtctccgcgtgtcaatgggttcgttggcccctgattga

SEQ ID NO: 92384 - DNA, 827 bp, Glycine max
  Peptide Sequence Number=SeqID_209162
gactgcacgcgcttgccttcgtagggctacatgccctcaccttcagaggactacatgtcctctccttcaaggggctacacgccctcgccttcagaggactacacgccctcgccttcagaggacttcacgccctctccttcatagggctacgcgtcatcaccttcatagggctgcacgccctcacctttagaggacttcatgtcctcaccttaagagggctacatgccctcgccttcataggggtacacgccctcaccttcagaggactacacgtcctctccttcagagggctacacgccctcgccttaagagggctacacatcctctccttcagaggtctacgcgtcctcaccttcagagggctgcacgccctcgccttcagagggctacacgccctcgccttccgaggacttcatgttctcgcctttaaaggactacacgtcctcaccttcaaagggtttttacgccctcgccttcgtagggctacatgccctcaccttcagaaggcgtttgccttaagaggactacacgtcctcaccttcagaggactacacgtcctcgccttcagagggttacacgccctcgccttcagaggactacatgtcctcacctttagaagactacacatcctcaccttcatagggctacacgccctcaccttcagagggctgctcgccctcgcctacagagggctacatgttcgcacctttggagggctgcacgccctcgcctttagaggaatacacgtcctcaccttcagagggctgcacgccctcgccttcatagggctacatgccctcacctttagaggactacatgtcctctaa

SEQ ID NO: 92385 - DNA, 102 bp, Glycine max
  Peptide Sequence Number=SeqID_209163
atgccaaatccaagacagagacaaatcgaggtaagcggtaacgtggccacgatttgctgcccaatgtcatctcctgctttcagggttagctcgcctgggtga

SEQ ID NO: 92386 - DNA, 399 bp, Glycine max
  Peptide Sequence Number=SeqID_209164
atgacatgtgtccctctgaaggcgagggcatgcagccctctgaatgcgaggacgtgtagtcctctgaaggcgagggtgtgtaaccctctaaagctgaggaagtgtagtcctcttatggcgagggcgctccaccctctgatggcgaggacgtgtagtcctctaaaggtgaggacgtgtagtcctctgaaggtgagggcgtgtagcccgctgttggcgaggacgtgtagtcctctgatggcaagggcgtgtagccctctaaaggttcgtttgaggctcatgcacagtgcccctcattgccctagtgtagggcttttaggtatcaaccttgtcttttgtcatgaccttgtagcagggaacctattgggtgagaacttccaatctgcccctaggttcgcttga

SEQ ID NO: 92387 - DNA, 366 bp, Glycine max
  Peptide Sequence Number=SeqID_209165
atggtggttgtgggtgatggagaaagttcttgggacattagaaatggctttggaagaaagaaagaagaagaaatggtgtttttcctaagctacacaaaagcaaaggttgaaaacgctcaagtgagaaatggtctcggacatggaaacgtttcacacactccagacaacttcccgaagatcccaacgctgcaaaccaaatttcgtgaagatccaacgattaacgaaggttgggaagcatttttaccgaggcagctcatgtggcttcctcaagaaacttcattaagaggcttcctcaagaagcttcctcgtggcttctttgagaagctagatccttatctacccacacccctctataaactaaattaa

SEQ ID NO: 92388 - DNA, 201 bp, Glycine max
  Peptide Sequence Number=SeqID_209166
atggttgtcatttggaagggaatggccccaaagaagcttttgtctaagaaggcaaggaaagatgtcgttggagaaggttccagtgcagccccacaagtggacgtggagttcggcggacatagattcgaagtgaggaacaccagtgccgttttgaggcaattaagggttggtcattcctcaaggaaaaacgggtctagttaa

SEQ ID NO: 92389 - DNA, 585 bp, Glycine max
  Peptide Sequence Number=SeqID_209167
atgcgcaaggacctcgaaacgctggtcgcgcacgcgcacaagctcgggttctacgtcaatctggtgacctcgggtgtcggcctgaccgatgaacggctcggcgcattgcgtgccgctgggctcgaccacatccagctgtcgttccaggattccacacgcgaactcaacgactttctgtcgagcacacgcaccttcgacctcaagcgccgatcgaattcctgcagcccgggggatccactagttctagagcggccgccaccgcggtggagctccaattcgccctatagtgagtcgtattacaattcactggccgtcgttttacaacgtcgtgattgggaaaaacctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 92390 - DNA, 282 bp, Glycine max
  Peptide Sequence Number=SeqID_209168
atgaccggcgctcgccggggcgtccttctatgggacatgaacaacggttttcctgctggtccgtcagttgtcgccaacttcaaacctcccgaagggcagggccttcagctcggcatgaccgaacagaagatcaggacgatggaagagttcgcggcggcaagcggattgtctcgtcctacggtctcgaaatatttcgacaatcctgaaagcgtaaagccttccacgcgggctcgtatcgaaaaggcgttgaaagactataattatcagcccaacatttttgca

SEQ ID NO: 92391 - DNA, 620 bp, Glycine max
  Peptide Sequence Number=SeqID_209169
atggcaggtgctgcatctgccgaaggcatcggcgcatcgcttctcacccagcagcatccgttctacatctcgctcgcagacgcgatgaagaaggaagcgcaggcagaaaatgtaccgctggaagtctccatcgccaatcaggacctgagcaagcagcttgctgatgtggaagatttcatcaccaagggcgttgacgtcatcatcatctcgccggttgacagcaagggcgttcgctcggccatcaacaaggctgaaaaggctggcatcaaggtcattactgtcgacgtaccggccaacaatgtcgatgtgacctcctttgtgggcacggacaatttcgcaggcggtgaaaaggctgccgaactgatggcaaagtccatcggcgagaagggcaacgtcgccgtgatcgattatccgacggttcagtcggtcgtggaccgtattgaaggcttcaagaagggcattgccaaatatcccgacatcaagatcgtggcgatccagccgggcatcacccgtccggaagctctttcggctgcccagaacatccttcaggccaatccggatattgtcggcatcttcggtttcggtgacgacgctgcgctggctgctgcctcggcagtaaa

SEQ ID NO: 92392 - DNA, 360 bp, Glycine max
  Peptide Sequence Number=SeqID_209170
atggcctcagttaccttaagaaaaaggggggttgaattaagatgcaaagactattccccaattgaactatcaatctctcttttcggattaacaatgcgcacagggataacccttcccttgtgttcaggaatcctctacaacaagagacccacggagtcatttgacttaatccatcaactgaaagatccttcaactatttctcgtccttggaaaattctttttgcaagaatcaactgcttctttcattcttcctcactacgaggtcgtgaaaacaagacaacacttggcacctctaagccctacactggggcaatgaaaggccccatgcaaaaacctcaagcgaacctaggggcagattag

SEQ ID NO: 92393 - DNA, 252 bp, Glycine max
  Peptide Sequence Number=SeqID_209171
atggtcgtacagattgctgatcatacggattgccaattttatccacgaagaaaaaagaagagcaacaacggagtgaaacaacacaaggaagaggaagaagtagaactaagcaacatgagaagtggaggaagaagacagaaagaagaagaaccacaaccgagaagtggaggaacaagaagagccgcaatcacgacatgcgtgaaagagaacgaagaagaaatattgcgacaaaattgtatgaacacactgtag

SEQ ID NO: 92394 - DNA, 838 bp, Glycine max
  Peptide Sequence Number=SeqID_209172
gaataccggggctgagcagccaacgccgccacgcggctctgctaaagtctgggcccgaccaggacctgtcgagacccccatgcctgtggctgcctgccggagaggactccggcgcccacaacgaaggccatcgcgctgatggccgcaccgatgctcgatacctaccgcgaggtggtgacgccagagggtgtgccgctgcagttgcctgccgccggcccggtaccgcgggcgatggcctggctggtcgatctcggcgtgcgcatcgcggcactggtgctggtgtccattccgctggcgctgctggacaagttcggctccggcctctacctggtgctgatgttcctggtctactgggcctacccgatcgtctgcgaagcagtgtggggacgcaccctgggcaagcgtgcgctggggctgcgcgtgctgtcccgcgatggcgcgccggtaggctggatggcggcgatcacccgcaacctgctgcgcacggtggacatgctgcccttcggctatgcgctgggcctgatcagcagcctgttcgatccgcatggccgccgcctgggcgacctggtggccggcaccgtggtggtgcatgcacccgcgctgtatctgccaccgccgccgaccatcgacagcgtgctggccccgccgcagcccctgcgaccagaggaacaggccgcgctgatggccttcgccgagcgcgcgccacgcttgtcggcggcgcgccagcaggagctggccggtattgccgagccactgaccggcacccacggccaggtcggcgttctgcgcctgtatgcgatggccaactggctgctggggcggcgatgaaacaggagca

SEQ ID NO: 92395 - DNA, 364 bp, Glycine max
  Peptide Sequence Number=SeqID_209173
agggcaacacgcccgtcaccgtaaaagcctgcacgccctcgccttcagagggctacacaccctcaccttcagaggacaactcgtccgtgccttcaaaggactacacgtcctcaccttcagaggactacacatccccgccttcagagggctacatgtcctcacattcagaaggctacacgtcctcgcattcacagggatagatgccctcaccttcagagtacctaacgtaatcgcttttcgaggactccacgccctcgctttcgtggggctacatgccctcccctttagaggactacacgcctacaccttcagaggactacacgtccccgccttcagagggctacacgtcctcaccttcagatga

SEQ ID NO: 92396 - DNA, 936 bp, Glycine max
  Peptide Sequence Number=SeqID_209174
atgccctcaccttcagaggactacatgtcctcgccttcagaggactacgcgcccttgctttcatggggctacacgccctccccttcagaagactacacgtcctcgccttcagaggactacatgtcctcaccttcagaggattacacatgctcaccttcagaggactacacattctggctttcagagggctacacaccgtcaccttcagaggactacacccttgcctttagagggctacatgccctcaccttaaaaggacttcaggtcctcgcctttagaggcctacacagagtcgccgttagaggactaacggtcttgaccttcagagggcaacacgccctcaccttaaatggcctacacgccctcgccttcagagggctacacacgctcaccttcagaggactacacgtcctgaccttcagagggcaacacgccctcaccttaaaaggccaacacgccctcgcctttagagggctacacaccctcaccttcagaggactactcgtcccttccttcaaaggactacacgtcctcaccttcagaggactacacgtcctcaccttaagagtgctacatgcccttaccttcagaggactacacgtccccgccttcagagggctacatgtcctcacctttagaaggctacacgtcctcgccttcacagggataaatgccctcacattcagagtactacacgtccttgcttttcgaggactccacgccctcgctttcgtggggctacatgccctccccttcagaggactacacgtcctcgccttcagagggctacacactcttgccttcataggagtacacgtcgtcgccttcaaaggactacatgtcctcaccttcagaggattacacgtgctcaccttcagaggactacacattctcgccttcagagggctacacaccatcaccttcagaggactacat

SEQ ID NO: 92397 - DNA, 186 bp, Glycine max
  Peptide Sequence Number=SeqID_209175
atgctgaatggaatgccccggaactcccccatgataagcacatgtcacattcgagttgcatcctcagggaaatgggggttgagggatctttgttgggcttatggctaccattgcattattgagcaaatacgagagggtgctgtttggtcttggatgtgcaacaggtggattttgtggccgatttag

SEQ ID NO: 92398 - DNA, 249 bp, Glycine max
  Peptide Sequence Number=SeqID_209176
atgtttgttggacctggctctctcaactatacccttcttgattacattcaagaacttgctgtagtgctaatttgtccctttcgaggagatcgaaaaaggcttagggttttggcgttaaccttcctttcaaggaagtttgaagacaatgatgcgctagtgctctcagattctgactatgttgcaaatttggatgcaaggagatatgtgactgggtacgcattcacgattgacaactctcttgctagttga

SEQ ID NO: 92399 - DNA, 636 bp, Glycine max
  Peptide Sequence Number=SeqID_209177
atgaaggcatccattaggtccttccgagagcggatccgggaaggttccaggttgtacacgaaagttgattatcagtctatggacctaaatcaagagtcggagattcggagagttcatcttggtgtagcagttctgaggatccttgctttaggagtgaaagatgtgctaggttttgattttgtggatgctccaagtcctagctccatagatatggcaatcaaaaatctaattcaattacgagccattgaactcaactatgatgttcatgatttaacttctgaaggttggtgcttggtaagaatgggaattgaacctaggctgggtaaacttattcttggttgtttcaaacatggtttgggtaaggaaggtatcatccttgctactgtgatggccaatgctagtagcatcttttgcagagttggcagtgaatttgataaacaaagatttgatggtcttaaagtgcaattttgccattgtgatggtgacctctttactcttctctctgtgtacaaggaatgggaagctttgcctcgagaaaggaagaacaaatggtgttgggaaaacaatatcaatgccaaatccatgaggaggtgccaagacacaattttggagttagaaactttccttgagcattaa

SEQ ID NO: 92400 - DNA, 501 bp, Glycine max
  Peptide Sequence Number=SeqID_209178
aatacctctggttgcatctgtgctgtgcacaaattcacaggcaatatgagggatgaagatagggataagtggggcaggataacatttatgtccccaaatgttgtcaaaagagctgctaagctagatggacatgagttttgtggctcatccttaaaagttgttccttcacaggttgagttgaaattgggaaggtgcttgcatgggcagattttaagagctactttttacttggatgcacatgttgaaacatcattgattgtaatgtacttaaaagaagtgagcacaaagagcatgtacatggaaacacaaagttacaatgaagacatgaagcttacctcgaacccaacaccgacaatggcagcgagactcagctattcaatggtagcgacaatgggtctcagaaaccaaaaaaggtacttagcacaatggagagcaacaacctttgatgttaacggagaagaagagagcgagagagaatacacggagaagaagagaacgtga

SEQ ID NO: 92401 - DNA, 1113 bp, Glycine max
  Peptide Sequence Number=SeqID_209179
gggaagtctttatttgtgagatttttcttaggaagatgaaaaacacggagaggattgcaaatttggccgtagcagaagtgattactgattatgctactacaggatttaagaaggtatggtgcttagaaggttgtggtttaactttagccccgcttattgtgaaagtagattcaaatgtaaatgttatcttgactgcttgcctcaccgtgtatgtgggatgttatcgttctgtcaaaccaacaccacctactgagacaatgtccaatgaacatgcaatgcgtttcccctttgttgggagtgcaatgttattatcacttttcttgctcttcaagtttctatctaaggatttggtcaatgctgtgttgactgcgatcaagagaagcaataaccatggaccaccagtagcagggcgcacaacacccaaggggtgcaaaccacccaacagttacgacccacccaaagggtgcaaggggtgcaaggtcaggagatgtgaatcaaggggacatgacccttgggaacagtcacaaccaaccgttatgatccgcccaaggggtgcaagacagcgaaccagagagaagagggactcttcccatcatcgcgtctcttccccaaggcgcgctagaaacaaatcttgcactgaaactgcaagatggaacagtagagaggcacgagtccgatatcatagtaatgttgcagtgagctggagcactgaacaagagaatgctaatgataacaatgccaacttcggagactggatagaggtatcacgcaaaaggagaaagagagcagaagaaaacagcagcagagtggttggaaatggaaaacagagacgttacaaaaacttacaccggagggatcatgaagatgtcaccacgttttacttttccaggttccctgacgggacaagggagactgacttatggaagattttccagaaatggggcagagtaagggaagtttttattcctaagtacaaaaacaaagaaggacacaagtttggttttgtccgattcaaagaggtgatggatgagaggaggttggaacgtgacttggataacaatatattcattgatggaatgaagctgtttgtgaacagacccaaattcgacaggg

SEQ ID NO: 92402 - DNA, 114 bp, Glycine max
  Peptide Sequence Number=SeqID_209180
atggggtctgcgaattttaaggataaaggttcaggagttgtttacatgcggggaagagtatggccctttctcctacgtatcctcaagtgcgatgaggaactcaaacctacgtag

SEQ ID NO: 92403 - DNA, 260 bp, Glycine max
  Peptide Sequence Number=SeqID_209181
atgtcctatcacacatttacggcagcactgtcaacatgtggtgggatcaaaggtgaggaggatatagtggggaggtctatctggagacataggaacaatgttatcttctccgaccagcagccccatccaaagcagtgcctagcagcagtgaaagcttcagacagaaaaagacagactaatctgattaagagcatcattgatgggatgaggggaaccgtcacagagggtgtattataccagtttgtggcgaaaatagccat

SEQ ID NO: 92404 - DNA, 237 bp, Glycine max
  Peptide Sequence Number=SeqID_209182
atgattttagttaaagagagaaagctgttggagttcatgtgtatggtcaagagggaggctggcaccgacagcttcaatgctgaatttccaccgacgcatgcaaagaagggtcggggcagctccaggaagcgtcgcaacggtggataccgccggggctccacgtcactgtcggaccctgatccaatagcagatgacattctgaggaaagatccaaagcatgaaactacacaagattga

SEQ ID NO: 92405 - DNA, 447 bp, Glycine max
  Peptide Sequence Number=SeqID_209183
atgacattgttatactgcaaaggaatcccaatctcgttcatggaaatagtgggaagtatcatgttgtggaacctgaagcatgatcagttcctctgcttcgccgtggacgatggcaccaactgcatccttttgctctcgctcaacgatgccaattcctcctccgtcgcctgccgtcatcaccacgaccacgccatgcgcttcgcctcactcgtcaagcttgacatagtggccatagttaagggcatgctgagctgcttcaggggagcagtgcaggtgacgatgtccaacgttgttgtggagagaaaccccaacgcagagatcttccactgcctgaattgcatcttgttgactcataactgttacaatgtcttccctggctggggcattgacggggtcatgggtccagtgcaggtgtcaggcaagaggccatggcagcaaagagaatga

SEQ ID NO: 92406 - DNA, 393 bp, Glycine max
  Peptide Sequence Number=SeqID_209184
atgaagatattgtttccgatgggtatggagtatcagaaaattcatgcttgccctaatgattgcatactgtacagacatgagtttgaagaaatgcacaaatgccctaggtgtggggtatcacagtacaaagtgaaggatgatgacgagtatagtagtgataaaaactcaaagaaggacccctcagcgaagaccttacatggaaaccaagagcatgaaagtgcgctgacaccgttagctagtgaccaggtccttcaatgggttcaacacctgaatactatctttggaaagacccaaaagaaggaaagaaagaaaaatgtttgtgatggtgtcattggaacgctccttaacattcaaggaaagatgaaagatggtttgaatactcgtcaaatctag

SEQ ID NO: 92407 - DNA, 959 bp, Glycine max
  Peptide Sequence Number=SeqID_209185
aggctctgtcacctgatgaagttgaagcttatgtgtttctgcaagaatgccttgaaatgagaaaaagatatgtttttagagaagctgttgctccatgggataaagaagttatatccgaccccagcacacccaagcctaacccagatccatttttatacattcctgaaggaaagtctgatcattattttgaaatgcaagatggggttattcgtgtatatccagatagagatgaaaaagaagagctttttcctgtagctgatgcaactacatttttcactgatcttcatcacttacttcgagtcatagcagcagggaatataagaactttatgccatcataggctcaatcttctagaacaaaaattcaatcttcatttgatgctaaatgcggatagagaatttcttgctcagaagagtgctccacatcgagacttctataatgttagaaaagttgatactcatgtccaccactcagcatgcatgaatcagaaacatcttttaaggttcataaagtcaaagctgagaaaagagcctgatgagctgtatgttttaggaattaatcctgtgatgtccttttttaacatatatgacctcaatgttgaccttttggacgttcacgcagacaagagtacttttcatggctttgataagttcaatcttaaatacaatccttgcggtcaaagtaggctcagggagatatttcttaagcaggataatctcattcaaggtcgttttcttggtgagttaactaagcaagtgttttcagatcttgctgccagtaaatatcagcttccacggttgtacaatatgtacaaagaaatgggaattgtgacatcattcctgaacatgctcgacaatattttcattccactttttgaggtcactgtcaacccagattcacatcctcagctgcatgttttcctgaaacagctgaatcctagatttgtactgacagtgtaa

SEQ ID NO: 92408 - DNA, 444 bp, Glycine max
  Peptide Sequence Number=SeqID_209186
cattatcaggctcatcctcacccccttggccaagaatgtgttgccaactccgctaagagggtggtgaagggaactcatccaggtagcattcgagatagaagtcatatgtcggagtggtggtggtcgcggtacgttggtatgctggtgcaacggtgtttggtttggatgtgggtcacggatgttaggtgggttatggctatggaggccgcaggttatggctgtgaggtaatgaagtgtggatgcacagtggttgccatggtgattggtgatggaggtgttgttgtggctatggccatggagaaaactgttgttgacatgcggatggcactggagcgcaccaaaggcatggaatatgccacaaccaacctacggttgatttatggatggcacatcttatgcaccacgggcatggcgtctaccatggctagcccgcggtgtctttaa

SEQ ID NO: 92409 - DNA, 285 bp, Glycine max
  Peptide Sequence Number=SeqID_209187
atgtgtgccaaagctagagcgatgagtgaaatagaggaggtacaagagcagatgaaggctgacatggaggccatgaaagagcaaatggccacaatgatggaagccatgatgagtatgaaaaaaatgatggaggtcaacatggctatagtcgtggccacaagtattgccattgaggtggacccgactcatccatctggcctcaatccggtaaatcctccagtctcggatatagtagggcagagaggcgaagtgttaggaagtgcgggcggcccccattttgtgcaa

SEQ ID NO: 92410 - DNA, 438 bp, Glycine max
  Peptide Sequence Number=SeqID_209188
atgcttcctttcaacttccggcatgtcacggaacttcacagattgcctaacgatgggtgccaagtatctcgaagtggtcaaacaagggtcgcatcccaacaaacggattgtccccagactaaattagggaatcacgcccacaagacacccagtggacccggaggagcccatcaaggccctggggtttccagctctggttacgggcctctgttagtcctacagggtgcttgttcccccccagcaaggtcacaccatcatgacatagggatcacgctcgcaagacactcagtggacctgaagaattctaacagggtccttgggtttccaactctgattattggcctttgtcagttctacggagtgcctgtcacccccaggaaggtcatcaagccccctactaaccgagctttcatcaagaagtactgcgcccccaggtag

SEQ ID NO: 92411 - DNA, 345 bp, Glycine max
  Peptide Sequence Number=SeqID_209189
atgtccaccttatcacgcaccacaatccctaaatatgttcttaatttcttcctgtggggaccgtcggccttgccagtagcaggatcaacatggaccactggtctctcagcaccagctggtctagtagacaaggatcatagacgtgaggttttccatgtccgcttcacgctagacggtgaagctgatgcattggaaagaggaggaggaggaggagaaggaggagaaagaggaggaggaggcgaggctggtggagaagccatgatcctttatctgatagggaatctgttcctgttgaaaatgaaggttgtgaagggattgcacaaacttgaaatatggcaaatttag

SEQ ID NO: 92412 - DNA, 579 bp, Glycine max
  Peptide Sequence Number=SeqID_209190
atgaccctttcagaactgagttatcgtttaggcattatcggagtgatcgaatatcaggaacgttttgaaatatatagatggcttgaagacaaaagcaacagtatttctgacccacgcaacgctcttggggaatactatgccccctctgaagaagagaggatggatgatgagaatgaatcggataaaaataacagaatggaagattcacagttgagtcagactggtgcaagaggtggtcaaacaatcgaggacgaagatgattcgatgcatttcctagcttttaaaaaatggctctttactattggtgacgcagactgttttccttcagttcctcatggtcattaccaacgaaaaaccaccccgtggccaaagttaaatccctataccggagtggtacatagcagcatgaaagttgaagatgttccttccaggctcaccaaaagagagatgagaatactttggaatgatactaagtttattgaagagtgcaggaagcagattctttggtatagtgggtttgcacctgattattcttttcctaatgcacgatttggcaggcatattctgccacggtggtga

SEQ ID NO: 92413 - DNA, 760 bp, Glycine max
  Peptide Sequence Number=SeqID_209191
atgacgtcaaggaatgttcgctttgtgccaagagcggaagttgaagatcaggaccaagaaagaagactaaacattcgcatctttgaacccgcaagcacagttgaggatattcttatcgtttaccacggtggtggagtcaactcagatgctggttacgatatgcttgctcatcatataagtcatcatggagctatttgtacatgcctcatagatatccgtggacacgggcgctcattgggtaacaaaggtagcgtttctaatccggagcaggtctggcaggatatcgacactgttcttgaacatgttcgcgtaaagttcccttgggccagagttcacttgcttggccattcaagcggaggggggatgttgatcaattattttactcgcttcaccccctctcaacaaagtgacagcctgattttacttgcgcctgagtttgggccttttgcaccagctaaaatttgcagaaaaacaatggttccattcgcgtcggtgagcaagtggcctttcgtactaaatgcgcttagtgtgggattactatgcggtaaccgttatgcagttactcttaattttcccaatgaggttatgctattaagacctgaatttgttcagcgatacagcgtgaatatggcgaatgctttgacgccgcgtcaacctgcaaggcaaattgcagcattgccattacctgtaactgttctgatagctgaaaaggatgagctatttgatgcaagacaaatgtcagagtttgtagaaggatgtg

SEQ ID NO: 92414 - DNA, 357 bp, Glycine max
  misc_feature (11)..(11): n is a, c, g, or t
  Peptide Sequence Number=SeqID_209192
agctacctgancggtatacggcaagatgtttgcttaaacattgaaaaagctgaaaaatttagcggtgaaaagtatcggttattcaatactgaagtgaatggtgcgaaggacgcttttatggacgctatgaccgcatacgtagatagtacgctaccgtttatgagtgttgattacccgaacagaaagccagtgatgctaagccttccccatgactggaagagtaagagtgttgaatcggaggcaaacttccgctttcatcagcaaaatgtgcgtgaaacatcgggggtgatgattgcgcgttatgaggattttgtcaggacatttaaggctcatggattcataagcgataaactgtaa

SEQ ID NO: 92415 - DNA, 1627 bp, Glycine max
  Peptide Sequence Number=SeqID_209193
atgccaattaccttcaatcaggccttaactgcagagtgcgagttttcagaatggacaatcagtaataaaaatcgagctaagctgattgaagtgattgcctatttatatttacggcaggaagaaaatgctcagagagtaattgatgccctagagccgcgatggcgggtttcgaaaggcagggtggcggagaatgttgtgagaaaactgacggctccgcgtgctgaagacgtcgagctactccagtcaggaaccgaagcacagaaggaggcagcgagaaagcggatcaacacatctattattcaccgggatggacttctatttcagcatatctcctggattgccgctcggcttgagctttcggacggctatatgacgtcaccccacgttcgacaggcggataaaggctttgacggttttatcatcgagctagatgaaagagtgtgtgagatcaaacgaattgtgctctgtgaggacaaggcttcgaaatcgccgcgcaaccttataacctctagcgtgtggcccgaaataagaacaattcggagcggcgatcgcgatgatgagatcctcgctgacctcgtaactttacttaggagtgttccaagtatcgacgcagaagaggctgtggataaaattttctgggaaggtgctcgcgagttcagagttgctgtagcaactggtgaagatcagcgcagagctggggattttttgcatatcatagccggttttaaaacggcggctggtggtgaacttgaagctcgcatggctggtgtgttggccttcgaagatgtgcgtacgggtttggatcttctcgccggagaggtggctgccaaagtcgaggagatcgccaatgcccctgatttgcccggcctcgcacctgaaactctagacgagctgttgacggctgcacacatagaactagcgactgtacggcttctgtctcgcgaaggtgaacctgaggccataagcgatgtactcgaccaggtacgacgccttgcttcgaccttcgaagcctatgttgcactcgatcttcgaccagagcaaacacgcgccacggcttttgtcgccgcgagcgctcatcagatattgagccgcgttcgcgagaccgcaacggatcgcccaaccgttgtttcaagtgatgcaataggatcatcaatttcagcgacgcttttattcctgattgctggtcgggcagcagacgcagcggaagtcgctagtcagctccgggcgaagggtgaacgtcgggcagtacgacgttcgctgatcctgagccttcgggaattggctactggtaatctcacgacactgatagagcgtgacctcggcgaacacatcatcgcaacgcgagatagccgagaagtagccactgaccttcttttaagggaatgtgcttatgtcgttcaggggcttggacaggaggcgcgtggaagcgctgtgcccgacactgatattcgttcaagactcaagcgtgttctccacttgtcggaggcctcagaggtagagatcaacgcagcgttggaagggaaagttcatcaccagtttgccggtccgcatcatttggccactttgttgagtcggcttattgatggagtgcaggctgcgatgctaattcgactgccagcaccatcac

SEQ ID NO: 92416 - DNA, 315 bp, Glycine max
  Peptide Sequence Number=SeqID_209194
atggactcgttttccaggcgacagggttattcaagacctgacgcagaaatcagcatcagacacgaagctccagaatcgctgagaacggcgatagtgtctattgcctaccgatgtggcttcgcccccagcgaacttcgtcttgggttgtgtggcatcctttataaaactccagataagagcaactggtcagagtatccgaatatcgatgacgaagtcggaatcctaatggacgagcttgaatggttcgaggtctacgatttcatcgagcatttggctgaaaagtctctttacaagggtggtgacttttcgggagaa

SEQ ID NO: 92417 - DNA, 1530 bp, Glycine max
  Peptide Sequence Number=SeqID_209195
atggctcggtttaatgaattactgaccaatcttggaatcaatgctgtcttgcataactcctatgcatttaagacgaaaggtgagatggcactagagtgcagggatcaacagtttatccggcaacatgcatcaaataccatgtcatgctcctctccccagagccgacgttatgatcccgatccggccgagcgtgctcccaagcattgtggcaggtgcgtgccctgccttatcaggcgtgcgtctcttcatgccgcattccgccttgatgaaaccccctaccgcataccagatctcaatgcgcaaactctcgacagtcgcaaagcggaaggggagcatgtcagggcattccagctttctctggcaaaacttgcgaccaaccccgggcgtgcaaaattcgatgtccacaagccaggtccactttctgaccatccagacagtattgccgattatgtcggtgccgaaatcatgactgccatgcagaaaaaagcgtctccgttatgggtcgattttcactgtcatctcgacctttattctgatcacgtcggcatcattgctgactgtgatcaggagcgggtcgccaccctggcggttacgaccacgcctaaggcatggcccagaaactgcgaactgacagccgagtcacattatgtgagggtgggcttgggtatgcatccccagttaattcaggaacgggaacaggaggttgctttatttgagcgctatcttccctccgctcgctacgtgggagaagttggtcttgatgctggccctcgtttctataaaagctttgaagcccaggaacgtgttttttcccgtattcttcgtgccagcgctgagcaggggaataaaattttgagtatccacagtgtgcgaacggcctcaaaagtactgaagcaccttgaggagagcaggctgtttgataatagtcaggcgatccttcactggtttaccggaaccgtttctgaagcccggcgggcagttgagctcggctgttatttttcgattaatgaagagatgcttaggtcagaaaaacaccgcaaactcatcagcattttgcctcttgaacgattgctgaccgagacagatggcccatttattctgcacgaaggcaccccccttcggccgcgtgatacagttggtctctcgagtctgagaaatgcagctttgcaaaggtcaatgatgagagcgctcattatcgtaatcagaataacgcaagccctcattttagctttgagggaggagcgtatgggcacaccacgatttacccctgaatttaaggaagaagccgtccgtcagataacggaacgcggttattccgtcgccgaagtatctgaccgtctgggcgtttctgcgcacagcctcttcaagtggttatggactatcaagcctgataacagcgaacagcatgcccggggtttacttgaagcccaatgcgagatcctgaaactacgggcgcagctaaaacgcaccgaagaagaacgggatatactaaaaaaagccgcgtggtactttacaagggaacccgactga

SEQ ID NO: 92418 - DNA, 1607 bp, Glycine max
  Peptide Sequence Number=SeqID_209196
gggttaggatttatcctattcagcaaggtttaacaggaatgtttatgaagaaagtaatggctgcgcttgcaatagtcttttccttgagtagttgtgacaagcccaagattgatacttccagtgacgaaagcatgaagacatcaattcagaaggtaagggagtcacttccagagaatcaacgcactacatacgatagtgcgcttaaggtagtagcccttaaccatttgaatcttgctgatctaatgcaagcagggatgacaaaaaatacctcgggtatcgaggcacaaatgaaaagcgaactttcaggtaaaaccggagaagagatcatctcttatgccgaaacggttagaaaggagagagctgaacgcgaacaaactcaggcacttcaggaaatctcggaacttctacaaaagcaaaaaaccgcagaaagtagcctgaaggaacttgaagccttcaaggtatcccgctcccggttttactttgagaaaaaaaactatggaagagatcagcccatcattgagttgagcgttgagaacggcacaaataaagccatcgcgcgcgcttatttcaaaggcgtcatcgcaagcccgggaagggaagttccgtggttcaccgacaccttcaattaccagatttctggtggtcttgagcctggagaaaaggctgaatggaacctggcgccgaatatgttttccgattggggaaaagtgaatgctccctctgacgctgtatttaccgtaaccgttataagagtcgatgatgcgcagggcaatcctgaaacggctacagatcttttgtactactcggcgattgccgagacggtggtgaagctcattgaagagacacccgaggctccgattacaattggtgttcacggcgactggggagcgggtttcgaagatgctaagacggttattatcgaaactcttgtggaagaacttgtacgagcccgcccgggttgcactaaggtcgcagccgcagctaagaaggtactcagaagggttgactggcttaaactcgcccgcaaaacgggaggcctggcgcttaccgctttcactggcatacctacgatggatcaactcaaaggcgtgctggatatcgccgccgggctgatcagtaatcctcaggaaacgttgtcagctgagggaatcaaagcatttgtcgggaaggcgggagattttattaaagaggctgatgctgagcaggaaacgctgccgaagcatatacatgccttcagaaatgaattcagtgaacttctcaaagaagcccaaattgacaagcttgtagtaattgttgacgatctcgatcgatgcctgccagaaacggcgatagacacactggaggcgatccgcctgttcctgtttgtcgagaaaacggcttttgtgattggtgctgacgaggcgatgatcgaatatgccgtccgaaatcactttcccgatctgcctcagagccagggcccgttatcttatgcgcgtaattatcttgagaagctgatacaggtacctttccgcatacccgcattagtttacggacctgttggagaagctcgtgaagagatgcagcgcccctggctgagtagcggcctggacagaaaagtggtcagtgag

SEQ ID NO: 92419 - DNA, 507 bp, Glycine max
  Peptide Sequence Number=SeqID_209197
atggatgtgaagagtgtccttctcaatggatacattgaagaagaggtatatgtagaccagcttctaggtttcatggactacaatcatcctaatcgtgtctataagttgaaaaaggctctgtatggtatgaaacaagcacctagatcttggtatgagagattgagcaatttcttgattgagcaatcttttgtaagagaactaattaagaaattcggcatggaaaagtgcaaagaaacatcaactccaatggcaactgtaaatggagtagaaatggtcattgatgcttctgtattgaaggaagtagttggtctggacatgggtggagtacgtaagttcgatgaaatggctaatgggtacagcaagatgcaaacctacaggggaatgcttcttagcccaggaaggaacttgaggaatcacttaagagttggaagactaactacaaaggatagaattttagtttacctcgtcatttacattctcactctgaggtcaagtagtcacgcttag

SEQ ID NO: 92420 - DNA, 264 bp, Glycine max
  Peptide Sequence Number=SeqID_209198
atgagatcaccgatgatagatggacttggtggacttgcagctcgcccagtttcacacttgcaaagcctcttggatccctctctttccggtgtgattcttcagggtgttacaaataagagaaacaaacaagtatctaatggtgaggaagcaaatgtagatgattgtattggagatgatgttctaaatgaactagataggatagccaaaaacatagttgaccaatgtaacaattttgaaggtggtgtgggtagtgtggaagaatga

SEQ ID NO: 92421 - DNA, 1443 bp, Glycine max
  Peptide Sequence Number=SeqID_209199
atgaacttcacaaagaggaacactcagaagtataacttcaaggacccggatttgacaaatttaaggaagctaggatctttggtagttagtccggacgacttccgaaaacgctacgggaatttgctcagcatcctcaagacaaacgttgaagaggggatccttaataccttggtccagttctatgaccctctctatcactgtttcacgttcccagattaccagcttgtccccactttggaagaatactcctacctagtcggcttaccggtgtctgacaagttacctttcagtggcctcgaaccaactcctaaacctttaactatcgccgcagccctccacctcaaaacttccgacataaccagtaaccttactaccaaaggaggcttccaaggcctaactcccagtttcctctaccaaaaagcctacacctttgccgaagccaccagtaccggtgccttcgaagccacccttgccctactcatctatggccttatactcttccctaacatcgacgatttcatcgacattaacacaatccaaattttcatatccggaaaccctgtccccaccttacttgcagacacctaccattccattcaccacagaacacaaaagaaatgcggagttatcacttgttgtgcacctttgctatacaagtggtttactttacatttaccccaaacccaccttttcaagactaatccagagaaaacccgttggcctcagagaatcatgtccctcactccaattgatatcctttggtaccaaccagctagtaacattggagtaatcatcgacagttgtggagagtttcccaatgtacccctcatcagtacacgtgggggaatcacttacaaccccactcttgccagacgccagtttggataccccatgaaggaaaaacctaacaacctctccttaaccggtgaattctacctcaaccacgaggaccatgcaggcatgagattgagatttgtgcgagcctggcacactgttcgtaggcttgataggaatcagttaggaagaaggacgggttttgtacatggatcctatactcagtgggtcatcgacagagcttcgattcttggtttaccctaccccctacccaggcacgtatcctcaaccgttccatcaccatccttacctgtgccctttgataacaaagaggaatgcaatgagcagttgattcaaatgcggcttgaaagggatacttggaagaaaaaataccaggagctcgagcgtgagaatgagaccttgaagggaaagctggcgcagaaagatcatgagcttttcgttcagaatcagaggataattgagaaagatgacttacttcgtcgaaaggacgctttgctcagacaggattccaagaggaggaggaggtttatggattcgctctctagtgcacatccggatttcgaggatccatctactccgggagtttga

SEQ ID NO: 92422 - DNA, 1942 bp, Glycine max
  Peptide Sequence Number=SeqID_209200
atggttgcaagtgcaccaacggacttcaccgaaatggtcaacatgggtgtacgattagaggaaggtgtccgagagggacgtttgaccgtggaaagtactcctgctgcaagtaataccaagaggtttggaaatcactttgcgaagaagaaaaatcaagaggttgcgaatgtcgcatccactatcccgaacccagcatatcaccaacaaaggccacattacccttaccaatatcctccaccacagtatcccccacaacaataccatcaaccacaataccctcaacaacaacaaaatcgcaaaacccctcaacaaccatatcgctcacaaaaccgccaaaaagtgacctttgatccaatctcgataaagtatgctgatttgcttcccgctctactcgctaaaaaccatgtccaggtcagggcacctccccgaacaccagatgttttacccccctggtaccggcacgacctaacatgcgccttccaccaaggagtgcccggccatgatgttgagcattgccttgctctcaagactgaagtccaaaagctaatccaggcgaaacttttgaccttcaaagactccgactcaagtcccaatgtccaggccaatcccttacctaaccacggatcctctgttaacatggtccaagatgaccaagaaggttgccccattttcaatgttcacaatattaggactcccctggtcccaatacatatcaagatgtgcgaggcagctctgtttgaccatgatcatgcagcatgtgaagtgtgttccgtgaatgtgaaaggatgccagaagttccagcagctggaaataagttataacagtgggagaccagctactactccactagtgattagcttgctaggacccgtgccttatgcttctctaaaagtggtcccttacaagtataatgtcccaatggtggaaagtggacaggaggtgcctctcccctctctaactcctgcgacttatgtagacaacatcgtcagtaacagcaaggttctgaggaatgggcgtgttatccccacattgttttcaaagaaagtgaatgatccggtagttgaacaagtgacagtgaacggccctggtacaaagaaggaaataggccaacctagtgggaccgacaaggatgcaaatcatgatgaaattctgaaactgatccagaagagcgagtataaagtggtagaccagctgctgcaaactccctccaaaatatctatcttgtctttgctgttgaacttagaagcacaccgtgaggctctaatgaaggtgttagaccaagcttttgtggaaaaggacgtgactgttaatcagctggacagtatagtaggaaacattactgcatgcaataatttaagtttcagcgatgaagagcttcctgaggaaggaagaaaccacaatctagcgttacacatatcagtgaactacaagtctgatgctttgtcaaatgtacttgtggacactggttcctcattgaatgtaatggccaaaacaacattagatcaactctcctaccaggggcctcccatgagaagaagcggggtagtcgtcaaagcttttgatggatcaaggaagtcagtcattggggaggtcgacttacctattacaatcggaccatctgttttccaaattacattccaggtgatggacatccgagctacatatagttgtctgttgggtaggccgtggatccatgaagttggggccgtgacatcaaccttgcatgaaaagctgaagtttgtcagaaatgggagattggttattgtgagtggagaagaagctttgctggttagtcatttgtcagccttttccttcattggtgctgatgaaactgaaggaacttctttccaaggcctgactgtggagaataaggagccagagaagagtgaagtgtcttttgccacttggaagagtgcacagaaagtggtgcaggaaggaacag

SEQ ID NO: 92423 - DNA, 831 bp, Glycine max
  Peptide Sequence Number=SeqID_209201
atggatctaattgagcaagaaaatcagagtctcaaagaggaggttgccactttacgagaaggaatggataggttgacgaccatgatgaatgcactcctgtcagcccagaattctcaagctgccgctgctattgtagatcagcctttcatgcctccaggttgtacatggggaatgccacctccagcctgtggaaatctccagcccgttgtatctgaagttccacttcctttcgctcagcagtcagcgccggttccacaacccggcacatctttccctcaagctgcaatgacttattcagcaccactgattcacactattcaacaagaggttgagccaatttaccatgctgaaagtattggagctccgaataagatggatgaactccaagaaagatttgatggtatgcaaaaagaagtcgaagccctccgaggaagagatctgttcgggaaggatgcccgtgaattatgtttggtcccaaatgttactattccccacaagttcaaggtgccagacttcgagaagtataaaggaaacacttgtccccgcagtcacttggtgatgtacgcgcggaaaatgtccatgtatactgataaccataagttgctcatccacttctttcaggacagcctgactggcgctgctctgaagtggtatatgaatctggacagtgcaaacatccaaacctttaatgatcttggtgaagcgttcattcgtcagtataaatacaatctggacatggccccagatcgtgatcaactccgtgcaatgatgcagaaagacaaggaaacgttcaaagagtacgcccagcgttggagggaagtggctgcctag

SEQ ID NO: 92424 - DNA, 393 bp, Glycine max
  Peptide Sequence Number=SeqID_209202
atgaccgcttaccgaacacctttggggatgtctccctataaggtggtttttggtaaggcatgtcatcttccaatggagattgagcattatgtctattgggtggtgaagggttgtaacatgacatttgctgaagcgggtatagaaaggaagcttctattgcaagaacttgaggagatatgcgtagaagcctatgagaactccaagatctacaaggagaaatttaagaggttttatgattctaggatttttaggaaagagttccatattggcaaaaaagtgctcttgtttaactctcacctcaagcttatttccattgagattaaaaatgaagttactggcaaagtcttcaaagtgaacggtcaccaactcaaactttttcatgagagctcctag

SEQ ID NO: 92425 - DNA, 420 bp, Glycine max
  Peptide Sequence Number=SeqID_209203
atgaaagcatttcacttctctctagatggtgttgataaggattggttgtaccttcaaccagatactatcaacactttcacatatatgaagaaaaggtttttagagaaattcttccctgcatctagaacaacatccatccggaaagaaatttgtggtataaggaagcaacttggagagacattatatgagtactgggatatattcaaaaagttgggtgctacttgccctcaccatcaaatcattgttgcaccatccagagctgctacaagtgaagtttctatttctatggatactgataatcagaggctagaaaataaacttatagaattggcatcgcttgtgagacagctagccattggtcaacaacagaatatgatggcagtcaatcaaccaaggttgtgtggtatctgttgtgcctaa

SEQ ID NO: 92426 - DNA, 282 bp, Glycine max
  Peptide Sequence Number=SeqID_209204
atgaactgggtactactgattaaaggcattatgctgaagagtcatcgtctggtggattatgaatttccttacgctgtggttgcctcaaaattcattgactacttcaatgttgatgtctctaatgagattgtagactttactgaagcctctagtgagaatactaaaaggcatctcaagaagcttgaaataaagtttgttgatcatgaatggataatgactagacagtcgacagctggaaactttaaccagatggaagatgttgctaaagttgaagctccataa

SEQ ID NO: 92427 - DNA, 939 bp, Glycine max
  Peptide Sequence Number=SeqID_209205
atgtcaaacagaacctcccaattcctcattcttacatcttcatctcacagatcacagagcattcctttctcttgttcttttcattcctcaacgaacacagtaccccatagaaaccgaagaaagttgtggaaatggtaccagaattgcttggcggttcaccctgttaagacacaggtcatcagctctggcttgatttggggtgctggtgacatagctgctcaggcagttacccactacactgccaagaaacgtgtcacttttgatgcgagagtaaagagagtgggaggttggtttttaattgaagttgcgttgggattgatgatattatggaaaatggtgggcaaatgcggccacagttgtgtggttatggagcgcaactggaaactattgggagagagcagggaactctcgctgaaagacctggcattctctccttgtctccccaatttaaagggaccgaagtttggggcttatttctcgttcaacggcaatttgtctcaggatgacactaaagaattcaagatcaactggagacgggtgtctacgaccagcttgtttgggttaggatttgttggccctgttggccacttctggtacgaaggtttggatcggtttataagactgaaactcatgcttaaaccgaattccttccgctttgttgccactaaagttgccgttgatgggtttatctttggaccattggatttacttgtgtttttcacttatatgggtttttctgctggaaagagtgttcctcaagtaaaagaagatgtgaagagagattttctcccagcctttgttttagaagggggcatatggccaattgttcaggttgcgaactttcggtttatacctgtgagctgtttcttgtcttgggttgagcaacaacaggatgctccatggaaacaatggttgaaatcatttctacctatgaagtaa

SEQ ID NO: 92428 - DNA, 255 bp, Glycine max
  Peptide Sequence Number=SeqID_209206
atgcggggttaccttatggttacccacacctttcgtcaaccaggggcaaacgagcccgttgacgcgcagagactaacatcgtctcctgcaccttctgtcgtcctgacccgtgaagtcagggacagcgagtcaggtggcaggcggagataccttatggtcatctacacctttcgtcaaccgaggggaacgaatttgacggttccgctaggcggggatattgatcggccaaacgatgttccgctcgaacgaaattag

SEQ ID NO: 92429 - DNA, 568 bp, Glycine max
  Peptide Sequence Number=SeqID_209207
atgtggaacagcgaatccacctcatcgcgctacggcagcgcgccctggccacatgccgtcaggccgcagccctcgccgcatattacctacgtcacgctgaaccaggcactggcctcacagctggcggcctggtgcgaacatcaggtcgaaatcgaggtgatgcgtaatacctatccttttgacccgagccatccgcgcaaagatttacgccgccagtttgggttgctgccacaggataaggtgattgcccgcaccacgcggattattccggctaagcggctcgatcgcgatattcacctgttgcatgcgctgaacagtgaacttattgcgcagcatcagccgcagcgcgtctatttaatggtggccggcgatcctttggaagacagcgtacattaccacgcgttaaaacagttaattagccagttccagctggaacgctacgtcatcttttttggcgcgttaaatcacgactttatggagcgcaatccacaggccaccaccattcaggatctttatcacgcctgcgatgtggtgtcgtttttaaccgcatgggattacgacagctacg

SEQ ID NO: 92430 - DNA, 414 bp, Glycine max
  Peptide Sequence Number=SeqID_209208
atggaaggagcgccgtcagaggaaagcatcacgcctttcatcgcccagggttttagtgaccccaatgcgagagtacttcaaggagtccgcatggcatggggtgcagtgcaaagtaaagataaggagcttaggggaagcagcaacgggatcgtcggcggctatcataagtggctgagagtccgaacgcaagagttggattggctcccaaagctaaaagctgcaagagaggaagaggctgaaacttcgaaggagagtgaggaagtgcaaaccctaaatgcggaacttgaaagagcccaagtagtaaaagagaagttcaagtcaacagccatcaaagttcgaaaagagtacaatgaactaagggacatcaatatgaccacaaccgaagccttggaacgagaaaccaagagagtctga

SEQ ID NO: 92431 - DNA, 191 bp, Glycine max
  Peptide Sequence Number=SeqID_209209
atgcggggttactttatggttacccacacctttcgtcaaccaggggcaaacgaacccgttgacgcaaggagactaacattgtcttctgcaccttttgtcgtcctgacccgtgagtcagctgacatgcggggttaccttatggttacccacaccgttcgtcaaccatgggcaaacgagccaaatgatgcccg

SEQ ID NO: 92432 - DNA, 855 bp, Glycine max
  Peptide Sequence Number=SeqID_209210
atgcagatgaagagcaatttcaaagccgcgccgttccagccaacgggccacgacccgggcgcgagcttccagcggcttatctacgggaacgcgttaaccgtcgccccgcgctcagcccgcgcagaattttttctcgacatcgtgattgctaactggggcagccccctttccaccgacttgggcgaaagacagtgcggggcgatttctctttcaatttcaaacgacaacttgagggcagcaatagagggtggtcaaaaaccccggctacagaggattgtgtgcgtgataacgttcgatcaggtcagcaagcattatcgtggcgcgacaacggctgtagacaggttgtcgctcaccgcgccgacaggaaaattgaccattttcgttggcccctcaggctgcggcaagaccacatcgctgcgcatgatcaaccagctgatcacgccttcgtccgggtcgatccttcttgacggcgaacccacggacaagatggacgtagcgctgctgcggcgtcggatagggtacgtcatccagaacgctggtctctttccccatcgaacggtggtgcagaatatcgcgacgacagcgcgcctgaacggcacccccaagcagcaggcgcttcgcaccgcgcacgatctgctggagcgcgtaggactgtcggctgcctttgccgatcggtatccgtggcagctatccggtggacagcaacagcgtgttggcgttgcccgggctttggcgtcggatccgaaattcatgttgatggacgagcccttcagtgcggtcgatccggtcgttcgcgcacagttacaggatgaattcctgcgtcttcagcgcgaaatcggcaaaaccatcatcatg

SEQ ID NO: 92433 - DNA, 850 bp, Glycine max
  Peptide Sequence Number=SeqID_209211
atggtcgaatacaatccgggcgcgtcttcgatatcgtttcaggtttgcgttattggggcggggccggtcgggctcgcgcttgcctttgccctcgaaagacagggcgtaagtgttctgctggtggaggcgggccgaaatggtcatgatggacggcttgccagcattacaaaccaccaccatgcgcctctggcttcttcaacggcaggagggcttggcgggaccacgtcactgtggggcgggcgttgcgtgccgttcgatgacattgactttctcgagcgtgcgcatgttcccaattccgggtggccgatcggtcatgagagtataagccgctattatgccgatgccctgcactttctgaatgtcagggcttcggctctgtcgccgggcgtcggtgcttcaccggcgggagatgtccatcttgactctatcgagtggtggagcagccagccggaccttggcgtgacatgccgggagcgaattgaaaaatcccgtttgatacattttctttcggatacatccgcaacgacaatcgatgtcgacgccacgggggcggttacggatgtccggctcagcaacgggcatggcgacatgcgtgttccggtaacgacgcttgtgctggcctgcggcggcgtgggcaatgtccgcttgcttcacgaactacgcaagaaacagcccgagcgtatttctccgacgctcgggcattattatcaaggccatctcaccggttatattgccgtgatcgagcttgagaatgacgccacggtggaacagctgtcttttcaaagagcgccttccggcggaattttccgtcgaaggttccagctttccggggatgtccagcagcgtctgg

SEQ ID NO: 92434 - DNA, 947 bp, Glycine max
  Peptide Sequence Number=SeqID_209212
tccccggcttgcattgggagtttgccggtatcttgggcgacctgattggggacctgacctggtcgccgaaaccgctagaactaaaactgttttcaaccgatatcaagtggttacaaaaaacagcgcccctggtgcaggccaagttagatcagattccaggcgtggtggacagctttgacgggttggaaagtaccggtccttcaatacatgtcagggtcagatccgctgatgcggcgcgctttgggctcactagcaatgacatacagcttgctgtgagtacggcgatgctgggccagaaagcttcctatgtgcttgaaggcgatcgcgtggttaatatccgggtgcggatgcccagcgaagtgaccgggcaaatggataagcttatgcaattaccgctcaggactgctgacggccgcacggtacaactgaagcaggtggccgacctggagctggtcgcgggcgagttggaaatgcaacgcgaagacatgcgccagctggttgccgttacggccagacttgagcatcgtgaccttggtagtgcgattaatgaaattcagcataaggtggcacaggatcccgtgctagcaaaagccaatattgagtttggagggctttaccagcagcagcatgagtcatttatcaaattaacgttggtcttgttggcctcattatttctggtattcaccgttttgctcattcaattccgaacctttcaagcgcccatctccatcgtttcaggtgctatcctggccatgtctggcaccgtgattgcctggtatgtgaccgggacgtcggtaaacatagtctctttattgggcgctattattggggtcggtgtggtggccaaaaacggcatattgatgctggatggcgtgcaaaaatttcatcaggccggattagatttacctgcctcattactggcctccggtgtcagccggttgcgtccg

SEQ ID NO: 92435 - DNA, 687 bp, Glycine max
  Peptide Sequence Number=SeqID_209213
atgaaggtggaagtagttaactaccctctcaattggagctcccaattcagtgggaagaagtttgtttgtgctcctgatgcttatgatgccaagaccttttggaatcatatcatgtggacaaacacttataaagccttcacatctggttatgatggaagtgacaatgttgtgcaccatgacatcattcaagtgttacgtctagttaggaagtataacttcgatgatgcttgtgtctgctttagaaaggatgctgacaactactcgcgtctattaaagttgtggatgacaccattgtacgaagggtcattattgatcttaccaatattggtgtccaatgcaaccgcagttgatgaagttgaacataacatcctagagcttgcatctaaacagtcaacaacttcaaatgaggctacctcaagagacaagggagaaccagatgccataatcgtctactccactagttcaggtcttgcacctctaagatatgcacaacctactatgattaccaaggatcaagctcagatatccatgcttggattttttggtgcacctgcacctgcacccatacctccacttgcacctcaatctcttgaaccttcatcaccaatgttagccctaacgcctccacctcatccatcttcacctttacctactcaacctccaccaccatcgcctgcttcaggatga

SEQ ID NO: 92436 - DNA, 468 bp, Glycine max
  Peptide Sequence Number=SeqID_209214
atggaagatgactttaagcacacccttgtagtcaagggttcagttgttgctaaacaacaaaaatttagcaaaactaacctaaaagctatgaaggttgctttagagaatagccttaaggaagctcctcaagtggacttggacaccataaataaaagaaagaagaagttttctaaagctatcactgatgaagatcaagctagaacatcagtcccacaaaggctgaaggacctaagtgagattgatgaagaggacgaaggagccaagactgtgctaccagctcaggaaccaagagagcctgtcatttcttctgcaatacctagacgcatcaagacaaaggctactaaagccaatcccaagattggtgagaaggagtggccagtcttcttcaccgggaacaaagaattttcaacttcattctgctcaaagggaaaccatcaatgtccaagccactacatggatgaagtatga

SEQ ID NO: 92437 - DNA, 270 bp, Glycine max
  Peptide Sequence Number=SeqID_209215
atgacattcgttgctttccttgaaaccattccgttggcaccaaagcactctttgctcttctttgtactcgcaatcacaaggaaagttgtagttcgacagtttgaagcttcagataccctgagactaggctcaggccctttgatttgcgctatatcagagctgggttacttaaggaggaagcaacccagcccacctgggcgagctgggcggcaacctcctcccccttttcctataaataggcgaagggaggctgttccaaagggtccctaa

SEQ ID NO: 92438 - DNA, 553 bp, Glycine max
  Peptide Sequence Number=SeqID_209216
ctttttcctttattggtgctgatgaaacagaaggaacctctttccaaggcctgactttagagggtaaaaagccagagaaaaatgaagtatcttttgctacttggaagagcgcacagaaagtggtgcaggaaggaacaggtgtaggatggggaaaagttgtgcagttgctggagagtaaaaaccgtgaaggactgggatttgcttcttctgcaggatccgcaacgaacagtgttggatcaagctccattactagcaccttttgtagcgccgggttcatcaacaactcgccagaagccaatgctgtcttggaagatgctcctgaagagatagtgcttgcatttgtcacacctggaaaacttgttcgcaactgggacgcggttgacatcccttcagtggtgataactgggaaccgagaagataaaaggaagtcagatggggcatcgcttgaggcagctgtcaaacgaaaggtgattgaattactcaaagaatatgccgattgttcgctggtcgtaccaggatatgcccggcttggatccccgtattgtggagcacc

SEQ ID NO: 92439 - DNA, 426 bp, Glycine max
  Peptide Sequence Number=SeqID_209217
atggagccgagacgctgcggagttatgactgtggatcacttcttttgtcatttctcttttagtttaagggtgtttttgtgtggtggagatgatgatggtgatggtagtgatgtcaacaatgacgataaagataccagtgatggtcatagtggcagtggcaataataacgacgatggtggtggagttggcattagtggtggtggcgatgttgatagtggtggcagtaacgacatggtgttggtaaccaatagtagcgatggtggtggtcatggtggcatcaataatggtggtggtagcaatgtcagtggtgtaggtggtagtgatggtggtggggtgattgtgatggtggggatgaaggtgatattgttggtagtggtagtgacaatgacgatgacagtgacattgatgattgatggtggtggttaa

SEQ ID NO: 92440 - DNA, 610 bp, Glycine max
  Peptide Sequence Number=SeqID_209218
atggaactggtgagattaaatcaacacgaggagaatgataagaaaaggaagggaattgctcttaaagcttcatcttcaatccaagaagaaagtgataaggaagacttaattgatttggatgaagatgatgatcttagcctttttgtaaaaaggttcaacaagttcctgagaatcagaggaaatcaaaggagaccaaattttaaacctaaaagaaagacaagagattcatcctctactccaaaatgctatgaatgcaatcaacctggacatctcagggttaattgcccgatcttcatgaaaagaatggagaaatctgaaaagaaaaattttagtgaaaaaaaggtgaagaaggcatacatcacatgggatgacaatgatatggaatcatatgaggattcggaaaatgaagagataaaactgtgtctaatggccaaaagttatgaaagtgatgaagaggtatctttgaagaagaaatggtacatagatagcggatgttcaaaacatatgacgggagatgcatcaaagttcacacatatctctcccaagaaaagcaaacatgtaacttatggtgacaaaaacaaaggtagaattcttggagttggaaaaatag

SEQ ID NO: 92441 - DNA, 138 bp, Glycine max
  Peptide Sequence Number=SeqID_209219
atggagaaagcaaggctaattctcatacaccagaaccaagatcctggtttggtccaaatggacagtatatcagagagctaccttgtccaagttgtcaaggaaggggttatacctcttgtacagtttgttactgagtaa

SEQ ID NO: 92442 - DNA, 408 bp, Glycine max
  Peptide Sequence Number=SeqID_209220
atgaagaatcctaatggaagagagtcatcttatgtagaaatgtttatgctgacacataagcctgagaaggaggaaaccagtaaaattattcttaaggaagaagttgcttcccatccagaagcgctaaagcaaagcccaactacagatgatgtatttttcaaagtcttgggaaaagatggacatggctatgttcgcacatatggaaaagggtttgtaccttcaaacttatggggaactaagtctcaagttggaaatcaaaaagtacttgatgaagttaaaataaattctcaagttgaacttcaaagcttacaagaaagaatgcaaaaggaaatggaagtaaaactaaaagagcaagtgaaagccatggaagcagaacttttaggcaatttcaaaaatgttttaacttaa

SEQ ID NO: 92443 - DNA, 940 bp, Glycine max
  Peptide Sequence Number=SeqID_209221
cgaaggagtaaagaatatgagcgaaaacgtctctgctagggtttctgatgggggcccacatgggaccactgaccaagagggtgaaccattttgcaaagaagcaggaagaaaaataaacacgtcggagttcgctgtgaaaaaggtggaggtgtgggtacgtattgagtcatggaatgaagattttataactaaggtggacaacatgttaggggttttgctcaaaattgagaatatatggccaggtcaacaatttggaagaaaatcacagaccaatcaaaagtcagaggataagaaggaaaaaggtaaagctgtgaagatgggtcagaagattgcgaagaagggccctatcaatggaaaaggaaaaatgaaagtgttaggtagctcggtcgaaggggattactatgtaggcttccttggatcatattttgagaatgatgatattgaaaagtacttgaaagatcaattgagaagtcatttgttggatcaatctatggttgatgaagatgaagatgatatcagttggtttagagatgatcaagaagagcaaacaaccttgttagccaagaagcataagatttcaaggccaagtagctcaatgacaagtgttattgatgagaaagaaccaacaaccttggttgccaagaagcataaggtttcatgtccatgtggttctatggctgcaatctttgaggatttgagaccgcatcaagccttgtcaaactccatcagcacccaaacacgatggcttaatgctcatggccaacctattggtagttatcgagctaccttgagcaattatttggggacattggctaggaatgcatatttaatccccttaacattcacaagctgtaaaggactaaaagaaaactgggatgacttatggaaaactgtcatagaaaattttgacattgaagagcgtgctaaaagtggattttag

SEQ ID NO: 92444 - DNA, 872 bp, Glycine max
  Peptide Sequence Number=SeqID_209222
atggatttcaggcaaagagctccaactttccgtccacaactttctgttcgtcgcgtgtacgagactttggagccacgatcagagacaaaagaacttccagaagcttatcttctgcgtgtttatattcctggttttccaagggagaatgtaaagattacatatgtggcctcttcaagaactgtgaggattacaggagaaaggcaacttcaaggtaacagatggcacaaaattgacaaatcatatcccattcctgattattgtgaggcagaggcacttcaaggtaagtttgagattccaattctcaccattacaatgccaaaaaaggccacttcacaagctgctactaaacaacaagaagtgggaacatcccaagagaaaggtgcagtagtagctgaaccaaagcctcaagaaaaagtccaagagaccacttcagcaccacaacctacaacaactactaaagtggaagaaccaattgaagagaagaaaagtgcatcaccaacaagccctgatttaaaggcacaacaaaaaaatgatacttttgaagacacaccatctcaaagcctttcaaaaccaattaaggatcaaaagggtcaagaggaattggtgccaaaacccacaccaacaccaacaccaacaccaagggcaactacaatgcaaacatatgaaaaggctcaaaagggtcaagaggaagaggaggttgagtcaaagtcaacaccaacaatgctaaccaaggccaaaacagctgaaagaccacaaaagggtgaagaggaatttgaagcaaagcgaacaccaacaatgctgaccaaagtcaaaacagctgaaagaccccaaaagggtgaagaggaatttgaagcaaaatcaacaccagcaat

SEQ ID NO: 92445 - DNA, 300 bp, Glycine max
  Peptide Sequence Number=SeqID_209223
tttcttccagcagcggcttccaaatttctatatggttccaaaaaatatattacgcttcatcggggactaggaaaacgcacccaacggcagcggggcctaggaaaatgcacccaatggcaggtgcccatccacgatggtgtgccatctattgctgacccatggttccagtaccttcatgaaaaaaaattgatggccggagatgaggttgtcttctacttccggtttgatgaccatgctggggagcttttgatcaggaaagatattgaatgggacaaggaggacatccaccttgatgattga

SEQ ID NO: 92446 - DNA, 1095 bp, Glycine max
  Peptide Sequence Number=SeqID_209224
cgggtgattgcgctcaatccggatcgcctcagagtcttcaactatgcgcacatgcctgcgctgtttgccgctcagcgcaaaatcaaagatgaggagctgccgacggcggcgcagaagctgcaaatcttgcagcaaaccattgcgacgctgaccggtgcgggttaccagtttattggcatggaccactttgccaaaccggatgatgaactggcggtggcacagcgcgccggtgtactgcatcgcaatttccagggttacaccacgcagggcgaaaccgaactgctcggactgggcgtttcggccatcagcatgctgggcgacagctatgcgcagaatcagaaagagttgaagcctgcgctgatctgtaactttgcgctggattttgccgacttcgaagcccggtggccagtggtgtttgaacgctattttgctgaggatttagcgctgctggcgccgctggtggcggacggcttgcttgagatgggtgagcgccggctgcaggttaccggcattggccgtctgctgattcgcaacatctgcatgtgctttgaccgctatctgcggcagaaagcgcgcatgcagcaattttcgcggactgacgctgatggcgcagaccacggcggccagcgcggtttgcgcccagtaaacgtgccgcttcctgcttgtggccctgcgtatgacgcagcgcagtggtcagcagcgtacgctccatctccggttgtgcttctgacagcaggttttgatgaccggaacgcagcgcgcggtctgcccactgcgccagcagcgttgcccagctgtccggcagcgactgaaccggattttccggcgtactcgactcaaacagctccggcggcagatcctgaatcagcacttcctggcccgcggccatcaccgtcagccagcggcagttgttctccagctggcgcacgttacccgaccagtgcagttgcgtcagcgcggattcagtctccggatgcagaattttcgattatacgcccagctcacgcggtgcgaccagcaggaagtagcgcgccagacgcgggatatcctcacgacgttcacgcagtggcggcagatgcacgagaatcacgttga

SEQ ID NO: 92447 - DNA, 273 bp, Glycine max
  Peptide Sequence Number=SeqID_209225
atggcgagggcattcaaccctatgaaggtgagggcgtgtagccctctgaaggtgaggacgtgcagtcctctaaaggcaaggacgagtagtcctttgaaggtgaaggcgggtagccctttgaaggcgaggacgggtagtcctctaaaggcaataggttctagtactcaagggtccacccctctgggaacctattgggtgaaaacttctaatctgcccctaggttcgcttgaggtttttgcatggtgcctttcgttgccccagtgtagggcttag

SEQ ID NO: 92448 - DNA, 540 bp, Glycine max
  Peptide Sequence Number=SeqID_209226
atgaagattatccatcaggatcccaagcttcaggcacagcgtgtggctgctattaagaaagccaagggaactgttgcagcaagaaagcattcttccaaaattatgaaagcttactatagtgatccagtaaacagtcagaaaaggagcatggccttgaagggtgtgaaattctactgccaaaactgtggacgtgaagggcacaggagacacaactgtccagaactcgaggatagcttggttgatcggcgattcacgtgtaggatctgtggggataaaggccacaacagaagaacatgtagaaagttaaagataagccttagcaatgggagaacaataaaacaccatcggtgtaaagtatgccaccaattcggccataaccgcaggacctgccctcaagctgttccttcttttgttgttcctagtaaaagaaggaatgcagcctctcgaagaccatacaaatgtaggttgtgtaagaaagagggacataatattaggacatgtccaagtaggacagttgttactgaacaccctcgagattaa

SEQ ID NO: 92449 - DNA, 1212 bp, Glycine max
  Peptide Sequence Number=SeqID_209227
atggagcttgcacctgtgaagtctgaactaagtccaaggagccataggttggtcattatagatggtagtgatgttattagcactaagtgtgccaaaaggcggcgaagagattcgtctatggccgtgttaggtggcaatggacaacaaggtgaacagttagaagaacagaagcaacttggtggccaatcaactgccaccactgtgaagagaagctcaaggttcaggggagttagcagacacaggtggactggaaggtttgaagcacatctatgggataaagggacctggaatcccactcagaagaagaaaggaaagcaaggagcttataatgatgaagaagctgctgctagagcttatgatttggctgcactcaagtactggggaacatcaactttcacaaatttccctgtatctgattatgagaaagaaattgagataatgaaaactgtaaccaaagaagaataccttgcttcattgaggaggaggagcagcggtttttctagaggtgtatcaaagtatagaggagtagcaaggcatcatcacaatggaagatgggaagcaaggattgggagagtgttcggcaacaagtacctctaccttgggacttacagtacacaagaagaagcagcccgtgcatatgacattgcagcaattgaatacagaggcataaatgcagtgacaaattttgacttgagcacctacatcagatggctaagaccaggaacacatcctactgcttctcatgatcaaaagcctagcactgatgctcaactttttgcaacctctaactccatgcaaacaagagggaacattgaggtatccaactccaacatgcattcattcccctcaggtgaattggacagtaccaagaagcgagacttttccaagtacatgaaccctttgagtccttgcaacaagccatcttccccaacagcattaggacttctcctaaaatcctcggtgtttagagaactgatgcagagaaatctgaactcttctagtgaagaagctgatgttgaattgaaatatccacaagagggcaatgatggggttggagggatttatgataatgacaacaccagtaactcttacttttgctcttctaatatcagcagattacctaacttggagtcatcagaagagtgtccattgcctatgtatcatggaactatgcaatcactatggaatagtgctttcaacatgtctaactga

SEQ ID NO: 92450 - DNA, 162 bp, Glycine max
  Peptide Sequence Number=SeqID_209228
atggaggattcaccaccgttcttaaccaatgatgaggtagatgcaatacccaaagtccttgcaaatatgactatccaacaactttcaaatgatattgttacaatgggagattcttctaagttctttaatgaagaagaacttagaagcaatgttcatcaatga

SEQ ID NO: 92451 - DNA, 1140 bp, Glycine max
  Peptide Sequence Number=SeqID_209229
atgagcatctccaccactaccactcctctcttcagcttcaaccactacttcacaagagaaagagaaccctccattcaccgttccaagccaaagccattctctctcacttcttcttccactctcaccctcttcaactccaacaacagctgtaactatagctttgcctcttgcaaactccacaagtttcacactccaaagtttgaggcttttgcagctaacactgataccctcgagtcccttcagtcctctgatgtcttattcgaccagattttccccatcaaccgaactggtctctcttttgtcttctcacttttttttttcttggagtggtgtttggtttatagagttttgggaatacccagaagagaaattgtggagggaaagatctttgcgagattggatcggggggaaggatttgggaaattggaagcttacaagggttgcaatctatcagggaaatggattcttcactggggagtttctcgtgtggatgatgttggaagtgaatgggatcaacctcctcttgatatgatagcccctattccccctggatctattcctattaaggactatgcaatagagacacctatgaagaaatcattgtcatccactgaaggagatattttacatgaagtcaagattgatcttaaacccaacaatgatatttcagcgattaattttgttctcaaggatgaggaaactggtgcttggtatcaacacaaaggaagagatttcaaggttcctctggggcctttggggcagatatctaacattctcctcaagtcagaagcaacacatgacaaagttcaagatgacaacagtggatccagaaatacaaaagtggaaaatagtcaactagaagatatacctggagatattctccttcactggggtgtttgcagggataatttgaagtggtgggaaattccacctgctcctcatccaccagaaacaatagcatttaaggacagagctttaagaactaaattacagaaccagaatggtatttggaacatatttggaggtcatgtcaactgggatgatcgtgcaattgtagctgatgattcatattttcaggggaggggcaacaagagtactggagacaattttcatgctgctccaaacattgatcattcatag

SEQ ID NO: 92452 - DNA, 387 bp, Glycine max
  Peptide Sequence Number=SeqID_209230
atggaatatatgaaggagatgctggagtcatcgatggagtacatgaagaagttggcctcgcaacatactacacaacttgcggagttgacagaaaatatcacagcaacagcggagatcaataagatgctcaagaagggggtggtgtgtttgaaaaattggcaacaattaaacaagagtcgattgaagagtatgtgtgagggttcgaaatcttggttgcccaagctgggtcgttatcagaggagcaactcttgggttattttcttggaggtcttcggccagaattacgcagcaaggtacgcattcatgatttcaaaggcaatcgaacttgcaagagatttagaagaagatttcagattgacacaaaaattgggaggttcaagattctga

SEQ ID NO: 92453 - DNA, 402 bp, Glycine max
  Peptide Sequence Number=SeqID_209231
atggggtgtagcaagcaaatgctcactgtcgcaacctacccttcggcgggagggcgacgcgagactcacaggtgcgtcttccatgggaggaaaatatgcggagtcgccaccaacgtttattcgaggaaaacgtcggaaaaaccgaaaaaggtgtggtctacgaactttaagtatgaaaggttcgggagttgtatttatgtacggggaaggaaagctggagttgctgcacatgatgtccaacgttatgtcaaggaatcagattgggctgcacaatgcacaaggcaagataaaatgtcaaatgaagaattggagctgcaggatccacgatgtcggatacgatgtccaggacatcctgcccgaaaatactggacacataaatctgttatatctttaacagattaa

SEQ ID NO: 92454 - DNA, 315 bp, Glycine max
  Peptide Sequence Number=SeqID_209232
atgccctacccgatgttctttcaaacaaagcgaggcctcacacttgaagccttggaaagaaaaatccaccaaaggccccgactacaaccactagatcaagtatgcgatgttgctttccaatacccacaagttgtgggacgtagaatgcttaagtttacagcagtgcaacttgttgacgatgaagatgtcaaagtagagcctacctcatcaacccaaccaaatgatcctaagtttacagtaaagcttggtttacctaacgaagaacttggtccctttagtgaggatgaagatgaagatttacgcaatcaaccctag

SEQ ID NO: 92455 - DNA, 564 bp, Glycine max
  Peptide Sequence Number=SeqID_209233
atgcaaatcatgatgattggggcctcgattggcacatcaaaggtgaacacccatctatttgaagaggagaggaagttctatgtccctcaagaaaacattccaacaaacaagtggtttcgaccagggaatgaaggatccaattcacattttaaggagtttgaagtgagtagtttggcacttcgaaggggaggaaccactaaaggttcaaggaagggttattatgactatcaaaatcctccttgggtgattcgaaacatgtccaaaacccaatggagatggcatcataggatgaggaaatatgcaatactagcagtgcaacataaaaatgttgcaagaccatcaatctttgacaaaattagtgaaggcccacctccaagattcgaaaagaaaatctcgatcaaggatcagaaggactcattggaagcaatatgtggagttatttcgatcttaccagcggaatacacaaaagattatcataataggaatatcttaagtgattatgctagagaggattacttcgatggtccttgtttaagccataaggcagtaggaagaggcctatga

SEQ ID NO: 92456 - DNA, 498 bp, Glycine max
  Peptide Sequence Number=SeqID_209234
atggggtgtacccatgggcccgaaatctaccctaaggctcataagaaccctagggccttctcttgcatctctggcccaatctacttggagttttctatccaatgcccttgcggggtaggattgcatcatggtatctctcatgagtatgatattgtttatgtcacccaaaaagctacaaaaggaaactcactagcagaatacttggttcattatcctatagaagactaccaatcaatgcaatgcgagttcctagatgaagacatattggcattatttgaagttggaaaatataaggatgagggaaaatggaccatgttatttgatggagcttccaatgcaccggggtacgaaattagggcaatgttaatttctcctatgaatcaattaatcccattcacagcaaggttgggttttgactgtaccaataatgtggcagagtatgaagcttgtgcgatgggggttagagcaacaatcgaattcaaaggtagaatcttatag

SEQ ID NO: 92457 - DNA, 324 bp, Glycine max
  Peptide Sequence Number=SeqID_209235
atggttcggctaggttccaggctatgcccattctatagtccgcttttcattttcttccaccacgtgtcagcgcttccctcacctcccatgcaacctctccatgttctgcttcctctgcttcttcgttccacgattttccgatttcagatttcaaatttcaaattcaaattcaaaagcacaggctatgtgggggagttatcaaaagctgcatctgaactcatcatttgctgtaaaaagaccttttcaacttctgatcttcctgagtcctcaggaaaagatgatgtgaaggttgatgatgcccctgaattgatggacgttctttaa

SEQ ID NO: 92458 - DNA, 1704 bp, Glycine max
  Peptide Sequence Number=SeqID_209236
atgtcaaagaatttaaaggctcaggatgaaagctctcagttttcaaaggtgcaatctccaaactcagcaaaatcaagtctttcctccaagagtcctgacagaacaaagattgcttcaattgacgatcagtatgcaattatggtgtcttgtcgatgcaattatacggcatcaagattattctttaagcaagcaaccagttggcaaccacgttcatcgagggatattataatctctgttgcatctgagatgtccggagagtctcctggaccttatgaaagaaattctcaacttcctgtgcaggttttaactcttcaagcttcaaatttgacatctgaagatctaacactgacagtgcttgctcctgcctcatttacttcacccccgtcagtggtttctctgagttcacccactagtccaatgagtccttttattggtttcaaagagtttttaggaaggataaatgttgaaagacatgttggtgccatccagggggggagctttacttctcttataaaagacaatgagaagcaaaatgatgatgtcagacctgagtcagtttcaatgaatgatgatgtcattgctagttctggcctaagttgtacacatctttggctgcagagtagagttccactcggatgtatcccgtctcaatccacagccaccattaagcttgagctacttccattgaccgatggcataattacactcgactctttgcaaattgatgtcatggaaaaagtggtaatcaagatgcaaaatgcacattatgttattgcacaggttctcatggatttacattatggtctaaacagagtgaaagcaatgaatcacctctcgattcatggcattaggcagttgcaattcagtgtgtttcaattgatcatcagtggaagcctttgtgccggtcgtaagagtggtggctccagcaagggtcgagatagtggcaaatttgtcaattttcagtgtcaattttgtcttaagtatgatcacactagaaatgtttgtcactttaggtctgacatgagttttcagtctcatggaacacttactttctttgacccagcaacactccaacccattccttactcctctggttctgtcagaacctctagtacttgggttaatcccaaatacaaatttggaactgctgctctagcatcaactcacccaaatgctatgcttaccaattccacttctcatggaaatggacatgctaactccacatggattccagattctggtgctagctttcatgggaccaataaagtctttcttcatggagttgttagtgctaatggtctttactcctttcataatctcacgcttcaagaccattcttctctattgttgtccacttcagcttcacctgttagctcaactacatacaattgcttgtctagtgtagatattgctgccaataaaattcctaatgtagtttctaatcttgtaatttcatctcctagcaatgttagtttgtggcatgctaggttgggtcatcctaatagccatgccatgaagtcagacttcaatcattgtaacatttcctcatctaataattttttttctagacttttgctcctcatgttgtatgggaaagtctcaccgattgtcctctcactcttttacttctgtatactttcctttggagcttatttttacagacctgtggggatcttctcatttaacttcatatgttggctttaa

SEQ ID NO: 92459 - DNA, 1602 bp, Glycine max
  Peptide Sequence Number=SeqID_209237
atggccttattctgtattgtctgtctgtttactgaggaacttcctgagaactggaatcatgtgtcggatatgcagtccctgcgctctctagatcgttcctttctctttcctggtgaacaagttcatatcctagcgtgcctgtctgcttgtaagcaggatacagagattattactccatttaaagttgctgctgtgatgagtaagaatggcatgggtcacagttctgacaaagaaaatggaaatgttgaaaacagaaatgattcggtatctggagaagggcaactgagtcctagcaaacaagagcagaaagaggataaattggaaaaagtgaagactgatcacccggcggatgcttctgctggtgaatcccttctaaggatggaggttcacaaaagacaaactgcattgttgctggaaaaatttgagagttctcatttctttgcaaggatttctgagtctgatgagccgctttggtctaaacgaggttcttcagaaaagtcctactctgaactaaatgggcaaaggatctcatcatttgaaattaaagacaccgcaaaaaatgcatcttctattagtgcagttattgatagagcaaattttgatgcaactatttctggtggagtggcgagaaattctgtcaattgttgtgccctaccaaatggagacatagtggactcagatgttatggggtgcctaagtcccacactgagtagtgtgggatgcttggtggagtatttaaatttctggaacataccttttgtgatgtgtaggatccaggttcttttacaggtgaatgttggtgttgattttcttagagacccttgcatagaaattctccaatacgaaaagtatcaggataaaatattgtcttctgagaaccagaacaattcagttcacacaaatcaggatccatgtggagcactattaaaatggatacttccattagataacactctcccccttgcttctcgcccgctatctcctcctcaattttctttgaattcaggaatcggtaacacctctcagaggtccaattcttcagcatcacctggctctcaattattttcctttggcagccatttcagaagttactcaatgtcagcattacctcaaaatacaaatgcaccaaatcctcctttaaaagcagctagttctaagccaagctttgacattgaagattgggatcaattcccatctcagaaattaaggaaaaaaaatggagtagaagaacttttatcttttcgaggtgtttcattggagcgagaaaggttttccgtttgctgtggattagaaggtatctacacacctggaagaaggtggagaaggaaatttgaaataatacaacctgtagagattcattcctttgcagctgactgtaattcagaggatcttctgtgcgttcagataaagaatgttgctcctgcacatgttccaggtattgtgatatttatagatgccataaccatagtttatgaagaggctacaaaaagtggaccaccatcatcattaccaattgcatgtattgaagctggaaatgaccattctttaccaaatttagccctcaggtttaggaatgtggtaatcttgctttggaagatttga

SEQ ID NO: 92460 - DNA, 298 bp, Glycine max
  Peptide Sequence Number=SeqID_209238
atggcttttgaggcctcttgtctcctatgcagtaatgttgtggagactcttgctcatgccttgtgtgattgtcctaaggtgaaggagctcgagatatttgttaaggagcaaatggttgtggttttgcattatgtgaataagaaagggcaagttatagagtgttttcccggtcttgttcatgttcctaacactgatgttctatcattaaaattggctttggaatcattatttgcaaaatatgggttaagcttgtcaaggttgcgtagacaaggatatgatggagcaagtaatatgcaag

SEQ ID NO: 92461 - DNA, 393 bp, Glycine max
  Peptide Sequence Number=SeqID_209239
atgtttgatgttaggtcatttgattttgacagaaagtgccccaaagaaagttgtttaatttcaagtccttcagtatattatgttagtaccttaaacgaagatacagacttagtgcagcaaaaacccatagtgtggagagtctctgtcaggaaaaataagaggcagggaaggaatgatgaggtggcagagagagaaagggatagaacaccagacaaggaaccttcaatgtatagtctcctcaagttaaagagttggccaatggtgtttggaagattgccactcaacaaattggagctaacagttaattggttcaaggatgtgacatttcctagacttgaaggaatggaagcgaaaaaaatgttctcggttagaccaagatgttgcagatattga

SEQ ID NO: 92462 - DNA, 608 bp, Glycine max
  Peptide Sequence Number=SeqID_209240
atggcgcgcagagacaaattatggtcattctgcgccttttcatctaggctcgatcatgaccgatggcatgcagagacaaattatggtcattttgcgcccttttgtcatccagaggcgatcgtgcccgatgacatgcggagacaaattatggtcattctgtgccctttgacattcaggagcagcgagtcgagtgataaacgcgcagagacaaattatggagcaacgagtcgagtgataaactcgcagagacaaattatggtcattatgcgccctttgtcattctggggcagtgagtcgagtggtgggcggagacaaattatggtcattccgcacaccttttctccatccagaggcgatcatgtccgatggcgcgcggagacaaattatggtcattctgcgcctttccatccaggcccgatcgtgtccgatggcacgcagagacaaattatggtcattctgcgccttgtgtcaaccaagaggaatgaatttgacagtatcaggatgatgggggtacaaatagcaatcaaacccacttgggccttccaggatcttccaacagaaggcggtgccttctggtggaagcaaccgagcttgcctgagcgagctgg

SEQ ID NO: 92463 - DNA, 189 bp, Glycine max
  Peptide Sequence Number=SeqID_209241
atgacaacaacacaattgcgacaggagaaagggcacggaggtggcgtggccaaggatgattcaacgatttgtgagagcggaaaaaacactaatgtgcgagcacaaaggtggttctcaccatcatcaagggagttaactgtcatagaattaaagatagagcctctggaagatcaaaaggatccggtttag

SEQ ID NO: 92464 - DNA, 414 bp, Glycine max
  Peptide Sequence Number=SeqID_209242
atggaatcttttgaagctatgttcaatgaaaatgttgaggttgatgttgaagtagatgaaaacaatatttcatctaatgatgttgaagaagatgaacttaatgatgaacctaaaaggccaaataaaagggataggaatatgtcttcaactggattgaaagttgctagccatgttattcataaaattagggaaagtatcaagtatattaaaaggtcagagggaagaatgagggattttagagcttgtgctgctaaacttggtggtattactaccaagatgggtttgcatttggatgttgttactaggtggaattccacctttcttatgcttgaaagtgcacttttgtaccatcatgctttcattagtcttgaatttgaagatagaagcaatgtgaattatcctactaatgaatag

SEQ ID NO: 92465 - DNA, 324 bp, Glycine max
  Peptide Sequence Number=SeqID_209243
atggaggttgtgtggaggaggttgttctcgagcttgctctggtattgtaaagaggttgatctgggagacattggggttgtcgtccctgcagtcgaagaggagggtaagtgggctgttatcatcactccgcccttgaagaaggtcgttgtcctcaatgaccaacgaatcagaagagaggccacgattgtgctttcaggaaacgttggagatgtaaagactaggattggttggttgggaaaagaagtggggattgaagggacattagtcttgggtagtggtctcttgggaaaaggaagacacgttgaagggataaggatggtatag

SEQ ID NO: 92466 - DNA, 682 bp, Glycine max
  Peptide Sequence Number=SeqID_209244
atgaatgacaatataactttaatactgcaccatggaggaagattcactccacgtgcctgtgatggaacggttgaatatataggcggagaatttgacgtctgggaggatatatctgcagattgcctgaatgcatttatcttatatgatctggtgaaagcttctgttgagaatgaggatgatttagatgatgtacctgttgctggccatgaggaagatgttggtgctggagagcagagagatgctggtgagcagatggatgctggtaagcagagggatggtggtgagcagagggatggtggtgagcagagggatactgatgctggtgagcaaagagatggtagtgagcagagggatactgatgctggtgagcaaagagatggtagtgagcagagggatgctgaagttggtgaggagagagatgttgatggtgaagagagagatgttgctgatagtgaggaggaaaaggaagttgacagtgatgagacagatgctgagtggtttataaatttctcttgtatgttgaatgaagttgaagctgaagttgagacagatggttatcattcagaggagcttaatatccccattagtagtgatgatgaagatgaggatgttgaagtttatcctcaatatagtcaaagtagtggagttggtgaacagaagttggaattagggatggagtttg

SEQ ID NO: 92467 - DNA, 516 bp, Glycine max
  Peptide Sequence Number=SeqID_209245
atgggttctccacctgcctccactcctcctcctcctccaccacctcctcctcctacttcggacgcatcggcttcgacaccacctggtgttgagagaccagtggtgcatgttgatcctgctatagggaaggccgacggtccccacaagaagaaattgagaacatatttggggattgtggcacgtgataaggtggacatcacctacgagaactggaaggaggtccctactgctcagaaggacctgatttgggaggatattcaggcggaatttgatatcccagaggcttttgacagtaggacgaaaaggaagttactacagaccgtgggggagagatggaggcagtttaaatcagacctcacgaggaaatgggcctttgcagccgatcaggacggtgtcgaggacactgtctgtgacaaatacggcctcagcaaggaaaagtgggcccagttttgccagactcgcagagacccttcttcggaggatgtgcgcatgaaggcacaggccatccagaagtag

SEQ ID NO: 92468 - DNA, 611 bp, Glycine max
  Peptide Sequence Number=SeqID_209246
gtaaatttaaattagaagataagatcttggagggattctttttagcacctaaatgctatagctataccacagaagagtcagatggcaataagaaggtctataagtacaagggaccgggtagaaatgttataactccagaatggtataaagaacagtacgccgacccttcccaaagtctgataaagaaggtaacttatcaatttcgacccgattggaaagaactctcggttaaaaagaaagagagtacaaccactcttagaactctcagtaactccaagagaatacctttctttaatgaaaaaggtaaatatgtaagtacagatccacttgatatcaatgacttgtcatctctaaattacattggaacaaaactattagaaagttttaaaaggaaaacagctcttttagaaaaagagaattcggctctttctcagaaattacagaagctggaacaggaaagaggtataatagcccagcggagagtagaagaaggaaataataccgaagataataatacattagagcaaaataatgctaaaagggctgaagataatatcaatggagatctattggatccagatacgatgccgcgggataaaaagcccccctga

SEQ ID NO: 92469 - DNA, 973 bp, Glycine max
  Peptide Sequence Number=SeqID_209247
actaggcatttatgagcccgttgaacataataaccctgcactctctcccaacttcgaatctcctgtctacgaggctgaagaggaggaggatgatgaaatcccggaggaacttgctcggttattggaatatgaaaagaaaaccattcggcctcatgaggaggtagtagaggtgattaacttgggaaccgaggaagataagaaggaagtcaagattggggcatcgcttgaggtaactgtcaaacgaagggtgattgaattgctcaaagaatatgtcgatgtgttcgcatggtcgtaccaggatatgcccggcttggatccccgtattgtggagcaccgtttgcctttgaagcccgaatgcccaccggtcaaacagaaactgagaagaactcgccctgacatggctctcaagatcaaagaggaagtacagaagcagatcgatgcaggttttcttgtcacatcagagtatcctcaatggttagccaacatagtgcctgttccaaagagggacggcaaggtcaggatgtgcgttgactaccgagatttgaacaaggctagtccaaaagatgactttcctctacctcacatcgatgtattggttgacagcgctgcaaagtccaaggtcttctccttcatggacggtttctctgggtacaatcagatcaagatggcagttgaagacagagaaaagacatctttcatcacgccttggggcaccttttgttacagggtaatgccttttgggttgataaatgcaggtgccacttaccaaagaggcatgaccactctctttcatgacatgatgcacaaagagatagaagtgtacgtggatgatatgattgtcaagtcaggcactgaagaagaacatgtcgagtacttgctgaagatgtttcgacggctgagaaagtaccaacttcgactgaatcccaacaaatgtacctttggtgttagatctggaaaactcttgggtttcatt

SEQ ID NO: 92470 - DNA, 171 bp, Glycine max
  Peptide Sequence Number=SeqID_209248
atgaagaaaatatgcagtaatttccaaggcaaggacaatgcacctccacctccacctcaatggattgaggctaagtttttttttaatggaacaccattagacactgacaccatcacgacactacgcaagaaatgggcagcctattttctagaagatggaaaatggatgtaa

SEQ ID NO: 92471 - DNA, 174 bp, Glycine max
  Peptide Sequence Number=SeqID_209249
atgaaggagcagcttgccacctttcgctctcagctcgaagatttcgctcgcaaacacaacttgaagaaagttagagcgagaaagcaagagagaggctgcattgtaagggatgttatgcgtggagaagagaggaagatgggaataagagatggaaagggtattacaggggaatga

SEQ ID NO: 92472 - DNA, 324 bp, Glycine max
  Peptide Sequence Number=SeqID_209250
atgtcttgctccatgagtattgggaagggtgatctcattaaaggtttctatgtcttagtttctccaagtgatttggattcagaagctagtacaaatatctgtaattctatttccattcaagaatataataagtctactttagcttgtacaaattctacaagttgtaaagatccaaatattgtagaagcaaagcctcatgatgataacaaaggtgatgacaaaaagctcaaagatcaatcaaagaacaactcaagtgaatcaagaacaattcaagagttcaagataagaatcaagaagaattcaagactcaagaagaaagtttag

SEQ ID NO: 92473 - DNA, 165 bp, Glycine max
  Peptide Sequence Number=SeqID_209251
atgatccatagagaggatctgattccgaatcaaagagtaggcttcactgagacccatcaagaaatgcatagcatactcaagttaagcatactcacaccaatgtttgattccattgcatttactgaaaaattaaaggtccatttcgctgctcaaaacactccttga

SEQ ID NO: 92474 - DNA, 969 bp, Glycine max
  Peptide Sequence Number=SeqID_209252
atggatcgggctttgtattttcaatccaaggttcccatacagtttaaggagactcggtcaaatcttgtccctcttcctaccacttcttcgactagagtttttgagtctgtgccaccacaacaaattcttagaagatgggtttacaagctcaaatataaacctaatggaacagtggacagatacaaagctcagttagtagctaaagcctacacgcaacaagctggaatagatttttcagacactttttcacctgttgccaagcttaccttagtgagagtgtttctagcagtaacaacaactaggaattggtgtttacaacaactagatgttaacaatgttgtcctcaatggggatctatttgaggaagtttatatggacttgcctcaaggatacaaaaccactgctcctggtcttgtatgcaaactcaataacttcttgtatggccttaggcaagcctcaaggaaatggttttgcaagttctcttctaccatattacaacaaggttttattcaatccaaaaatgattattctcttttcacttatggctctggatcctcattagtagtgctcattgtatatgttgatgacagtatacttgttggcccaagttccttatatgttgctgaggtccagaccaaattacaatccatgttcaagttaaagattttgggctctttgaaatatttcttaggccttaaaatttccaaatctagtaaaggcatttcactttctcaaagaaagtacacactatcattgctagatgatataggataccttggtagtaagccaacacatctacatatggatacaaatctaaaattgaccttgactgaagataatctaatccctgatccttctctgtataggagactcattggtaggctcatctacttgaccattttgagacctgacattacttttgaagtacacaagctaagtcaatacatgaagatccctttgactacttag

SEQ ID NO: 92475 - DNA, 438 bp, Glycine max
  Peptide Sequence Number=SeqID_209253
atgggagccaagaaacagatgcaaaaattagatactagggtgaaaagcaagaatcttcatgggggagaagagacaaaccatggtgaattagaaccagcaacaaaattagagatcaagagccagaatcaaggttgtagagagagcatcaatggtgaggaagcaaaagaaacaaagaacaagagtcgtcatttagcaaatgaggtgatcgagaatatcagaaaccttagtatgagtatggaggaggaagatattccatcaccagaattgcaaatgacactgctttatgatccttgtatggtggccgagatagaggcagaaatgatgaagatgagggtggagatggaagtggttctgctaccccaaaatattaactcagttcatgagccaatttgcgtaaaggctgcagtaatgtctagctcattgaccaagctgtcctga

SEQ ID NO: 92476 - DNA, 1245 bp, Glycine max
  Peptide Sequence Number=SeqID_209254
atgggacgcccaaaattaatcttaaagcccatcccaaatgggagagatcgtgatttggctttcacgaagagaaagaaagcactaatgaagaaaatgactgaattttctaacgtgtgtggagtcaaagcttgcatgattatgtatgatggcaattatggtgatgctccaccactgacttggccccaagatgaccccattgaggtgcactccatcatcaaaaggtatgagagcataaagaatgagaaacttcccaagaacttcgatctcaataatttttttgagattaggaagaacatggttgacaatgatatttccaaagtccaaaaagagaccctcaagatcaaatatccaacttggcatccaagcttcaacaacctaggtgtagaggagctgaggaatttcatcgctaggttggacattaagcttgaagcttgtaatcaacgaaacgaaatgtcgaaacacaaccatcaaaatgaagccaacttcaatttcatgcaaagcatggttcaatcagacagtgttgctccaaacccaagccaactcaatttcatgcaggaaatctctcaaaatcaattttctcttgctcctatgaggccacttaatgatggtaaccaggtagcatcttacctacttaatcttgacataggttctagttctcaatcccaaatgcttaactttgatccaaatcttatgcaactaattgccaagaatcaaggggtgatggatattactaatcaagttgttgtgcctctggcttgtgcaaatcaaattaatgctttaggaaattttacaaatcaacatgatgtgcctgtagatttgactaatcatcaacttggtgagtgtttggactattttagccaacttgatgaaattgaagatttgactagtcaacttaatgagattgtgaattcgggtagtcaacctggtgagtctataatttggactaatcaacatggtgtgccagtgattgggggaagtactacagcaatgaatggtgctactaattatggtacaaagtttcatggagatgaacacaaccaagagtcctcacattgcaattacaatgaagttgtgcaatcaatgcaaccctataattatgatgccgcattgcagaatattgcttctcagtcagaaaatgtgcagcaaatagtaacttggccttcccttctaccaccaaaggatgaatttcagacagatcactacaacaagacgcttcaaaatcagtattccaaccacttcatttag

SEQ ID NO: 92477 - DNA, 546 bp, Glycine max
  Peptide Sequence Number=SeqID_209255
ttgaaaatcctatttaccttagccatctgccatgttttcttatatacagagacacttgttcattctacattggaacactgtgatgatgcggatttcacttttactgtcttcttcaatttgaaagagtacatagtatatgtaaaacagaggccttatctccacacattcttggagagggtatcagagatgtttgaagtagtaatttttactgccagccaaagcatatatgcaaagcaactacttgatatattagatcctgatggaagatttatttctcgtcgcatgtatcgagaatcatgccttttttcagatggaaattacacaaaagatcttactatattaggtgttgatcttgcaaaagttgccataattgataattcacctcaggttttccgattgcaagtgaataatggtattcctataaagagttggtttgatgatccattagattgtgcactgatgtcattacttccctttctagagaccttggctgatgctgatgatgtccgtcctatcattgcaaagagatatggtaacaaagaataa

SEQ ID NO: 92478 - DNA, 516 bp, Glycine max
  Peptide Sequence Number=SeqID_209256
atgggacatgctgcctctcttcagcatcccttctctcttcatgcatactgtgatgctgattgggcttctgaccctgatgatagaaggtcaacttctggtgctgctatatttcttggccctaatctcatctcttggtggtctaaaaagcagtcagttgtgacaagatacagcactgaggctgagtacaaaagtatggctcttattgcagcagaagtaacttggattcagtctcttctttctgaacttcaagttactcataccactcctcttattctgtgtgacaataccagcactgtctctttggctcataaccctgttattcactctagaaccaagcacatggagctggatttattttttgtcagagagaaagttctaactaaacaacttaatgttgtttgtgttcctgcagttgatcaactggctgatatcttgaccaaggctttatctcctttgtttcttttgttcaggtccaagctcagagtagttgaaagactttcttccaacccctcttga

SEQ ID NO: 92479 - DNA, 183 bp, Glycine max
  Peptide Sequence Number=SeqID_209257
atggcttaccagtctttgccttggccatgtgagttgaggcttttgagctacttagatgaggaggaactaaccaacacctgcacagcaaacttagaaacaattttttctcctgcttttgagcccattgaagtccattcacaacattatactgagaaagatgcagttggccattcatggaaatag

SEQ ID NO: 92480 - DNA, 621 bp, Glycine max
  Peptide Sequence Number=SeqID_209258
atggccgaagtgggagctgatgaaggaagaagcatatgtggttatgaaacatgcgatgtatcagacttctacatttctgacatgatcattacaaacttaccctttggggggaattcctttgatgatgatatcagtgaaaccaactgcctatctgattatggatctactgagccatccatgtttaccgcgtctgaacagtacatgatcctgcctgctcttgaagatgatattaaagttggcactacttctgatatcatatcatatgaagaaaccatgatggttcgagaaagtgctagtttgtattcagcaatgggtcagataagatcctgcaaccaggagtctgatgttaaaagtgacttggataaatcagagtgctttgatccacagtcatttatcaagaatttaccagaactatcagaaatagaagtaaatgggaagccaaccctaattcctaagcaatctcctagaagaaagtcaataactctggtgctggacttagatgctaaaaaacaaaattcatgcaactattttctatctatagcctggacaaaaaattggtgccagatcacaaaaacaggaagaggccagaccacttctaggactgagatcgaagctggataa

SEQ ID NO: 92481 - DNA, 1306 bp, Glycine max
  Peptide Sequence Number=SeqID_209259
gactacacgtcctcgccttcaaacggttgcacgtcttcaccttcaaaggattgcacgtcctcacctttagagggctgcgcaccctcaccttcagaggactacacatgctcaccttcagaatgctacacgctcttacctttagaggattacacttcctcacctttagagtgttgcacgccctcaccttcagaggactgcacgtcctcaccttcagagcgcttcgcgctctcacctttagaggactacacgtcctcaccttgagagggctacacgctcttaccttcaaaggactacacgtcctcgccttcagagggttgcacgccctcggattcagaggactgcacgtcctcaccttcagagcgctacgcgccctaaccatcagaggactacacttcctcatcttcagagggctaaacgctcttacctttggtggactacacgtcctcaccttcagtgggctacacgcttttacctttagaggagtacacgtcctcgcctttagagggttgcacgccctcaccttcagaggactgcacgtcttcaccttcagagggctacgcacgcccacctttagaggactacacatcctcaccttcatagggctacacgctcttaacttcagaggactacacgtcctcgccttcagagatttgcacgccttcaccttgagaggactgcacgtccttaccttcagagggctacgcgccctcaccttcagaggactgcatgttcttgccttaagaggactgcatgtcctcgccttcagaggactacatgtcctcgcctccagagggttgcacgccctcgccttcagaggactacatgtcctcgccttcagagggctccacatctgcaccttgagaggacctaaggggggccaactgtgcgaacacaaccagagggaggctatcatgcagccactatgcatactggggcaagatttcacttgtgccgctacaaagggacaagtgcggatcatgagcaccaatatgaccactcttacacagatatggatgacggatcgtgcccacaagacacccagtggacccggaggagcccaacaaggtcttggagtgattgtcgcccccagcaaggtcatcaggccccctactaaccgagctttcatcaagaagtactgttcccccaggcaggcgcaaggcgaggcaccacaacagcctggggatggccggcagcgggcaatagacgcaccgccaccacctccagagcccctcaactcatctacaaaggctagagcgttgcctacgacccgtggccgactagcaggcgaccaagtccaaagccaaag

SEQ ID NO: 92482 - DNA, 501 bp, Glycine max
  Peptide Sequence Number=SeqID_209260
atgggaacaaggggttgtatcaattacaaccccatcctcgccataagacaacttggctaccccatgagaggagcgccatcagagaaaagcatcatgcctttcattgttgggggtttcagtgaccccaatgcaagagtacttcaaggagctgcaagagaggaagagactgaaactccagaggagagtgaggaagtgcaaaccctaaaggcggaacttcaaaaagcccaaatagtcaaagagcagttcaagtcaacggccatcaattacaaggaaaagctaagcctagcagcgactcatgagcaaaggctagaggacgagtacgccaaggtgtcaatcctacaagcggaaagggaagctagggaaagggtgatcgattcattgcacagagaagcgatgatgtggaaaaataggttcgcctttactttgaatgggagtcaagagctcccccgactgctagccaaggccaaggcaatgggggatgtgtactcggcccctgataag

SEQ ID NO: 92483 - DNA, 495 bp, Glycine max
  Peptide Sequence Number=SeqID_209261
atgaaaaactcttggtggggaaaaaagttacacccttacaatcaatatgaagaagaaacaactcttaatcttgagagtatgtttacggaattcgtggcataccatgctagctctaaagccaatcaaaactcaacgcaaaatcaggaaattcgtgttggcaagaactactccatggaaaattgtcagtgggagcaagagttacaaccctacaatcaacatgaagaagaaagaagttctaatctggataatttgttgatgcaattcaaggaatcaactgaatctactcaacaagcatttaaaagtctagaaattcaagttggtaagctagcaaaagaagtggctaaatttatgtccacaagggaagaaaactttgtagaggttgaagctcaagaggaaagccttgtagaagagcatgattcaagagaaaaagatgaagaaaaaagtaaggagaaagcacaacaatgggagaagtgctcacaaatagaaattcaatga

SEQ ID NO: 92484 - DNA, 141 bp, Glycine max
  Peptide Sequence Number=SeqID_209262
atggcagatgagcacgacctgaagactacccttgaggactattcaagagaggctaagaggtggctccactcattcaaaggtaacagtcttaaaacctgggaagaagttgtggaaaagttcctaaagaagtatttcccataa

SEQ ID NO: 92485 - DNA, 177 bp, Glycine max
  Peptide Sequence Number=SeqID_209263
atgttaaactttgacacagcaggaggtctagaagatgaagaattgaagcaacgggctcaccacactggtgcatgctcagcgcaagaaaccaagctagaggccagctattttgacacagcaggaggtctagaagatgttgaagaattgaagcaacgggctcagcacaccggtgcatga

SEQ ID NO: 92486 - DNA, 225 bp, Glycine max
  Peptide Sequence Number=SeqID_209264
atgcaagacgtgaagaaggtgtctgtagcgcgtgcagaggtgcatgatgatctcgctggtgctactggcggaatgcccagtcagcacctacgcctttgtgcccagtcagcacctgtctcgctgatgctactggcgataccgccttcgtgcccagtcagcacctgtctcgctgctgccaatggcgagacaagcttgccgccagtaggaatggcggaatccacgtaa

SEQ ID NO: 92487 - DNA, 1177 bp, Glycine max
  Peptide Sequence Number=SeqID_209265
atggagaatggtttcgggtgcaaccgcagcctccatgtcagccctcccacgggcatgcttaattatacaaaatgccccgactacgatctctactacaagcacatcatcacggctgatgatgtgtctcggagttctttggtggcatatatcatcattcgagtagacttaactgatgaatgtgcagattgcaactatcgccatggagggcagtgcaaacttgacagcacagagaaattttgttgtgccaatgcagttataaagaaagggttgagtttgaaggccaaactgggtataggtttaggtattggaatcccaagcatgttggcaattgggttgctgtttctctttctacaatacaaacgaaaatatggtacctcaggcggacaattggagtcaagagattcttattctgattcctcctcaaatcctcatggagaaagtagtagcgagtactttggagttccactcttcttgtacgagcagcttaaagaagcgacgaacaatttcgatcacaccaaagaacttggagacggaggcttcggtactgtctactatggtaggatacttaatcaaaccctacttgacacacaacattactctccttgtatggtttggaactactacatgctcattggtcctagtcaatctccaagtatccagggtccggaactactatgtgtctgtggtcctgggaaactcccagatggacgtgaagttgccgtgaagcgcttatacgagcacaactggaagcgagtagaacagttcataaacgaagttaagatcctcacacgtttgcgtcacaaaaatcttgtgtcactctacggctgcacttcacggcacagccgtgaactcctacttgtgtatgaatacatttcaaacggcactgtagcgtgtcatctccatggtggattagcgaagcctggctccctaccatggtctacacgaatgaaaattgccgtagagactgctagtgcattggcttatctccacgcctctgacatcattcaccgtgacgtgaaaacaaacaatattctcctcgacaacaacttttgtgttaaggtagcagattttggactttcaagagacgtccccaacgatgtcacacatgtctccacagctccacaagggtccccaggttaccttgaccctgaatattacaattgctatcagcttacta

SEQ ID NO: 92488 - DNA, 255 bp, Glycine max
  Peptide Sequence Number=SeqID_209266
atgcctctggtatcgcgcaggatgagtagaaggaaagaaaacaaggggaagcagaacaaatcaaccggagccatcccaatttcccaattttccgaggaacaagtaatgaactctcttaacaacaacttgactagggaaatgagcgtgggagacttggagaaaaaaagagcatattgccacaaggacaggacgggagttaacaagaataccttcattgcccttaaaggtggaaattttggtcagacaaccatttga

SEQ ID NO: 92489 - DNA, 219 bp, Glycine max
  Peptide Sequence Number=SeqID_209267
atggagtttgtagtagacttttgcagtatgtataccctctttgataggttatgtgggcctgttggaggaagaatagttattggaacctgctcggctggttttggtgtcatcaacaaagtcaataagggatattggtggtttcatcagatgaggaagtcatggtggaagaggtatgaatcaaatgctgttaagccaaggcaattgacacatatggagtaa

SEQ ID NO: 92490 - DNA, 261 bp, Glycine max
  Peptide Sequence Number=SeqID_209268
atggtaagctctctgtcctttgcaattccttgcattgtttcctgccgtaataagtggaagaatcataaaagtaatggtaaagcagcgaagctcggcagagttgaggctatgtcagcatgtgttcatggtggatactggatatacagattaacgagccagcttcacaaggagctaggtggactcacgtttcttagctgcattacctgtagaactcttctgttgatttactataccaatgaagggttccttttctttcgataa

SEQ ID NO: 92491 - DNA, 183 bp, Glycine max
  Peptide Sequence Number=SeqID_209269
atggcgtgtgatgtggccacaggcaagagattgctactatttgcaaggcgtttcttcctgcatttgctaattggcaaccttaccatcaatccagtgaccagacaaccgtgttccagctattttcgctttgactcacagttatcgatggcagtaaatgggtcccaccctaaatcacttgaataa

SEQ ID NO: 92492 - DNA, 969 bp, Glycine max
  Peptide Sequence Number=SeqID_209270
aggacgacaagaggactcagggcgtgtggggcggagtttcagccttacttcgttctcggggatttgtgggaatcctttcgggaatggagtgcttatggcgcaggagtgccacttgtactgaatgacaaggatagtgttgttcagtactatgttccgtatctgtctgggatccaaatttattcccagaatgtgaagccaactgtaaagtcaaggcaactgggggaggatagtgacagtgattttagggactcaagtagtgatggtagcagtgatagtgaacctgtacatggaaggggattgaggaatcttccccatctgttagaagaggtgcctcaatggatgggcggattatctttgagagaccaccattcccttccaccagatgggttttctagtgatgatggagaatctgtcaattctcagggttacttgatttttgagtatcttgaacgggaccctccttacagccgtgagcctttggctgataagataatggatcttgcttttcaattccctgaactggtgacccttagaagttgtgatatactaccatcaagttggatatctgtagcctggtatccaatttacaggataccaactggtccaacattaaaagatctcgatgcttgttttctgacataccattctctttatatgcccatgggaggttcacaaagagtccaggctcccatgccacatcctactgagatggacaatgtccataaaatgtctttacctgtttttggtcttgcttcatataagttcaaaggatctctgtggactcctaatggtggacacgaatgccagcggtctcttttgcagggtgctgatgactggttaagactgcatcaaatggccatacttgatgaagttggagttaataacataattgacagaaggaagatgaaaaatggagaaaagatgtttagcactgtccttggtaattttctgtatcgtttccttccgtaa

SEQ ID NO: 92493 - DNA, 324 bp, Glycine max
  Peptide Sequence Number=SeqID_209271
ttctggttgcgggcctctgttagtcctacagggtgcctgtaccccccggcaagggatcacgcccgcaggacacccagtggacccgaagaagtccaacagggtcctagggtttccaactctgattacgggcctccgtcagttctacagagtacccgtcgcccccagcaaggtcatcaggcctcctactaaccgtgctttcatcaagaagtattgcgcccccaggcaggcagagggcgagacaccacaacagcctggggatggccagcaacaggctacaaatgcaccgccgcctcttccagagtccctcagctcattcacaaaaag

SEQ ID NO: 92494 - DNA, 222 bp, Glycine max
  Peptide Sequence Number=SeqID_209272
atggctcatacgctttcttctagggaactgtcaagtaggatggagtcagcatcaaaggagctattgatgcctcgccttgacgaaggtgataagaaggttctaatgcaatcctaccccctaaaggcattggatagaagactccaagacaattgcaccaaagatgcaagagaaggccctagggttctcatgagccttagggtagatttcgggcctatgggctaa

SEQ ID NO: 92495 - DNA, 408 bp, Glycine max
  Peptide Sequence Number=SeqID_209273
aatctcactcttcctagtacccgcgagttcgatattgctccgaatcaaacagacattagattgttctacggctgtgggtcattgccttggctggaagagcacaaagttgggtgctttaacgaaacgagttcagttctggcattgtataaagaggataaaaatataagttttgtgtcaaagaattgccagggcgaggttgtggatacgatagtggaagatggaataataggagggaatgaagaagcgttgacaaaagggtttttgctgacgtggaaggccggtaactgcagcgtgtgccacaacactggagggaggtgcggcttcgatttcgtcatgtacactttcaggtgcttctgcactgacagagttcattctgccaaatgtggtcctgatgatgatccaggttag

SEQ ID NO: 92496 - DNA, 384 bp, Glycine max
  Peptide Sequence Number=SeqID_209274
atgattcaagaggtcctcatgaagtttatggaaaaggcagtacgatttgatggggatttgaatcaagttgaagtcaagtatcatttagaagttgagaatgtgaatgggattcaattacacacagttgtggaggcaatggatgtagttggtatactagagtatgggcttgctaaagttgctgatttgatgatcaagtatgtcattactccttttgtaaatcatggacaacctctttcatttcttgaggaattgcatcaagaatcggctctactgaagatagttccatcactagatagtaagaagtatttgcttccagaaaagttcttggatgcagtgttttggacggttgacatggccaaggatatcagagctaataatatctag

SEQ ID NO: 92497 - DNA, 138 bp, Glycine max
  Peptide Sequence Number=SeqID_209275
atggagaacatacagcttcaaggagaagaagcagagacttgtgacgatgctcgagtgcgacaaacacgatgcttagatgcacacagggacggtttcgctagacggagattagaagaagaagatagcgcggaagcttag

SEQ ID NO: 92498 - DNA, 127 bp, Glycine max
  Peptide Sequence Number=SeqID_209276
atggagaaaggccaaaaagaaaggcctaaggacgtgaaatcttatatctctcctctttcaaggaaatcacagtgcaccggagagaagttcgaatggagaaaggtacaagtctttctatgggagaaag

SEQ ID NO: 92499 - DNA, 195 bp, Glycine max
  Peptide Sequence Number=SeqID_209277
atggctaagcgagcatggctcgctaagccttattctctgacaaagagtagcaagactgactcgcttagcgtgacacactacacaggcttagtcgagactggctcgtttagcccaggcttattcaagctacagaggcatggtggcttagcgagactgactcgcttagccaccaacagaataccaaaagcctcttag

SEQ ID NO: 92500 - DNA, 549 bp, Glycine max
  Peptide Sequence Number=SeqID_209278
atggctaaaaccatgctcaatgacaactctacacctaaacacttctgggctgaagtagtgaatacttcctgttattcacggaacaaaatttatataagactcattctaaaaagactccttctaaactttggaaaggacgaaaacccaacatttcatatttccatccttttggatgcatacaaagtttacaactctagaaacttagttgtggaagaaggtattcatgtaagattcaatgacacaaagcctgatatagaaatgtcagagcttaatgaatcttttgcagatataagactaggcaaaggcattagaccactgatagaaaaatctacaggaacatatgcatccaatcaagtaatagaacaacctcaagaagaaagagaaacaactagagaaattctaaggaagaaccatccaaagagtcaaatcattggagatccctcaaccaaagtccagacaagaggatttctcagacaacaagattacatagctttcatttcagaagtggaacccaagcatattggtgatgtgatggaagatgagaattag

SEQ ID NO: 92501 - DNA, 936 bp, Glycine max
  Peptide Sequence Number=SeqID_209279
atgcctagagatatgaggtttgtctattcacatcctccaaatctaatcattggagaaacatcttctggagtcaaaacaagagcatccttgaataaaaaaagaggaatgatggatcttctctcatccattgagcctaaaaacattaatgaagcattgagtgaagattcttgggtcacaacaatggaggaagaattgagtcagttcactaagaacaagaaaaatgatgggattttcatccatgaagagaaacagacaaaggatcttctgaaaaggttcaaaattgatgaagccaaacctatggcaactcctatgcatccttccatggtcattgatgaggatgagaaagtggataacaataacttcacattgaaggccactttgaagggtactgagatcttaatctcaaaacaactactaaataatttcttaggagaccctccgatagtgaaagattgtatgatgactgggtggaagattgttcactggatcaacatgctttctgtgaggcccagggctggtacctttcaagaagccactaaacctatcagtcttccctttttcatcattaatcatgtgattaaggccactaaacctatcaagtctacttctagtgtcccctatgggatgttaatgaatttgatttttagacactttggagtgtttatgaagaatgagtctagagatgatgaagtattttcttcgagtgccaagaatgttgctaccttgagcatgaagaggatgaagactaaagctagaaggagtcctttgtctaagaaaaatgaggtgtataagacattcgaagaaaatattgtgaaggaaactatttcttctcaaattgttgtagaatctgacttggaaagtgagatttctaagttagttgagaaacattttaagaaagcaagctctgaagaagctaagaactcaaaagattgctga

SEQ ID NO: 92502 - DNA, 930 bp, Glycine max
  Peptide Sequence Number=SeqID_209280
atgagggcagcaagaagaccgaaggaaagccaagcacaagaatcctcactgggtagtgtcaccgtgaccgctaacagacgtaaggaaaacgctcaaaagatcgccacaccgattaccgtactaaaaggtaaagacctcctgaaccaaggcgtgggccgctcagcccaagaagtattcaactatgtaccaaacgccacagcggtaggtcaacaacatggccgcccacgttggtggatcaggggggtgggtgcagggcagcaacagcaggatttagctagccctattggcttttatctggatgaggtctatatcagcaatgcaaacgccacagggttcccgctatttgatttggagcgtgtagaggtattgcgcggcccacaagggaccaaatacggtaaaaatactacgggtggtgcagtcaatatcatctcgcagaaaccgtccttgaaagaaggcaagacagacgactatatcaaggcagattacgggacatttaatgacaaagtactgcagggtggctttaacgtaccgttaattgaagatcgtctgggagcacgtatctctgtttaccaagaagacattgatggtcgttttaacaacatcttccgtggtactaaagatggcggcctgcaagacggtgctattcgtggccaattattgggcaaaatttccgacgatgcagaagcgttgttgaatgtgcattatcgaaaatataaaaccaatggaaccattacaaccaccaacagctatgctgcaaatggcgtctttagaaacaactatgcaccaagtacgggttataacgatgtcagtaccaacgctgacaactggacggagtcttcacaaaccggtgccaacctgaacctgaaatggaacatcggcaaactggcctttacgtctatcactggctttgagggtttcaaaaacgaaggg

SEQ ID NO: 92503 - DNA, 989 bp, Glycine max
  Peptide Sequence Number=SeqID_209281
atgtggatgagctgcttggataaagttggcatgttgtttgccatcaagcctgttatgtacatcacgatagaggcagccatgagtcaacctactcccgatcaaaagcaggatattcatttgtggtatacccgctgcggcgcggcaacggcctccgcgctcgccatccggcaacagtggttgcaacaggagtttgctggaccaggcacgcagttacattctttgcgagactccgagagtctagagaccaggaattcccactatcatcataaacagtctggcatgtttcgcgagggggggaatattccgccgatctgggcgaaaggattgggtcacgatacggtggtggtcggtattacctggctggacgaatatcaggggattatcgtgcgtgaggatagcgatatccatactattagtgaccttaagggcaaacggctggccattccagaccacgcacaagcggtgatcgattttcagcgtggggcagcacagcatggctttgccactgcattgggcttgtatggtttgacgcctaacgatgctaaatgggttgatattccggcgcccagttatgatttgagtgatggccccagagccgagcgtaacagctttcgccacgttgagttggaggcattgaacgctggtgaagtagacgccatttttgtgcgctttgcacgcggtgtacgtgtcgccaatacgcctggctaccggcaattgatcaatattaatgagcacccagatccttttatacgcgtcaacaatggtacgcccaggccaattacggttgatcgtgctttcctgcaaaaacaccctgatattgttgaccgttacctggcagtgttgctgcgtactgcttcctgggccaaggaacatccacaagaagtcttgcagttgctgactcctgaggcgcagagcgccagtttgtctgaagtgattgcctcacacggcgctaatgtctaccagtcgttcaccccatccttgaaggaaca

SEQ ID NO: 92504 - DNA, 312 bp, Glycine max
  misc_feature (22)..(22): n is a, c, g, or t
  Peptide Sequence Number=SeqID_209282
atggctagaaagatcttaagtncgggttactattggctcaccatggagagcgattgctgtctccatgtgaggaaatgtcacaaatgccagacattcgcagacaatgtcaacgctccgcccttgcctctgaatgtcttggccgcaccgtggctgttttccatgtggggaatagatgtgattggggccatagagcccaaagctgcaaatggaatagaggttgtgctaccgtttgaggtggaagtcccgtcattaagaatcttggtggaatccggattaaaggaatcggaatgggcccaagcacatttcgattag

SEQ ID NO: 92505 - DNA, 363 bp, Glycine max
  Peptide Sequence Number=SeqID_209283
atgtgggccatcattgatgagtacaaagagaagctaaatctagcggcgactcacgagcaaaggctagaggatgagtatgccaagatatcagcagaaagggaagcaagggaaagggggagtaacaccataactaagcatgctccaaggcacccctatcgaacccgttctaaatctagggctatgggtgacatagaggaagtgcaagaaaagatgaaatctgacatgtcggctttgaaagatcaaatggcctccatgatggaagccatgctaggtatgaaaagattgttagagagtaatgcagccacagctgccaccgccagcaccgccgctgaagaagacccgttccatctactgcaaatctag

SEQ ID NO: 92506 - DNA, 168 bp, Glycine max
  Peptide Sequence Number=SeqID_209284
atggatcaacagcacatttgcaacttaacagtgaatggatcttctttcttgggggatccttttgttccttcttccgagggtaaagggaaaaactcctatcctaagtcaaggtttatggccgatgagttgaggttttggctcaaaaggcttgtagaaggccggacatga

SEQ ID NO: 92507 - DNA, 282 bp, Glycine max
  Peptide Sequence Number=SeqID_209285
atggatccaatctcgatcaaactgggtgatgacaattactcaatatggaaggctgaagccttaggaaaaataaaaaaatgcaaccttgagaagttcatcacaatgacaaatttgggtggaaagccacccgtgttcagtgaagaatacaaaagctgggaagagcaggatcaggttctttattggtggcttcttgattccttgcatccggagtttcttatccaaatggaaagatgtgataatgctttggaactatggatggagatagaggtttatttcttagaa

SEQ ID NO: 92508 - DNA, 967 bp, Glycine max
  Peptide Sequence Number=SeqID_209286
atggctgacaaaatgctgaaaccgcgcgcaaagcggggcagttgcgtgattttcgcctttatcccggcgcaaaaaaatgctgacctgggatatacttgctgcgcattccggcaactgtcacggcccccggcggccaggagaggttttgttgcgcgtcagtcgttcgttaacgataaagcagatggccaccgtgtccgccgtggcgctggtcaccatctggtggattacgcccagcagatggagaacgtcgcgcataccgtgcgtcagccgctgtccgaagcggtgctcaaagccgatatcccgcaggccgaacgcattctgaatacccttaagccggcgggcattctgtcgcgcgccgatgtggtgctgccgaacgccttccaggcgctgcacgctgacttcgcgccggaaaaaccggtgccgcgctttgtcgcccggctgttcgaactgccggtgcagattacgctgccgctctattcggtcgagcgcagcgggctgccgaagccgattgcctatctgcacgctgtccaccatgatcaccacctatctgctgctggcgctgattctgtccgtggcgatcagctggagctgccgccgcccgccattctcactcataagctggcgctgccgcacaatcatcgcgacgatgagatcggcatgctgattcgcagctacaaccgcaatcagcaggtgctggagtcgattcacgatgagatgagccggctgaccacccatttcgcggtgaccgatttgcccaaccgcgcgctgtttctggcgctgcttgatcagcacatccgccatcgccacagccagcagccgtgggggctgatggtgatccgcatcgaaaccctgcaggaagccaatggcgtcctgagcgatgagcagcgcgatacgctgatgctgacgctggtggaaaaaatccgcagtaccattgatgaccatacgctgctggcacagaccggaccga

SEQ ID NO: 92509 - DNA, 273 bp, Glycine max
  Peptide Sequence Number=SeqID_209287
atgtcggaatacactgtcacggaagaacttcttccgcgagattgcacaaaagaaccttcttccgcaattgaaattaacaactgcggaagaagcttcttccgtgcaatcctgctgaagaacttcttccgagagagtgcacggaagaaccttcttctaggcatccctgcggaagaaccttcttccgtgcatccctgcggaagaacttcttctgtaggattgcacgaaagaaggttgttaaatcttgaattagtcgatattcatagtttgaagtaa

SEQ ID NO: 92510 - DNA, 231 bp, Glycine max
  Peptide Sequence Number=SeqID_209288
atggcgattagtatgaataaagaaaaggtaacgcttgacgtggcaaaccgcgtctacggaagagggaggccgaaagtggaacgagactactggtactggggcaagccagggggttttttggttcagagtgtaacgagtggattgccacacagcttgtggcgattctcttatgccagagtcattgaggttcaaggtgtgccacaacaagccaacacaaatcggagggattga

SEQ ID NO: 92511 - DNA, 1020 bp, Glycine max
  Peptide Sequence Number=SeqID_209289
atgaaggataattttgatctttcacaaacacacaaacaattaacagattcggtaacagatgcgaaagaaatgttggttatcgccatattgattgtgctcaaatttacggcaatcaggaggagaactaaaggattctctatacctgaagttaagatgatggacaggtgtacagatcatgctccagaagatgtaccagaagctctggacagaacattgagagacttgcaacttgattatatagatttataccttgggagtatgcatatttgtaacattatcaattatatactaatgagttttcctattaagattcactggccaattcgaatgaagaagggttcagtgggctttaaggctgaaaacattgtgccatcagacatacctaacacttggaaggcaatggaagctttgaataaaagtggcaaggctagagctataggtgtaagcaatttctcaactaagaagttgggagaattgcttgagtatgctcgtgttactcctgcggttaaccagtcagagtgtcatcctgcatggaggcaggacaagttgaaggccttttgcaaatctaagggtgtccacttctctggatattcacctttgggttcccctgcctggcttgaaggtgatttccttaaccatccagttataaatatgatcgcaaagaaattaggaaagactccagcacaggtagctcttcgatggggactgcaaatgggccatagtgtgcttcccaagagttctaatccagcaaggataaaggaaaactttgatatttttgactggtccattcctgaggacatgcttgataaattttttgagattcaacagagcaagagtctggtcaggacctgctcgaatcgaaaagagaggagagtctttaagaaggaattcccaggttcaaagaagtatttacgaagtacaaagctaagacaagaaagaggacttcgagctattgggcaattcgaactggtgtatggacgagtcgaagtcgaggcagcaagagttctagacttagcgtaa

SEQ ID NO: 92512 - DNA, 1053 bp, Glycine max
  Peptide Sequence Number=SeqID_209290
atgtatgggctcgagtccaatacaaagtgcaaaggacatggaaaagatagccactgcaaagttcggaagaaaaagaaaatgcttcgggctggaaagaaatctcaagtgccaaagccagtgctttcatcaagaatcttcactggcagagagataaaaaaagcaactaacgatttctcccaagaaaacctcattggctctggtggcttcggtgaagtcttcaagggaacattcgatgatggaaccgtcttcgccatcaagcgtgccaagcttggaagcaccaaaggcattgatcaaatgcaaaacgaggtccaaattctctgccaagtaaaccacagaagcctagtgagactccttggctgttgcttggaacttgaacaccctttgctaatatacgagtatatttcaaatgggacccttttcaattaccttcatcgccactcttctggctcgagggaacccctcaaatggcaccaaagactcaaaattgcacaccagacagctgaagggctttgttatctgcattctgcagccgagcctccaatttaccatcgcgacgtgaaatcgagcaatatacttcttgatgacaatcttgatgcaaaggtttctgattttgggctatctaggcttgttgaattggctgaagagaacaatagccatattttcgctagtgctcaagggacacgggggtatcttgatctggagtattaccgtaactttcagttgacggataagagcgatgtttatggctttggagtggtgttgatggagttgctcactgctcagaaggcaattgatttcaatagggaggaagagagtgtgaacttggccatgtatgggaagaggaaaatggttgaggacaagttgatggatgtggttgatcctttgcttaaagaaggagcaaatgagttggaattggaaactatgaagtcattggggtatcttgcaactgcctgcttggatgagcagaggcaaaaagggccttcgatgaaagaagttgctggtgagattgaatacatgattaaaattgttaggggtcagatttccaaatcatga

SEQ ID NO: 92513 - DNA, 282 bp, Glycine max
  Peptide Sequence Number=SeqID_209291
atgagcaacgaaatccggttcttcgagctaaacactggagctaatatcccttcactagggctgggaacttggctggctgatcctggtgttgttggtgatgttatagctcatgccgtcgagcctaggagtcaagaacaagcctctaagggttctccacttagccacatagcaatgttgcctggcaccataaagatagggcttaaacatcaaattctggagattttacacttattgcacccaaggttgtgtttagtgccaaaaacacatagtttcaatctatga

SEQ ID NO: 92514 - DNA, 219 bp, Glycine max
  Peptide Sequence Number=SeqID_209292
ggcacctcaaactctctacctaactaccttacctgtgaattcttacagaaaaccagtgatgcctcctaaggcaataggaacctccctgagaggaggtcggagttctggaaaaggattcaaattggatctatcagagccaactaccaaaaaaggttcttcggcatcttctgggtcacctacccagactgggtcatccacccagaaaccaaagattgaagg

SEQ ID NO: 92515 - DNA, 441 bp, Glycine max
  Peptide Sequence Number=SeqID_209293
atggtttgtgttgttgtgcttatagttttggtcattgctctgtatccagctgagggaagtaaagcagttgctgaatctggtcgagccaccccagaaattccttcatcgccaaacacaatgaaggacctgggcgtggttgcaatcctgttgtcagtagagttctttgacgtgattgtctacactgtaagcaaagcagccatgaagaaggacatgaatgactctgtgtttgtcatgaaaagagctcttcctctactcacatatttcatagttggccaattatttattaatggcttcttaagttgtagtgttcagatgctcaggttttttggaataggttactgctctcccactttggccactgcaatgtctgatttaatccctgcttttaccttcatacttcccatcgtcttcaggcactcaaacatatcaaagagcatgtga

SEQ ID NO: 92516 - DNA, 954 bp, Glycine max
  Peptide Sequence Number=SeqID_209294
atgctggtaatcgacgccggaaccgatgtgcatatgcacgccgatcagtctcaggccgtagcggcgaattttctccaccgcctgcggcaggtcggcataccagataccgtgcttgctgttctcgccgccggtgttggttttctggctgtggccgtggccaaaacccgggttaatgcgcagccacaccgggtgccctgcggaaacctggccgagctgatccagcatgtcgatggaaccggcgttgaccgggatcttcaattcgctgacgcgcgccagcgtggcgtgatccaacacgtccgcggtaaacacgatttcgctcggttcgccgcccggctgaaaaccggcttgcagcgcccgctcgatctcgcccagcgacaccgaatccaccttcacgccctgctcgcgcatcaagcgcaaaatatgaatgttcgaacaggccttctgtgcgaagcggatagtgtcgaagtggcgcagctgagcaatgcgctggctgatgatgtccgcatcataggcccaaaccgggcagccgaaacgctgcggcaaggccaacaggttagcggcgttcaacgcagtggaggtgtcgtgcaacgggcctgttcgatcgggtgcgcgggcgcttgtccccctaccgtgcagggcctacggttgttcgaagaggtgcagcgctcctattacggcctcgatcgcatcgtcaacgccgccgccggcatccgccagtttcagcaggcgcagctgtcgatcgtgtgcctgccggtatttttcccaatcgctgctgccggcggtgtgccggccctttatcgaacgttacccggaagtcagcttcagcgttatcccgcaagagtcgccgctgctggaagagtggttgtcggcccagcgccacgatctcgggctgacggaaaccaccctgacgccggcgggcaccgagcgggtgacgctgatgacgttgaacgaagt

SEQ ID NO: 92517 - DNA, 360 bp, Glycine max
  Peptide Sequence Number=SeqID_209295
atgctgaacactcctagagcctctcaatatcgcccattatcacaacccttgcatttcgtgagaggagaaggatctctcgtagtatttgagaaggaaaagattaagcatatagaggagaggttacacaccatcgaaggaaggggaagttatggttttgccgacatgtcagagttgtttggtacccgatgtgactattcccctaaagagttcaaggtgacagattttgataaatacaaagaaaccacttgccctaagaaccacctaaggatgtattgcaaaaggatgggggcttatgcgaaggacgagaagttgttgatgcatttatttcaagaaagtctggttggggcagctattatctag

SEQ ID NO: 92518 - DNA, 279 bp, Glycine max
  Peptide Sequence Number=SeqID_209296
atggaagtcgaagctaggcgaatcaggaggtttgtgcctcagaggccctcacaccgcactattctcccgcttcacgcttcttcctcctcccacaatgtttccaacaccatttcctgctggtattgcgactacaaaatctgctcgtttaatagacctcttttccactttggtcgccgatacgccaggtttttgaaagtgtggttttcgattggggttgggtttgccctctctgctgtactcggagtcactttggtgagagttttggtgtttctgaattga

SEQ ID NO: 92519 - DNA, 249 bp, Glycine max
  Peptide Sequence Number=SeqID_209297
atggctcgacggcagtcaacgaaggtcaatagtggcgaaggatactgttcacccatgaataaagcgctctctaaggcagaaaataaaaatgtagcggttcgaatccagaatcagtctctttacatatgcaagggtaaggctgcgtataatgaccctcctccaaacctttgcatagcgaggaatactgggatttggtcaaacttggttttagtccctacattttttatagatggtgattttgatccttga

SEQ ID NO: 92520 - DNA, 204 bp, Glycine max
  Peptide Sequence Number=SeqID_209298
atgaaaagcagtgagggaatacaagtagagtacattgccgtcttcattgcgattctatttcctggtgctctggttgccttcaattatgaatttttgcagactttgcctcatttgactgccctgcgtgtgtattctgctggcatttggcacaatgcagttgccatggctcaatgcttaggttctgcactaggcctagatgtttaa

SEQ ID NO: 92521 - DNA, 1308 bp, Glycine max
  Peptide Sequence Number=SeqID_209299
atggctgctttagacatcagcgacacttgggaacttgtccctttacctactagcaagaccactgtgagtttccgtggggtttatacaatgaagatcaaaccagatgacaatattgattgctataaggttcgcttggtggctaaaggatacacacagatttttggccttaactacgggggcaccttttcccttctggccaaaattgcttctgttcgtctctttcttgctatggctgccattcaacattggcctctttaccagctggacatcaaaaatgccatcttgcatgacatgggtccactcaaatacttcttagggagtgaagttgcccaatcctcctctggcattgtcatttcccaatggaagtatgttttggatatcttaaccgagaccggcatgcttgattgtcgtcctagtgatactcctatggatcctaatgtgaagcttctcccggacgtcacttttgcaattggtcgtggattgctatatgaagacaaaggcaatgccaaaattgtttgctactttgatgctaattgggtaggatcaccattaggaagtaggtccacttcgggatattgtgttcttattggagggaacttgatctcatggaggagcaagaagcagaaaactattcctagatccaatgctgaagctgagtatcatgccatggcagcagctgcatggagagtgagagtagagcaaccaacagatagagcggatcccagacaaaactacaaaggaaataggtttggacagcagggcaattggaggaacagaatggacatcacctcatactattttactaggttctctgatgaaacaatggagaaggagctttggatggaattcaaaaaatggggggatgtaagggagatattcgtctctagacagaggaataaaagagggcgtaggtacgggttcgtgagattcaagggagtgacggacgataaaagacttgaaaggcaacttgataatatcatcattggaggtctgaagatgtatgtgaatttaccaaaatatgggagagataacagaacacaaagaagctttacagccaaccacggcaggcagggccaagcagaaaatgtgaatgacgaaatagcagcagctagagatgtagcagcacatggtattgcacccaaaaggacgtacgcgaaaatactgaatacaagcacagtgaagataggacagaggaggtttttaaccaggaatcaacacagtcagggggggtctcattcttcggtccaactacaggtgggggagaaaggatggtacacagacgcttgggtgggaaggctgaagaaatag

SEQ ID NO: 92522 - DNA, 603 bp, Glycine max
  Peptide Sequence Number=SeqID_209300
atgtggaggttgtatgacattactcatgagtcaaaggattatgttatggaagacctaatagccaccagatggaaaccgttgagagatattgggcgtgccgttccgatcagggagagactggatgagctacaaatacatgttgttatggggtgtacacatgaggaccacagggatgtgaggccttttgcacaacaatcccttttctttggcttcatcatatgtgggactcacgtgaggccttatcgttcggagagggtgctgaggctgacacctaggactctctgcattgattttacaagatttcccatccctatgtcattccaccaaaggaaggatagccgccacgtggtcttgtacgattaccgcccattaaagtacaaccacaacttgggcagccaatgtagactatgtatgaggtggagactactgtttccaggattgattccagatagcgttagaagctatgcagagcttgttagacctaagagttgtgccaaagggcacaactcatcatcaactcatacaacaagctttggaattgtagtaggagggcttatcagttgggtgcagcttagaggcatagagacccaggaagaggattga

SEQ ID NO: 92523 - DNA, 468 bp, Glycine max
  Peptide Sequence Number=SeqID_209301
atggcttacacgaagcagatgtcgtatgttgttggatgtgacccctcctatgaaggccattgcaacaagggatcattagacctccatttggaggaagtccatttgatttgtcccttcttcagtcgtatagcgattattgtgttgggcacatttggattcgttatgagtggtctgagacctttttggagagctcacaccaagagatcttccttccacctgcctattgaagagatgatcatcactctaaatgatatgtctcgcctactacaattgcctatgacaagcagacctattggtcatgtcctttcacactttgatagaaaggtggtgaagatcctcatgatgagtcatttgggcattttgacagtgacaaaggcttttgtggtagcaaacacaagtgtcaaggtgaggttgatgtggctaaaagacctttaccactgctacattgaatcaggcctgtttgtttga

SEQ ID NO: 92524 - DNA, 243 bp, Glycine max
  Peptide Sequence Number=SeqID_209302
atggagggtcttattccttttgtttacaaggctatcatgcaatacaagggtgacaaagacggtcatcctataggatcatggctttgtgagtcaccttcttactcatacatgagacttcctgctggtgactcagcttcaccctcttccaccaaccctaattcttcttctgctacacaaatcattgtttcctctggtgttcagtccccacatcagtgtcttacacatcgtcgaattgcagcatga

SEQ ID NO: 92525 - DNA, 168 bp, Glycine max
  Peptide Sequence Number=SeqID_209303
atgacgttggataaaggagttttggatgagagtccagctcttcacgcaaagccaggaaattttcaacgcaagctcacacgtgagtacataacatatctgactctatacatgcattaccttccttacctcaccaatggcattgatatcattgattctaccatgatataa

SEQ ID NO: 92526 - DNA, 799 bp, Glycine max
  Peptide Sequence Number=SeqID_209304
atgagtacttctaatcaagttaaagaacaaggtgatgacaccaaacctttatggaattatgtttcacagattaaaggtgtaagtggaggcggtggaaattttgaaataactccttcaaggcttgcgaaacttacaaagatggataatgaggctgcattaagaataaagaggtcaaagaaaaaatttgtctctttaccaccgagtgatcctcaaaaaagacctcttatcaatttcatggttgtgaccaagagtggaccaatgtttttaaaggccttagattgttctgatgaggtaaaagatagggatttcatagctgaacaaatgagggatgtaattatggaggttggtcacttgaatgtagtacaaattgttactgataatacacttgtatgtaaggcagcagatgatattaacaaggcaaaatctgtgaaaaagacattgttggatgacatttggtgggacaaggttgattatatactttctttcactactcatatctatgatgttcttagaaaaacagatacggatgctgcttgtcttcatttggtgtataaaatgtgggactcaatgattgaaaatgtgaataaggtcatataccgacatgaaagaaagggagaagggcaagtaaatgtagagtttgcaaacttttctggtgaaagagaagactttgatgaaattgactctttaagggatagaggtctaatagagacaaagtcttggtggctagttcatggtgctcatgcaccaacacttcaaaagattgctcttaagttactagggcaacctcgttcatcatcat

SEQ ID NO: 92527 - DNA, 174 bp, Glycine max
  Peptide Sequence Number=SeqID_209305
atgcagctacgaagtagatccacatcaacaagagcaaaggaggtgaaacacacaaatcgcagaatcggtgatcgaaacgcaccttgcgcaaacaaaaccctatttgcaggggaagtggttcggtggtggagcaaaggcaaaagcagcagcaacaatagctgcaaagggaagtga

SEQ ID NO: 92528 - DNA, 573 bp, Glycine max
  Peptide Sequence Number=SeqID_209306
atgtttatggaacttgttcctgcaaagtgttctatgcttaagttcttcaagttcatatcatggaagatcggaatggcattaatcagagatgccgatatcgtattagaggtggacacaggccttcaaaatagggctccaaatccactgcaccagaaacttccgtccattcctaccgctaagattaaacgttctcccttcgccatctttcataacggaaccaatatagccaccgccaccacccattccgtacaagcccttgtacaaatcttcgatctcggtgggcgcggtggggtcctcatcggcgtactacgtgttcacgagcgagttcgacgagagctccgccagctcgtgcccgatcacactcaccatgtcgtccaccccgatgtctccgttcgacggtatgaggtggccggggccgccgctacccatgtacccggggacggcgaagggataagcgcaaacctcaaggcactgtttttcggagttccccacccacgcgtaattcagagaaagtgtcatacagcacaaaagaatttcaaattctttcataaaatgaaggatttgaaatgctaa

SEQ ID NO: 92529 - DNA, 397 bp, Glycine max
  Peptide Sequence Number=SeqID_209307
agttcccaaatgtcagggagacggagaagggattgaagcctccattctatactgcttcatgcgatgcatatttctccctccacagacatgttttttcaaattccaacggtggaggtttctgtgggaaaggaaaaggctacgatacgaagggtatttctataagctcagacatgatatcgaaattcccaacagtgagaatgctcagaattgggttgcgaatcaggtgcttaaatttcacaatgatccaacggtgaatgagttcgagatcattgtttttctaagaccaggaagagtcttgaaagatttgggacttgaaatattgtcattaggattgcatgttcatgatgaagggatagataatcttggctctacgtggatagaaaaatattgtgcatga

SEQ ID NO: 92530 - DNA, 336 bp, Glycine max
  Peptide Sequence Number=SeqID_209308
atggctgccccaaagagaagccgcaccagaaaatatatgacctgccagagatgggtgatgcaaggggacagtattgggtcattctttgaagtgaaaggttgtgaaatgtgcacatggggggaaggaggttttcattcaactggcatgaagaggatgggaggtggacatggtcatgatgagccctactatcttcatgcaaagcacatgtacaacttggacaagatgaagcaccaggggttgaaaatgtcccttgctgtgttcactgctttcagcattggtgttgcagttcctgtgtatgctgtcattttccagcaaaagaaaacagcttctgcctag

SEQ ID NO: 92531 - DNA, 228 bp, Glycine max
  Peptide Sequence Number=SeqID_209309
atggcgcttagctcaatcaaattgagtttaggctgcaagaaggtcagcttagccaccatgattggcgctcagctccatgaaccccagttcttttcgcaaagagatgagcttggcggcaacgactcgtgcttagccaaagtctcagccttggccaacttagcagatcaaatcagcctcagatgcaagggttgggcgctaagcactttagactctcagcttagtgcatga

SEQ ID NO: 92532 - DNA, 228 bp, Glycine max
  Peptide Sequence Number=SeqID_209310
atggttcagcccactgatccaagatcaagtccaagattctccactgtggaagcaagactacaggagattttgatgatgccaacagtcaagtgttcttcatggataattcaagtgaacttcaagaaatccaagaaatacaagttacatctacaagttagattctcaagttggatttacaagttatatttgaaagcacaaagtgaattggtaatcgattaccagtcttaa

SEQ ID NO: 92533 - DNA, 183 bp, Glycine max
  Peptide Sequence Number=SeqID_209311
atgaaagatgaaatcattttggtgagggagtggaagaacacaacaaaaggaaatacattagttggaacaagaaagcaatcatggaattcaagactgccatctgtcatggactgtcccgacctgaaagatgaaggggagaaaatggaagaggtattaagagatctgatattgctagaaaattag

SEQ ID NO: 92534 - DNA, 690 bp, Glycine max
  Peptide Sequence Number=SeqID_209312
atgaagtgggaaagtataaccctctcttctcctacaccttgcactccaaactccaacaccaattggttggtgatggaggataataatagaagcagcacaaaatggacctctgaagacaagaagctctttgaaaatgctcttgcagtgcatgataaggacaccccagatcagtggcacaaagtggctaagatgattctcggaaagatagtggttgatgtgataaggaagtacaaggagttggaagtagatattagcaatatagaaactgttttgattccagttcctggctatagtagcattgctacctcacctttcaccttagattgggtgaacactcatgggtatgatgggtttaaaggatatggaaagagatcttcctcactgagaccaattgagcatgaaaggaagaaaggagtgcctaggactgaagatgaacataaaactccaacacaggttggtagtcatgctcagaagtacttcataaggcagctttcaggaggcaaagacaaaagcagggcaagcatacatgacaaaacaacagtgaatctcacagaaaccataacaacttcttcagaagacaccaatagatccacttcaccacatgtgctctcaagcaacaacagccaaattctactcctactacaccaagaactcgttttcaatggagtagtcagtctaacacagggataa

SEQ ID NO: 92535 - DNA, 864 bp, Glycine max
  Peptide Sequence Number=SeqID_209313
atgggcctcatcaaggctatggaaccatacaaaaagtatgataggattgctagtcgagcaaggcttcctattaggaaggtgtatgagaggaggaagcttgagctcctgattttctccagcgacgatgcgtacggttggacgcaccgtttggaacgatactttgagttgcgaaacgttcatgaggaagagaaattgtgtgccactgtggtggccatggaggatagagaactaagatggtatcaatggtgggctaggtgcaatcctgaactgacttgggatgggttcaagttggcggtggttcgcaggtttcaaccttcaatggcacaaaatccctttgagttgttgttggcactcaaacaaacagggacgatggtggagtttgtggaggagtttgagaaatatgttggagctttgaaggccattgatcaagaatttgcacgaggtatcttcatgaatggcttgaaaaaggaaattcaagtcgaggtaaaactttatgaattaaagtctctgtctgatttaattcaaaagtctattatgattgaggagaagaatctagtttggactaagaagggaaccaacactttcactaagccaaccactatttctaaggctagttcttacactaagtctgtgactgtggataccaagccttggttagataggaaaactgagattggtacctctgctactaatcttgtgagtgttcaggctggggaaatgaataaaaccaggggtggtgatttcatacgtttgtctggggctgagatgagagacaaaagggagaagggactatgtttcatatgtgatgagccctaccatagagaacacaaatgcaagaataagcagtttcatatgatcatttaa

SEQ ID NO: 92536 - DNA, 3050 bp, Glycine max
  Peptide Sequence Number=SeqID_209314
ataccccttcttacattgtggaattgggagatggtcatagactgaaatgtaagggaaagtgtttcaagttgagtttgctattgcaaggaatggagattaagcaagacttttattttttcaccttacaaggggtggatttggtgttgggtttggattggctgtctagtttgggagaggtcaaaaccaactttggcaagttggagcttaccttgtctagagatggcaagttgattactttggttggtgatccttccttaactaagattgaattgtcttatggagctttcatgcaaattttgaaggaggaagggaaaggcttgttaattcagtatgattatgcagaacagaaatcaatagaggatcctcaaggtcttccaccccaaaggaggttagatcatgcaattcatttaaaggagggggttgagatacctaatctacgaccttacaagtatccacactatcaaaaaactgagatagaaaggttggtttcaaaaatgcttgaggttgggattataagaccaagcattagtccttactctagtcccatcatcttagtcaagaagaaagatggtggttggcgtttttgcatggattatagtgctctcaacaaaattactatccctagcaaatttcccatccctatcattgaagagttgtttgatgaactggatggagcaacaatattcactaagcttgatttaaaatcaggctatcatcaaattcggatgaaggaagatgatatagagaagacaactttccgaactcatgaggggcattatgagttcttggtgatgcctttcggtctcaccaatgcttcttccacattccaagccctcatgaatgaggatttggatgttcatcttgttcatatccaccaagtcttagcaatactgatgcagaatgggttgaaggcaaataagaaaaaatgggtggcagcttgcccttccaagacggcagccataacttcttggcctattcctattgatgtgaagggtcttaggggtttcctaggactaacagggtattatagacgttttgtccaaagttatgccatggttgatcttcccttgctggttgtacctgatgtcactaaggtctttgtagttgaaaccgatgcttctagtaaggggttaggagttgttctgatgcagaagggtaaacctcttgccttttggagtaaaggcctatctttgagagttcaacaaagatctgtttatgagagggagcttatggctttggttcaggctgtgaccaaatggagacactaccttttgggaaaccatttcattgtgagaactgaccaaaggagccataaattcttgactgatcaacgattgtttagtaccgagcaatttaaatgggttgtcaagctcattggtttggattttgaaatccaatacaaaccaggtaagaagaatactgcaacagatagtttgtctaggagagatatgtatgttgccatctcagtcttacatgtggaagatgatgattcttgggatgaggaattacaacaagatcctaaattgcaacagttggtgcaggacttaattgtctctcctacttctcatgttggttatgagttcaagaagggaaggcttttgtataaaggcatgaggggagatatcaagaagtttattgaagaatgtgatgtgtgtcaaagaaacaagtactccactttatctctggcggggctacttcaacccttgcctattccttgccaagagtggcaagacatctctatggattttgttggtggccttccacgagttagaggcaaggatacaatccttgtagtcattgatagacttacgaagtatgctcacttctttcctcttgggcatccttacaatgctaaggagatgcttaaagttggatgccatgatttccttacaatgcttatgaacaccattccatcaaagttggatgatgtcaatcagttggcccagcaacgagatgatttgcttgaggatttgcgacaaaacttgttgaaatctcaagaccagatgaggacacgagcaaataagcaccggtggttggtgaattttgaagttggggagtgggttttcttaaaactccaaccttacaaattaaaatccttggctcatagaccatatgctaaattggctcctaagtattatggtccttttcagattctaagccgagtgggggaggtggcttacaagttagatctgccccttgaagttaaaattcatctggtgttccatgtttcattgcttaagaaagctttgaaacctcaccattcacctcagactttgccaccaatgttgaccgaggagcttgaattagctgtacagccagaagatatactgcagtggaggaatgatgttggaggcaatatggaggttttggtgaaatgggctcatttgccatcttgtgataactcttgggagcgagcttccaagatgttggaggtttttccttcctttccccttgaggacaaggtagttcttttaggggggggtattgataggattgctagtcgagcaaggcttcctattaggaagggtggattggttggaactgaattgcagttaaagggcaattcagttggcatctttgtaactactactctattcaattttttcagtttcaataatacactcttgggagagactattttgattttcgctccttcatctattcttgagttttcttcagatttcaccaccagttctaacacggtacatcaaactatggtggaggccaaatgtgacaaggggcaacttaatgaagaaactcaaagggagaagcttccaaatccatttcaggctgcgctagcatcagcactggcattttctgttggtgttttggtgccaccgatagctgctgtgtttataaggaatcacaagattagaatgggagttgttgctgctgcggttagcttggcattgttggtgtttggaggagtaggggcagttcttggaaaaactccggtgacaaggtcttgtcgtagggttctggttggaggttgcatggctatggccataacatttggcctcaccaaattgattggctctgttgatctttga

SEQ ID NO: 92537 - DNA, 216 bp, Glycine max
  Peptide Sequence Number=SeqID_209315
atgtggatttttgtcggtcatgttgagctgcttaaagtcaatttccgcacgatccataagatttcacaatgttttggagccttggacccatctaggcccattaggaagcttcaacataaagcaaccagctcacttgggcgagctaagctcgcctgggcgagtaggttgcttctggaggaaggggttcaacacccttggtattcagatttcacttaa

SEQ ID NO: 92538 - DNA, 339 bp, Glycine max
  Peptide Sequence Number=SeqID_209316
gtgcgggaccatatggttcccctgcatgtcatcagacccgctgtctctggatgacaaaggtggaaaaaggtgcgggaccacatggttcccccgcatgtcatcagatccgccgtctctggatgacaaaggtgaaaaaaagtgcgggaccatatggttcccccgcatgtcatcggacccgccgtctctggatgacaaaggtgaaaaaagggccatatggttcccccacatatcatcggacccgccgtctctggatgacaaaggtgaaaaaaggtgtgggaccatatggttcttccagatgtcatcgggctcgccgtctttggatgacaaaggtgaaaaaag

SEQ ID NO: 92539 - DNA, 456 bp, Glycine max
  Peptide Sequence Number=SeqID_209317
atggcgaggacgtgcagttctatgaaggcgaggacgtgcagtcctctgaaggaaatgatgtatagccctctgaaagcgaaggcatgcaaccctctgaaggcaaggacgtgcagtcctcttaaggcgaggacgagtagtcctctgaaggccagagcgtgcatccctctgatggggaggatgtacattcctcagaaggcgtggacctatagtcctctgaaggcgaggacccctctgaaggcgaggtcatgcagccctttgaagatgaggactcacagtcctgtgaaggcgaggacgtgtaatcctctgaaggcaagggtgtgtagccctctgaaagcgcggacgtgctgtccactagcgtgcagccctccgaaggcgagtatgtgcagtccgcttaaggcgaggatgtgcagtcctctgaaggccagcgcatgcagccctttgaaggcgaggacctaa

SEQ ID NO: 92540 - DNA, 252 bp, Glycine max
  Peptide Sequence Number=SeqID_209318
atgcaaattgagaagctggaaagaaaacacaacacagagattaataccatgaagcagtacagtacaaagagcaaattaccggagtctgcattgcaaccactgtatagagaggattttgatgtgccgcataatgcaacttcctcctatacttatgatgatcaggcatcaagagcagcagagactgcgcatatgataaaaatcaaaacaatttgtctggcatcagatcctacttggattaaagggaattcctaa

SEQ ID NO: 92541 - DNA, 393 bp, Glycine max
  Peptide Sequence Number=SeqID_209319
atgcctaactctctaaaaatagtccgtagtggagtcgctaactgtcgcaacctacccttcggcgaaagggcgacgcggggctcacgggtgcgtcttccaagggaggaaggcgcgcggagtcgccacctacatttattcgaggaaaacgtcggaaaaatcggaatgcgtggtctacgaactttaagtgtgaaaggttcgggagttgtttttacgcatggggaagaagcaagtttcatgatgatgaaccaagaaattttgatgatgccaaaagcccaagtgattgattcaagattgattcaagacttcaagatcaagcatcaagaatccaatccaagattcaagattcaagagaagaaatcaagaagcaacaagtcaagacttcatataggataa

SEQ ID NO: 92542 - DNA, 236 bp, Glycine max
  Peptide Sequence Number=SeqID_209320
ctactaaggaagacgttgatcttgttgtcgctaccgccaaagctgccctctcccgcaacaagggcgtcgattgggcctccgcttccggctccgtttgggctcgctacctccgcgccatcgctgccaaggacgatgttgccggttgctttcagttctacgctgaccttgctgaaaaatcgaacgcacagaaaaaggctcatgtgtctgatgtgccatcattttcttctattttctaa

SEQ ID NO: 92543 - DNA, 2490 bp, Glycine max
  Peptide Sequence Number=SeqID_209321
atggatgccacttctataatgcatttgttgaagggcttttgtgatcacacacaatggaaatatgctggtttttggaagcttgaccaacattttcctatgacgttgacctgggaaaatggttaccagaaaagagatgaggttaaggaaagtatgtggggtgacctcagtttcaaatccccagatgagttatattcttcaagcggtgaaaattctgattattcggctcgattactcttgattgaaatgtctcatcgcaaatacagtttgggagaaggggttgttggcaaaatagctctcgccagggatcattgttgggtttcatatgaggatattctcaccagtaaatttgacacagatttaatcactgagtgtcctgatgagtggctgcttcaatttgcatgtggcatcaagactattgtgcttgtaccagtgcttccacaaggggttttgcaattcggttcatttgaagcggttgctgaagacaaggaatttgttaccaatatcaaggagaaattctattccactcattatctggaagcagatattacccctttaaatttgggaactgattgtcaagatgtgtcattctcagacctaatgcataatttgatgggcagtttggatgaatcatcatcttctgttacaaaaagtatattgaaaagtgaagtttcaactagtcctgctgccctcaattcaaatggttcaaggttgaacccgactatgctatcatttattcaggatgactgtttcttttctagagaaaatttactagaatctctgaaaagagaaaatgaaaatgagataggttcctcatcaactgagatgccaagacatatcggtaaggtggagacaaaacctaatcatatggaagagatatggtcctggtctcacttgctcaacaatgttggagtatttagagagatgtcaaatggattagactcttcctcggttataaatacaacacagaaacaacttggaggcattgaaactggccatgatgctaagaatgtgaatgacttcgcttttccctcagagtctgaattccgcaaagcacttggatcagtttcatatggagagacaggcaaatttatgtcaaaatgtatctctgttgaggaaacatacagtaactcaactcttgtaatcaacaaaaaagagcatgatcatattaaaggtttggagtttcccaaagatgttgatctggaatatcttttagatgctgttgttggcaatttttgtggtgctgctgctgatacttcaagtatatccaacagtgttaggtctcttacaaccatgccaacagagtttaccagttccattcagccagaaaattattcagaagaaagcactttgattgtggatagttcagatgtgaaaaatgatcttatgcctgcaatcatggtcaagggaaaagatgaattttctaaccattttacatcatcttttgatggaaatgcaagcttattgattgacgaggcacaacaggaaaaggctaatagtcatatgcagcctattggtggaccaaagctctctagctcaagcaagaaaagaacaagagttggtaacaaccaaaagtcaaggccaagagatagacagctgatcatggacaggatgaaggagttgagagaacttgtcccagaaggtggtaggtgtagtattgacaacctcttggaacgtaccataaagcacatgctgtacttgagaaagataacaagccaggctgagaaactgaaacgaattgctaatcgggcggttcccgagtgcaaaagacagaaagtcaatgctagccacccaggaaggagctgtgcatttgactttgaaagtgaagtatcttggcctatagtcatagaagatctggaatgctcagggcacatgctcatagagatgatatgcaacgagcatggactcttcttggagattgctcaggtgatccggaagctggatgtcaccatcttgaaagggatcttggaaaactgttccagcaacagttgggcttgtttcattgttgagtcgatttcaggcaacggtgcacctactgcaccgacaccaacttgggtgaagtctcagcctctgcacaactttgtcctcaatgtcttgaaatggggcatgaacaacatcaacaacgcccaccaccaacaccatcgtcgcccctacctcccaatcacgcctctgaacccaattcctgcccccatcgccttgaatctagaatcgcctacaaccaagtctccctccctctcaaaccaccaccaccacacagagccaagcacaacaacgtcaatgactccgtccaaaactggtggaaccttcgccatcgcaaacccacactccctccccaaggccgccctcgagattgacactaaaccttcttttcccaccaccacaacgccagcaacaacagtgacggagaattccaagacaacaacaacaatcccacgacaaagtcactctggctccgaggaaaaagagcaaattctggattactttctcccatga

SEQ ID NO: 92544 - DNA, 222 bp, Glycine max
  Peptide Sequence Number=SeqID_209322
atgagggccccacagacagggacactgacagtgacagaagctgctgatgattctactgcactttggagcgcgtgggaaaaggaatttccactttctaatgacattaacagtaacagtaacagagacaagttctgttttcttgttgaatcttctcctcgggattctctcttcattgcaaaaactcattattgcacattgcccaaggaagcaaaactcgtataa

SEQ ID NO: 92545 - DNA, 306 bp, Glycine max
  Peptide Sequence Number=SeqID_209323
atggctggaatggactcctgggaggctgacgagacaatcggcgccggtctggcaagattccgatgtcaggaagtcagggcatggcgctcacgcgcgagaagaagcagcggctggcggcggcgcgtgggtggccggatggccacgcgacttgtggggttaggtcgagcttctcaagacgcaccaaaccctactgtcaccaaagaaaaatggcagcgaacgacggcaacgcgacggcggacgacagcgtacaagatatatatagagtacataagaagagagagacaactcacatacaaaataacctaa

SEQ ID NO: 92546 - DNA, 201 bp, Glycine max
  Peptide Sequence Number=SeqID_209324
atggaggaagctattcaatccagaagcactgacaccgtgattgatcctccatcccccatcagacgacacgtgaagtggaagatggcctgcacgaagaaaactagccaaataacgtttgaggcagcaaaggaaattgctgagaagattgattcgttggaggagcaggcctcacagggttcgtttgtcacccatgggcgttag

SEQ ID NO: 92547 - DNA, 405 bp, Glycine max
  Peptide Sequence Number=SeqID_209325
atgcaagatttcttgaagaaggaagagaacataggaatgttgcctatacctattattgttcaagaaacaactccagtaatagaaaataatattccaattattgttgataacattgttcaagaacaagacaagaatgagattctccctcaaacacctatacaacaacttcaagaagtgtcattaaggagatctattagagagaggagaatttcaatcccaaatgattatattacctttctccaagaacaagaggatgacattggtttaacaaaggatgatccaatctacttctgtcaagctatgcgtagttctaactttaaaaattggatcgatgccacaaaggatgagatgaaatctatgcaagaaaatgatgtttggaatcttgtcgaattgctaaaggtgtga

SEQ ID NO: 92548 - DNA, 363 bp, Glycine max
  Peptide Sequence Number=SeqID_209326
atgggggattgggggaattttctccaccgaatccttgaggaggattctgaggattccgctccgattaaaatgttcctcttggttgggggttcgacagcaagcaatgacggctcgtggcggccaccggtggtcgtgggtggtggagaaggaggtgttagggtttgggtggcgtttggagaggaggagagagtgaaaatcatgttttttacattgaagaacggtgttacaacgaccatggtcgaagaagctacgagagtctgtttagcagactttcaagagatagctcctctagccaacataaatatgtatccaaatgtggaacatttactgtctttgcatccagaaaaattagagtctttgtag

SEQ ID NO: 92549 - DNA, 336 bp, Glycine max
  Peptide Sequence Number=SeqID_209327
atgaagctaacaaagacactccttccttcttcctctctaaaattggcacctctaaaaccttgtccatcgcctccattgcctcaccactcctctgagtttagggaagatgacttcaaggtcaatgtgtctcccaacgagaaggagacgcgaacgtcactatggcatcaaactaacacgatatcatctccgactttgtttgatggaggggaagggcaagtttgcaaagtggtgaatgtcggaggtggaggatgcagagcagtgcatgtacaattagaccccgcaggatgcctagtcataagtggggagcttgggcatcctaacaatccttgggtgtga

SEQ ID NO: 92550 - DNA, 474 bp, Glycine max
  Peptide Sequence Number=SeqID_209328
atggtcccctccattttccagaaatttcgatgccttcaaacaatgcaatccgcgcgtgcggtcctgatctcgccaacaaacgcagcgttgttgtcgattccctgcgttttggagccccgtgttgtcgtttaccagatcggagatttcctcgccatgaacgaaaccgaagcggtggaggatgcgagggaggtggtggttgtgaaggaggaagagcgtgcggagaaaatggtttacatgtggggataccttcccggagcctcgccggagaagtctccgatactctctccggcgcctgtgactctctccgatccttcactggccgtagattcgtggaaggacgtgtgcggcggtggttgcggattcgccatggtcatctcagagaaagggaagctcataacgtggggttctgcggacgatgaagggcagagctacttgatatcagggaagcatggggtaatgcagttagtgttctaa

SEQ ID NO: 92551 - DNA, 198 bp, Glycine max
  Peptide Sequence Number=SeqID_209329
atgaagttcccaaaggcaatgtatactacaaaggccatgttggactacgtctattttgactgctgggggcctttgagagttccaccattaggaggggaggagtttgagagatccacaatcaaaaacactagtgatcagaagcaatttgaagcacttgatgagattgatcaagaacttcaaatgcaccctcaacattag

SEQ ID NO: 92552 - DNA, 276 bp, Glycine max
  Peptide Sequence Number=SeqID_209330
atgcaaatagaggatagggtcacgatcgacagatcatcgtcccttcccggcgctggacaagcggaaaacgttgctgcaaggcagcccagggatggccttaggattatgttgtattctgaagcaatggggcatgccacattgcccccattctcttgctatttatgcctaagcatgcgcccaacaagtgctcggagaaatgccccaatgacatatgaatatggttttgaaagattgggattgtgggactgttttatatacatagaggattcaaaatag

SEQ ID NO: 92553 - DNA, 390 bp, Glycine max
  Peptide Sequence Number=SeqID_209331
atgggtactaattttgagtcatgtttccacctatgccaactaacacaaccacttctaaaggcatttgggtatgggagcatagtgttgatatcaggtctcaaagcttttccactttgttctacttatgcaaccactaaaggagcactgaatcaatttaccaagatggaattggcaaaggataatattcgtgcaaataccgtggcacctggtcctattaagactttacttttggagtatctcattaaatctactgctgaagtgcataagatggttgtggctatggaatctcaaatgacagttggtcgtcttggagaacctaaggacatatcaacaccgattgctttcctttgccttccagctgcgtgcgatgcttcatacatcactagctaa

SEQ ID NO: 92554 - DNA, 474 bp, Glycine max
  Peptide Sequence Number=SeqID_209332
atgttgcatgaagatcctggtaatatcatctatttagttgttgatggcttatctgattgggaattgagggagtcaattgaactacctctgatgaatcatgagctctttcttcgagttggaattaaacctccaaaggttgtttcggccagtgccataattgacaagtacattggagaaaatgccaagttaatgagagagatgtttggttatgcacgtgatcaccagtcgtgcatcatttttatggatgagattgatgccattggaggtcgtcgtttcaatgagggaacaagtgcagatcgtgaaattcagagaacgctaatggagctgcttaatcaacttaatggatttgatcaacttcgaaaggtagtgggtggtagggatttaatggggctgatctttgaaatgtctgcacagaagctggaatggcagcaattcgggcagagcgtgattatgtggtccatgaagattttatga

SEQ ID NO: 92555 - DNA, 192 bp, Glycine max
  Peptide Sequence Number=SeqID_209333
atgggggagcggtggagacagtttaagtctgatttgacttcgaaatgggcacttgcaaccaacaaggacggtgtcaatgacacttttcttgaaaagaagttgatggacgagatgaaaaagaaacaactggaggaagctgctcaatctggaagcactgaccccgtgattgatccttcatctcccatcagatga

SEQ ID NO: 92556 - DNA, 300 bp, Glycine max
  Peptide Sequence Number=SeqID_209334
atgtgcaagaaggagcataagtcgttcaaggaatatgcccagaggtggaggaacttggcacttcaagtagcacctccaatgatggagagggagatgataacaatgatagtagacacgttaccggtgttctactatgagaagatggtgacttacattccttcaagctttgttgatttagttttcgccagcaaaaagatcaaagtgggtctaagaagaggcaaatttgattatcctactttgatgaatgggaagcctgggggaatggagagaataagaatgagggaggaaaccatgccgtga

SEQ ID NO: 92557 - DNA, 849 bp, Glycine max
  Peptide Sequence Number=SeqID_209335
atggctttgagaaagcttccatcaaagaggttcaggaaggacaccgtcagagaaggctccaacgctgacccacaagctaacactgacttcgacagcatcgatttcagagcggacgatgagttccctgattttcaggaggagataggctgcatgcactgggcgccactcatgacacccatggctaaattcgacccaaagatagtcatggagttttatgccaatgcttggcctactgaggagggagctcgggatatgcgctcttgggtgaggggccagtggatcccctttgacccagacgccctcagtcagttcttaggccacctgctgattttgaaagagccagaggaggagttaggtctcggggagatgggtgatgatcatgcgcaccagcatgaccaccctgacccagatatggatgacattattcctcaacaacatcctactcagaacgacgcctacaagacaccctatggacctggacaggtccaacagggccctggggttcccagctttgatcataggcctctgccaggccagacatcacagcagcctaaggaggatcagcagccagcaacagatgcgctaccgccgcctcgagaacagcaagcggctaatcacagagggcaggggtggctaaacgagacgttctatcgttacaacctgcaccagcaaagtcaggaccccaatcctttcccttggcccactcccgagcagttcaaggccacggtggcttggcctggggacgaggccgagtttgagatgcagggagggcccgtggggacctctggaggtggggacaaagcccaagatgatcaggacatggccgacttgatagacttcctcctctaa

SEQ ID NO: 92558 - DNA, 411 bp, Glycine max
  Peptide Sequence Number=SeqID_209336
atgcgagttcctaagaactgttcttttgatacactcaagcttagaatgcacaacacccttcaactaaccaacgatcaactactggatgaaatctattaccgacaaccattcatagatgcagaattattatgtaccattattagaacaccggatgctatactcaacctgcttcaatcaaccatcactcctactcatgatgcaattatgtattctaacgggaagtggaacataccacgtcaagatgagtttttgggttactcctttactggaactaatccaataagatttggcattccttcgagatgtgacatggagaaactcaaggatttaatcaaacaagttgcacctacacgggttccccctaatggaattcatggatcacaattggttagacgattgttctttcgataa

SEQ ID NO: 92559 - DNA, 198 bp, Glycine max
  Peptide Sequence Number=SeqID_209337
atggtgatggtgtcctcaccacagcaggctagaaaccttgagtttcaatttgaccctcattcatcaacccctgcaacaaccccttggacactagacatatttctacctcatgcaactcccttggatgtagcaggcaccgatcccccttattaccgtcgtattcaaccataccagcctagtacaacgcctccaaaatga

SEQ ID NO: 92560 - DNA, 1575 bp, Glycine max
  Peptide Sequence Number=SeqID_209338
gagccggagaactacaacgtgcgcgccaacattatgtgggcggcgacgcaggcattgaacggcctcattggcgcaggcgtccctcaggactgggcgacgcatatgctcggccacgaactgacggcgatgcacggcctggatcacgctcagacgctggctatcgtgctgccggcgctgtggaatgaaaaacgcgataccaagcgcgctaagctgctgcagtacgccgagcgcgtgtggaatattaccgaaggttccgaagagcaacgtatcgatgcagctatcgccgcaacccggagtttcttcgagcagatgggcgtgccgacacgcctttccgattacggtctcgacggtagctccatcccggcgctgctggcgaaactggaagagcacggcatgactaagcttggcgaaaatcaggatatcactctggacgaggaaggcatgacacatccaaccgttataaaactacacgacggcaacctgatgccgcagttgggtctcggcgtgtggaaagcaggcaacgaggaagtcgtctccgccattcataaggcgctggaagtcggttatcgttcttttgacaccgccgccgcgtaccaaaatgaggctggcgtcggcaacgcgttaagcagcgcgggcgtcaatcgcgatgagctcttcatcactaccaaactgtggaacgacgatcaaaaacggccgcatgaagcgctaaaagagagcctgagcaagctgaaactggactatgtggatctctatttaattcactggccggtgccagcgataggccattacgtcgaagcctggcaggcgctgatcgaattgcagcagcaagggctggcaaaaagcattggggtatgtaatttccaggtgccgcatctgcaaaagctgattgatgaaaccggcgtcgctccggtgattaaccagattgagctgcacccgttaatgcagcagcgtcaactgcatgcatggaacgccacccacaaaatccagaccgaatcctggagcccattagcgcagggcggcaaaggggtcttcgatcagaaaattattcaccatctggcggataaatacggcaaaacgccagcgcaaatcgtcattcgctggcatctcgacagcggactggtggtgatcccgaaatccgtcacgccatcgcgtattgcggaaaactttgacgtctgggacttccgtctcgacaaagacgaactcagtgaaatcgctaagctggaccagggcaaacgtctcggccccgacccggatcagttcggcggccggacgcgcccagagcaggaagctgctgccgcgcataatcaaacaaacgtcgcccccatccctggccgcgctgcgccgcgcccacataaaagaataacagttgacgcagatcgcccttttccccccttggcaaggcgtataaacctggcgatcgtgaggatcccaacctcgcacatcataatactgcgggtacgcctgaagccggccattatcgagcttataaagggtgtcgataatttcgctgcggctttcccccggcgatcggaaccgccggggaagcggcttagcgggacgccgtcttcggcttga

SEQ ID NO: 92561 - DNA, 924 bp, Glycine max
  Peptide Sequence Number=SeqID_209339
atgcacaacctgcgccactggtggcaccaggtgttcgccagcgccacccccgatctgctcaacccgtatcgctcctggcaaagcgccagcggccacagcgtctccggcctgcacatgccggatgcgccgccgcagccggtatggcgttcgttcgacgagtatgagatcgccagcgggcgctgcacgccgccgctgccggcgcgtttgcagcgccatacctggcagagcgagcgcctgggcaacagccgcgacgtttggatctacaccaccggcgacagcaagccggccgagcatgccggtctgggagccgctgatgcagctgacccgcgagggggcgttgccggaagcggtgtatgtgttgatcgacatcatcgatctgccgcaccgggcgcgagaattaacctgcaaggacgatttctggctggcggtgcaggaagaactgatgccgcagctggccgactgggcgccgcacagcgacaaaccggccgatacggtggtggcggggcaaagctttggcggcctggcttccctgtatgccgggctgcgctggccgcagtgcttcggcgcggtaattacccagtccggttcctactggtggccgcggcgcgacatgctgcagctgccgagcatccccgacgacgcctgctggctgatgcagcaggtggaacggcatggcctgggcaaccacggtgcgctgaaggtatttatggaagccggttcgcaggaaaagctggtgcatcgggtcagcggcgaaatggcggctcgcctgagcgacgccggccatcgggtgcactaccgggtggtggaaggcgggcacgacgcgttgtgctggcgcagcggcctgaccgacgggctgcaggcggtctgggcctccgctttcgccaccgcttatccggcatcggcgacggcacgaggaacacatga

SEQ ID NO: 92562 - DNA, 516 bp, Glycine max
  Peptide Sequence Number=SeqID_209340
atgtcgaatttgcagttacagattcactctcctccaccatcactcttatcatattcatcatcatcactatcctcttcttcttctcttaagctattcccaaaccaccctttctcctcaaagtcccttcctttcaacactcctaaacccttctccctcagatgccgtcactctgacctcttcgatcagaacaccttagcctctacaccacgaccaacgagaccctctgcttcagttggagctttgccgcctagggtttatgttggttactccatttacaaagggaaggctgcgcttacattgactcctaggccccccgaattcatgccactcgattcgggggcatacaaaatatctaaggaaggttatgtgctgcttcagtttgcaccggcagttggtacgcgccaatatgattggaataggaagcagggtaatatctatgctggtgttatatgtcaaaacctagaaagctgtgctggttttcagttgggaggtctccaatgtctgttaggaaagtaa

SEQ ID NO: 92563 - DNA, 528 bp, Glycine max
  Peptide Sequence Number=SeqID_209341
atggcattcttgggagagacaagcagtcaaacagttgtgaactccacattaggttttatttttccaaatggatccattgttcacaacgacagtggtgtttccttccaagcttccactccaattcccattcgagtacctaacgggtgtgattttcaaacgttaaaaactagaatacacaatatccttaagataaccgacaagcaatttttggatgaaatttactaccggcagcctttcacgtatgcaggaaaaagtcccaaaaactttgacattcccaccggatgtaccatggatgaactgaaggatttgatcaaacaagttgcgcctcgtgggattcccccttatggtgttgatgaaacacaaatggtgattcgtacgttgatccgtaagaagaaaaacaagcaggggcaattttggcatttaataggtttgctgggtgcaccaacaataatgatgggtgcacctagcaacactcctaaatcaggtggattggataccaagtggtttgggtcatttttttctacataa

SEQ ID NO: 92564 - DNA, 261 bp, Glycine max
  Peptide Sequence Number=SeqID_209342
atgacagatcttgtaagtgcggatgatgatgtaaatctccgcgtgtcaacgggcttgttggccgcgattgacgaagggcgcagaatgaccataatttggctctgcgtgccatcggacacgactgtgtctgaatggcaaaaggggtgcggaatgaccataatttgtctccgcatgtcatcgggcccgccgcctctggatgacaaaagggtgcagaatgaccataatttgtctctgcgtgccatcggacacgactgtgtctga

SEQ ID NO: 92565 - DNA, 729 bp, Glycine max
  Peptide Sequence Number=SeqID_209343
atggtggaccggcacgggagacgacagagtggcctagggttgacggacgggacgatgataagattcatgggagatgactacaacgcagaggcgtcgttctcagtgagcgacactgtgaatgcagcaacatctcaattacttgttggtcacataggagaacctaaagagatattgatgcaatcctacaccccaagggtattggatagaagactccaagaggattgggctagagctgctaaagaaggccttagggttctcatgaaccttagggaagcttctcaaggaagtttctcaaggcttcttaaggagccaagctctagtttttctaagaatcttctcaagaaaacttctcaagaaagcttctcacttctcaaagaggtgaagtttccgacgtcaagctttgcggtggtcggtggtggcaaacgaggtgcgcagatgatggatgaagatgagtggatgtatgaaataatgtctgaacgagaggatatggattatgaaaatgcagaatcatgcggtgtgaatgaaccacatgttgattgtttgaatgcattcaagacttctcaggatgtttgtggtgggctcgatccgtggctcatgaaaacagatttgtggcggagtggcgagtataagtgtaggaaaaaagaatttatcagaagagacactaggattaggaaatgtgggtgtcccttcaagcttcgttgcaagccagtggttggaggagaaggctag

SEQ ID NO: 92566 - DNA, 279 bp, Glycine max
  Peptide Sequence Number=SeqID_209344
atgtgttattggaaagttgttgttgtcgcaacctacccttcggcgggagggcgacgcggggctcgcgggtgcgtcttccatgaaaggaaaatgcgcggagtcgccaccaacgtttattcgaggaaaacatcggaaaaactggaaaggtgtggtctacaaactttaagtgtgaaaggttcgggagttgtgtttacgcacggggaagattgcgcgacaatgttccctttcgacttccggcatgtcgcggaacttcacggattacccaacaatgggtgttaa

SEQ ID NO: 92567 - DNA, 138 bp, Glycine max
  Peptide Sequence Number=SeqID_209345
atggaagctattgagcaattcaatggtcataacttttcacttgaaggtccgattcaggagcataatatatcgagacgctcgaaaatgaacaatggaagctctcgagatattcaaatggccataacttttcacacggag

SEQ ID NO: 92568 - DNA, 324 bp, Glycine max
  Peptide Sequence Number=SeqID_209346
atggattacactgtggaagatatatcaaccactatgggcaccaattttgagtcatcttatcatttgtgtcaagttgcacacccacttctaaaagaatctgggcacgggagcgtagtatttatttcgtccattgcaggtttaagagcttttccatttttttctgcttacgcagcctctaaaggagccatgaatcaattcaccaaaaacttagcatttgaatgggcaaaggataatatccgtgcaaatgctgtcgcagctggacctgttatgattgtccttatggaggctgtcaagaaggtattcagtgcagtgttgataagctag

SEQ ID NO: 92569 - DNA, 599 bp, Glycine max
  Peptide Sequence Number=SeqID_209347
ttgccattgattacttcaccaaatgggtggaagcagcctcatatgctaacatgactaggaatgtggtggagatgtgtgaggatttcaagatccaacaccataattcgacaccttatcggcctaagatgaatggggcagttgaggctgccaataaaaatatcaagaagatcgttcaaaagatgacaatgtcatacaaagattggcatgaaatgctacccttcacattacatggttatcaaacttttgtgtgcacttctactggggcaaccctgttctctttggtgtatgggatggaagttgtgctcccttttgggggaaagagattggttgtcataagtcatgggcggctacatcagagcggaatgaaaaatgcatttgacaaaagagtttgctggcgtgagttcagcgagggggatcttgttttgaagaaagtatcgcatgttcagaaagatcatcgaggtaaatgggccctaaactatgaaggacctttcgtggtaaagaaggctttctcgggcggaggactgttactcatgaacatggatgatgaacagttgtcttcgcttgtgaattctgatgttgtcaagcgatactatgcataa

SEQ ID NO: 92570 - DNA, 531 bp, Glycine max
  Peptide Sequence Number=SeqID_209348
atgcttagagtggcaagggaaatcgtgactgtccaagcacctgtttggatgcaacatgactatgagcacactctatctaaggcctttaagactttaacatcagatgccatagttcatcatcctcctccacaatggactcgtccagtgcagcccaacattgtcaagatgtctccttattggctcgtacctggaactcaacaacgagttagaccatctatggagtggaacccaaagatagagtttcagataaagattcacttatggacgcccattaccaaactcttaccagttcatccaattgatcttaatctttcccaagaagaacactcatctcttggcaaattgcatgaacaattgtacttgagagatcaagccactgcctactctcctagtctgtacatctcgagagccactgatattaagatggttgatgataaagtgagtccttgtctaccagtttgggatgttgcaaagaagaagggatttaagctttactacagtgaagggatgttgtcgcaacctaccttatga

SEQ ID NO: 92571 - DNA, 318 bp, Glycine max
  Peptide Sequence Number=SeqID_209349
atggcctttgcaaacacccccattactgagactatcccaaccacagaaatcactaccatccacacaaacaatcagccatccattcatgtagaacaattttttgacattcaagaactcgaaaaagtggagtttgtcaacaagaagactatagcatccaaggttttgggagtgaaggtagtgttgtccagtgacactattgccaaggcaacaagatttttgggtgaaggcagtacttatcaggagggatgggagaagaactatgactctcatgtcacaagaatactctatcgggagaatgctgacaaggttggtgactag

SEQ ID NO: 92572 - DNA, 3237 bp, Glycine max
  Peptide Sequence Number=SeqID_209350
atggcagagaacacgcgcacaatcaagcttcccttcgtgaaatggaagaacgtctcagcagcaaaatggaatcaagatttgtcgagctcgttgcttccatgcaacaaacaatacacggaatgtttcagcagaggcaacaagattctccagcagcaagcaatccacctagaggtgagagatctagcccctattcttgtggcactcgattggctagggaaagcactgcagtggcatagtgcttacataaaatctgtaggattggagaatttaccttcttggaatgaatatcagatcttgttacttgatcgttttggagatgtttgtgaagatcccatggcggatttaataaaactcaggcagacaggatccatcatagagtatcatgaggagtttgactcaattgtatcaagaatagatctttctgatgagcatcaacttagctactttttaggaggattaaaacaagaggttcagataattgttcgaatgtttcagccaaattctgttcgaaaggcttattcccttgcaaagatgtacgaatcttccttcttcaatacacaagccaaaccatttgtcaagaaccagaaatcttcctttgtttctaaaccaccccttattccaaaccctcctagatcaaccaatcccttaaccatcaatccctccaccaaaccacaaacacctaagcacctaactcctgcctacatggctgaaagaagatcgaagggcctatgctacttttgtgatgaaccatttacacttgaacatgaacctgatgctaatgtggttagtgaacatgattcagaacctttaatttctgtgaatgcattaactggagtagctaattttcgaaccatgagagtcactggctccctgctccactctttgactactcatgctagtcaacaggtattgccacttgatattaatagcttgttactcgaattcacagatgtttttcaggagccatctggtcttcgtccttgccgagttggccatgatcacaagattcctttaacgcaaggagctaaccctgttaacaagagaccctataggtatgctaaacaacagaaacagattattgatggattgattcaggactatttgaagtcaggaattatacagaagagtgatagtccttatgcaagtccagtagtgttggtgggaaagaaagatgaggcctggagactttgtgtggattatagggatcttaataaggcaatggttaagaacaagttccctataccattagtagaagaccttctggatgatttgtatggatcaaccattttttccaaaattgacttaagagctggttacaatcaagttcgaatggatgcagctgatattcacaaaactgccttcagaactcatgcgggccactttgaatacttggtgatgcccaatgctcttgccacatttcaaggactgatgaattcagtttttcagcattacttgagaaggttcttacttgttttctttgatgatatactcatctacagcagaagtatggaggaccacctttctcatctatatcagactcttcttactatgagaactcactgtttgtatgctaagaaatccaaatgctactttggtgttgacaagcaattgaggagtttcttgggtcttgccgattattacagaagatttgtaagtcaatatggtgcaattgcaaaacccttgactgatatgttgaaaaaggataattttagttggtcttctatagcaaaagaagcatttcaagaattgaagcaaaggctagtagcaacaccagttttggccctaccagacttttctaaggaatttgtagtggaagtggatgcttctggcctaggcttaggtgttgtgttaatgcaaaatcaccacccaattgccttcatcagtagaagtttgaacacgcagcaacagtccttgtcaacatatgagaaagagttattggcagttgtgtttgcagtccaaaaatggaggcactacttacttcccaagaaggaatttgatttcagcatagagtatagagagggtcgagaaaatgttgcggtagatgctttatctagacttgattcccctgagatcatggctttacaggttcatcagcttgattctagcatgctctctaggatccaacagtcctggcagaaagattctatcttacaacaacttgttagtgacttaaaaagcaatccctcttctcacaaacattatacttgggttcggaatgagctgaggaggaaaggcagattagtcattggctcaaattcccaattgagacaggacattctctcttggattcatgcttcagcttgtggtggccattcaggtagagatgctaccttgcaaaagatgaaaaatgtggtttattggagaggcatgtccaaggctgtcaagttttttgtgtatcaatgtgccacttgccagaggagtaaatatgacactgctgcatctccaggactgcttcaacccttacctattcctgagcatgcagctcatttcatggccttatcacatccttatactgctgcggatgtggcccaatgcttccttgatcatgtctttaaattccatggttttcctgacaccattaccagtgatagggatcctgtttttgttagccactttaggaaggaatttatgtccttgcaagggattcagtggtccaagtggttgcctcttgctgaatggtggtacaattccacttaccacagtactgttaaagcaagtccttatgagattgtgtacggcaaagctcctcatgttcatttactttatctcccgggggaatctaagattgctttggttgatagaagtttgcagaaacacgaggaaatgttaaagttactcaaattccacatgaagagggcccaggacagaatgaagcaacttgccaaatccaatgcaaagttggcccctaagtactatggcccatttccagtagaagacaagattggtgctgttgcatacaagcttaaattgcctcttggatcaatggttcataatgtcatccatgtttctcagttaaagaagtttaatggtactgctactgctgggaactttagtccttcacctttattggatacttctcagaaggaacctgcagctatcattgacagaatgacagtcaagagagaaaatcgtgctgtaaccaaagttttggttcaatggaaacatcaactacctgaagatgcaacttgggaattcttttatgacttgaatcagaagtttcctcactttaatccttga

SEQ ID NO: 92573 - DNA, 1365 bp, Glycine max
  Peptide Sequence Number=SeqID_209351
atggggtggggagatatttacaagagacgggttagagtatttacaatggccctaatagtatacctagattataagggtgtacaacaacgagagaaatggactagcaaatcaagacaagctgcattgtgggagaaggctcatgagcgtaatgctaagcgtgttctaaatttgataatagagatggaaggcttatgggttaaacttgggcaatatatgtcaacacgtgcagatgtgcttcctgctgcttatatacgccttttgaagcaattacaggactctcttcctcctagacccttggaagaggtctatggcaccatacagaaagagttggggaaatcaatggatgagttatttgctgattttgtcaacgaacctctagcaacagcatcaatagcacaagtccaccgtgcaactttgctcaatggacttgaagtggtagttaaagttcaacatgatggtatcaagacaattatactggaggacttaaaaaatgcgaagtcaattgtcgactggattgcatgggctgagccgcaatataactttaatcctatgatcgatgaatggtgcaaagaagctcctaaggaacttgacttcaatcatgaagctgaaaacactagaacggtggctaaaaatcttggctgcagaaaccaatatgatggaaatatgagtgccaatagagtggacgttttaatcccagatgtaattcagtctacagagaaagtccttgttttggagtacatggatggcattcggttgaatgatttagaatcactagacgcttatggagtagataaacaaaagcttgttgaggagattactcgtgcctatgcccatcaaatatatgttgatggatttttcaacggtgatcctcatccaggaaattttcttgtgagcaaggaatctccccatcgtcctattttacttgactttggccttacgaagaaactatcaagcaccattaagcaagcacttgcaaagatgtttttggcatctgctgagggggaccatgtggcccttctgtccgcctttgcagaaatggggcttaagttgcgtctggacataccagagcaggcaatggaagtaacaaccgtattctttcgtgcaacaacaccagcaaatgaatatcataaaacaatgaaatcgctagccgatcaaagggacagaaatatgaaggttatacaggagaaaatgaaccttgacaaaaaagaaatgaaacgctttaatcctgttgatgcatttccaggtgatattgtaatatttggaagggttcttaatcttctaagagggctttcttccaccatgaatgtacgaatagtatatatggacattatgaggccatttgctgaatcagttttgagtgggtga

SEQ ID NO: 92574 - DNA, 1191 bp, Glycine max
  Peptide Sequence Number=SeqID_209352
atgggtcacacgaagaaaaagaaagatacgggcattacttggaaccattgtgagagtgttccacctgctagacttttagtcaaatgcaagtattgttcatatacttgttggggtggtattgcaagaatgaagcatcaccttgctgaaataaaggagaatgttattgcttgtatcaaagttccaaatgaggttaaagagatgtttttgaagatattagaagataaagaaaaaatgaaagaggcaaacaaacaagactgttttgaagaagtgagtactcaggataatacaaaaaaaggaacattggagtcatttgccaagaaagggaagcaaggaactatgaagcaacaaactatggctgggatgcttaaagatagggagccagtaaatgcagacatttgcaaatgcatctatgttgaaatatggaaaagagtgggaaaatggggttgcactttgatgtgtgatgattggacggatggaaaaggtagatcactaaccaattttttggttaatagtcccagtggaactgtattcttaaaatctgttgataccagtaatgtgatcaaggatgccaatcacatgtttgagttattggattctatggtagaagaaattggagaagataatgtaatgcaagttgtgacagatggtgcctctaattttgtgaaggcaggaaagatgttagagaataagagaaccaaattattttggtctccttgtgccactcattgccttgatttaatccttgaagacaatggtcagctactggtattctataataccattgcaaatgccaaaaaagtcacaactttcatttataggcatccatgggtgctaaacttgtatagaaaacattccaaaggaagggagttagctagaccagtaatcacaaggtttgacaatgccaaaaactatgatccggatactgaagttttaatgggtttatacgagaccattgaaaaaatgatcccggatagaaggactagatttctagttgatcaacaacttgatagattcaggacagccaagggactttttggaatgagcatggcaatagacactaggaacgaagcaacctgtgctgaagctgagtttagatcgatggctcaaggaatatttgaggttccatggctgaagagagtagctgaagaacttgaaaaaaacaaaagttcttcctatgcagctatgttgtga

SEQ ID NO: 92575 - DNA, 369 bp, Glycine max
  Peptide Sequence Number=SeqID_209353
atgaaacttgccacagtgaacccagaactaaactttgatgtagacatgatcatatccaaggatattcttcattcacgcataggacatggaactggtgcatatggtcctagtatcaattcctctcacaccttccccaatcgaagtttccatggaacattggctggcatgcctagtgcatcgtcacaattccctccttggccacaggctttaggccttgcttatctacatctgggtaggtttactgcagctataaagtctaatggccatgcaattgagttggatgatataatggtctttgctttggtggaaagtggaaatatctctatgactcttggttcttttagcaaggtacactttgctaatcattag

SEQ ID NO: 92576 - DNA, 222 bp, Glycine max
  Peptide Sequence Number=SeqID_209354
atggctatgcaagattttggatccgtcttgcataatccgcaagttgtgtgggtttggaccacgggtgtttctctagaaactaggcccgtgaggcgagtgcggaccaatgtattaagtttgtgtaagagtgcggggcagactgatccgtctgctaccaacgtgggcttacgcagggtgagtcgacccgtttacccactcctaattttaacggttaatggttaa

SEQ ID NO: 92577 - DNA, 756 bp, Glycine max
  Peptide Sequence Number=SeqID_209355
atggttggaacagctgtggttactcgtagtgatggaagattagcattgggaagacttggagctctctgcgagcagcttaaagagctaaataacaacgattatgaggttatattagtgacttcaggagcagtcggtcttggccggcaaagactaagatatcgaagattggtcaatagcagcttttcagatcttcaaaatccacaaggagatcttgatgggaaagcatgtgcagctgttggacagagtagtctcatggctctctatgatatcatgtttagtcagcttgatgtaacttcatcacaacttcttgtgaatgatgggttttttagggatacggctttcagaaaacaactttcagacactgtgagctcgttattagatttaagggttatccccatcttcaatgaaaacgatgctgttagtactaggaaggcaccctatgagggcaagaactgtctgcaggattcttctggtattttctgggacaacgacagtttggctggtctattggctttggaacttaaagctgacctccttgttctattgagtgatgttgagggtctttatagtggccctccatctgaccccaagtcaaagttaattcatacatatgtaaaagaaaagcatcaaagagaaattacttttggagaaaagtcaagattgggaagagggggtatgactgctaaagttaatgctgctgtttgtgctgcttatgctggcacacctgtgattattactaggtaccttcaattttaa

SEQ ID NO: 92578 - DNA, 336 bp, Glycine max
  Peptide Sequence Number=SeqID_209356
atgcaaaagttcacccgcttgttgtgtgataacaaagtgagagtggggaagcaacaacatacaatgggtacaaatctaagaaagtgtcgtgccactaaattacagcagccacccaacaaacaaagatgtgcaaacttttacttttggaaaagcattaaaggcattttgctgcaccttcatgtgacttatgcagcaatggaatgtatcaagggcaaagatacaactagggtggtatatctgaggtttgtccatgctcctattcttgttaaaggatggtttcacctgggaaaactgggaaagcaaaaatcacaatatgttggcattggtttttattaa

SEQ ID NO: 92579 - DNA, 1061 bp, Glycine max
  Peptide Sequence Number=SeqID_209357
atggagtccaagtggggcgccgccgccaccagcatcatagcggcaaacttcgacgacttcaagtggatcgcctccatgttctatcccgacgttgcaaacgacaacgtcaagccatgcaagctcgatcctttcaccgacgaagctttccaaaacctggaggcagtaaccgcatcttcaacatgtggtggagtaacagaagatacccttgtccactcccaaaacctcactcccattcaatccactatctctgcaactattgattctctgtcttccatttgtgttgggagcccattgtctgctaataaaccaaacgcgagagataatcaagtaaaaggggccaccaccactacaagtggttcctcacgtgagccatctgatgaggatgatgaagcaggtccttgtgaacaaagcacaaacgctattgatgtgaagcgcctaagaaggaaggtttctaatcgagagtctgcaaggaggtccaggaggagaaaacaagcccatttggctgacctggagtggcaagtcgaacggttgagacttgaaaacgcaaacctatttaagcagcttacagatgccagccaacaatttcgtgaagctgatacaaataatcgagtcctaaaatcagatgtcgaagctttgagagctaaggtgaaattagctgaggatatgatcactcgtggcacactcacccctaccaacaaccagattcttcaaaatcagagtccactaaacaccccacctcaactcaacacgaataatttacgccgcatgggatatgtttcgccaaccttcaccgtccatgggaatgatgctactgcttcatatggtggtggaatcacagttagtggacaaaattcaccgcttggtgggcttggaaacttggataatattccatgcagcgatttcaatagtggagtcaatagcgataatgctcaccaacagaagaagaatacgcaaagtcgaggtgaagaccaccaccaccatgctgccaataatgttgaagaagaacgcgcaaaagaagacaaagggcagtcgcggatggaaaacgaaacgaaagagacaag

SEQ ID NO: 92580 - DNA, 147 bp, Glycine max
  Peptide Sequence Number=SeqID_209358
atggaagatgtctatgttatccagttaaaatttcagctcaaaactcaaagtattcaagccatagcggagttaagaagacagtgtgccagaacggatagcaatcagaattgcaacctagaaatcaagagtagtgtttatgttgcttaa

SEQ ID NO: 92581 - DNA, 115 bp, Glycine max
  Peptide Sequence Number=SeqID_209359
tactagtaggattatttctttggggagccatgccagtagttcaacccgcgtgatagctattagctacatggcagaatgggttgtaggaactggatcatttggaattgttttccag

SEQ ID NO: 92582 - DNA, 477 bp, Glycine max
  Peptide Sequence Number=SeqID_209360
atgggtaaccttcagcaatacttgagagttaagagaatatatcctagcattattatactggaccttgctgaagaacaaagacttaggagtcgacgttgggttgcggctgcgggaccaaagcataaaggatgcctttatgatactggagaccttgctcatacttacaaatgtggaaatgacatcttcatgcagcatacacaaggatcttccagtagcactgaagatgttgcagagaataaccgattgagggaggagttgcgtcaatcaaaggaggagatgcgtgtttttcagtcagttgtccttcaattcttacctttgaagcacagaacattattcatcaacaacaacctcaccagcagcaccagcaccagcactagcaccaggaccagcaccaacaccaataccatgcagatgaccagcaggaacatgatgaccaacagagacactctccttatgactactttgattattgactaa

SEQ ID NO: 92583 - DNA, 1023 bp, Glycine max
  Peptide Sequence Number=SeqID_209361
atgggatcaagtcaaacaccttcgcttaaaaagaggttctatcaagtcaaggtcaagagcctagggatcacctgtctaaaagagctagggcagttaatggggcagctccagcggcaagctttttgcaaagcatacgataaattctgggacctagccatggttgaagtctccatagaggccattgcctccctcgcccagtattatgatcagccactaaggtggttcacctttggggacttccaactgtcacctatggtagaagaatttgaagagatcctaggatgtcctctagggggaaggagaccatacctcttctcagggttctatccctcattagctagaatttctaagattgtccaaatctcggcgcaggaattagaccacaggaagcaagtcgaaaatgaggtggttggaataccgagaaaatatttggaggcaaaagcaagaatcttggcaaataatcaaggagttcctctcctcacaaaagcctctccttctgggaaagctagactgaatctaaaccagctcaagccatttagatatgaagacttggcaatcaccataaaaagtcttctgtactatggatgtctagaatcaattatgatccttccctcatacagatttgaggggtttaatccctctataaatgaagccataaacctaatacagggcaacatacagtaccaatatagcctcatgagagcacaaacacagggatatcaatggtttttctcagattcagacaaaagagattttgacctgataagagaaacccatgctacaaaactcttcctatcggcatacaatgggatgtttttcatacccttctcggttgaacataacaacaaattggtacaatttttccaaaaggaaaagaaggacaaagagatatatgaggccagtggttgtcatgaacaacaaactccttcatttccatccactgatttgtccatggaagactcatcagacattttttgttttggaaacatccacgaagaagaaaatgttaccaatacgaaatga

SEQ ID NO: 92584 - DNA, 342 bp, Glycine max
  Peptide Sequence Number=SeqID_209362
atgaaaagacttgatctaaggatgaatgctttcctagaacttaagcttttgcatcctagaaaaaccatgatttgcttgcagcccgacctcattacaagccaagaaaagtccttcagattcagttttgaccgtgaggcattggctgatgatccttccttgatatctgtcttgcttactagcttatttcagagagaaaaattggaagaagtagtagttggtgtctcgctaagcctggaccatgcgcttagcgagtatcatccgctaagcgagacatcagcccgcatagcgagtaagaggaatcttgaagggaatctgccatgcaagcatgcgcccagcgtgtaa

SEQ ID NO: 92585 - DNA, 261 bp, Glycine max
  Peptide Sequence Number=SeqID_209363
atggcttctagaaagagaaaggacccagcctcccgacctcgggaatcttataacacttccagacttgcctctgaggtcccatgggagagatatgcacagaatgttcactcccggaacatccttctagagaggaattcacgtccagatcctcaggagtttgtgaccagactatgcattccaggacgcggatttgtcctgaacgctgaaggagcaccctggaagctactaaggaaagatctcacgactctagcacatacctag

SEQ ID NO: 92586 - DNA, 735 bp, Glycine max
  Peptide Sequence Number=SeqID_209364
atggatagggcaaggttagtttatgctttggttataaagatggacatggacgtgggctccttcatttctggacagatttctcagatggcccagtccaactcctcaaggcttggattcccagctctgatcacaacattatgcataacccgaggagttgtctcagattcccttactttcgagtcactcagcccggccattaatttggcctacatcaagaagaactggacccgtaaggccagggctcgaggatctgagggtccatcttcatcagctccccctgcttctactgcaccacctcccctacctcaattagcaccagcacagatcggcacctctgcttcattatcatcatcattccagtgtcgatgctccgagagcatgcatgactcaactcaacatcggccttttatcagcatggatgagttcatggcacaggtggcctggccaggagtccagccttcttcttttgggggagaggttgacccagaagccatactagatattccagagccagacatgccagaggttaacctagagactgacccaactactcaggaggacactgcggaggccactccaaagatgactccacaagcatcaccaatgaccacacctgtgctggagttctctactccgcaggcatccccagtgatgacactagagctggagctttctgaggaggaggacgatgcaacagctatggattatgccccttctgcaccacaggacctatga

SEQ ID NO: 92587 - DNA, 297 bp, Glycine max
  Peptide Sequence Number=SeqID_209365
atggtgaaggtcagtcctggaagcaaaccagatggtgaccctaaactcgcgttcaccatgatcacaaaatccttcgattcgaagggcaagggtccagcgatgccggaaggaacgccgatgatggaagccggaggaggagcagatggttcattcaccggagaaggagcgggaattgaggaggatttgcgacgttggatagtctatgtggcactaaaattgccaacaatgtacctcactaacgatgttactttcaaatttaacagcaaggactattttgcgacacttatgcaaagatag

SEQ ID NO: 92588 - DNA, 4914 bp, Glycine max
  Peptide Sequence Number=SeqID_209366
atggctaatataatgaattattgttgtcttcttgactttgaggctaagggagggtgctttacttggaggaaaaatattcagaatggtgggcaagtgaggaagaagcctgatagggtcatggctaattcagattggtgcctttcttttcctcatgccttggtggagttacttcctatgaacaaatctgatcacaatcatctcctgttgagttgtagggtgactaagaaagactttaatttcattcttgacaagatccaaagcagattggcgggatggaaaagtaagcttcttaataaagcaggggtgtgggataacattgatgctaatattcattcttttcttttgggaaaacgtcatactcattgggtggattggaattcagtaactcaatcaaaagccttaaggggaggttctggaccctcgaagtccaggtacagagttgctaacattttggtgctctcgttcatcttctccaccaccgcattcatgtctgaaccaccctattcatccccatccactgagaaattggaagatgccatccttaagcttacctcattgaaccttacccttggcgagtctgttcagtccatgaaccttcgtttcgatgctcttctgcaacgcctctcgtccccttttccctttcctccaccaattcccacctctgcgaccagttcttccaccccacctgccacaaaccataaaatgaaattagatgttcctaggtttgatggtaacgaccctcttggttggatctttaagatcaaccaattcttcgattaccaccacacctcaaaacaggacaagctcacaattgcttcgttttacatggagggacgagccctcgcctggtttcagtggatgaccagtaatggtcaattcacgtcgtggctaggttttctccaggcactccagaccaggttctcaccctcacaatacgaagaccccacagggatccttttcaaactcacacagcgtgggtcagtagctcaatacctggctgagtttgaggagctcgcgaatcgccctgtagcctctgacgttggttcaggcagccggtctggcacgacttcaggaggagaaactcgccgagcacagaaccttccctcggggacgaccccccctgtgctttccgcgaccccttcacgatcgtcgtccacgacccctgctattccctcatcaccaacgcttcttccaccgccaccgccactcctaccgccgcgcctgcctgcccctggcctcaaacgcttgtcgccggaagagctcgcgtcccgccgtgaccgcggcctatgtttcaattgtgacgaaaaataccatagaggtcaccgttgtgcctctagggtatttttcatggtagcagatgctgaggacccgtgtctctctaatatagactcccctgacccggaacctgacccacccgacgagactgacccgacccaggcccaaataagcctatactctcttgcgggtcatttggccccggagacactccgattactaggctccatcgccggccaccctgtcatcatcctcatagatggtggcaatacacataatttcatccaggaatcccttgttgctcaattgggattttcttcgagtgagacacggcccttacgggtcatggtcggaaatggacagtatttagagtgtacacagtggtgtgaggcgctcactatcgacattcaatcagtccaattctctcttgatctctacgtccttcccattgccggagccaatgtcgttctcagggttcagtggctcaagtccttggggccggtgcttattgattataacaccttgcgtatgcagttcttctatgaaggacagttggtggagctcagaggcaaccacgagcctacatctcacctgttatcaccaccacaattcaatagggtgcttaagaagcaaagttcaggggttttcttccacatttccgtcctccaggagcacactacgaatcatcaccatgaccactacccgccggaaatccaagaattgctagcccaattccagattctgttcaaacctccgaccaccttaccgccagaacgacccactgaccaccacattcacctctttccccaggccaccccagtcaatgtacgcccctaccgctaccctcattgtcagaagtgtgagattgagcgtcaggtagaggtcatgcttcagcagggtgtcattcaacccagcaccagtccgttttcttcgccggtcctgttggtgcgaaagaatgatggctcgtggcgcttctgcgtcgattatcgagctttgaatgccataacagtccgtgaacgcttcccgattccgactatagacgaactgcttgacgaattgggtcaagctcgttggttctcaaagcttgatctattacaaggttaccaccaaattcatatgtctgccggtgacatacccaagactgcttttcggactcaccatgggcattacgaatttaaggtaatgccctttggtttgtgcaatgcaccatcacccttccaggcgacaatgaatcagattttccggccatttctctgccgtttcctcatcgtcttcttcgacgacatcttaatctatagtgcctcttttcgtgagcacttgcaacatttaacgaccatatttcaggtcgaatatttgggccatattgtgtcacaaggaggagtggcaccagtagctgctaaattggggaccattgatcagtggccaacacctaggacaactagagctctccgcagtttcttgggactcgcggggttctgtaggcgcttcattcaggggtattccaccattgccgcccctctggtcaaggccatgataacagaaccattccagtgggggaacgaaactcaagctgcttttgatcaactcaagaaagctttgtctcaggcccctgttctagctttgcccaactttcaattaccattcacggtcgaaacggacgcgtcaggggtaggaataggtgtcgtcttatctcagcaaggccacccaattgctttcttcagcaagcccttcaccccaaagcttctgcgagcttcaacttatgtccgggagctttttgcgattacgacagcagttaagaagtggagacaatacttacttggtcagcgtttcaccattctcacggatcaccggagtttaaaggaacttctcacccaagtgatccagacgccggagcaacatttatatcttgcacgattgatgggctttgattatcagatcaagtatcgatcgggagccaacaatcaggcagctgatgctttatcgcgcttgccggaacagacgacatccacatgcatgatactctctacaccttgttacaatttcctctctgagattcatcatcagctagagaccaaccaggaatacctcaaattgcgcgaagaaatagaaaggtgccctgccaagtaccctgacttcaagctcactgataaactaattctacacaagaaccgaatttggttgcctcagggattacccatcatccctatgttgcttgcagagtatcattccacccccacaggagggcataccggcatcgtgaagacactagctcgactctctgaaaacttctactggtctggcatgcgtggcgacgtcactcactttgttaccacttgtattgattgccaacatactaagtatgagacaaagcgaatcgcagaccgcgaccccctcttcataagcaatttctggcaagacctctttaggttgagtggcacgaaattgaggatgagttcatcctatcatccacaaagcgacggacaaaccgaagctctgaaccgagttattgagcagtatttgcgggctttcgttcaccggcgaccggcgacgtgggggaaattattgccgtgggtcgagtggtcccacaacacttcttggaatgttgccacgggtaccacttcctatgagataacattcggaaagaagccgggcacgatcccagattacattgcaggcacttatgacattgttgcagtggacgcagtattgaccgacagggaggagaccttcaagtgcattagaagaaaactccttaaagctcagagtctgatgaagcaacaagcggacacgcgtcgtcgtgatgttgaataccaagtgggcccagttgcttatcgtctccaacttccaacaggcactcgcgtacacccggtttttcattgttcattactgaaaccatttaaaggcacccctccatcagacatcacagcggtgcaattacctgagaagttcttcggcactcaacccatcatcactcctctggctattctggatcatcgtcaaacttcacaggaccctccacgttgggaggtattggtccaatggcaaggacttcctcctgatgacacctcatgggaggattggtctactttatgtcgagactaccaccttgaggacaaggtgcttctgcaagggccatggagtgttagcaaagtagcagacacaaagccaagcgcaagggaaagttcatggaacaatgcagaggatcttgctggattatccataccgcagcagggaaacaagcataacggcatttgtcattttgtaatattctctagctgtcacaattgcaattctattagaggttctggaccctcaaagtccaggtacagagttgctaacactctccttggaaaacacgttcggtctttgttgcatgatgatgataagctttggacaaaacttgttaatggcaaatatctttatggagacaatattcttcaaacgaagaattgggttctcaaggggcgtctatgtcataaagtgcctttcattgactaccaagatgttaacatgagggtgggcatgtttgcgaacccgaattttatggtgaatgactacaagcaatggatcaagacgcaagctacttccaaaaatggttatttgctttttgctacttgccgggtgcatctagaagtctag

SEQ ID NO: 92589 - DNA, 852 bp, Glycine max
  Peptide Sequence Number=SeqID_209367
atgagagtcattggttattgtggaaagaaacctctccatattttaatagatagtggaaacactcataactttttggacttacacatagctcagaagatggactgtcaagcagaagctatggacattgtttctgtcactgtagcagatggaaataaagtccagatttcttcaaaggttccaaaattttcttggtcaattcaaaataccaactttacttctgatatgatgctattacctcttggttgctgtgatttagtattgggaattgaatggttggtatcattaggggacatcacatggaatttccacaaattaacaatagaattttttgtccatggaaaaagacatgtcctgagaggagctactcctaccaatctggccactgcccgaaaacaacatcttcataaaactatctcttatggtgtccacctctctctgattagtttgcaatctgcagttgaaggctccctgctccactctttgactactcatgctagtcaacaggaaccatctggtcttcccccttgtcgagttggccatgatcacaagattcctttaatgcaaggagctaaccttatcaacaagagaccctatagggatctcaataaggcaactgtcaagaaaaaattccctataccattagtagaagaccttttggatgagttgcatgggtcaaccattttttcgaaaattgacttaagagttggttacaatcaagttcgaatggatgcagctgatattcacaaaactgctttcagaactcatgcgggccactttgaatacttggtgatgccttttgggcttaccaatgcttctgccgcatttcaaaggctgatgaattcagttttttag

SEQ ID NO: 92590 - DNA, 1224 bp, Glycine max
  Peptide Sequence Number=SeqID_209368
atggccttacaagttcatcagcctgattctagcatgttttcaaggatccaacagtcttggcaaaatgatcctatcttacaacaacttattcatgcttcagcttgtgggggccattcaggtagagatgctaccttgcaaaagatgaaaaatgcggtttattggagaggcatgtccaaggctgtcaagttttttgtgtttcaatgtgccacttgccaaaggagtaaatatgacacaactgcatctccaggcctgcttcagcccttacctattcctgagcatgtatggcagcacatcaccatggacttcattgaaggtcttcctttttcttttggtaaacaagccatttttatagtagtagataggcttagtaaggcagctcatttcatggccttatcacatccttatgctgctgcggatgtggcccgatgcttccttgataatgtctataaattgcatgggtttcctgacaccattaccagtgatagggatcctgtttttgttagccacttttggaaggaatttatgtccttgcaagggattcaggtacaactttctacaacttatcacccacaaactgatggtcaatcagaagtggtgaatagatgccttgaaacatatctcaagtgcatgtgtagcgactctccagcacagtggtccaagtggttgcctgttgctgaatggtggtacaattccacttaccacaacactattaaagcaagcccttatgagattgtgtatggccaagctcttcctgttcatttaccttatcttccgggggaatctaagattgctttggttgataaaagtttgcagaaacgcgaggaaatgttaaagttactcaaattccacatgaaaagagcccaagacagaatgaagcaacttgcagatagaggcagatctgataggagttttcatattgaagataagattggtgttgttgcatacaagcttaaattgactcttggatcattagttcataatgtattccatgtttctcagttaaagaagtttaatggtactactactactgggaactctagtccttcacctttattggatacttctcagaaggaaactgcatctatcattgacagaatgacagtcaagagaggcaatcgtgttgtaaccaaagttttggttcaatggaagcatcaactacctgaagatgcaacttgggaattcttttatgacttgaagcagaagtttcctcactttaatccttga

SEQ ID NO: 92591 - DNA, 1135 bp, Glycine max
  Peptide Sequence Number=SeqID_209369
ggtgatggagttggagattgagataccacatgatcaggggaaagaaaagcatgaggatcaggaacgtgtgaagaatggtgaattgagaattgagaacaatgctgaagattttcgtgtcaaggtcaatgcatatgaacaagaactaaggattgtgaatgagaagttgaggctttcagaagaggagataggtaaactgaagattgaacttgaagaatataggtcaatgaaatcaaagaatctgaagggtggtgttggattatcttcaactgtggaaggggtcaaggtaggaggagaagccttggagttgaagaaacttagggaggaactaagggtgaacaaagacaagcttgagtcttcagaaatgcaaattgtttcgttgaaattcggggctacgaaaacatttgagactattcagcaattgcaggaacagcttgacttgtatgagaaggacattgcaagttggaaaacaaagttcaactctcagaaaagagagaattctaaactccaagaaaggcatgcaaggatgaggactaatgtagccgaccgggatcacgaggttagagatttaaaaggttctctatctgatgtagaacagaagatgttctttgagagagcaaatatgaagtctgaaatgcccaagttgttgggggaacagactcatttggaggagaagttgaaagaacgggaatttcattgccaagccttggaagatgagataaaaaaaatccactctgaaaaattagagatgggagagacactcaaaggtgaaattgagaagttaaaggaagagattgagtcaagaaagaaaagcatagaagatgcaaatgtaagcctagatgctttgaagttagagagaaatgatctcaaagaagaagttggttcactcaaagaagtggtaaattcaagaaatgatgaggttgaagaggcacataaacaagtggaggaactaacatcaagagctaagaaacaagagaaagagattgagaaacaaaaggttgagatcttagaaggagctgaagagaaacgtgaggtcataaggcaactatgcttctcacttgagcattacagaaatggatacaatgtacttcggcaagctttcacaggacacaagagggttcctcttttggccacctaa

SEQ ID NO: 92592 - DNA, 135 bp, Glycine max
  Peptide Sequence Number=SeqID_209370
atgaaggcaatgaaatgtagacataaaagtgaggagcatattgatggactggccatcatggggtcggtttcttacgtgggtgccgtcattgacactgacgggaagcttgaaccgccagtgccaacgacgggatag

SEQ ID NO: 92593 - DNA, 336 bp, Glycine max
  Peptide Sequence Number=SeqID_209371
gagttgggtcgggagcaaagcccaactgacaacatcttcccactgttcgatcaaaacgaatctacgaccaagatcacgcaacatttggaagcccaatgtgggaagcccttcttttcagccaaggccaaaaatgggatcagggggctagtataccagataaagtacatagtaagactgaagggacacctagcacacccaaaccgaacacatcctttgaccacatatccacatatgtcgaacaacccacagaccccaggtccagcaagtttaaagacatggatggaaacaggagtgtggggccctagagcccacaaagaggtgtctgcttgtggttga

SEQ ID NO: 92594 - DNA, 1272 bp, Glycine max
  Peptide Sequence Number=SeqID_209372
atggctgatgcattaaagaataatgaaagtgtgataaggcttgagaatggagctgatgttgctgatgcagaggagatgggatatgagaaagcacttatatcacgtttaaccctgagacctgagaagatctctagtcttgtaaagtctgttcgcatgctagctgagatggaagaacccattggtcagatcttaaagagaactgagctagcagataaactcatcctggagaaaatatcatgtcctttgggtgtactcctggttatattcgagtctcgaccagatgcccttgttcagatagctgcattggccattcgaagtggaaatggtctattacttaaaggaggaaaggaagccaaacgatcaaatgcaatcttacacaaggtcattacttcaattattccagatacagtgggtgacaaactcattgggcttgtgacttcaagagaacatattccagatctgctcaaggcaaatcttgtggtccccagaggcagtaacaaacttgtttctcaaatcaaggattccacaaagattcctgttcttggtcatgctgatggaatatgtcatgtatatgtagacaaaacagctaatattgatatggcaaagaagattattagggatgcaaagattgattaccctgcagcctgcaatgcaatggaaacacttcttgtacacgtagatttgtcaaggaatggtggacttgatgaacttgttgctgaactccgacatgaaggcgttcaattatatggtggaccaagagccagttccttattaaagatttctgaaacacactctttccatctggagtatagctcactggcttgtacaattgaaatagtggatgatgtatttgctgccattgaccacatacatcacaatggaaggcaaattcaagttcccctacaaaatctatgttttgattctctatatcttaaaaatctatttctttcctgtttctgcagtgctcatactgaatgcattgttgcagaagactctgaaattgccgaagctttcttaagtcaggttgacaggatggataagatcaagaatgagatcattaggaagaaggttggagtggtgtgtatggaagacaagaaaattattctcaaaaggtgcatggttggaataagcacaagccgacttcatgccagaggtcccgtcggagtcgaagggttgttgacaaatagatggatattgagagggagtgggcaggtggtaaatggtgatcgaggggtcacttatacttacaaggatctgccagtaaaagcataa

SEQ ID NO: 92595 - DNA, 1032 bp, Glycine max
  Peptide Sequence Number=SeqID_209373
atggctgccttctatagttgccataccagcttcaactaccgcaacccacaccacccgctaaacaaagctctcatggcttccttccatgattgtcataccaacttcgactaccacaacccacaccacccaccgaaccacctttcctcattgcttcctctccatactaccttccatcagcaaccaccttcccttccatttcagcacacacctcgaatgacagacgccgaacttttttccgctcgtgaggaccgcctcgaggccgccttgaccaaacttgctgcagctcaatgccgcatcgaatccacactggatgccattctcctaaaactgcctctgagaaccagccaccactacccttcttcctttgtgcagtcaccactgccacctctgccgcccatgccgactccaccttcacttcccgcactcatacagttgtgcccaacacccttgccaactccgttgtccacgccgactccgtcacccatgccaactccgctgcccataccatctctgccatccatgccgcctccgcttcccatgtcgactgcgcctccatgtcctgcacccatgcaaccatcccttccaccattgtcgggtccgcttcctaggtctgctctgcatcttcctactttcggtcatgttcgtgctgctattcccatttccgataacctctttagcgttatccttcgttctggccataccacaactcctcacgccaagcatggagaacatcgagacatcgcgctgtttgagctgggacctggattctttgggactatcatggtctcacgcaagtgcataccatctatctttgcactacggacaggtgctaaactgagtgagttttgccacaacaggccttgggatcttggtattacttttggtagccatggtttgaagccccaacaccttgaggacaaggtgtttttgatgggccagggaatgttaggagggagaaaacagtcaagcagcaacaatacacatagcaagcaggcacaagtgacattatgcagcaagcagacaaggtgctga

SEQ ID NO: 92596 - DNA, 447 bp, Glycine max
  Peptide Sequence Number=SeqID_209374
atggcgatgcaagggaatgtcatggtcattgatagggtttcctcaagccatcacaagagcagcaaggctcacttcactgctccatcgagtatgcgtcacgtcctaatgagtgcgcctctctccaccgatctccgatcaaagtacaacgcgtggtccattccgcttcgcaaggacgacgacgttcaggttgtgaaaggaacctacaagggccacgagggcaaagtagtccagctttatttttgtttgtgggtcatccacattgagcacatcatccgtgagaaggttaacgggtccaccgttaacgttggcattcacccttccaaggttgtcgtcaccaagctccgaatttacaaggaccgcaaattcttgcttgattggaaggccaagggttgcgccactactgacaaggaaaagggtaccaagtttgctcatgaggatatcgtttag

SEQ ID NO: 92597 - DNA, 726 bp, Glycine max
  Peptide Sequence Number=SeqID_209375
atgacagctttgaagccaaccttcaaggtcgaagttcctgttgattttccttttgacattgaggacaatcctggagaaagaaccatacaactaaaaggaaaattcagagatgaaattatcaaagttcaagttgacatccctaatgtagcaccagaagaagaacatgaggatgacgaaaatggcaacaatgagaagaatgatagtgaatctagcattcctttagttgtgagtgttttcaaagaaaatggagtgtctctagagtttggcgtgactgcttttcccgatgagatttccattgatagcttgtcaataaaacagtctgaggaatctgaagaccagttggcatacgaggggcctgagttcattgacttggatgaaaatctgcaaaaggcttttcacaagtatcttgagatcagggggatcaagcccagcacaaccaacttcttgcaggaatacatgtttgctaaagacaacaaggaatatttaatgtggctgaagaacctgaagaacttcgtcgagaagaattatctcgctttatcaaagcataatcacgtgaatccccgttgccaaacggtgatttgggtaagggagatcatggacaaagaaaatacaaatgggcctttacattttgatctgaatactggtgcaaagattccatcggttggtcttggaacatggaaagctcctccaggtgttgtgggtgatgctgttattgctgcagtcaag

SEQ ID NO: 92598 - DNA, 279 bp, Glycine max
  Peptide Sequence Number=SeqID_209376
atggcgacaatggaggaactcatagaaacagtccacatggaacatatcatcatgttccgaccgtgtcttggtggcgccaataaagaatgggggattccacagcgtgctcgacatcggaccttgaaaatgataataagggaacacatggtgttctcaccaaccacagatatagctccgctcttgtcaggaatgccaagtgaggctcgtgagtcccctaagctaactgaaaatgctcttagtcaggttatcaccacacaacgttcttctaggttcctttga

SEQ ID NO: 92599 - DNA, 414 bp, Glycine max
  Peptide Sequence Number=SeqID_209377
atgtcgagaggcttggagttggatcaacgcgttgcatcacaattttttgctgagagactgagagtgagagtgagagtgaaagaccgagaacgggagttgcaatgccaagaggagagtgagagtgaaagaccgagaactggagtttcaacgcgacgaggagaagctagactcggttttaaccgaacctacttggtgtgctattatggtggatctggtaagcgtggcgatttgggcgtgttgctactgatggaggttgatggtagtggttcaaccacaacctttgcaagtggaggtagtgaaagcttctgtcacgctaggaataggaaggttgagcaccatattgttagagataaggggagcaacatgagtaacatgctgaacaatctctcaaggaaaagcttgaagaagtgttga

SEQ ID NO: 92600 - DNA, 705 bp, Glycine max
  Peptide Sequence Number=SeqID_209378
atggataccaaccaaaacatcactactactgggaatcacgagaacatgggaagagatgaacataacaacatcatcctccatgatcatcatcatcataaccaaattccaacgccccactataaccaccaccctcttcacattgttcaaccctcatcaaacgtggcaccctctttcgtcagtgatgttctaggagtagtccactttgaagaagaagatgaagatgaagaagaggttgaagaagagctcggagccatgaaggagatgatgtacaaaatggcagtgatgcaaccggtggacatagaccctgcaagcgtgagaaaaccgaagaggcgaaacgtgcgaataagcgatgaccctcagagtgtggctgccaggcacagaagagagaggatcagcgagaaaattcgcatacttcagagattggtccctggtggaaccaaaatggacaccgcttccatgctcgatgaagccattctctatgtcaagttcttgaagaggcaaatcaggttgctccaatcaacttcatcaccactaattaattgcactggtgctgctcctaatagtgattattggccttttgcacccaatatattccacagttccatcaccaacaccaacgcctccatggacataccggttattggaatggaattcaacaccagaggccatggccatgccggtgatgcctcttcgatccacctttga

SEQ ID NO: 92601 - DNA, 2454 bp, Glycine max
  Peptide Sequence Number=SeqID_209379
atgagtggaagtggcaaaaagcgctcttcaaagtgggatttgagagacaatcctgatttttctcctgatgatggtgataaattaaagcatttttctggaggcagaggatcaaataaggataatattatgaataaagattatagagttttggattcaacaatggaatgggatgaggatgaaagttatgaccataaaatgtctcctgggttggatgcatggaaacataagagacataatagtcaatcccccaaaaatggttggagcaggtcggtcagcaggagtagtcgaagcaggagccctcctcatggttttaggtgggattcgggagtcaatgacagaagtagaatgcgggctggaggatcgacacaaccatgtagagattttgctgctggtaaatgcagaagaggcagtcactgtcattttcttcatgataatcaaaatcacgaggatggttgggaagataagtacagggaagatggagctcccagatattctgctccccgcgagggtagagactattctcttaagagcggtagatctgatgaagcttgtattaattttccaaaaggaaggtgtagaatgggagcatcatgcaagtttgtgcatcataacaattctgatgggcacagtaaagtttctgtggatggattaactagagagagggaaattgatagaaggcacagagacagttcttttgagcagggtagcgggcatggaccaaaccgtggtgatactctttgcaaattttttgctaatgaaagttgtcgtaatggtaaatattgtaggttttctcatgacaggcaagcatgtagaagccataatagaagattaagagatgataggtgggcaagcaatcctggaggagattatcatatgctggatagaccgaaattgagtgattcagttagtccaaatagaaggccaaggggtgataggtggggttctgatggtaacaaggctgatgcagataaagtttgggacagtccagagcggaatgatacagtggctgtctctgatacagcaaagctggttgaggacaaaagtgaaaatgtggttgccgctgagcaaggattcactcctttggctatgagggatggatggggtcatagtttggataaaagcagagtgcatagtaaacagccattttcaagtgataagaaggaagctgacagttggatagcaggaaatgctgccaacatgcacggttcccagtcagtaggtacagacatttggttgggtgatgatgcaaaaatgtctcctgattgggattacagggtgagatcttccagctgtattgaagaaaagcatgaacaaaataagcatgggataacgcagggttttatgtatttagccacctctgaacatgacagaatacaaattgctccaggacaagattttaatcagaatgcagagagttttaatcctttgcattcttcaagctgccaagtagttggacaaactcaagtagcagctcccattctaccttcacagggtggaattgttgatggtatgctgaaacaggaagtctctactgagaaaaaatacactactgaaccaaatatcatggatgctggcttattacaagttagttcaagagatcctcctccaactgagaacgtggtaggcaaagaacagcttgctcagcttaccaatctctcagcctcactggctcatatccttggaacagggcaacagctgccacaactttatgctgctttaaattctcatgatgcaaagggcacatcctccctagcaaaagctgaggtgcttgctatgcctctttccaacacactcatcaggccagatcctgctgttggactcctgaagcagtatgatccaatgtgtgacagtgttgagccaaagagtgctgttgcaagtagtggggtaaccccagccattcccccatgtaaaaaagttgcagaagatgtagtggaaatttcatcacagtccaacacagcaagacaaaattgtggcaattcttccaagtctgctggctcagaagaacttgtcaagagtgatcctctaatcctgttgcagccaggtcaaaacattggggttaataaagatgataacaaggaagtgttacctgaggaaaggcaaaaatctaaagatgatcctaaaaataccaaagagagtggtcctttggaaaacatggagcaaactgatggtcctgatgaggcaaagaaaacaaagggaatgaaggggagtcgtgcatttaaatttgcattggtcgagtttgttaaggagcttctgaaaccaacatggaaagatggtcaaatcaccaaagatgattataaaacaattgtgaagaaagttgttgataaagtaactggttccatgcagggggccaatattcctcagacacaggagaaaattgaccactatttgtcattttcaaaaccaaagcttaacaaacttgtacaggcgtatgtggaaaaggttcagaaggcttag

SEQ ID NO: 92602 - DNA, 228 bp, Glycine max
  Peptide Sequence Number=SeqID_209380
atggcttgcacccacattctagtggaagattcaacaagcgattctcctcaaatttcagccagcccacatccattagactttgcaccttatgcttcagggtcatacagtgctcaatggaatgccccagggctcttccacgatatgcacatgttgcgttcgagtcgtatcctcagaaaaatggaggtggtcttcgtcattggaagtgcggtagacagactttgtggttga

SEQ ID NO: 92603 - DNA, 624 bp, Glycine max
  Peptide Sequence Number=SeqID_209381
atgtctacttctgggaagcccggtgatcatgtgcttccagtcttcactggggagtgcaaggagtgtgatcattgcaaatcaaaggagagtaacatgtgtgaccttctaaggattaacaccgaccgtggagtgacgctgaatgatggcaagttaagtgagtacactgtagtacatgttagttgtgttgccaagatcaaccctgctgccccactttacaaagtttgtgttctgagctgtggaatctcaacaggtcttggtgctacattgaatgctgcaaaaccaaccaaaggttcatcagtggttgtatttggattgggagccgcggggcttgctggatggggtgttgctgtgccaaataaagatgatgcgatcaagactcatctggttaatctcttgaacgaaaagactctcaagggtactttctttggcaactataaaccgcgttctggcattccatcagtagtggagatgtacatgaacaaggaaattgaactggagaaatttatcacccatgaagtacctttcgaagaaatcaacaaagcttttgaatacatagttaaaggggagagcttgcgttgcataatccgcatgtctgaatggaatttatttaaacaactactttga

SEQ ID NO: 92604 - DNA, 3141 bp, Glycine max
  Peptide Sequence Number=SeqID_209382
atggggatcagcaacactcatgaagtaggatggcagatcactgtaaatatggcatgggtgatacatgttgcaaaatcagattctcgacttgcaaacaatgatcttcctctggacatacagaggttgagatgtcgtgcaatgtatcatgcacttcgattttctcctcctatagagaatttgggaaaggaggtgggcatttttcttcatgctcttggttatcccccatctacaccaatatacattgcagcaggagtgatctatggtggtaatactcatctttcagagctctcatcccgcttccctagtataatctttaaggaatcccttgcaactcctgaagagctgaaagattttgccaatcatgcctcccaaactgctgcacttgattacataatctgtgtagagagtgatgtatttgttccgtcatattcaggaaatatggcgagagcagttgagggacaccgcagattcttaggtcaccgcaagacaatcaacccagacaggaaaggacttgttggaatttttgatatgctggaaactggagagctagtagaaggaagggaactgtcaaatatggtgcagcgcatgcacaagaacagctccaactcccaaaacccttcttccctcgcaaaacccctttcccccaatttccccactcttcacctcgctttctcaccaccagattcttccctcgcaacttcacgaatcgatgcaaactcagaatcaccgcatccaattctccttccgacacagcctctcccaagcaagagcaagaacaagaacaagacgccgaatccgctcaactattcgagttgtgagttgatgagaagagtgaactgtgtgcagaaactgaaggagacggagaggaagcggatgaatgagttggaggaatttgacaagaaggcgaatgtgcagttagagaggcagcttgtgatggcttcttcatggagcagagctttgttgactttgcgtggaaaactgaagggaactgagtgggatcctcagaattcacacaggatagactacagcgattttttaagacttcttgactctaacaatgtccagtttatggagtactctaattacggtcaaacaatatcagttattctaccatattacaaaaatgggaaaccaataggaactgaagggaatcctaaggatattatttttcagcgccatccagtcaatagaatgccaattgatagttggaatgatgtttggagaaagctacatcagcaaattgtaaatgttgatgtcattaatgtggatgccgtgcctgctgaaatatactccactattgcagttgcagtcatatggtctatgcgtcttgctctggctgttggattttatgtgtggattgataatttgatgagaccaatatatgcgaagttgataccttgtgatttgggaactcctggccaaaaaactacgcagccattaagaagtcgtgcacttggatctctaggccagagtcgggctaaatttatatctgcagaagaaagaactggtgttacatttgatgattttgctggccaggaatatataaagaatgaactacaagagattgtccgaattttaaagaatgatgaagagtttcaagacaaaggaatttattgtccaaaaggtgtacttcttcatgggcctcctggaactggtaaaactctactggctaaagctatcgcaggtgaagcagggttgccattttttgcagctaatggcacggattttgtagagatgtttgtaggggttgctgcatcccgtgttaaagacctttttgcaaatgcaagatcattttcaccttctataatctttattgatgagatagatgctattggtagcaagcgtggaggccctgacattggcggaggaggtgctgaaagggaacaaggtttacttcagatactgactgagatggatggattcaaagtttccacagcacaggttctcgtgataggtgccacaaatagattggatattcttgatcctgctctattgaggaagggtcgttttgacaagatcattagagttggtttgccatcagaggatggaagatttgccattttgaaggtgcatgcgaggaataaattttttcgctctgaggaggaaaaggagactctacttaaggaaattgctgaactgacagaagattttactggggcagagctacaaaatatactgaatgaagctggaattttgacagccaggaaggatttggactacattggacgagatgagctgcttgaggcattaaagaggcaaaagggaacatttgaaacagggcaagaggatagtaccgaaattcctgaagaattaaaactgagattggcatacagagaagcagctgttgctgttctagcatgttattttcccgagccccaccgtccttttcttgagactgatataaattctatccgcagccagccaaatatgcgttatgctgaaatttctggccaggtttttgcaaggaaattagattacataaactctatagtgcgtgcttgtgctccaagagtaattgaggaggagatgtttgggattgacaatttgtgttggatctctgcaaaggcaacattagaagcttcaaagcgtgcagagtttttaattctgcagacaggcatgactgcttttgggaaagcatattacaaaaactatagtgaccttgtgcccagtcttgcaatgaagcttgaagcacttcgagatgagtatatgcgttatgctacagagaagtgctcatctgtgctaaaagagtaccatttggctgttgagacaatcacagatattttgcttgaaaaggggcaaatcaaagctgaggagatttgggacatttataggggtgctcctcgtgtagctcagcctgctgtcagtccagttgatgaatttggggcactgatttatgctggacgatggggaatccatgggatcagtcttcccggaagggttacatttgcgccaggcaatgttggatttgcgacctttggtgctcctcgccctacagagacacaaattgttagtgatgaaacttggaaattagtagatgatatctgggataaaaaggttcaaaacattaaagatgaagcttcaaaggtgattgaagaagagaaggaaaagccacaacttttgatggcaagccattttctttga

SEQ ID NO: 92605 - DNA, 420 bp, Glycine max
  Peptide Sequence Number=SeqID_209383
atgactaagctgctgcattacttgaggtttaatagcacaataatatcttggcgtaaaacaaaaagccgaaccaacctgagaagaatccaccgaacagataggccgtccagatcctgccgtttacacgcgcgcgactgccgctgcggcgctgccgaggaacgagaggaatccggagctattaggctcctgattgtcgagaaacagatcctcgggaacgcgaaaagccccgtgcgcgcacacgattgccaatccaaccatgagggaagagatcaacaaggatccaacactggtgggcaaaatgacaaaggtgcgttcgaagaggacgataggctgatccaaagggcgaaagagataaaggaacgaccacgacgcgaggagactgaagatcgaggacaaatagcgagaatgaatgcgcgatga

SEQ ID NO: 92606 - DNA, 321 bp, Glycine max
  Peptide Sequence Number=SeqID_209384
atggacggtttgcaagatatcctcaagagcgaacttggtactcttttccttgatggcagcggcacgaccctcggcctttctatcgagcaaggatttgtggtccttgtccattcaatgcttagtgacgataatcttggaagggtgaatgccaacgttaacattaaccttctcacgggtgatgtgctcaatgcggatgacccacttgcagcaatagacctagagccgttaacctcgtcgtccttgcgaaccgaaagggaccacacattgtacttcaaccagagatcaatggagagaggcacgctcgacggaataatgaagtga

SEQ ID NO: 92607 - DNA, 1146 bp, Glycine max
  Peptide Sequence Number=SeqID_209385
atggaggaagtatcagttataattgcaggtgcaggtccttctggccttgcaatttctgcatgtctatcacaaaactctatctctcacataatactagagaaagatgattgtagtgcctctctttggaggaaaaatgcttatgatagattaaagcttcatcttgctagcgagttttgtgctttgcctctcatgcctcactcaccctcatccccaaccttcctatccaaagatgagtttgttcaatacattgactcatacattgcccgtttcaacataaaccctctctattgtcgtttcattgaatttgctgcgtatgatgaagttgaaaacaagtggagggtcgaagcaaagaacactcttgaaggcacaagggaaatttacgtagctaagtttcttgtgattgccacgggtgaaaatagtgaagggtatattcctgatgtgcatggactagaaagctttgaaggagagataatgcactccaaatactacaaatcgggttcaaaatatgaatccaaagaggttttggtagttgggtgcggtaactctggaatggagattgcttacgatctcaatgactggggtgcaaacacttctattctcatcagaaatccggttcatgtcttcaccaaagaattgatcaatgaaggcatgcgtatgatgaagcatttgcccattcatgttgtggacactatcattacctctttggcaaacatggaatatggtgatctatctaagtatggaatttatcagcccaaaaaaggaccctttcagcttaagtttattactggaagggctcccgttatcgatgttggaaccattcgaaggattaaggagggagcaattaaggtaattccttctcatatagtgagaattgaaaacaagaaggtcatctttggaaatgatgtggaaaagaagtttgatgtaatcgtttttgctactggttacataagcgtggctaataagtggcttaaggactacaaatacattctaaatgatgaggggatgccaaaaaatgattttccaaaccattggaagggtgatcgtggattatattgtgcaggactgtcaaacagaggcttatttggagtcaaaatggatgctgaggctattgctgatgacatcaatcaaactcttaagttacattaa

SEQ ID NO: 92608 - DNA, 477 bp, Glycine max
  Peptide Sequence Number=SeqID_209386
atgaccattgttgagatagttgacactcatcgaggatttaagctggttacagacaatataacaaccaaaaacccacgccttcccccatgggtgttcagtcctagacagcttggcatccgccatagtcatgatttctctgttgcagaaattagtacctctgtcagagtatcagaatttaaatctgcacttgtgattgctttcttgatgattgttgaggaaaaaacattcaaccgtgtatgtgaatcttctaagtttgttgtttcattctccaactatttggaggatattgggaggtgttgttgtaatagcagcaaatactggtggtgcatggagtcgtattggtgttgttaccactactatgctgtggataaatggccaagtatctgcagtgcaaacaatgaaggtctattggaaaattctcttccagtttcatacatttgtttggatcatgtgaaaagtttgtgtggaactacataa

SEQ ID NO: 92609 - DNA, 261 bp, Glycine max
  Peptide Sequence Number=SeqID_209387
atgggtgcttctgacgacaacaacaacaactttctccaagttgtcttcaataactttgatgttcttgcactgcccttggttacgcttgtttaccctttatatgcttcaattaaggccatcgagaccaagtctactactgacgatcaacaatggctcacgtattggattctgtattccattctcacaatctttgagctcacatttgtcaaagttcttgaactttctaaagcaaaggaatttgtcatcctagatggtgcctaa

SEQ ID NO: 92610 - DNA, 216 bp, Glycine max
  Peptide Sequence Number=SeqID_209388
atgaagaacagcggaaaaccttcacggatttgctcacggaaacgtctcggaagtgttacagacgcacctcagcttggattttctttatggaaacaattttattctcccaacacagctgaaatgcatagccaagggggaaaagggggaggaggttgccgcccagcttgcctaggcgagctcagctcacccaggcatgctaggttgcttcctccttaa

SEQ ID NO: 92611 - DNA, 318 bp, Glycine max
  Peptide Sequence Number=SeqID_209389
atgttgtctatatcaggtcccgtggcggaggacatgtttcactggcaggcaacaatcatgggacctcctgatagcccatataccggtggtgtattcctagtttcaattcattttcctcctgattatccattcaaaccaccaaaggcaataagctatcctaggaggaaggaaattttccttaggtggtggtgcctcaggctatctgagttgcgaagccacacacctgtggtggtggtggtggtggtgcctcagtggctcaaatgctcaatgctctggtggtcaagagatactgtgggtgccagactgccaggattgtag

SEQ ID NO: 92612 - DNA, 222 bp, Glycine max
  Peptide Sequence Number=SeqID_209390
atgaccgatgtcttgcaaagaaatattcacaaagtgacaatcaattcccttaccatgctaaaggaggagcatgatcatcccatggcatacttctgtgtccagctacgagcagtggcttcatacttagccctgtcagtcttgtacatgtgggcaatttcaggcacaagcgggtcatcagggttgggatccgtcaacagtgagcaaatggacaaaaggacctaa

SEQ ID NO: 92613 - DNA, 525 bp, Glycine max
  Peptide Sequence Number=SeqID_209391
atggctataaccagaattggagtgaacaccgctgtaatggagcaattggctaacaatcaacacaacaaagatgttcacgtagaagatcaaaccaacatgtcttccatagttaggagactatatgcacaggtctccgagatgcaaaaacatcataccgaggaaatcgttgccctttgggacgagaacactcacctccaagaggcacatagacacaacagaagacatggaagagagtttaagaactggaaagtctcgcttagcgtgccaccctcgcctagtgcaccatcctcgcttagcgtgccacccgcgcttatcatgagaaatcacatgggaagccagatgtcacgagttaacaataggtcatggcaacctaaggctaatctgctgaggggaggagaggccggatcaaccgcaatcggcctaccccaagccactaatctaagcatgagtttggacgctatctccctgtccttcaataccttgggaagacagttgtcacagttcaagaacccttttcgtccctag

SEQ ID NO: 92614 - DNA, 300 bp, Glycine max
  Peptide Sequence Number=SeqID_209392
atgccacaaggatggctccgaagaaactttctgcaaaaaagagctaggaaggctactacaggggaaggatccaatgcaaccccacaagcggaaattgagtttgatgggcaccgcttccgaagcgaggagcatcatcgccattttgaggtgattaaggattggtcttttctcaaagaaagatggatccagctagcggagagagagtatacggaattccaagccgaagttgccaggaggcgttggacacagcagatagagcctatggcaaagtatgatcctgaagtagtcatgaagttttag

SEQ ID NO: 92615 - DNA, 951 bp, Glycine max
  Peptide Sequence Number=SeqID_209393
atggaaggcttagattttctagatacattttccccagtggcaaagctcacaagtgtgcgtctcttacttgctctcgctgctctccatggatggcatttgcatcagcttgatgttaataatgctttccttcatggagagctcaatgaggaagtgtacatgcaacttcctcctggtctcattgttgataatccttgccaggtttgccgccttcgacattccttgtatgggcttaaacaagcaagcaatgatcttgcaactattcgacatatcacatctcttttggatcaagccttcaaaatcaaggaccttgggcgaaagtatatcctggacattctctctgatttaggtatgcttgattgtcgtccaagcacaactcccatggattatggtacccgattacaagccacagtgggtggaccttttcctgttgatgcctcctcttcttatcgtcgtcttgttggtcggcttatttacctcacaacaactcgtcccgatattgctcatgccgttcaacaactaagccaatatatggctgctccgacgactgctcattccaatgctgcctctcgagttcttcaatatctcaagggaactcctggttctggcattttcttttctgccaccggtcatcttcaactaaaagcctttagtgattctgactgggcaagttgccgagacacacaccgttccatcactgtattttccatttatctcggcgactctatcatctcctggagatcgaagaagcagcccacggtatctcgtagctcctccgaagctgagtatcgagctttggcttcaaccacttgcgaacttcaatggcttacttaccttcttcaggattttcgtgttgcatttattcagccagctaacctttattgtgataacaatccgctattcagatcgcatctaaccaagtctttcacgaacgcaccaagcatattgatttag

SEQ ID NO: 92616 - DNA, 165 bp, Glycine max
  Peptide Sequence Number=SeqID_209394
atgaatgaagagtcatttttggttatggttggtgccacaccaacttgggcattagagcaggtgccaacaggtgctaagtccacaatcggatttgctcacgatcgaagaaaagaattaggaagtgtgagatggcaaagccttgactacaaccacgtgtccaactaa

SEQ ID NO: 92617 - DNA, 1802 bp, Glycine max
  Peptide Sequence Number=SeqID_209395
ctattgctgatctaagttcagataagcaagcccttcttaattttgctaatgctgtcccccaccgtcgaaaccttatgtggaatccatccacctcagtctgttcatcttgggtaggcatcacttgcaatgaaaatagaactcgtgttgttaaagtccggctccctggagttggactagttggcaccatcccatccaatacacttggcaagcttgatgctgtgaaaattattagccttcgctccaacctactcagtggaaatcttcctgctgacattggttctcttccttctcttcagtatctctacctccagcataataacctttctggtgatatacctgcctcattgtctccccaactcattgtacttgatttgtcatataactccttcactggtgttattccgaagacatttcaaaatatgtcagtattaactagtttgaatctccagaacaactctctatccggacagatacctaatcttaatgtcactctgctcaagcttttgaatttaagctacaaccatttgaatggctcaattcccaaagctcttgagatttttccaaattcttcctttgaaggaaactctctcttatgtggaccacctttaaagccatgctctgcagttccccctacaccttctcctgcctcgactccgcccccatcaactactggaagacaaagctcaaaaaacaagttgagtaaaatagctatcattgttattgctgttggaggagctgtggtgctattctttattgctcttgtttttgttatttgctgtttaaagaaggaagataacagaggctccaatgtaattaaagggaaaggtcctagtggtggtaggggtgagaaaccaaaagaagagtttggaagtggggttcaagaacccgagaagaacaagttggttttctttgagggaagttcttataattttgatcttgaggatttgctgagagcttcggctgaagttctggggaagggtagttatggtactgcatataaggccatactggaggagtcaatgactgttgtggtgaaaagattgaaagaagttgtggtaggcaagaaggactttgaacagcagatggagattatgggaagagttggacaacacacaaatgttgtgccacttcgcgcttattattattcaaaagatgaaaagcttttggtatatgactatgtcccaggtggaagaactccattagactgggactcccgaataaaaatatcccttggaacagccaaaggtcttgcccacattcattctgttggtggtcccaaattcacacatggaaatatcaagtcctcaaatgtcctcctcaaccaagataatgatggctgcatttctgattttggccttgcgccccttatgaatgttcctgctaccccttctagagctgcaggttatcgtgctcctgaggtgattgaaacccgtaaacactctcataaatcagatgtgtacagttttggtgtcctccttcttgagatgcttaccgggaaggctcctctccaatctccgggacgtgatgatatggttgatctccctaggtgggttcagtctgttgttagggaagagtggacggccgaagtttttgacgtcgagctaatgaggtaccaaaacattgaagaagaaatggtgcaaatgttgcaaattgccatggcttgtgtggcaaagatgccagatatgagacctagcatggatgaagcagtgagaatgatcgaagagatccggcaatctgactcagagaaccgaccatcttctgaagaaaataaatctaaggactcaaatgttcagactccatag

SEQ ID NO: 92618 - DNA, 564 bp, Glycine max
  Peptide Sequence Number=SeqID_209396
atgagcgaaagagtagagcatacgtctagcatggatagttgtctctatcttcacccaagcgaaaatccagcaatagctctcgtatctccagtgctggattcctccaattatcattcctggagtagatcgatgatgacagccttgagtgccaagaacaaggttgaattcattgatggaagcataccggaaccacaaaaatcagatcgaacatatgacgcatggcgtcgctgcaacaatatcgttgtttcctggattgcgcattcaatttcaacacaaattcgacaaagtattttgtggatggacaaagctaaagagatatggcgtgatctgaaatcacgatactcgcaaggagatctccttcgaatctccgatctccaacaagaagcagcctcgatgaaacaaggtgatctttcggttactgagtatttcactaaattgcgaattgtatgggatgaattagagaattttagacccgatcctgtttgttcttgcactgtgcgatgcacgtattctgctcttactgttatttcgcagagaaagcttgaagatcgagcgatacagtag

SEQ ID NO: 92619 - DNA, 738 bp, Glycine max
  Peptide Sequence Number=SeqID_209397
atggaggagggaaagagcaagtctacattggcgaagaatccgagccgcagccggaatccgagccggcgtgtggccttggacgtgccctcccctcgccacatgggctccaccctcagtggcatccattcctccatcgaccaccttgacaagggacgttaccacccatgttgctttgcatgttgtgcatggtcatgccttattgtgttcatcttaatcatagccattctctttcttggtattacctacttggcttttctcaagtcagggatgccaaaaattaacgtgagagccttcaacataacaaagtttcaagttgatgatgggtcacaaaagatgaattcggttataggcttaggattaatattctctaacaagaatgataagcttaagcttttgtatgggcctcttgatgttgatgtcactagtgaggatgtgctattggggaagaaaaaacaaggtggcttctctcaaaagcccttgaatgtcaccaatttggacatgaccatgacattggaaaatgccgatgttgacaagtatgccgctgaagagttgaaatcagacatcaaagcctatgagatggtgtttgatttgtatgtgggtggacacattggttttcaggttgggaaattgcagatgaataatgtaccctttctagcatcttgtaatcaaatcaagagggaggatgtggattttggaagaaagcctgaatgtgaagttaagctgtttgctgccaggtaa

SEQ ID NO: 92620 - DNA, 447 bp, Glycine max
  Peptide Sequence Number=SeqID_209398
atgtattgcacctccgagacacccagtggacccagagaagttcaacagggcactgggattttcggcattgatcacaggtctctaccaattcgacgggaaatattgcatgccaaggaaggcacaacagccggggcacgacgagcagcagcagtcgaccatggatgcaccaccaccgcctccacatcagccaccatctctagagtccatcccagctcacatgtagaggatagagctctagatgcacgccatcgccaggacctgaacccttacccgtggcctactcccgagcaggtcaaagtcactgtcacatggcctggggataggcccaattttcaggaggaggcgggtcctacaaatgctcaaggagctgcccaaggggacgaaggtggagctgaggatgatggaggcatgacagatttgcttgatttcttcattggaggagactga

SEQ ID NO: 92621 - DNA, 315 bp, Glycine max
  Peptide Sequence Number=SeqID_209399
atggagtttactctaggtgaccaacatgtatgtgtaatttcaacttcattaggtagggagttgctaggtgcacccagcaatattgctggtgcacccagcaatttattgaaaggtcaattttgcccttcatttaaaaacataaaaaactttatccctctttcagaagcattctgtcttctctcttccgcgaaaaagcttttctcctctcttctctcttccgcgaaaaagcattctgtcttcttctcttcttctccgcgaggcttctccggcttcatcttctccgcgaggcttgtcttccatttgcattcgaggtag

SEQ ID NO: 92622 - DNA, 497 bp, Glycine max
  Peptide Sequence Number=SeqID_209400
actcaagcaaccccatttcagatggcacctccactttcactcaagcaccgtttccttacaacaccttccactctctaaacccagcttcaaattttaggagcataagccccggtgatccatccaaagggattgttcttgatctcactagcaacctcaatgaaccaccactacgtttttccagtggtagctcctccaatactacaactgatcctcgtttttcttggatgcaaaacaaataccaaggtggtggtgcaattgcaatgaacaacacttttcacaagcctagggcattggatattcatgatagaatttggaaaggagaagaaagcaataataataagccactagatcatgacaatgtgtcctcaattgcctcagatcctaagtttagggttgctgttgctgcggccataacatctctcatgaataaagagagccacgctactcaccctataggaacttcctttggccctaggagtggccaaaatggtagctag

SEQ ID NO: 92623 - DNA, 180 bp, Glycine max
  Peptide Sequence Number=SeqID_209401
atgggttttcaaacaactttaatggggattggaattgaaatagcaaaggttgtgaattggatcttcaaagtggtctctggtggtggaggggtgacaatgacgggtcgttggaggcagtggacgggttgtcaaaggcagcgtataggctcgtcagaggtggcagagaaggaaggagagtaa

SEQ ID NO: 92624 - DNA, 822 bp, Glycine max
  Peptide Sequence Number=SeqID_209402
atggaagaacaaagagttcatcacgatgaaaacgtgactcgcaagcccaatttcccgctacagctgctggagaaaaaggatgagggaccgccgccgccgccgagcgcagccaaggcgaagcgagcaccgacgaaggacagacacacgaaggtggaggggcgggggcggcggatccggatgccggcggcgtgcgcggcgagggtgttccagctgacgcgcgagctcggccacaagtccgacggtgagaccatcgagtggctgctccgggaggccgagcccgccgtcatctccgccaccggcaccggcaccatccccgccaacttcacttcgctcaacgtctccctccgcagctccggctcctcccagtcccactacttcctcaaccgccacaacaatcttcacaatcacaacaccaacaactatcccttcttcacaacaacaacaccacccgaattttcttcttcaggatcgtattttaaatcacacccaagttttagtcttatgcaaaattctagaaggttctcgcgaaagaggaggcatgaggtgatttcgcacgtggggaattattgcttgtcgcagatgtgtacggactccgttcccgccatgatgagtggtgctgattcagtttgggcgattccctccgtggcttcttcttctgcgagtggcattcattttacgaattttgcttcgctgttgaccggtcaacacgtgggtggtgcaatggtgagtagtgaaacaaacttcaatgtgcttgcaacgcttaatgcgtattccggccaacaaccacatcatcgccatgaaggagaagaaacaaacaactag

SEQ ID NO: 92625 - DNA, 249 bp, Glycine max
  Peptide Sequence Number=SeqID_209403
atgacaggagtaggactggtccagtcttctgaggtattcgtacttattaattgtcttgttcttggtcttgacttgacggctgacaatggtaaacctggggattctgattcttctgttttgaggtctagcgaagaggaaatggatgatgaaggcttcttggggcgtgttccagattcatcctggacagttcctcacatcccttcccctcctactagtattataaagaaaattcttccacttggttggtga

SEQ ID NO: 92626 - DNA, 255 bp, Glycine max
  Peptide Sequence Number=SeqID_209404
atgacttacatgtacgacgacctaagacgcgctttccacgggcaaacgacacgaggtcagtatgagggagacagtcttcatgacgcgagctccactgcttcacgccgagggcttagtgatgggtcacagacttctcttcgacagggcttagtgatgatgggtcacaaatttctctttcaacacttggtgaagacaggggatgctggtgaagacgaaaggggacactgggtgaagagtggaaagggatggctgtaa

SEQ ID NO: 92627 - DNA, 1512 bp, Glycine max
  Peptide Sequence Number=SeqID_209405
atggaccctcaccgccggcaccgccgccgcacgtggtgctgctccttcgccttccctccctccagccccgacaaccttaatagcaactcctccaaacctgcattctccctcccaacctcccccaaatcccgcatccccgttaagatcgaccctcgccggatcctctccccgggaagagtctcccccatcgactccgattccgtcgccggagaacctctcccctttccccctccctcgccggagttgccgcggccgcgatctccggcggcgacctgcgagaatagggacgtgaggatgagccttagagggaataacggagggtgcatggttctggaagtgaactcggaagttctctgcgcgaattcggaagtgttcgcggggttgatagaggattacaagaaagggtcttggagtgggagtgggagtgggagcaacaaaatgtgtagaatagaggttcctgaagtcgataacttgggagtgttcagagaaaccattgagcttatgttcgaaaacgaggatggcgtcacaaaaaggcttcttaacattggcgtttttcgatccattgacattttggaggtttcagcaggcatcatgttcaccaagggtgttttgtcttgtttacaataccttgaagctgtgccttggactgaagaagaagaagaaaaactgagaagtctattcacaagattcaagtttgatgaagcaacaacaagagacatcctaggaaggctttacttgcacgattcagtagattcttcttcccagcctaatgtggctcgacaacttgtatggtctatcaccacctgtgtggataacaatgcaagaaatgaactaaagacactagtgaagggtcttctttgcaaaagctcagtgtatgagaagaatcaccttgacctcagcaaggaggatctgtattctgtgtgccaatcatgtctggacacattgataagcctctttgaggaggcatctgacactgaaaggttgacaaagaaagataagaataagccattgatcgaacgcatctcaagacaggttgataacatcaactggttgttggaaatcatgcttgatgggcaaatagcagaggactttgtgaacatatggacggatcagcaccaacttatcaaaatgcatgaaaatgcatcccctatggttagatatgaactaagtcgcgtgtcagcgattctctttgttgccatggctaccagaaaattgcaatgtcggttggaagctcgatcggggcttcttcaggcatggttccggcctatgcttttggactttggttggcttcagagatgtagaagagggcttgatataaaggtcttgcaagaggctatgggtcaaacacttcttactctacctctaaatcaacaatatatgctcttcatggaatggtttaggtatttctcaagccatggtactgaatgtccgaatctaagcaaggcattccaaatttggtggcgcagatctttcttaagaggctctgaaactgatgccattgaaacaaggtaa

SEQ ID NO: 92628 - DNA, 477 bp, Glycine max
  Peptide Sequence Number=SeqID_209406
atggagatgggaattaatgatggtaatagaggtttatggagtgaggtggtggagtcagggggcaatcatcttcaaagtggtttgatatttcggttgagtggaaagaggggaagggagataaaatcttgttttagagtgacccttggggagtggtttgaatggaagaatgtagatgttgaaagattttatagggagttgagggagatatatttaccaaaagccatttcggtttcatggagcgtgtttccttgcactaaggaacattatctgaaacatgtgttgattaaagagaagaaaaatgtttgtgaaaagtcgaattgcatttgggtaggtgtcttgtggtctctatggaaggcaagaaacaacactatcttcaggggaggtctcttcgataaggacaagatcatgcaagttgtctttcatatgtggacatggctgaagaatttagactcatcgtttggttattcttatgactaa

SEQ ID NO: 92629 - DNA, 1497 bp, Glycine max
  Peptide Sequence Number=SeqID_209407
atgccagggtatcggtttcaacccactgacgttgagctgattgagtattttctgaagaggaaggttcggggtaagaaattcccttccgaaataattgctgaagttgacttgtacaagtttgctccgtgggatctcccagctatgtctttgctcaagaatggggatttgagttggtacttcttttgccctcggggaaagaagtattcgaccggagggaggttgaatcgggccaccgaggctgggtattggaagactactgggaaggatagaccaattgaacacaataatacagttgtggggatgataaaaaccctggtttttcacactggtagagcccctaggggagatcgaactgattgggttatgcatgaatttagacttgatgacaaggtgctggctgacgaagccgtatcacaggatgcctatgtgatttgtagggtgtaccaaaaggaaggtcctggtcctaggaatggtgcacagtatggtaaaccatatgatgagaaggagtgggaaacagatgaggaaattgattctgtacaatctgcccctgttgctgctgtttgtgcacctgttcctatacaacctagtgaaagccatatttctgttgctaattacacccatccctctacaagtggatgtgctggattgacctctgtatcatgtgtatcagaattgatgccctcatgctcgacacatccttctgcactaaacaatccggttgactctgtatcatgtgtatcagaattgattccctcttgctcggcacacccttcagcaccaaacagtcaagttggctctttatcatgtgtatcagaattgatgccctctttctcgccgccttcaacaccaaaaaatccagtttactctgtatcatgtgtatcagaattgatgccctcttgcttggcacatcttttggcatcaaacaatcaagttgactctgttccatgtgtttcagaattcatgccctcttgctcagcacatccttcagcaccaaacagtcaagttggctctgtatcaggattgataccctctttcttggcacattcttcagcatcaaacaatcaagttggctctgtaccatgtgtaccagaattggtgccctcttgcttggcacatccttcagctccaaataatcaagctgacgttggcattctaccttttcttgattgttccatagaagatgatgacacattggctgtgaatgaaaacaacagcattgagaacgttgatgatcctgatcaggcaaacaatgcagaacgtggaccatgttcagatccacatgctatttttgaggacttaggagaccttaacagcttggttggattgggagaaggcagtttttcctgtggccagaaaaatgaatatactacaagcgcaatgctttatacaggtgatatatttaggtcttgtgaccatgactttttggagttgattgacctagagacgccgccaccgctctggcagaataaacatggaagtgatagccaagataagtaa

SEQ ID NO: 92630 - DNA, 1221 bp, Glycine max
  Peptide Sequence Number=SeqID_209408
atgtctttgagtggatttgaggctgcaatattaaagttggctaggagaaagggagatgatgcactaaaggcagcattagcatctcaatccctagttcaactaggacttataatgactttgcccatgtttatggaaattggactggagagagggttcagaactgctataggtgagctcataataatgcagttgcagctagcaccagtttccttcactttctctttagggacaaagctgcactattttgggcgcactgttctgcatggaggggcaaagtacagagcaactgggcgtggttttgttgttcgccatgagaagtttgctgaaaattacaggatgtactctaggagtcactttgtgaaaggaattgagctcacaattttgctcatatgttataagatttatggatcagcaacacccgattcagcgtcctatgctcttctctcatggtcaatgtggtttatggtctgttcatttctgttttctcctttccttttcaacccatcagggtttgaatggaagaagatagttgaggactgggatgattggcaaaagtggataagtaatcgaggtggtattggtgttccttcaaacaagagttgggagtcatggtggaatgaggaacaggagcatctacagcacactgggtttctgggacggatatgcgagattatacttgacatgcgtttctttgtctatcagtatggtattgtgtatcatctaaatgtagccagaggtgacaagagcatattggtttatgctctgtcctggatagtgatagtagctgtcatggttatccttaagattgtatccatgggtagaaagcaattcagcgcagatttccagttgatgtttcgtcttctcaaattgtttctgttcattggagccattgtcgctctaagcttaatgtttactctgctgagtctcacagttggagacatttttgctagcctcctagcctttttgccaacagcatgggcagttattcagataggacaagcatgcaggccattcttgaagggctttggcatgtggggttctgtcaaagctttagcaaggggctacgaatacttgaagggagtggttatttttgcaccagtggccatattggcttggttcccatttgtttcagaattccaaactaggctgctgttcaaccaagcattcagccgagtacttcaaatccagcgcattctgattggcggcaagaagaataagtag

SEQ ID NO: 92631 - DNA, 789 bp, Glycine max
  Peptide Sequence Number=SeqID_209409
atgacacctcaatttgcagcaagccactcttttttccgcgttcctcccacttccccttctctccgtttcacaaggaataaagatttgattccagaaagatatactataatcaacaggaaaaagaatcatgccatcacagcttttgcaggcaattctcttggaaaatcagctatccaactcaatgctgcttcatctccactatttgctgataaagaagctcacctctcactcaaacttcctatgtctcgaaaatccaatactacaatccgacaagcatttatatatcattcatctggtttccgaatcccatcaaatgctgagaagccagaatggtggtggaggactttatcctgtgttccctatctgttagcattgcagatatctgcagctgggttttatctagaacctatccttgagaaatttccattgtttcggaatttggttttttatatcccaggagctgtcaaccgattaccaaactggttccctatgctatattgcaatgtggctattgtatgggtggtaaaaaacaaggacttgccccttatcttcagattccatttaatgatgggaatgctactggaacatgctctgcagatagtgtggatttcaagcaatttcctgccacttatacacttcaagggaactttggggatgtattactgggctggtgtggcgttgacatatatttttgtaataataaggtgcataaggtgtgcacttctgggtacatttgtgagtatccctctacttagtgaatcagcttttattcattctctatttagttaa

SEQ ID NO: 92632 - DNA, 192 bp, Glycine max
  Peptide Sequence Number=SeqID_209410
atggcaaccttagcatttgtcacttcaacacaagagtgtcaagaaagatggggaagagagcattttagacttgaagacacgacaatggtaatctcaaaacaaagaatcaagctttctccaaagtctaccatgcaaaaagctaagaagccaaagcttctaattccaaagtcttctatgcaggaatacaactag

SEQ ID NO: 92633 - DNA, 666 bp, Glycine max
  Peptide Sequence Number=SeqID_209411
atgggaggtcggcaaggtgacacgaagttctatgcgaggtctaaaagcccgggtcctgggtcaagagggcccaccagcccaacatcacctcttcatccgaagttgcatgttttgagtcttgactcccctacaggcaggcaagaaggtgaatgtcatccattgcctcttccgccaggttctcctaccagtccttcttcttctcttcccagcacaagagcaaatggaatgacggaacacactaccggtaacctttcgaagtggaagaaaggaaagcttcttggtcggggaacatttgggcatgtttacctgggattcaatagtgatagtggacaattgtgcgcaataaaagaagtcagggttgtctgtgatgaccaatcatcaaaagagtgcctcaaacaacttaatcaggagatccatttgctcagtcagctttcacatccaaacattgttcaatactatgggagtgatttgggagaagaaacactttccgtttatttggaatatgtctctggtggttctattcataaattacttcaggaatatggggccttcaaggagcctgttattcaaaattataccaggcagattgtctctggactttcctatcttcatgggagaaatacaagaatgaattgcttttgctcacttgaaaagttgttgcttctg

SEQ ID NO: 92634 - DNA, 325 bp, Glycine max
  Peptide Sequence Number=SeqID_209412
atgcacaaatgccctaggtgtggggtatcacggtacaaagtgaagaatgataacgagtgtagtagtgacaaaaacaaagaagggcccccagcgaaggtgttgtggtatcttttgatcattccaaggtttaagcgtctgtttgctaatggagatgatgcaaaagaccttacatggcatgcaaatgggagaaactacgatggaatgctctgtcatccggttgattcctcccagtggaagaagattgatcgtttgcatccagattttagcaatgatgcaagaaatcttaggcttggacttggcactaatggaatgaatccatatggca

SEQ ID NO: 92635 - DNA, 396 bp, Glycine max
  Peptide Sequence Number=SeqID_209413
atgcagagtgggtcccaatctgaaccgtttgatgtagaaatgggagatcttttagaggattttcagcaagcacatgcccctatgtatgatacattgcaaattgattcaaagaagcctttgtatccggggtgcaagaattccttgatgatgttgtcggcagtgtttagtttggccaagaagatattgtgtccgataggtatggagtatcagaagattcatgcttgcctgaatgattgcatactgcacatacatgaattacaagaaattcccaaatgccctaggtgtggggtatcatggtacaaagtgaaggatgatgacgagtgtagtagggatgaaatctcaaagaagggcccccccagcgaaggtgtggtatcttcccatcattccaaggtttaa

SEQ ID NO: 92636 - DNA, 291 bp, Glycine max
  Peptide Sequence Number=SeqID_209414
atggacaattcaagatttaatacaacgattaatgcaaactatcccgcaagaatcatggtattcaatctcaaacgggaatctaagcgaacaagtaataaaaacattggtaacagacaacaacatcaaaagtttacaaaatacatttgtacctgtgatgatgagcaacatggtccaaaaacagagcaacaatctaataaagaactcaatcaccaccttcatcaatcatcattcccaaaaacattagatataaaacttcctcgacatagccaacacagtccaaaaccaccatga

SEQ ID NO: 92637 - DNA, 345 bp, Glycine max
  Peptide Sequence Number=SeqID_209415
atgcgaggtctagccaagaatgttgtggccaccatagtcgaggcaatgccatgccactccaccatggcacttggcaaaaactcaaccatgcgaatagtggaaacttcgtcttggttggattcattgacaactgactggatagtcttgttgtgttgtgttgtgttacttcctaattggaaattgaaatcgaaatccctcttcctagcggtggtcattgtggtcgtggtttttttcttgcatgatgcgctcaggagtacagacgagcttattggggattatcaagaatctccttatggtcttatgcttggtgacactcctaccaatggggcctatgtccctatttga

SEQ ID NO: 92638 - DNA, 522 bp, Glycine max
  Peptide Sequence Number=SeqID_209416
atgcttgccaaagctgttgctaatcataccactgccgccttcatcagggttgtaggatctgagtttgtgcaaaagtatcttggtgagggtccacgaatggttcgtgatgtatttcgtctcgctaaagagaatgcgcctgctattatatttattgatgaggttgatgcaatagccactgctagatttgatgcccaaactggagctgatagagaagtacagcgtatccttatggaacttttgaatcagatggatggttttgaccaaacagttaatgttaaagttattatggcaactaacagagcagacactttggaccctgctctgttgcgtcctggaaggcttgatcgtaaaattgagttccctttgcctgatagacgtcaaaagaggcttgtttgcacagccaagatgaacttgagtgatgaggtagatctggaggattatgtttctcgccctgacaaaatcagtgctgctgagattagcaagatgacactattccatggggaaattgtggaacagagttga

SEQ ID NO: 92639 - DNA, 1509 bp, Glycine max
  Peptide Sequence Number=SeqID_209417
atgaagataggggaggaagaggacgaggaagaggaagagcaaggggatgaggttcttcctgtggcagaggaagagggagacaatcaatcaacaaagctgaaattgaatgcttcaaacaaggtagatcaggaggatgaactcttgctaatggcttatcttgattttaagcaaggaatgatagaggaatggtttcttgactccgggtgcaacaaccatatgagtggtaacaaagactggttctcagaattagatgagaactttagacatgcagtaaaacttggcaatgacactcgaatagttgtaacggggaaagggagtgtcctgttgaatgttaatggagtcacacatgtaatctcacatgtgtactacgttccagaactaaagaacaatttactaagcataggacaactccaagagaaaggcttgtctatactaattcagaatcggaagtgtaaagtctctcatcctgaaacaagacaaattctggaaatagaaatgaagggaaataggattggtttgaagacactttcctccaaacaaatggtgaatggactgcctactgtcacaattccaagagagatctgtatgcactgtttggctgggaagcaacatcgaaagcctatgcctaggaaaagcctatgtagagcatcaagcaaacttcaacttgtgcatgcagacatatgtggacctatcaatccaatatcaagcatcaacaagaggttcaaggtgctggttgaaaaggaagctgatgtaagcattggatgtttaaggacagatagaggaggtgaattcacttcaaatgaatttggtgaattttgtaaaaaccatggcatacgtaggcagttttctacaacctacacacctcagcagaatggagttgctgagagaaagaacaaaacggttatgaatataatgcaatctatgcagaatactattgattactttcgagtatttggatgtttggctcatgtccatataccagatcaaaaccgagtaaaactggatgataaaagcaagaaatgtgttctcctaggaaatatagaagaacatcaacaggatactctagagtggggagataatgaagagtatgtgagtgattccgaaaagcagtctgaagaaaatgttgtgaaaagtattggtgctcaagaaaccaaggatcaaaatgaagatgttgagaatgattctacaggtactgatacttatcctaatgactctcatattattaattatgaaactccagttgaagggagggttagaaggaataggagaaaacctgtttggacgaaagattatgaaataggagaagtggagaaatgcaatgatgaaagaaatggaatcaatagagaaaaacatgacttgggagctcacgatctaccaagaggagtaaagccaattggagtcaaatggatcttcaaaaccaaatttaaagagactagagaaatagacaagttcaaagccaggttagtagctaaagggtacatgcaacaatatggagtggattacacagag

SEQ ID NO: 92640 - DNA, 273 bp, Glycine max
  Peptide Sequence Number=SeqID_209418
atggaaaattccatagtagtgaactttaatgtaaacttgcccctggtgaaacgagctagagttagaatgggtaaatcatccacagaggcaaaactcaatagcatttctcaagttcagccccatgttctaaaaaagggtctcatcaactgtttaattaaaaaagaccaaatgttaggctgctctgtggatgatgaagttgttttacctccatctaaatgcatccatcgtgatggaagcttgcttgtggggcttctatggaggctagatctttga

SEQ ID NO: 92641 - DNA, 225 bp, Glycine max
  Peptide Sequence Number=SeqID_209419
atgcaaagcaacgtggcaatcacgagggttgaaaatgagctgttaactatgcagtgtgtagtgtttaaaggagtgatgaaagttgggattttgatttttgaggcaggggattccgtcacacgtgagtgtacggctaaggacgtcaccactgagtccgagggtttttaccgacacgtgtccttacagcaagtggcccatccttcaataaataatacgctgttataa

SEQ ID NO: 92642 - DNA, 3399 bp, Glycine max
  Peptide Sequence Number=SeqID_209420
atgatgccattggaggtggtgagagtttttgaggtcgatgtcatcagaggcgacgaagaaggcaaggacatgggtgatgaagtagcgctcgtcattggtgagggtggtttgctggtggagatgaggaacaagacttgcacgacgctggacgatctaggattggagcttgaagaaggaaatgagaatagccattctagaatgggtgcacctagtaaagagatatttttgttcgttgcggtctttgggaggtgtaggatgcgaaatggagttacaagatataaatgccttgtccatttcagaattcattcacacactccttttcacattcacttcatcttcaccatggccgttcgagaagagagagtcacggaggagaacgacgcagaagaggcgaagcgactgatgctgaaaatcgccgcgattctggacgaggcccgaacctcatacgccacgcacaaccgaaagctcaaggaattgtcgctcctccgatccaaatcctcttctcattcgcacttcttctccggcttctccaaaaccataactcctctcttcgacttccagaggcgcctcgcctctgccgaccgtatcgtttccttcgtctccgccttcgccgccaccgctgctgcctccggtgacttcctcgaccacttcctcaagttcctcctggctgccgccgcagcatcaaacaaaaccgccaggttccgagcctgccagatcgtttccgagataatattgcgtcttccagatgatgctgaagtgagcaatgagatatgggatgaggtgatagagtggatgaaggtgagggtgcgagacaagatccctgttgtacgtacttttgcggttagagcgctttcgcgctttgtgaatgactctgtgaatagtgacatccttgatttgttcctcgaggtgcttccattggaacagaatgcggatgttcgtaagatgattgtgttatctttgcctccttctagtgcaacctctcaagttatcattgattgtaccttggatgtgagtgaatctgtacgcaaagcagcatactgtgttctagctaataaatttcctcttcaaagcttaagcattaaactcaggacagtaattcttcggagaggacttgctgaccggtctgttgctgtctcaaaagaatgttttaaactattgaaagatgaatggctcatgaagtgttgtaatggtgatcctatagaacttttgaagtatcttgatgttgaaacctacgaatcagttagtgagtctgtaatggaagcgcttcttaaagctggtttagtagaactacagaatggtgcaagtatccagcagtacatatcatcaaatggtgacagaacagaaggggattcggttcattgcccaccaagcattcagccgatggaagcagaggctgctctttattggagaactgtttgcaagcatttacagtcagaggcacatgccaaaggctctgatgctgcagcaacaatgggtactgaagcagaagtatatgcagcagaagcatcagataaaaatgaccttctagaaaaaattcttcctgcaacagttggtgaatatatagaattggtcagagctcatactaatgctggatcaaaccatcgctttgcatgccggcagctgcttttgcttggtgcaatgtttgatttttctgatgttacaaatagaaagactgctggtgcatttctgcatgagcttatgtgcaagcctcctgagcatgaggatgatgatgaagggaatatagttgttcttggagatggattaagttttggtggagacaatgactgggctgaagctgtagccagtttagcaaggaaagtccatgctgctcctggtgaatttgaagaagttattctagcaataatagaagagctcgcccaaccttgcagggagagaacagcagattatgtgcagtggatgcactgcctctctcttactggtcttttgcttaaaaatgcaaaatcacttcgctttcttcagggcaaggctattggacctgatgagctactccaatcgttactactacctggggcgaaacaatctcacttggatgtgcaaaggattgcaatcagatgccttggcctttttggacttttggaaaggaaaccaagtgcagaacttttgaaacagttgagaatttcatatattaaggggccacattcaatcagtatagaggcatgtaaggcattaattgatcttgtgatgtggtatggtcctcaagaagttgacaagatgttaaacctcagtattccatgccaattaaacagtgagaagacgactttttctcctgtgaatttttctgattcagaaagggaattagatgttgggacgctcgatatcttatatggcggctttgaaaatgatgactgggcgagtcctttacctagcaacgaagatgagtgcgttcatgctatacttggagaggggtttgccaaaattcttctcttaagtaacaactatccaagcataccagcttctttgcatcctgttattttatcaaagctcatttacttgtatttcagtgacgtgtcggaacacttgcacagttgcataacgaagagtttcattccagcaatgcgttcaatgtggccaggaattttcggcaattcttcgggttctacttttatggtgtcgcagatgcgtaagcgtgctgttcaagcttcccgatttatgctgcagatggtgcagattcccttatacgctaaagagattcaaccagattgtgaaaatactaacacggaacatccacaagtcatagatagttgtgtggaacttccatttgaatgtggagaggaggggctcgcactacgcttagccgtagaggtgacaagctttcaatcgaagaaaacagcttctgagaaggcatatgtgtcggctttatgtagaatacttgttttgcttcaatttcggatatcagaacaagggccagtaaaatttatgaagagacttttatgtcgcgtgattgaatgtgcatcttcagagaaggatcttgttaaggaattgaaacgcatgtctgaacgtctcatgacagtagatagtcaaccagatcaggaattgatgcaagatgaagttaatcttattttggggaaattggaacttgactgcgacctggatttggatggttctgtgtcaatgccgcaaacaccagctgcacccgcaactaggcccacacgttctaggagaagggtaaggattgaagaagaaagttctgatgaagattcaccttctgtggttcctaccacccaacacactgtacaaagtcgctcacaaagagcaagcaaaacggcagcaatgaaaaagatgtcttctgctactagatcgctcaaaattgatgaaatggaagaactagatgaagaagactctgatgtgacagcagaagattatgatgcatcggattag

SEQ ID NO: 92643 - DNA, 246 bp, Glycine max
  Peptide Sequence Number=SeqID_209421
atggagattaagaggaagaagaatgtcattagttttgctatgctcatagcctgcaaggatttggaggcagagattgaggtgaatatgagtgaagatggggactttaagcaagaggatatactaaaggcagtaaaaactatcatggtggaggatgatgaagagcctgggaagcgcataaaagaaaatcacatgaaatggaaggagtttttatccaggtttaggaattcagaacaaattcatcactga

SEQ ID NO: 92644 - DNA, 1138 bp, Glycine max
  Peptide Sequence Number=SeqID_209422
ctgccggcgcagtaccaccagcgcgcgcacaacctgttcaatcgccacgggctgacggcgctgctgatcggccgcttcctcggcttcgtgcgcacgctgctgccgaccatggccggcatttccgggctcaacagctcgcgcttccaggtgttcaactggctgagcgcggcgatctgggtctgtgcgctggtgggcctcggctacgctttcagtcaaatccctctggtaaaacgctacgaaagccaggtgatgaccggcctgatgctgctgccgctgctgctgctgttcgtcggcctgctgggcgccatgctggtgatctggcgcaaaaagcgcgcttcctcttcctaaatccggcgcgctacagcgccttctcgaccagcgcccggcaagatcgcactgcccccccgggcgacttcatcgctcggcgtcatgccgaacagccgcttgaattcacggctgaactgcgacgcgctctcgtaaccgacgcggatcgccgccgtgctggccttcaggccgtcatgcaccatcagcaggcgcgccttatgcagccggtacgacttcacgtactgcagcggcgaggtgttggtcaccgccttgaaattgtggtggaacgccgagacgctcatgttgacctcgccggccaactgctcgacgttgaggttgtcggcatactgatgttcgatgcgccgcagcgccttggcgatctggctgaagtgggtatggcgattgaccaactcctgcagcgacgcgccgcaggtgccgcgcagcacgtagtaaaggatctcgcgcacaatctgcggccccagcacccgggcgtcgagcggcttggccatcacgtccagcaggcgttcggtggcgcacagcagcgcttccgtcagctcggccaggttcaccccgttgctctccgcccgcggttgcatcaggtagtcgtcgtcgccgatgtcgatcagcaaatcctgcagcatttgggtatcgatattgaccgccaatccaaccagcggcagttccgggctggcgaaggtttcgcattcgaacggcagcggcaccgtcatcagcaggtagttgcgcggatcgtactggaacaccttactgccgcaatagccgaccttgtgcccctgaaagatgatgacgatccccg

SEQ ID NO: 92645 - DNA, 225 bp, Glycine max
  Peptide Sequence Number=SeqID_209423
atggaacctattgtttatcccaatatcaacaattccattctctttgcctgcctagtttcaattctgtccaatttccaaaaccaaaacaagccacacaagttcatggcaactcccaataacagactctctcttgccatggagagaactgggcaatgggttttctctcaagacataccaactgatgttatagtggaagttggagaaacaactttctctctgcacaag

SEQ ID NO: 92646 - DNA, 207 bp, Glycine max
  Peptide Sequence Number=SeqID_209424
atgcctgtatgcaaaatgttttatgtccctgacatgttaaggatacggtgcgttgtctggcaatgccacaacccatcaaccattgaagctatggctaaaatgcttaaatggatgtgtgagactcaatccttcatgctgagttggccacatgatccaaatataaacatcacttttaaggcaactttatttgtaacagttaatcattaa

SEQ ID NO: 92647 - DNA, 282 bp, Glycine max
  Peptide Sequence Number=SeqID_209425
atgaaacaagggatgagagctttgtttttctaccaaatcctagaggtagattttgaagattctgtttcgattaaagtgttcctctttgtgcggtggtctagtggcaagcaacgacgactcgtggtggccaccagtggtcatgggtggtgcaagaaaagatcaggaacctgtgcacatgatgataatctcattcgcacagggaaggtacctatcattgttcaaatgactgagaaaagtataaaagacaatatagtcatggggaaattctggtgcccagagtga

SEQ ID NO: 92648 - DNA, 728 bp, Glycine max
  Peptide Sequence Number=SeqID_209426
atggagatagttggtggatcatcagcagcagcaagcccttgctcatcttaccatccaagtccatgtgcttcctacaatccaagccctggctcatcatccccttactacacccaaattcccaatcctgatggcaactccctcattccatggctcaagaacctctccactgcttcatcttcagcatcctctcccaagcttccccacctctacctccacagtggctccatcagtgctcctgtgacgcctcctctgagctctccaaccgccagaacgccacgaatcaatgctgagtgggacgagcagtctgcgcggccggggcccggatggaccagacagcagcactactcattcctgccatcttctagtcctcccagccccggccgccaggttgttgaccctgaatggtttgctgggatcaagcttcctcatgttagtccaacctcaccaacattcagcttggtctcctcaaacccttttgccttcaaggaacatgctttgccctccagcggttcgccaatgtggactccggctcagagtggaacatgctctcctgctgttccaccgggttcttatcagaatgctgacattcctatgtctgatgccgtttcggatgaatttgcatttggaagcaacgtgttggggcttgtcaagccttgggaaggagaaaggatccatgaggaatttggatcagatgatcttgtactcacacttcgtcactcaaagaccag

SEQ ID NO: 92649 - DNA, 1662 bp, Glycine max
  Peptide Sequence Number=SeqID_209427
atgccgatcgaaatgcccaagggattgcccttctcggtggacacatggactccttcgtcgtccaagaggcactgtttcctcacgcacgctcacaaagaccattcctcttccatcacttcccactcttcatacccaatttactctaccaatctcaccaaaaccattctccttcaacaatatccacagctagatgcttccttgtttctcaacatagagcttggtcaatccttggtcatccatgaccccgccgccgccccattcaccgtctccgcttttgacgccaatcactgccccggggcggtgatgttcttgtttgaaggcaaatttggtaatattctgcacacgggagattgcaggctcactcctgagtgtttgctcaacttacctgacaagtatgttgggaggaaagggaaagagcctcgctgccctcttgattgtgttttcttagactgcacttttggcaatttctctcaggggatgcctagcaaacattctgctattcaacaggttattaattgtatatggaagcatcctgatgcacagacagtgtatctaacctgcaacatgctcggtcaggaagagatccttgttaatgtgtccgaaacatttggggccaagatatacgttgataaagccaagtattcagaatgttttgagaatctagcacttactgtgcctgaaatcctctgcgaagatccagcttctcgtttccacttgtttgatggatctcgaaatctatatgaaagagctaaagcaaagcaggttgaggccaaagaaactctccaacccgagcctctcattgtgcgcccttctgcacagtggtatgcttgtgaagaaaagttctcagatattgataacactagaaagaagaggatggacgaagcagttaaggatcagtttggtgtctggcatgtttgttactcaatgcactcatccaaggaagaattggaatggacacttcaacttcttgcacctaggtgggttgtttcaacaacccccagctgcagggctatgaaactggattatgtaaagaaacacttatttaactctaaaggagctctcaacaactctatgtggaagcttctggatatgactccggaaacttctgatcatgttgatacgtcagaaaaatctgtgagctgtaatcttgttcttgaagaaacccctcagccttgtgcacaatctaatgtgctaactaaatcacctgtcaaacagttcactgaggctaaaacactaaaagcactgcttcttcatgacaaaagcttgcctatcacgttatttggaagagcaaggttcactctccaagatagtggcttttcacgagtaggatgtaacacattgcccgttaatgtccttacccaaacagtttcaaacgatgcacgacaagaattcttgaaagatgctgaggatgctgaagtgaaggagaggtcaccagaaaaaaagaatgatttacatcaagtggagaagaatcagcaaactgaggttcaggaggacacaagagttcataagggtgcctcttatctaaatatcggatcttcaggcttgagtggaactgtgagaaagttgtacgggtcaatgaatgttcctgtgcctcaacctcttccctccttaagggatcttataaattccagaaaacgtgtcaagaggggaattaaatattaa

SEQ ID NO: 92650 - DNA, 126 bp, Glycine max
  Peptide Sequence Number=SeqID_209428
atgtatgggaacttcaaactcccaaaacactgcgacaacaatgaagtcctcaaagctctctgcaacaaagctggttggaccgttgaacccgatggaaccacttaccgcaaggattatctcttgtaa

SEQ ID NO: 92651 - DNA, 498 bp, Glycine max
  Peptide Sequence Number=SeqID_209429
atggcgttctctgctactctatcctacacctccttcccttgccttcctcgtttcccgcaaactttgagaacaaaaagtgttcatttccctctgattcgtgcagtgcaaggtggtcaagcagagacacccgagagcaagaagagtgaagggtcatctaatgctcagtcttcaagtgctgctgctcctaaacccaagaaacccgtctattccttgaagaaaggtcagattgtgagggtggacaaggagaaatatctcaatagcgtcaattatctttctgttgggcacccaccttattacaaaggattagattacatttatgaggaccgtggtgaggtcctggatatgcgtatatttgaaacgggagaatatgcacttattgcgtgggtaggggtccccactgctccagcatggcttcctacggacatgcttatcaaggatcagcttaagcaaaagcctaatcaagctgagccagtatttggacaagaacagcttgtttaa

SEQ ID NO: 92652 - DNA, 915 bp, Glycine max
  Peptide Sequence Number=SeqID_209430
atgaatctctcttatcttactcgcttccccgagcgtctcgttgctcctctttatgccacacttcccactacagctactactagtggaaataggcctgagaattttgcgattgaagggcgtaatttgaaattctcattcacgacgaggcaaacacaggatgtaccggttcttaaggattgttcgattcgcattccttgcgggcagttttggatgcttcttggacccaatgggtgtggaaaatctaccctcttgaagattttggctggtctcttgactccaacttcaggaacagtgtacgtgaatgggcctaaaagttttgttttccaaaatccagatcatcaggtgacaggaatcttctgcctcattcttagcgagcaccatgggatgtacgccaaagggcttaacagtagtgtgcctcagattgctcttcagcctagcaatgatttgagtgtgagggtggtaatgcctacggtagattctgatgttgcatttggtcttggtaagatcaatttggctcacgatgaagtcagatctagggtgtcaagagctttgcatgctgtaggcctgtctgactacatgaagagatctgtccaaactctgagtggtggtcagaagcagagggttgccattgctggtgctcttgctgaagcttgtaaagttctgttgttggatgagctcacaacattcttagatgaagctgaccaggttggggtcatcaaagctgttaggaactcagtggatacctctgcagaagttacagcattatgggtcacccatcgcttggaagaactggagtatgcagatggtgccatctacatggaggatgggaaagtagtcatgcatggagatgccgctagcattaggagtttcattgaagccaggcaatctgcctatataacccagattaattcttaa

SEQ ID NO: 92653 - DNA, 387 bp, Glycine max
  Peptide Sequence Number=SeqID_209431
atgttgacgcttcgaagggtcatggatacagcaaagctagttacaaaatctggaaatttaaatgagttttcgatggtcttgttgaacaacaccctttctttgcctttgggaattttcatgataattgttttcaatgaagtggattatctcttaacaacgccacttctgagattgcctagcttttggctggtgatgaccttcagtggatttttgggtctagcaatcagtttcacatccatgtggtttcttcatcagacaggagctacaacttacagaaaaataccaaaattagagacgttagtggggtgggatgaggttgaggtagagttggccaagctcgtcgttttcgaaggcaccaaggccatcaccaaatttacaagctcttga

SEQ ID NO: 92654 - DNA, 489 bp, Glycine max
  Peptide Sequence Number=SeqID_209432
atgtaccgaatcgccctccgaaacgattcggtattggatgttttcccgtctccgacgccgccgaaatcctcgatcgacaagacgaccttcctcggcggaacatcgcggaagaagccggcgcaggcccgagaggaaccaaacgggcctggcgggaaggtggagggtgagaaaggtgacgagggtgaagaggaggaagatgagggcccaggagggtcgggtacaggttcccaggaccacggctccaaaggttgttttgccggattccatatatataataggaatggaacagaacagggggtgaatgatttgattttgttatggttggaaaaggtggtggtggtggtggtggtggcggcgatggaggagaaaaagaatagagagtggtggagatggcgcatagggtgtgttgtgaagctggaaggaagtgcgtggtgcactactatttgcatttcggtgaccgcgtttcacacaaaggaaggggaaaattaa

SEQ ID NO: 92655 - DNA, 243 bp, Glycine max
  Peptide Sequence Number=SeqID_209433
atggacccaaaagaatggccaataattgagccattgccatcgtatggaagaggcagagagaggctaggaggaagacatattagccttatacatggaaatggcattagcaatgttgtcattacaggcattttattagttatgtggttttgtaggacaaaatgggacagtggatggtcaaggaaggatgtggtgggaactttggtggaacagaacattggagcacacgagagggcacctccttga

SEQ ID NO: 92656 - DNA, 219 bp, Glycine max
  Peptide Sequence Number=SeqID_209434
atgacagtcacactcaagaaaaaaggaaaagcacttcctgcacaaagaagggctgccactcaaattggcgtagttagattagagcaagtattgactggaaccaaaaatggctgctatcaaagatcagggtcaaaggatagcaaaaattgttcgaaaaatagacccatcctaagaggacagagccatattcccgtttcagggaaatctctgataaggtag

SEQ ID NO: 92657 - DNA, 258 bp, Glycine max
  Peptide Sequence Number=SeqID_209435
atggccgtcgttttcactggaagtgaatcctacccaatgattttaatggcaataacttccaaggggtccattgttgatgtagagagagttagagaaggaaagagcgttgtatcgacggaaatcattcactggttttctgaagatgtcgttagagtagtttttgaaggagttcattccagggatctatcattcattggttgcagagagatcgtaggagaagagggtggaggtggcaagggaacaaacaaggatatataa

SEQ ID NO: 92658 - DNA, 900 bp, Glycine max
  Peptide Sequence Number=SeqID_209436
atgggcaatggaattgccaaaagtttcttagctgggcctggaatgccggaattctgggaattggtagggtacctttatgttgatgacgctctcacactatttggagagacgggatgcaagcctcctgttgaacgcatggacatagtaggtggttctgcagcagcaagcccgtgctcatcttaccatccaagtccttgtgcttcctacaaccctagtccaggctcttcttgcttaccgagccctcgtgcatccccctatcctccaaaccacaatgctgatggaaattctctcattccatggctcaaaaacctttcatcaggatcatcatcagcatcctcttccaagcttccgcagctgtacattccaaacggctccatcagcgctcctgtcactcctccaatcagctctccatcgtctcgaaagccccgaatcaacgctgactgggaggatctgtccactcgtccggcagcgtggggcggacctgcatacaccttcctgccctcttcaactcctcctagccccggtcgccaggttgctgaaacagattggttttccaagatcaggattcctcaggtaggactaacaccaacttctccaaccttcagcctggtctcttccaacccatttggcttcaaggaagatgctatgggtggcagcggttcccgcatgtggacgacaccaggggcaagtggaacatgttctccagctgtagctgcaggctctgaaaacacttctgacattccaatggctgaagcagtttcagatgaatttgcctttggaagcagctcatcagttttagtgaatgcctggaaaggggagaggatccatgaagcttctttcggaacagatgatcttgagctcactcttgggagctcaaaaaccaggctactccataagtga

SEQ ID NO: 92659 - DNA, 339 bp, Glycine max
  Peptide Sequence Number=SeqID_209437
atggaatcgagtccaacacaggaattcgaatatttgtttaagttgttgatgattggggactcaggtgttggcaagagtagtctcctcctctgtttcacctccgattcctttgaagatctttctcccacaattggtgttgattttaaagtcaagtatttgacgatggaagggaaaaagctgaagcttgccatttgggatacagctggtcaagagaggttcagaacattgacgagttcttactaccgaggtgcacaagggattatcatgggtgagtttcaattctgtttcctcattcaccaccctacgagtcatatttattatttgggtgaaatgttttga

SEQ ID NO: 92660 - DNA, 381 bp, Glycine max
  Peptide Sequence Number=SeqID_209438
atggagtcccccccaccccaaagatcttatgatgtaactcggcgggaaacgtttacgaatctctctgaaatatgggcaaaggaaatagacctttattcaacaaatccggaatgcgtcaagatgctggttggaaacaaagtagataaggagagtgatagagttgtgacaaagaaagagggaatagactttgccagggaatgcggatgcctatttaccgaatgcagtgctaaaactcgagctaacgtacaacaatgctttgaagagcttgttctgaagattctggatacacctagcctcttagccgagggctccaagggcaataaaaagaacatttttaaggacaagccatcccagtctgatgccacaagtagttgttgctga

SEQ ID NO: 92661 - DNA, 1123 bp, Glycine max
  Peptide Sequence Number=SeqID_209439
cttggacttgttcgaagatccagtgactttgtgcacaggccaaacctatgacagatcaagcatagagaaatggttttccgccggaaatctcacatgccctgtcacaatgcagaagcttcatgatccatccattgttcccaaccacactcttcgccacttgatcaaccagtggctccaattgggtccacaatttggtaactctgcctctattgattatttagctgcattaaaacacacccttgagtcaccccaattagaaaacaagctccaagcacttgagaaaattagagtcctctctgatgagtattgctccttcagaaaatcttgcttccaccaactaaacttcttgccactacttttggaactagtttttggtactcagctatcaaaaagtcacaacatggagttcaccgagctagcactttcttgcattctaaagttgttgcctcttgtgagtttggagcctctaaatatgatcaaagatgaatctaagttagcaacttttttgctactatttgaaaaaggaactagctcggttaagactagtctttgccatctcatagattcaacagcatctccacaaacagaagaggtatgtcacatgcttggacactctcacaaactagtgcatgagattgttgtacttgttcgccaaaactgtgaggtttccaaggttgttgcaattaaggccatgttagcattatgttccttgcaatctaacagagagaatttggtgagggaaggagcaattgatggggccataacatacatttcaggttgtgaaacaaggcagaagaacgcggctccattggcgatggcgataataaagaagcttttggtgctggatagtgctaaagaggctttggtgaatcatcctaatggggttgagactctggtgaagatggttttcagggtgtgtaatcaagagtgtagtgagagtgctgttgggatacttgcaattgtttgttgtgactttgggcgtgcaagagaggaagcaattggagctggagttttgactcagttgctgtttcttctgcagagtcagtgtggcaccaaaactaaaacaaaggcaagaatgctgctcaagttgctaagatccaagtggattgaggaaccaaaacag

SEQ ID NO: 92662 - DNA, 318 bp, Glycine max
  Peptide Sequence Number=SeqID_209440
atgaaacctggccataagctatttgagcatatcaacaaagccattcatagctccaaggttggtgttgctgtccccacaaatcgttattgtaattcctacttctgtcttcacgaacttgcccttcttcatgagtccaagaaaagggttgtccctatcttttatgacatcaagccctcacagcttcaggttgagggcaacgcacgttgtccacctcaagtgctccaaacgttcacgtctgctctggaagaaactaaatacactgtactggatggagctgcaaagacggatttaggatgctgtgatcatgaacttgcttga

SEQ ID NO: 92663 - DNA, 2571 bp, Glycine max
  Peptide Sequence Number=SeqID_209441
atgaagctgattctgctctctttttttcttttgtggtgggggctattttacagatttgtgcgctttgtcagcacacccgctattctggagaggtttgctagccttgaaaatgaaattcttcagatcgaaagttcttttcaagctaatgctctatcgatgtccattgcaactccagatgaaggatccgtaccacaagccaatggcatcacaaagaggttaagtgattctacaaagttaaatgatgtacttgaaggtgttgacaataaagaagaggaaaactcaaaggtttcactgcatcgtctgttagagtctcgaatagcactactccggaaggagcaagcaatggcttatacacgtggtcttgttgctggatttgaaattgacagcattgatgatctcatatacttcgcaaatgcatttggagcagtccgtttaagggaagcctgcattaattttaaggaattatggaagaaaaagcatgcagatgatctttggataaaagaagtagctgctatgcagtcaagcttaccaccagcactctcattgtctggatcatcaggaattatactggcaaatgatataaccacccataatagctctaaggacagcattgcttctggtgacgaaaatgtatctctggaaacatcgaattctactttaaacagaaaagaagatgtgaacctgcctacaccagatcagaaaccttcacatatggcaaatgttcatatgccaatgccctggccttacaatgtacctccatatatgtataatcttcaaaatccgcaaatgccttcataccaaggatatcctatgactaatatgcagtctgttcctccttaccttgtaccaaatatgcaatggtctcctgaactgggagtgaatcagaaatcatcagcaaccaaaagggataaatctcacaagaaaagagctgaagaatatgaagaccagcagactgagtcaagtgaacctgattctgggagtgaatctgattcagataaacagaatcactccagtcattcttcgaaggatgatctgaagaggaaaaagcacagaagaaagtcatccggaacagttgtgattcgtaacatcaactacatcactccaaaaaggagaaatggaaatgaggatggaggctctgatgaatctttagaagatgatgatgtcatcgatgacgaaaccatcaaacaaaaggttggtgttgcacttgaatctttgcaaaaggtccataaaggtgaaaaacgtgctaatggaaaaaaagcagcagtgcggcacaatgtaactaaatcacgtgatgcgactgcagaggatctcactgaaaacttgagtgatgcctctgaaggaggaaagaaaaatgacaactgggatgcattccagaaccttttgaagattgatgaggggaccggaactgatggaccagaaaggatgcagtcaattgatgtccaggatgaacattttgtgttgagaagctcggaagaaagaatgccaaacggtgctagttcatctcctaaatttgatttcaaacaagttttgaagaatcctaaagttccaaatgactcctttattgtgactcggagagatggaggaaatgaaggtggctccaagctggatgagtatgtagacaagtgtggtccagttacaaagagcagggaaaatattggtgaagaaatgctgttatcacatagatcaaaagaacacggtaatgaactcagtgatccattatctacttttgctgctgactcattacaaacaaagggcagaacagaagatgattggtttgttgttgataatttggaaaagatgaggagcgctgacccctcaattgtgcctgcagtgtttgatggtgattacacttcatcagtgaacggtcattcccaatatgagaaaagaagtgaacgaattctcattgacgattccttcatgatacagggtcaattagtagataatgatcgttctgactcacaatggaagacggacttaagtatggttgcagatctatctgctgccaagaagcttgaaagtgatgcagcagctgcttcaaatgagaagaaccaggagccaagtgacctctttgtagttctaaaacgggattctggattggactctgttgaggcctcacggacaatggactatgaaatcgacttttccttctcggagactaatagaagatcctccattgatgattctcatgaaaaggtgaatgacagccttcctgttagtcctgcgaaaaccaaagtttctggaacaagaagttctgaaaaagatggcaagtcaaaagcgctgcgatgttcctctgggaagggcaagcctgaaatcatgtctagggccagaaagccagctctccctaaaaagcctgtagttcagaagagcaaaagggaacaggaagatgagattagacagaagatggaagaattgcggaacgaacgtcagaggagaattgctgaaagaactgcatcctctggtgttggtcgtgccgcgacaaagaaagaccaaattgaaggtaaaacagcaaggatttctgccaagagtgacaagaataagggaatcagttctgtcaaggtcaggggaatttag

SEQ ID NO: 92664 - DNA, 99 bp, Glycine max
  Peptide Sequence Number=SeqID_209442
atggaagacgtgcagctattcgaactgcaagaacaaggaggaacccaggaaggtcgtctcccaacgagcaatggtcaaccaaacgttcataacagatag

SEQ ID NO: 92665 - DNA, 207 bp, Glycine max
  Peptide Sequence Number=SeqID_209443
atgactaaagcacgtcaaaagggggtacgaaaagaaaatgagggaggaccttgccacccagctcgcccaggcgagctaggttgcttcctccagaaggcaccgccttctggagaacttcttggaaggcccaaattatgcaatcatcccttctttggcttccggaatgttacggaactttacggattgcgcattaacacttccttttga

SEQ ID NO: 92666 - DNA, 258 bp, Glycine max
  Peptide Sequence Number=SeqID_209444
atggagagggagatgataacaatgatagtagacacgttactagtgttctactataagaagatggtgggttacacaccttcaagctttgttgatttagttttcgccgacgaaaggatcaaagtgggtctgagaagaggcaaatttgattatcctgctttgatgaataggaagcctggggaaaatggagagagcaagaatgagggaggaacccatgttatgactgccattgctatatggccaaattccccactagcttaa

SEQ ID NO: 92667 - DNA, 252 bp, Glycine max
  Peptide Sequence Number=SeqID_209445
atggatgccaccaccagatgttatttccaattagctggctatcaagcgtttggtcaaagcagatcaagtttaatatatcagcagactctgcgcaaaccaaacgagtatgttcagatagatataacagggattcgagcactatgggtttctacttacatgaaaaatatggatgctgacaagaaggatacaatcaaaaatagaaacgccaatgctggagttaatcgaattcctgcagcccgggggatccactag

SEQ ID NO: 92668 - DNA, 361 bp, Glycine max
  Peptide Sequence Number=SeqID_209446
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggctcgaccatcacgatcgagccatggaagtcgggtgccttcccgattctgcgtgaccttatcgtggatcgctcggcccttgaccgtgtcatccaggctggcgatcaagcttatcgataccgtcgacctcgagggggggcccggtaccagcttttgttccctttagtgagggttaatttcgagcttggcgtaatcatgggtcatagctgtttcct

SEQ ID NO: 92669 - DNA, 1692 bp, Glycine max
  Peptide Sequence Number=SeqID_209447
atggcatctatccctcatctctctttcgtgtccacagtcaacaatttctctccctactccaccactcccccttcttccttgcatccattttcacagttccaatccgctaaatataaaaaaccaaaacaccatcacattccaagagtgacatgcagtggaaaccaaaacaatccaacaccaaacccttccgaaggagaacctccacatattgtaggacataggagaagcgttctatttggcttaggaggattttgtggtgcttctacacttaacaacaacaatccttttgcatttgctgcaccactatccccggacataaccacatgcgattcaccaaacctacctgcgggtgcagaaccaaccaattgttgccccccaccatctgcttctacaaatatcatagattttgagttccctccctctaaccaacccttgagggtaagaccagccgcacattcggtcaatgatgactatgtagccaaattcgaaagagccctaaacctcatgaaaaacctcccatctgatgatccactgcacggctcttggatcttcttccctttccaccgatggtatctttatttctatgaaaggatcttgggaagcttgatcaatgacccaacctttgccattccattttggaactgggattctcctcaaggcatgcaaattccttccatttatgcaaaccctacatcacccctttacgacactctccgcagtgccaatcatcaacccccaacagtcatagatcttgacttcaatattgataatcctggtgctggtggaaatatctccaccaacctcaccataatgtataggcaagttgtgtctaatggaaggactcccacgtcgttccttggagatgcttaccatgctggggatgagcttagccttggtgctggtgctggctccttagagaacgttccacatggcactgttcatctttggactggtgatagcaaccaaccaaactttgaggacatgggtactttctattcggctgcaagagaccccattttctattctcaccattctaatcttgataggatatggtccatatggaagaagacacttggtgggcgagatttcactgactcagattggttagaatctgggtttctcttctacgatgagaataaaaatcttgtgcgtgtaaaggttaaggattgtctagacgagagaaagctagggtatgcttaccaagatgtagacattccatggtcaaactctaggcccacaccgcaaaggtctagggttcaaaaggttggtactgtagcacatgttgctgagacttcaaggaatgtgaagttcccattgatgttggattcagttgtgacgacaatggtgaagaggccaaagaggtctaggagcaagaaggaggagattctagtggttgaaggaattgagtttgagaagaacacacctgtgaaatttgatatgattattaatggtgaagattataagctaatcaaaccagataattcagagtttgcaggaagttttgtgagtgtgcctcactcgcataagcataaaaacaagaacatcgttacttctttgaagctgggactaacggatgtgttgcaagatttgggagcagaaaatgatgatagtgttatggtgacgctggttccaaggtttgggaaaggtcgcatcaaaatcagaaacatcaagatagagtttattgcagattaa

SEQ ID NO: 92670 - DNA, 315 bp, Glycine max
  Peptide Sequence Number=SeqID_209448
atggtgatgataacggatgcagaacttctgtttacaaaagttttgtttgaaactgattgcattcgccttaagcaggcctgggatcgttctattggaggggattatagctattttggaggattagtttctgactacagaacgaaatctcgaagttttgcagcttgtaggctctgtcatgttaaaagaggaagcaatatggaagctgatagtctttttaagttagcttataattttgatgtgagtaatactggttggaggaacatcctcaccagatttctgctctccttatctgatgtattctttgtttccacgtga

SEQ ID NO: 92671 - DNA, 2133 bp, Glycine max
  Peptide Sequence Number=SeqID_209449
atgttgggtgatgttgggtattgttattttgcacaagtgcaaggtggagtgatgttgggtccttcggtgcttgggcaaaaccaagcatttgccaatgcagtgtttcctctaagaagtgtgatggtgattgaaacaatggcaaacattggtctcctttattttctgttcttggtaggggtggagatggacatgacagtgatgcgcagtgttggtagaaaagctgtggcttcagcaatagctggcatggttctaccattcgtggttggaattgtcttctcctaccttttggccgaaagaactgattctgacataaaccaaggcacttttatactattcctcggtgttgctctctctgtgactgcatttcctgttcttgccaggatccttgcagagcttaaacttattaacacagagttggggaggcttgctctttcagctgcactcatcaatgatgtgtgtgcttggattatgttagctttggccattgcattagctgagtctgaagccactaccttggcttctctctgggttctaatttcaagtgcagcatttgtggccgtttgtgtttatgctgttaggccagcagctgcatggctagttaagaaaacccctgaaggtgaacccttcagtgagttttatatatctcttattctagccggggtcatggtctcaggcttcatcactgatgctattgggactcatgctgtttttggagcttttatgtttggtttgtcaatcccaaatggacaactcagttttactcttgtggaaaagcttgaggacttcgtttcaggacttctactccctctcttctttgccatcagtgggctaaaaactaacctagggctcatccatgggtcacacacctggttaattcttcttctagtcatttttctggcctgcattggtaaagttgctggaacgattttggttgcattgttttatcaaatgccaatacatgaaggagctgcccttggtttgctcatgaacacaaaaggccttgttgaaatggttgtgcttaatgttggcaaggaccagaaggtttttgacgaagaatcatttgcaattatggtggttataacagtgataatgactggaattattctgagtgggcgtacatcagccattctcattgttcacaacactgcaaaacaagatgcccctgtccttaatagaaccgaagcacaatctgaccacataatcaaagcctttgaaaactatgagcagcatgcttcatacatctcagtccaacccttaacagcaatctcccgttactcgaccatgcatgaagacatatgcaatttggcagcggacaaccgcgtgtccctcgtaattgttccattccacaaacaacaaacggttgatggcggcatggaagctacaaacatggcatacagatccatcaaccagaatgtgctagcaaatgctccttgctcggtaggaattctagtggatagaggcttaagtggctctaacaacttggcaggaaatcaagtatctcaccatgtagcagtcttgttctttggaggaccagatgatagagaggcattgtgctatcgatggagaatggtcgaacatcccgggattagcctcaccgtaatgcgttttgtccaaactgatcaagtacaacttgagcctttcagccaacaacaacaacatggtagtattgatttccatcaaccaagggtcctcacagtgcaaacagatagggatatacagaagcagcttgatgaaaagctaatacatgagtttaggatcaggtgtgaggatgataattcggttggttatgttgagaagctcgtctccaatggggaggacacggtggcagcaataagaacaatggatgacattcatgatcttttcattgttgggagaggtcaaggggtcatttcacctctcactgcaggactcactgattggagtgagtgtcctgagataggggcaattggggatatgcttgcttcttcagattttgcagccactgcttctgtcttggtgctgcaacaatatgttggggatggttcaccatgtgaaggattggaaacaccaaatgctgaagaacatattactggcattagccatagttccacaccacctccatcaggacataaaatgttcaattcagatcgctag

SEQ ID NO: 92672 - DNA, 2922 bp, Glycine max
  Peptide Sequence Number=SeqID_209450
atggcagtgggagaggtaaagatatacccagaagagaacaagaacatggatctgaaagaaatcagaataagtcacttctcacaacctagtgaaaggtgtccaccgcttgcagtgcttcacacaattacttcttttggtatttgcttcaaaatggagtcatcgacctcacagaaacgacaacagcaagatgcactctttcatttgcactcctcatgtatcagagagaacaagactgctgtaatgccagtgcgtggggaagaaatacacttggttgcaatgtattcacggaataatgataggccttgtttctggggatttattgttgcctctggactttacaattcatgtcttacaatgttaaatctgagatgtttgggtatagtgtttgatctggacgaaacccttgtagtggcaaatacaatgcgttcttttgaggataaaattgaggtgctccatagaaaaatgaactctgaggtcaatccgcaacaaatttctgctatgcaggcagagatcaagcgatatttagatgacaagaatatattgaaggaatatgctgaaaatgatcaagttgttgataatgggaaagtgataaaaattcaatctgagagtgttccagcattgtctgatagtcatcagcctatagttcgaccactgatccgattacaagaaaagaatattattctgacacgcatcaatccacagtttcttataattaaaacatgtagacttgtcagaatcattggtccaacaataacttgtgtctttggaaagattcgtgatactagtgttcttgtgaggttgagacctgcatgggaagatctccggagctacctgactgcaagagggcgcaagcgttttgaggtttttgtttgcacaatggctgagagggactatgcactagaaatgtggaggcttcttgatccagaattgaatttgataaattcgaaagaactgctagatcgtattgtttgtgtcaagtcaggtttaaagaaatcattgtttaatgtattccaaaatggcttatgccatctgaagatggcattggtaattgatgatcgcttgaaagtgtgggatgagaaagaccagcctcgggtgcatgttgtccctgcatttgctccatattacactcctcaagctgaagcaagcaatgcagtccctttcttgtgtcttgcaagaaatgttgcttgcaatgttaggggtggcttcttcaaggattttgatgatggtcttttacagaagatccctctaattgcttacgaagatgatatcaaagatataccttctcccgatgtgagcaattatctagtttcggaggatgatgcatctgcttccaatggaaataaaaatttgcttctatttgatggcatggcagatgctgaggtagaaagaagattaaaggatgcaatatcagcttcttcaactatccttgcattgactgctaatatagatcctaggcttgctttcacttcttctcttcaatacacaatggtgtcttcttccggaacagttccacccccaacagcacaagcatctgtagtgcaatttggcaatgttcagtttcctcaacctaatactctagttaagcctatgagtcaagttacccatccaggactgagcttgcatagttctcctgccagagaagagggtgaattacctgaatcagaattagacctagataccaggcgtaggtttctcatattgcaacatggtcaagatacaagggagcgcatggcaagtgaacccccatttcctgttagacatcctgcacaagtttctgctcctgcttccagtgtcccatcacgtaggggatggttttctgtagaagaggaaatgggtccacaacaactaaatttgccagtacccaaagaattccctgtagattctgaaccatttcatattgagaagcgctggccccgtcatccatcctttttctctaaggttggcgattctatttcctctgatagagttttccatgagagccatcaaagattgccaaaggaggtgcatcatagggatgatcgctcaagattaagccaatcactctctagttatcattctttaccaggtgatgacattcccttgagtggttcatcttacagcaacagggattttgactctgaatctggacgttctctattccatgctgatactacagctggagtattacaggaaattgcactgaattgtggaactaaagtggaatttttgtcttcgttagtggctagcacagaactgcaattctccattgaggcatggtttgctggaaaaaagattggtgaaggatttggtagaactagaagggaagctcaaagtaaggctgctgggtgttcaatcaaacaattggctgatatatatatgtctcatgctaaggatgattctggttccacttatggtgatgttagtgggtttcatggttcaaacaacgatggttttgtgagtagtggtaattctcttggtaatcagctattgcctaaagaagagtcaggctcattttcaactgcatctgagtcatctagggtttcagattctaggttggaagtctctaaaaggtcaacagattcaatttctgccctcaaagaattgtgcatgatggagggtcttgctgccagttttcaatctccaccagcttcagcatcaacacatttaactcagaaagatgaagtgcatgcacaggttgaaatagatggtcagatctttggtaaagggtttggagtaacatgggaagaggctaaaatgcaggctgccaagaaggcacttggaagtctaagaacaatgtttaatcaaggttctctaaagaggcatggttcgcccaggtcaatgcaaggattggcaaataaacgtctaaagccagaatatcctccaactctgcagcgggttccctattctgctagatatccccggaatgctcctcttgtcccttga

SEQ ID NO: 92673 - DNA, 870 bp, Glycine max
  Peptide Sequence Number=SeqID_209451
atgtggcctgggaagtataaggtggcatggaacatgagattgtgctacatgagcaaatacacgatatggtcaaaagggtctagtttattcccgttgactacatgtagttatcagataatagacaagggattcttgtttgcttttgctgaaagatggcacacaaagacaaacaccttccatctgctcgtggaaaagatgacagtaacacttgatgatgtggcatccttacttgacattcctattactggtgctttttacaattatgaacatatggataaagaagaagcaattatcgtgcttgtggagctacttggagttgaatataaagatgcctttgatgagacaaagaaaataagaggggaacaattcagtttaagttggttgcagggtgcatatgaggaaatgtgtgaagaagagagatgggatgaggcagcaaaagcctatttgtttcatctagttggttgtaccttatttgctaataaaaatgcaacctatgtggagattagtggctatgccactcttcttcagattatcaccccacaacaggttgacgataggtggttgcacttgcagaatcacttaatccagcccataatgggtgtagttcagccaagagattgtgatgttggttattatgtgtggttatacacaatctcacatccttttgtccaaccaagatactatgctccaccccttgatgcaactaaggatcttacccatctacaattcaggcacatcctgcagttgtacgaaacatgtcataggactggtcaactactgcatcagacattagcattagcatgtggagtaattgatgatgatcatctaaacactagtaaggcacgaggtggcaccaaagtgaatgtatga

SEQ ID NO: 92674 - DNA, 1704 bp, Glycine max
  Peptide Sequence Number=SeqID_209452
atggggttagttggggtccaagaaaacgggaacggtaatggagatggaatctctgagattccgttggggactaaaacaaaatacattaagatgacctctgatccagttgaggaagatgaagaagttctgcagagcagaaagtacgagaccaaaaaatatatctttgcatgtgccgtttttgcttctctcaattccgtgcttctcggctatggtagaaatgctaataatagtaaaatgtgtgtcagagaatgtgttggtagcattcatctgactttaaaagtcatgtctaagttaatttggatcaaaactaagaccctagttggttgtctttggtttgcagatgtgggtgttatgagtggagcaattatattcattcaggaggatctgaagataactgaggttcagcaagaagtactagttggaattttgagcataatatccctgttgggtagtttagctggtggaaagacatctgacgcgattggccgaaaatggacaattggtttggcagcagttatcttccaaacaggtggagctgttatggctcttgctccatccttcaaagtgttgatgataggcagactcatggctggggtgggtataggttttggtgtcatgattgcacccgtctatattgccgaaatttctcctgccattgctaggggatctcttacctctttccctgagatatttataaattttggaatccttctcggctacatatcaaactatgcattttcgaggcttccagcgcatataaattggaggataatgcttggtgtgggacttatcccttcacttgttattgctattgcactgtttgtcatacctgaatccccaagatggctagtggtgcagaacaggattgaagaagctagagcagtgttgttaaagataaatgagagtgagaaggaggccgaagaaaagttgcaagagattcaggcagctgcagggtcagctaatgctggcaagtatgaaccgaaagctgtctggaaagaaatattgtgccctactcctccagttagaagaatgcttataaccggttgtggaattcagtgtttccagcagattacaggcatagatacaactgtatactatagtcccacaattttcaagaatgctgggatcactggcaactctgagcttcttgcagcaacagttgctgttgggttcaccaaaactctgttcatcttgatagccatatttctcattgacaaattggggagaaaacctttgctttacgcgagcacaattgggatgacagtatgtttatttagcctgagcttgtctctagctattctgagtcatgcaaaagttgggatcgcattagcaattcttgcagtgtgtggaaatgttgcttcgttctcggtgggactcggccccatatgctgggttttgtcatccgagatatttcctttgagacttagagctcaagcatcagctcttggagcggtgggaagtagggtgagcagtggtgcaatctccatgtcgttcctctcagtctctcgcgctatcaccgtggcaggaacattctttgtttttggcgttgtttcatgttgtgctgttgcctttgttcattattgtgttccagagacgagagggaagactttggaggaaattgaagtactctttaaagacgaggatgatttgcaagagagtgaggtggaaatgggagatgtagagtgtctgatgcagaagtcatga

SEQ ID NO: 92675 - DNA, 1188 bp, Glycine max
  Peptide Sequence Number=SeqID_209453
atgctttctctactcttctccctacccacatcatttttcgctctctttcttctcctccttttatcttacaacgctttcaccgtcttctctgtccatgtccctaaatccccaaccaccaccaccctctccaactccaagttctcttcttccctcaattcacctctcttcaagaacccccacttgccccttcttcaaaactccactgaaagcttttccttttcaactattcagaggcctagtagaagagtcaagaagcacaagcgtggcctcagaagcgtgcgttcagaatctcacttcccagttccatttttccatgccagactcaaagcattcttcaacaattctcattcttcttgcaaggagaggttcttcatgacttggatttcttccttgaagggatttggtgagagggagttattctctatggagagcttgttcaagtctcaccctgaagcttgtttggtcatagtgtcaaagtccctagactctaacgctggaactcagattctgaaaccatttgtgagcaacggtttcaaagtcatggctgttgctccagatttcggttacatattcaaggacacacatgctgaaacatggttcaaccgtttgaaggaagggaatgtggatcctggtgaagtctctttggggcaaaacctctccaatttgcttaggcttgctctcttgtacaagtttggaggcacttacatagacttagatgttgtggttttaaagagcttctccaagctgaggaacaccattggggcacagaactttgataccaaaaccggcaagtggagccgcttgaacaatgcagtgttgatatttgacaagaagcaccctttgcttttcaagttcattgaggagtttgcactcacctttgatgggaacaagtgggggcacaatggtccttacttgatctctagggtggtgtctagggtgagtgggagaccaggattcaatttcactgtgcttcctccttctgcgttctatcctgtggattggagagggattaggagtttgtttagagatgagattagttccaaatggttgatcaataaaatggagcaaattcgcaaagaaagctttgcagtgcacctgtggaacaggcatagtaggaagcttaaagtagtcaagggaagcattgtggatagtatcatttctagttgttgcatcttctgcaacatttag

SEQ ID NO: 92676 - DNA, 249 bp, Glycine max
  Peptide Sequence Number=SeqID_209454
atgaggaacatcatccacagccgaatcaacatccttgccaaccgcctcgacctttggtacgagtacgcgtccttaagcagttccctaatccgtgaaggcttctccccttcgacaatcgaagaaaccaccgacatctccagcattgatcagaatcgcctcatcgtcggcgcgcaggtcagcgactccctcgtccactccaaggctgaccttaacctggcccaagctcctctaagagattcgcctccttag

SEQ ID NO: 92677 - DNA, 615 bp, Glycine max
  Peptide Sequence Number=SeqID_209455
atggaagatgaaagcatcaaccttcctcctgggtttttgttctctccaactgatgaagaacttgttgttcactttctttattgtaaggcttctcttattccttatcatcccaacatcattcccgatctcgatccgtctcagcttgatgatccttgggaactaaatggtaaggcgttgttaagtggaaatcagtactatttctttaccaaagtgaatgaaaacagaaccactgaaaatgggtattggaaggacacaggtgtcacgaaacctatattgtcaacctttgataaggaagtgggaatgaagaagtacttggtattccacattggtgaagctccacagggcactgaaaccagttgggtaatgcaagaatatcatatatgttcctctgagtttgacactgcctcatatcgaagtgttaggagaagaagaaaacatgatcaaagttggagcaagtgcgttttgtgcagagtctatgagaagatcaggtctcaacaaagtgtagactgctatagggatgatgatgatgatggcagtggatcagagctttcgtggctagacgaagtttatctgtcgttggatgatgatctgaaagagattggcatgcctatttag

SEQ ID NO: 92678 - DNA, 792 bp, Glycine max
  Peptide Sequence Number=SeqID_209456
atggatatcaataatgttaggtcagcaaggaagttgctgttaagatgtatactgacatggtcactctccgatctatggacactatcttctattaagcacaaaggcaagtatagggaagcaggagtcttgttatggcgtggtttcactctgcaagaatttgcaaaccagttattttccaataaatatgataatgggaaaggaaggcagataccagctcattatgggtccaaaaagcacaattactttacagtagcatcaactattgcgttaagtattgaaatcttttacatacaaggctttgatggagatttccacgctgccttaaattttgcagcagtttcggaggccccagttatttttatatgccggaacaatggatgggctatcagcacacccatttcagatcagtttcgaagtgatggtgttgtcatgaaagggcaagcatatggagtccgtagcattggtgatggaaatgatgccccggctatctatagtgctattcaagctgctcgtcaaatggcaattactgaagagagaccaattctaatagaagctcttacatatagagtgggacaccacaccacatcagatgactctaccaagtatcgtcctgcgaacgagattgaatggtggagactgacacgtgatcctgtggctagatttagaaagtggatagaaaagaatggctggtggaatgatatggctgagtcacagcttataaacaatttgagacagcaggcgagatatacatctctaaatcccttgattgatgataactggattccattctaa

SEQ ID NO: 92679 - DNA, 234 bp, Glycine max
  Peptide Sequence Number=SeqID_209457
atggactggagtgaaaagaatggactgaactgcaaatttgacttccaatactgccagaaactggggttggaagaacgagccagagttgctaacaaaattggaaagattggtgtcgtcaaagtcaattatggcaagggtgatgagagttataaagttggcttgatgattgaagagagaagtgggagtgagaggttgtgggttcaaattctttcactaaccaaaattaatcggtga

SEQ ID NO: 92680 - DNA, 411 bp, Glycine max
  Peptide Sequence Number=SeqID_209458
atgtcttccttcgatgccttcgccgacgacttgaacgtcaactcttcttccactcgccagcacgacgatgacgaggacaacttctctggctacggcggctactcctccttcaccggaggattctccgccgacggagatgtcgccgtcgatcactccgccgccgcgtcgccggagatctacggcttcactgattcgaatcccgcttactctcagtctcccttcgaatcggccaccgtagagaacgaaaacggaaacggatacggcgacggcgacggtgtttttgtctccgacggtccggtgcttcctccgccgacggagatggagccggaggaaggttacgctcttcgcgagtggcgccgaagttttctagcaaagtttctcgcgcttgcttgtaataagttaggattatga

SEQ ID NO: 92681 - DNA, 468 bp, Glycine max
  Peptide Sequence Number=SeqID_209459
atggctacttatgtcgtgctgatggtttgccacttatgtttagcagagatgaggagccctgctacctattctacgaccccaccaggaattatgggtgactttgtttggagtccctttgtgagaaggtcgaacttgctggtgggactgcgccaccatccactggcgcccctactgttggaaaagggggttaatctgttgctgagattgacccaattattgatattgttgaggtcacccccagtgccctctacttctttcgaacccttgagcctttatgccttgaggcaagccattgggttgacatctcccttgtcgatcgaagtttttgctcctgccattgttgttgttatttccgctcctgctgttgcctccgcttctattccttcgcttctgcaccaatgtgtacaagtagtaaagttaaaatggaagtccaagtgtcgagtccacatggactttgtttgtacttag

SEQ ID NO: 92682 - DNA, 522 bp, Glycine max
  Peptide Sequence Number=SeqID_209460
atgtcttcatttttctctgactccgccatcggcatgggtgacatcgattccgggggttcgatttggcaacccttgatggatcaggaggtcatttccattcgcggttcctcctcgaagaatacttgccatgatgcctcaaacagcgaaacctcttcctcggagaagttgagggtttcacgctacactggtggaggcatctctcatcttcgcgggagggcgtggccttccgctgcttccccggccagggagcttgtccaggtcaccttgattctcctcccttctgcttctgggggagcaaagagaagcgatggagatgttagggcatctcctcgcgtgcgacatagccatagtgttgggtcgtcattgtccccaccttccgttgctagttatgagtgggtgaaggacgatgttctaaagtgtttgtttgaggtcttaggtctcattctccccttgactgcttttcattgtgctctttttgagcacttgaatgtggtcatattgttagtcattatttacgactaa

SEQ ID NO: 92683 - DNA, 3576 bp, Glycine max
  Peptide Sequence Number=SeqID_209461
atgaagaaacaagggtgtgaggttgaggcaattggcatcaactacaagatccgtacaaagacaacagagaaaccttttaaaatcttcaccaaacttccacaattgaatagggaagaagatgttcatgaagcagaagatgaacaaaggtcatgccgtggagtgaggcatgtcctcaaagatgtgaattgcatggccaagccatgggaaattctggcaattgttgggccaagtggagctggaaaaacatcccttcttgagatccttgctggtaaagctagtcctcaaagtggttctatcttggtgaatcaagaacctgtggataaagctgagttcaaaaaattttcagggtatgttacacaaaaggataccttgtttcccttacttacagttgaagaaaccattatgtttagtgcaaagttaaggctaaatcttcctcgggagcaattattctccagggtcaagtcactgattctagagcttggtcttggccatgttgctaggactagaattggagatgaaagtgtccgcggcatatccggtggtgagaggcgccgtgtttccattggtgttgaagtcatacatgatccaaaagtgctgatcttggatgaaccaacttcagggcttgacagtaattcagctttgcaaataattgaaatgcttaaagtcatggctgactctaggggaagaactataatcctcagtatccaccaacccaggtacagaatagtgaagttgttcaactcattactgttattggccaatggcaatgtgttgcaccatggcactgtggatttaatgggtgtgaatctaagactaatgggtttagagcttcctcttcatgttaatgtagttgagtttgccattgattctattgagaccattcagcaacaacaaaaatttcagcatggtgagagtagaagtggtaagtttactttgcaacagctctttcaacaatccaaggtaattgacatagaaatcattagttcgggaatggatatcacctgtggttttgctaattctggattgagagaaactatgattctcactcataggttctccaaaaacatccttcgcacaaaggaactctttgcttgcaggacaattcaaatgctggtttctggacttgttttaggctcagtcttttgtaatctcaaggatggtctagtaggagcagaagaaagagtgggtctatttgctttcatattaacgtttttgttgtcaagcaccaccgaagctctaccgatttttctgcaagaaagggagattctaatgaaggagacctctagtggaagctacagagtttcatcctatgctattgccaatggcctagtttacttgccatttctactcatactagccattttgttcacaatgcctttgtactggctcattggtctcaacagaaatttcacagcatttttgtactttttgatgcaaatttggctgattcttaacactgcaaattcggttgtggtatgtttcagtgcactggtgcctaatttcattgttggaaattcgatgatcgctggtgtcattggttcgtttctcttgttctctggctacttcatatcaaaacatgaaattccaagttactggattttcatgcattacatatctccatttaagtatccctttgaagggttcctaataaatgagttctccaactcaaataagtgcttggagtacttgtttgggacatgtgtggtgagaggagcggatgtacttaaagaagcaaagcttggaggagagactagtagatggaagaatgttggggtgatggtacagatgttcgcaaggagttatcctaaaacgacagaaagcaacataattatgctcccaaacgatgtcatttcctccgttgaaaaatactcgtttttgatttcaaagtgcatcacggcgaggagggtgaaactcgcaaacgccgtgcacggtcaccttatcaaaaccgcgcttttcttcgacgctttcctcgcgaacggtctaattgacgcgtattcaaagtgcggctgcgaagaaagtgcacacaagacctttggcgatcttcccaacaagaccactcgttcgtggaacacgctaatatcattttactcaaaaacgggctttttcgatgaggcgcataacctgttcgacaaaatgcctcaacggaacgtcgttagttataactcgttaatatccggctttacgcgccacgggcttcacgaagattcggttaagctctttcgggtgatgcaaaacagtggtaagggtttggtgttagacgagttcacgctggttagcgtagttggaagctgcgcttgtttgggtaatcttcaatggttgcgtcaggttcatggggtggcagttatagttggcatggagtggaatgtgattcttaacaacgcgttaattgacgcttatgggaaatgtggggaacccaatttgtcgttttctgtgttttgttacatgccagagagaaatgttgtttcatggacatcaatggttgtggcttacactagagcatgtagattggatgaggcttgtagggtatttaaggacatgccggttaagaacacggtttcttggactgctttgttaacgggttttgtgagaaacgggggttgtgatgaagcttttgatgtcttcaagcaaatgttggaagagggtgtaaggcctagtgctccaacttttgtgagtgttatagatgcctgtgcacaggaggcgcttataggaagaggtaaacaggtgcatggtcaaattattagaggtgacaaaagtggtaacttgtttaatgtgtatgtgtgtaatgctttgattgacatgtatgctaagtgtggagatatgaaatcagctgaaaatttgtttgagatggctcctatgagggatgtggtaacttggaacacattgattactgggtttgcacaaaatggccatggggaggagtcactggctgttttcagaaggatgatagaagccaaagtagagcccaatcatgtgacatttcttggggtgctatctggttgtaaccatgcaggtttagataatgaaggattacaattggtggatttgatggaaaggcaatatggagtgaagcctaaagctgaacactatgctttgttgattgatttactggggaggagaaacagactcatggaagccatgagtttgattgaaaaagtgcctgatggtattaagaatcacattgcagtgtggggggcagtgttgggggcttgtagggttcatgggaacttggacctcgctagaaaggctgcagagaaactgtttgagttggaaccagaaaatacgggtagatatgttatgctggcaaacatctatgctgcatctggcaaatggggtggtgccaaaagaatcaggaatgtaatgaaggagaggtgtttggagaaagaaccagcttgtagtcggatagagttaaggaatgcgagacacgagtttgtggccaaggacaagttccatccacaggttgaagagatatgtgaagtgaacagtaaattagttcttcattcgaaggatgctggatatcagccttatactgattacccttttcttcctgattatgatgatgatttctactttagttag

SEQ ID NO: 92684 - DNA, 2798 bp, Glycine max
  Peptide Sequence Number=SeqID_209462
atggctggtgatgctatcattacagacagtggtgccatgcatgtggcaggtgtgccaattgttaatccatccaccattgttgtttgggaggttatgcctgggcctggtaatggtttccaagtaattcctagaacaagtaccaataatggtgttccacctcctcttagctcacccaactggactggttttgcacctttagctgcatatttatttagttggcaagatcatctattatctgaagaaaaacaagggaaaaaccagacaaaccaaaaccttggtgattctataccacttaactgttcaccggtttcaaatttttcagcatatgtgagtcctgaaactgcagctcaaactgctgcaaccactacatggggttctggtgtaacagcagtagcttttgatccaacttgtggtggttccgtgatagctgttgtgatagctgagggacagtacatgtccccatatgatccagatgagggcccatcaatcacagggtggagagtgcaactctgggaatcatctttacagcatgttgtccttcatccaatatttgggaatcccacttccagtatgggtggacagcctcctatgcaaactgtttggcagaccaaagtggacctgagcattccaccaacaaatgatttcaagaatcatcaagctccagcagttggaatgaacactgacattcaaaaggtatccgagtttggttttgataagtcaaaaagggtcaattttgatccttttgatcttccaagtgatgttagggcacttgcacgaattgtatactctcctcatggtggtgaaattgccattgcttttcttcggggtggagtgcacatcttttctggtccaaattttgcacctgtagacaactatcagattagtgttggatctgcaattgctgctcctgctttttcttcaacaagctgctgttcagcttctgtttggcatgacccaagcaaagatcagacaattttgaaaataatccgggttcttcctcctgctattccaactagtcaagtaaagaccaactcatcaaactgggagcgtgcaattgctgaaaggttttggtggagccttttggttggagttaattggtgggatgctgtgggctgtacacagagtgctgctgaggatggtattgtttcactcaacagtgttatcgcagtcttggatgcagacttccattctcttccttctgctcagcacagacaacagtattgtcctagtctagacaggataaagtgtaggctgcttgaaggggcaaatgctcaagaggtcagggcaatggttctggatatgcaagctaggttgttgttggatatgcttgggaagggaattgagtctgctttgataaatccttcagctttagtgcccgatccatggcaagtatctagtgagacattaaccagcattgaccctgaagcagtggctgttgaacctgcactagttccatgtgttcaggcttatgttgattcagttcttgatctagcttcacactttatcacccggttgcggcgttatgcaagtttctgccgtacattggcaagtcatgctgtaactgcagggacgggaaataaccgaaatgtggtagctagtcctgcccaatgttctgcaactcctgcaacaagtcagggaggtcaaaatgggacaaccagttctagtggaagcacacagatgcaagcttgggtacaaggggccattgccaagattagtagcactactgacggagtgtccaacccggttcctaacccccccatcagtggtccttcgtcctttatgcccataagcattaatacaggaactttccctggaacacctgcagttcgacttattggggactcacaacaaccccgctatgcgggaggtgtacagagaactgctgacacaaatctacaaaaacctcaacctaatgcttctgtccctggcaaggtggaggaaattgcaaaaccagtgtcaactgtggttaggccagatgatggtcaggctggtcgagttagtcaacttgtgcctgcatcaaaaggaggtgaagaaccatctccagggcgttcaagaattggtactggaaatgctggcctaggatatacatatgaagaggtcaaggttctttttctagtacttatggatctatgtcgccgaactgctggcttgcaacacccgttgccagtttctcaggtggggagtaataacatacaggttcggctgcattatattgatgggaactacactgtactgcctgaggttgtggaagcagcccttggcccccatatgcagaacatgccccgtcctagaggtgctgatgctgctggtcttctactacgtgagctagaactccatcctccagctgaagagtggcatagacggaatatgtttggtggaccttggtctgatccagatgatttggattctgcaaatgatgcaccaaaacttattagtttaaatccacttgattccagctcattggaaaattgtgatgtctactatggagccaatggcttatggccaaggaagcgcaggatgtctgaacgagatgcagcttttgggttgaacacttctgtgggcctgggagcataccttggtataatgggatctcgaagagatgttgttactgcattgtggaaaactggccttgaagggatctggtacaagcttccaccaatcttcccagtcaaaatgaccgggagatttggtggatcagccgctgggcttatggatggaagaattgcttgtattttacctgcagaaactgaaggtggatggaattgtacaggagaggagacatgtagattacctgacag

SEQ ID NO: 92685 - DNA, 318 bp, Glycine max
  Peptide Sequence Number=SeqID_209463
atggttagcactcggtctagcctcagacgcgaaccccctttcaaaagctccaatcctcctctagtaggcctgccatacattgatactctccaacaactccaaaattgcattgcaaagatggagcgacgccacgaggaagagcttagaaagctaaaggttgaccagaatcagctggaggctcgcttcagacacctctacggcgacgagcactccactcacacattgcctgagcgtactcaagaggaatcacaccctcaacgcacagtcaacgcccaagattattcaagtctctcccacatgcaccatcctgtagggtga

SEQ ID NO: 92686 - DNA, 285 bp, Glycine max
  Peptide Sequence Number=SeqID_209464
atggagagactgcgaggtatgttttactgtggcctcacggtaggcaccaaatgtactgaccaaaatttggagctggcacacaccagggtgaacatggctaaggtgggctcctggacttcacatgtcgactggagagtggcctttgttaggaggacaagaggggagacctgcaaaataaaggactctaacactgaatgtcagtgtcaatggagtaacgaacatgttaccataaaggtgttaaactgcccacaatatgcccagacctattgcattctgacgtgttga

SEQ ID NO: 92687 - DNA, 234 bp, Glycine max
  Peptide Sequence Number=SeqID_209465
atggtaaaccacaagtcagacaaagatagcgtttatgatgtgcttcattctactcctacctcaacttctgttccaactcatcatcatattgcttgcaatcctcctaaggatgattttgttaagctaaatgtggatagtagctttatagctaatcctgaaacatcaagattccactttctttccagtacacttttagagcatcttttggtggtagatcccaacttgagttcttag

SEQ ID NO: 92688 - DNA, 2265 bp, Glycine max
  Peptide Sequence Number=SeqID_209466
caccttctccttatgccatatgcaaaaatgtctcctcccctaatggaattaagtgcttccactctagtactttaccctgcatcacagccaccacaagagcctaaaaatgagaacaatgggggcatagtttttgactcaaaaaatttgcagcaaatgcaaggggaaatgcccaaagagttcctttggccttctagggacttggttgacaccacccaagaggagctaaaggaaccccttgtggacctagcaatctttaagaatggtgacgagaaagctatttccaatgcagcagagcttgtgagaaaagcatgcttgaagcatgggtttttccaagtgataaaccatggtgtggacccagatctcattgatgctgcatatcatgaaattgactccatttttaagctcccattgagcaaaaagatgggtgctaagagaaaacctggtggtgtctcagggtactctggtgctcatgcagatcgttattcgtccaagttgccatggaaagagacgttttctttcctctatgatcaccaaagcttctccaactcccagattgttgactacttcaagtctgtgttaggggaggatcttcaacacacaggggtatatcaaaagtactgcgaggcaatgaaggatttatctttagtaattatggagctattgggtattagtttgggtgtggatcgtgagcattatcgaagattttttcaagatggtgactcaataatgaggtgcaactattatccaccttgcaacagagcgaacctcaccttaggcactggccctcacactgatccaacctcactaaccattcttcatcaagaccaagttggaggtttagaagtttttgtagataacaaatggctcgctgttcgccctcgatctgaagccttagtcataaacataggtgatactttcatgtatccgatgtctagtccaagaatgatagaggtgcgacaaccgagtggttgttcatttggaatggaggaagggtatcaggttgaatggggggaggaccctgatgttttttcaggagtgagacatgaaacacaaggtgaattttggacccaagtggaagttggaggcgtgaggacgaacaaaagttggcctgtatggatggagtttgacatagacaaggtccctaacattgaaagtgatatggcggcgatgaagccacaaatgaagcggcggcttccaccggagaagaatcctgtaagtaagatggaagagaagggggcaactagccataaattacttcaaatgggtctgattgaggacttttgtttggccatctgtttctgggtgataagcagtgctaaatcggagtttggtgccactcagggattgaaggagacctgctactttcttggtctcgtatttagtttgttgatagatagagtattgagaaatgaagcgatggacatctttgcgcatgccttcccagacgaaattggcatgtcaacggcgaaaggttttgggaatgtccatgtgtccccccaaaagctcgcgacgaatggagtagcccagatggtcagtggggctagtccttaccatgttccacatgttcaagaaggtcgaagattgatggacgtctacgacagcattactggagctagatcgacattcgatagtgtaatcgccttaatgatcagtgaggattacaaaatgatggtcaaggagggcatagtgatgaacaaaacatctgtagaagccggcgaggcccaaaaaaccacgcagatcagtggtagaggttggggtaggctagtcaactatggcgctaattttcaaaggatcaggagtgaccccttctgcagaaactatgtggcccaagtattgcaatgtttgtttggcaaacaaacatttggatttgaggaggtgaaaggatcctctagaaagaacagaaaagacctcctcgaggtgaagcaagtgttgatggaaggatgcactgtatatgaggatgtcgtcaaacaaaacggcaaaaaatttgtgtccaatttcgagaaccatgacgttgcaccaagttcgtcaagaagctcattgatggttggcatcgaaaacctatctttgataatgatgttgaataaacctggcgtcaagcatggcttggacctgattctccagttcagtcttttggctataggggtaacgagatatgtgtatcgcgtgatgaggttagtgattttaggtggttcaggtaattggtcaaggttgagggtaggggatgaagtgtggttattgtttgtggttgttgttggggtcaattga

SEQ ID NO: 92689 - DNA, 444 bp, Glycine max
  Peptide Sequence Number=SeqID_209467
atggatgctagcatagttgacactaaaaatactttgagaaaacataaaagaaaagaaaatcatagtcgctgctgctggtgttgtgtgtatgcttatgggtgtagcagcatgaggaatcaagttctggtacaaaaagaaaggaacgatctcaacttctctggtacactatcccaaaggagaaagattagagagaaagatgaaatagttgcttcaatgaaaaaagtggctgagtctttgaagcaactgcaacaaatatttaataataagctggatgaaaaggatattcaagaagtgctagatgaggtggcattgataccaaaccttgatcaacaacaatgggctaaaactgttaaatggttaagtgacgatctagaacagttagctgtcatgagaggccttcccattcaaaagaagaaggcttatattttagcttttatttcttga

SEQ ID NO: 92690 - DNA, 2319 bp, Glycine max
  Peptide Sequence Number=SeqID_209468
atggctttggggaaatatgctagggtagatggtagaagatcgtcgagctggtgttcgacggtgactgttgtcgtgtttgtggctctatgcttggttggggtttggatgatgacatcatcttcagttgtccctgtgcgtaatggagatgaggcccaggagaataagaaccaagtgaaagaacaaacagagcctacagaggtgaaagaagcagtgagtgaggtcagcaatagcaatatgcggcagtttgaagataatccaggtgatttgcctgaggatgcaaccaaaggggacagcaatgtagcctctgaagacaactcaaacttgtcagataaacaagaagagaagtcggaggaaaatcctgtagagaggtcttctgacgatacaaagtcggaagacgtggaggataagaaaactgaggaggaaggttctaatacagaaaatgaatcaaactcagactctacagaaaatagcaaagacagtgatgagacttccactaaagaatctgattctgatgagaatgagaagaagtctgattcagatgaaagtgaaaagcaatctaatgacactgatgaaacaacagatactaagatagaggagaaggtggaagaaagtgataacaaggaatctgatgaaaactctagtgagaagaatataaatgatgataccaaacagaagagttcaaaggaggtatacccttctggggctcagtctgagcttcaagaagaaagtacagcagaaactgggtcttggtcaactcaggcagcacagtcgaagaatgaaaaggattctcaagagtcctccaagcagccaactggatacaagtggaagctttgtaatgtcactgctggtcctgattttataccatgccttgataactggaaagctattaggagtctccagagtactaaacactatgaacatcgagaaaggcactgtcctgaagaacctcctacctgccttgttcctgttcctgaaggttataaacgcccaattgagtggcctaagagcagagagaagatatggtattacaatgttccacacaccaagcttgctgaagttaagggccaccagaattgggtgaaagtaacgggcgagtaccttacttttcctggtggtggaacccaattcaaacatggggcacttcattacattgactttatacaagaggcctataataatgtcatggcaattctatacaaatcctgtagatctaaagattatgggaggcatctcatagggaactgggctttggtgatacagactgtacctgacattgcttggggaaaacgcacacgtgttatactagatgttggatgtggtgttgccagctttggaggttttctctttgatagagatgtacttgcaatgtcgttagcaccaaaggatgaacatgaagctcaggtacaatttgcacttgaaagggggattcctgctatatctgctgtgatgggcacaaagaggcttcccttccctgggaaagtatttgatgtagtccattgtgcacgatgtagagttccgtggcatatagaaggtggtaaacttcttttggagctaaatagagtattgagacctggaggtttttttgtatggtctgctactccaatttatcagaagcttcctgaagatgttgaaatatggaaggccatgaaggcactaacaaaagccatgtgctgggaagttgtgtcgatcagcaaggatccagtaaatggagtaggtgtagctgtatacaggaagccaacttctaatgagtgttacgagcaacgctcaaagaatgagccaccgctgtgtccagactctgatgatcctaatgcagcatggaacattcaattgcaagcttgcttgcacaaagcgccagttagttcaaaggaacgaggctcaaaattgcctgagctgtggccagccagactgatcaaagtgccttattggttgtcgagttcccaagttggagtttatggaaagccagcccctcaagatttcactgctgattatgaacactggaaacgtgtagtatccaagtcttatctagacgggatgggaattaaatggtcaaatgtacgcaatgtcatggatatgagatctatctatggagggtgcaatttggctgctgtagtggctgaggctgatcggattcttaggcctgaaggaaaacttattgttcgcgatactgttgagatcattgaagagcttgagagcatggctaggtctatgcagtggaaggttcgcatgacttactccaaggataaggagggtttgttatgtgtggagaagtccaagtggcgacctaaggagcaggaaaagctcgagtatgctattgcttaa

SEQ ID NO: 92691 - DNA, 252 bp, Glycine max
  Peptide Sequence Number=SeqID_209469
atgaatgtggcgttgatggagacagtggaggtaccgaggaagacaaaaggcgagggtaatatagtatttgtctctgatattcaatgtgatgctcccggactcaaaggagataactataagatatggaaaaagagaattcttctgcaattggggtggatggacatagattatgctataaggaaagacaaatcatctgcaatcattgatgaaagtagtccagctaatgttgcgctatatgagcagtgggaatga

SEQ ID NO: 92692 - DNA, 2730 bp, Glycine max
  Peptide Sequence Number=SeqID_209470
atgctcaccaccggagtaatccaacccaaccatagcccattttcttcccccatcttgcttgtaaagaaaaaagacgggtcatggagatgctgtgttgattatcgggcattaaacgcggtcacagtgaaagacaggttccctatgcctaccatagacgaactgctagatgatctgggccaagcttcgtggttttcaaagttagatttacgccaagggttccatcagataagaatggctgaagaagatacgcataaaaccgcctttcgaactcaccagggtcattacgaattcctcgtaatgccctttggattgtgcaatgcaccctcaacgttccaggccgccatgaacgacgcgcttcaaccatttcttcaccgattcgtcgtcgtcttcttcgacgatatcttagtctacagtccggacctgcagtcccacgtgtcacacttagaatccgttctatccactcttgctgatcgagagttcttattgaaacattccaaatgttcctttgcccaacgccaactcagttacctgggccatatcatttcctcgcagggtgtggcaccagaccccgataaggtcgctgcaatgctcgagtggcctcagccaacatgtcccacaaccctccgcggatttctgggtttgacggggttctatcgtaagttcgtcaagggatacgccgccattgcagcactccttaattccctcttaagaaaggacagcttcatctggtcccccgaaacccagcatgcctttcatcaattgcaacaggccatgactcagactccagtgctcgccaaccccaacttcctcctcccttttacgctcgaaaccgacgcctccggcacggcgatgggtgcagtgcttctgcaggaatctcacccaattgcgtattatagcaaagttctctgccccaggttacagcgcgcctctgcttatgtgcgagaattgcacgccatcacctccgcagtgcgtaaatggcgccactacttattgggtaactccttcattattcttacggaccacaaaagcttgaaagatcttatgtcccagacgatacaaacgcctgagcaacaaacatacttgtcaaaacttttgggctttgattattctatcaaatacaaacccggcccagcaaacgtggtcgccgacgcactctcccgtatcgttccgacggaggccacataccttaccctgactatgccccactgtctcttcctccagaagctccgccatgctctgttgcaggacccacagtatgagcagctccttcgggacgttcgcgagcaccctacggagcatcccgaacttacaactcaccaggagcttcttctccggcagggtcgaatttggatcccctttgagacaccattcacagattccttattggaagaatttcactcttcccctctcgccggccacccgggcgtcgccaagactctccaccgtctccgtcagaacttcgactggcctagaattaagatcgacgtccgccgctatgtcgcccagtgcgccacgtgccagcagacgaagtacgaaacaaagaaaagcgccggcctcctccaacctctccctatccccacccacgtatgggaagatttgtcattagacttcgttacagggctcccatcttctcaagggtacacaacaattctcgttgtggttgatcgattttcgaaggcgtcccacttcggagctctgcccacccctcactccgcttacaaggtggcaactctattcttagacatggtgtgcaagcatcacggatttccgcgcagtctagtatcggacagagatcccattttcgttagcaaattctggcgtgagctcttccgtttaagcggcaccaagctccgaatgagcaccgcctaccacccgcagaccgacgggcagacggaggtgctcaaccgctctcttgaacagtacctccgcgcgtacgtacatacacagccctccaactggtaccgtttcctttctctcgccgagtggtcgtataacacatccctgcattcggctatcggcatgactccatttgaggcggtctacggcaagcctccaccaaagatagctgactaccttcgcggtcaatcttcgaacgacgcagttgactcattgctttccacccgcatccgaattcacgatcagctaacgcgtcgcctgcaccgcgcgcaggagcgtatgaagctcaccgcggataagcaccgccgcgacgtttccttcacaataggcgactgggtgtatgtccgtcttcgtccctatcgtcaaacgtcaattgctcctacgtattcgaagctcgccaaacggttttacggcccattccaaatactggagtgtattggacccgtggcttataaactcctcttgtcggaatcttcccgcatccaccctgtctttcacgtatcccttttaaagagtcatcacgaccctcttccagcctcaccagcttccctgccagtgaattccaacgataatcaccctgtcgttcttcccttcgcaattctggattggaagctagattcctcggtcacaccgccagtcaaacacgtcttggtgcaatgggagggtcttcctccggaggatgcctcttgggaactttgggacgagctgcgtactcttcccaaacttgaggacaaggttgttttcaacgacggcggtgttgttagcatcacagcagaccaacacaggcccaagagagaacgcaagaaaccagcatacctgcaggactttgtatag

SEQ ID NO: 92693 - DNA, 468 bp, Glycine max
  Peptide Sequence Number=SeqID_209471
atgagggttcactgttatccagcaagtcggagacccagcatgaccacagattcacctccactccttatgttcccatggacccggtgttggtgtttgtgtgcatcaaatgaaaaaatatctatctcatgcatacatttcaaaaacacactaaaagcatcaaagagttataaacaagaacgtaagagaaataaaagggaaccgacaaaagaggaagtcatgatattgcacgaaattagaaggcctaactctttaaaaacagtccccagtggagtcgttaactgtcgcaacctacccttcggccggagggcgacgcagggctcacaggtgcgtcttccatgggaggaaaatgcatggagtcgccaccaatgtttattcgaggaaaacgtcggaaaaaccgaaaaggtgtggtcaacgaactttaagcgtgaaaggttcgggagttatttttacgcactgggaaggtattag

SEQ ID NO: 92694 - DNA, 1370 bp, Glycine max
  Peptide Sequence Number=SeqID_209472
atggatctggacgaggcgatccgtatttaccgcgaagataaaaaggtcgaccaggaatacgaaggcatcgtgcgtcagctgatgacctatatgatggaagactcacgcaccattccgagcgtgctgaccgcgctgttctgcgcccgttctatcgagcgtatcggcgaccgctgccagaacatctgcgaatttatcttctatttcgtcaaaggacaggatttccgtcatttgggcggcgacgccctggaaaagctgctctccccgggcgccagtctgaccggcctcgccgccggcgccgcgcacgcggacaaacttgacgatatcaagcaagccggcgtggtgcgtatcgcggtgttcgacagcaacccgccgttcggctacatcgatccgcagagcaagaagctggtgggctacgatgtggacgtcgccgatgcgatcggcaaagcgctgggggtaaaagtggagctgcgcgccaccaacccggccaaccgcattccgctgctggtgtcgaagaaggttgacctgattgccgccaacttcaccattaccgacgagcgcgccaaggaagtgaacttcagcgtgccgtacttcgccaccggccagaaattcatcgcccgcaaaggcgtgctgaaaaccccggaagacatcaaaaaactgcgcatcggcgcggacaagggcacggtgcaggaaatcaccctgcgcgagcgtttcccgacggcgaaagtgatctcctacgatgacaccccgctggcgttcgtggcgctgcgcaacggcaacgtgcaggcgatcacccaggacgacgccaagctggtcggcctgcttggcaacctgccggcagcgcagaaggcggagtttgaaatttcgccgttcagcctgaccaaagagtaccagggcgtcggcattcccaagggcgaagatcgcctgaccgccgcggtgaacgagacgctgatcaagctggaaaaagacggcgaagcggttaagatttacgatcgctggggcgcagcttgctgcgcccctgatgcattctgcaagacaaggattgaacatgaacctggactggctgctggcgccgcaatacctgagctggctgtggcacggttttctgctgacgctgtggctttccgcctgcgcgggcctggcggccacgctgctgggcttcgtgctggcggcgatgcgcgacagcagcctgcggccgttgcgttggctggcgatgggctacagctcgctgtttcgcaatacgccgctgctggagcagctgttcttctggtacttcgccgccgggcagatcctgccgtccgccgccatgcagtggctgaacagatcacatcaggtcagcccgctggaatggccgtcgttcgagtttctcgccg

SEQ ID NO: 92695 - DNA, 273 bp, Glycine max
  Peptide Sequence Number=SeqID_209473
atggcaaggaataaattgtcatttgttgagggtgcatatattaatagaccaccattgttctctgacacgaactactcttttaggaaaatttggagtgcagtggttaatggatataccattccaacccaagtacttgataacaagaccatagagaaaccttacaaattttggtcacaagaaaagattaaaaaagtttttcaccaaaaacatgttattctggcaagagattcaaaggtccaaaatcagcagaaagttctggaagagaaattgtga

SEQ ID NO: 92696 - DNA, 249 bp, Glycine max
  Peptide Sequence Number=SeqID_209474
atgggttttcctttaccggtagtcatttaccttgccgaaaatttatctggttttagcattcattatttgctctcccttgaggagattccgttgtcctttgcttcgggggaaaggatgaggattctttttataggccaaggttcaaagtggtctaaggtcgtgtctcaacagggtcttttttcgtgggagcccgatcttgatatctggggcacaacaaattcgtgtgtcaaggtatcggtctcgggttga

SEQ ID NO: 92697 - DNA, 198 bp, Glycine max
  Peptide Sequence Number=SeqID_209475
atggacattaaacttaaatcaagcatacgagatattaagggacaaaggagaggaggaacaatacgtcatcatcaccataataattcaaacagtgaagaatcacacgaaacacgcacggccgagaagataacaaccccaaagggatcagagctaaatatcacgattatcatttttggcaaatgcttagactttggttaa

SEQ ID NO: 92698 - DNA, 336 bp, Glycine max
  Peptide Sequence Number=SeqID_209476
atggctgaaaaagtgccatcattcaagcatggcggagcttcttggtttattgatctctcaactcctgatgccttgtacatttttccagctttgacagcattgtcattcttaataacagtagagtgtaatatgcaagaagggatggaaggaaatcctgtggctggcaccatgaaaaatgtctctaggggtcttgctgttcttacagttcctttcaccatgggatttccaaaggcaatattctgttactgggttacatcaaatttgttttcacttgtgtatggacttggtaggctagaatgtataatgcacgtaattgaagaatccatggctccataa

SEQ ID NO: 92699 - DNA, 273 bp, Glycine max
  Peptide Sequence Number=SeqID_209477
atggatcatagacatgaagatcaaatgcacaagagaggcaggcctgtgattatgggaaattcggagtcaatgtatgagtctcaagataatttttaccaacatcccccttcttataataatagctatcatcaaccgtctccttatgctgagaattcagagaataatacctatcatgaaccatcttcttatgctgggacttcatcaaatactagctattatcaaccctctactcatcctgggagttcagcaaacactcgccatcaacatatatag

SEQ ID NO: 92700 - DNA, 396 bp, Glycine max
  Peptide Sequence Number=SeqID_209478
atgaagactctaaggacaataaggtggtttggagttgtgcttttccagtttgagtgtggtgcatttggctggagagaaattacaaaatctttagctggagatctcttcctacccatcttggtaaccagaaatccagatgtaccacgtggaaaacttagtccacaagcacaagcaacaattagttctatcgctgctgcaagtcactatcctctctcaattattttggttggcgttggagatggaccatgggatgagatgaagcactttgatgataacatttctgagcgcttatttgacaactttcagttggagataagaaggattggagtttggcgtgatattgacaaacttgatagtacttcatctaattctgaaaccaatatcagaggtctgtaa

SEQ ID NO: 92701 - DNA, 390 bp, Glycine max
  Peptide Sequence Number=SeqID_209479
atgagtatcaacactggaaatttttcagctgctgcccttatggaaattccatttcagtaccgggcagcccaaaatatacaacttaacgatagagaatcagttcttcatcaacataaaaggcctttccctccacctaatgaagcaatagatcatgataatgcacgcatggcaattccacacatgacaaatttggaatcagcggaaccgacagctccagctgctgtcgaaccagtatgccccatttgcctaaccaacccgaaggacatggcttctggatgtggtcatacaacttgcaaggagtgtggctcgacattatcttcctgctctatgtgccggcagcaaattacaactcccccgagactgtacacttgggtgaggaagcttatctga

SEQ ID NO: 92702 - DNA, 183 bp, Glycine max
  Peptide Sequence Number=SeqID_209480
atgtcgtcaaagggaatgaacaacgatggcaaaaggtccaaagaccttggacccagcaaggctagtataaaaaaggatgaatccctaggtaccctcccctctgctctgttagatacttatgcactcatatcattgacaagaaacaacaaacaaatgacccttcgacccttcgaaaaagtataa

SEQ ID NO: 92703 - DNA, 234 bp, Glycine max
  Peptide Sequence Number=SeqID_209481
atgaagggaatttcccaaatttgcaatagaaaaggtagagataatcaatatagccctgagaggcacaagggtcattggatttcaggcagagattttggtcacaaccacaacttcaggggtgtggaaatgaacaatcatgaaggaaaaaatcacaaggaggaaacaagtgttcaagaacaaggtgtatgtcatccttttggacacaaaatctgtgatggccatgttgagagatga

SEQ ID NO: 92704 - DNA, 612 bp, Glycine max
  Peptide Sequence Number=SeqID_209482
atgcctgtggcgcctgatccgagttccgggcgcatcttcatatggatcactgcgtgtttcttgttcacctgcgtcctcgctggaggagggtgcctcgtggaatacatgattcttcccgcgtcagaagttccaccttggattccccttctagggttcacactggttagtctaccctgggttttttggcttctcactttcttgtaccggattctctcgcggtgttgtggatgtagatttggttttggtgttgcaagagagggatcaagaggcggtaacagtgatggtgcaagtgcacccggggaagcaaataataataacaataataatggtatgaataggacgttatctgctgcttcacatgagagtcaattgccattggcaaattatacatcatctactagaagcaatatcccaagtcctcaccaatcttcatggataccctcattagtgtgggacaaagaatccaaaagaatgaatcttgtagaagatgaggaacccttcctaggaatcttcacctccagacctttcaccacaacatcctacactcagcgcatgatgagaagaaaccttccaagcaatctcgcagtcaactctcctttttcttctgcttag

SEQ ID NO: 92705 - DNA, 1455 bp, Glycine max
  Peptide Sequence Number=SeqID_209483
atggcctataatttatgttattgcactctggtgacccctgaagatgctcgcaagctcaacatccctccagagtctgtgaacagaactccatcgggtgaaacatttgttaaatcaaatttgcagaagggaatacttcctgaaatacttgaagagctattaacagcccgtaaaagggcaaaagcagacttaaaggaggcaaaggatcccctggagaaggcagtgctagatggtagacagctggccctgaagattagtgcaaattctgtttatgggtttacaggggccaccattggtcagttaccatgtttagagatatcatcgagtgtaacaagctatggtcgacaaatgattgagcacacgaaaaaacttgtggaagataaatttacgacacttaatggctatgaacacaatgccgaggtaatatatggagacacagattcagtcatggtacaatttggtgtttctgctgtagaagaggctatgaacttggggagagaagctgctgaacatattagtggaactttcacaaaacccatcaaactagaatttgagaaggtttactatccatatctcctgattagcaagaagagatatgctggtttgttttggacaaaaccagacaactttgacaaaatggacactaaaggtattgaaacagttcgaagagacaattgtttattggtcaaaaacctggtgaacgattgccttcacaaaatattgattgacagggacattcctggggcagtccagtatgtcaagaatgcaatttcagatcttctcatgaatcgtatggacttatcacttctgggtttaacgaagacaggagatgattacgaagtaaaggcagctcatgttgaacttgctgaaaggatgcgcaagcgagatgctgccactgctccaaatgttggagacagagtaccatatgttattattaaagctgcaaaaggtgcaaaggcatatgagagatcagaggatcctatctatgtgctagagaacaacatacccatagatcctcattactatcttgagaatcaaattagcaagccaattctgagaatttttgagccaattctgaagaatgctagcaaagagcttctccatggaagtcatacaagatctatttctatttctacaccgtcaaacagtggcatattgagatttgctaagaaacagcttacctgcattggttgtaaagctttacttggcaagggttatcacactctctgttcacattgcaaaggaagggaggctgagctgtactgtaaaacagtatctcaagtgtctgagctggagatgctttttgggaggttgtggacacagtgtcaggagtgccaaggttcacttcatcaggatgttctctgcaccagtcgggattgtccaattttctatcgacgaaaaaaggcacagaaagatatgggtgaagcaaagttgcaattggacagatggaacttctaa

SEQ ID NO: 92706 - DNA, 550 bp, Glycine max
  Peptide Sequence Number=SeqID_209484
atggccatcacagattttgtgtccaaaaggatgacatacaccttgttcttgaacacttgtttcctccttgtgattttttccttcatgattgttcatttccacacccctgaagttgtggttgtgaccaaaatctctgcctttgataacatcaaagagcaagagtgtgagagcttagacagcttaggtgactacaaagccaagtgcttgtacctgaaatccaatgacccttgtgcctctcagggctatattgattatctctaccttttctattgcaaatttgggaaattcccttcattgggttacacccttttgtttctttggctcctagttctgttttatttgttggctaatacaacttctgaatacttttgtccctccctcgaaagcctttccaagttactaaggttgtctcctacaattgctggagtcaccctactctctctgggcaatggtgcccctgacgttttctctagccttgtctccttccaagaaaccgggacacgcgacatcggcttcaacacggttctcgggggtgtttccttttctcctg

SEQ ID NO: 92707 - DNA, 660 bp, Glycine max
  Peptide Sequence Number=SeqID_209485
atggctgacaacagtgttggacagcagcagatggcgaccagtggtcctgtttacttgattcagttcaagtttaggcggctggagataccaccaaactacagtcccaaccatttaggttgcattggtggctgtgatgagattcttgcacagttgacagaaatatgtggcaggggccctcgcatgccagcaagacctcgaggaccaactgcaccaaccagcaatgcccatcatactaacccaaggcaaggagcttgcatgaactgtcgagaaacaggacattcttccactgattgtcctttacgttatgggaatgttcaacatcatggaacaagtgaacataatgtgttgccactgggatttgagcaaatggtgacggccattcatgaagacactgaatgtgtattactttggaatgatggattagatagcctcaatgctggcactggaggcagaagtgttacacgctcaaatagtattccagccttgaatcctaggcaaactggtggacgtggatctcgtggtagaggtggtcagtatggatctcgtactgctaacacaacatttatgtcagccactggagatcctatttctggtagaagatgctatacgtgtggtgatccatctcactttgctaatgtctgcccccatcgtggtgtctga

SEQ ID NO: 92708 - DNA, 1971 bp, Glycine max
  Peptide Sequence Number=SeqID_209486
atggccgatttggagaatttgctattggaggctgcggggagaactggtacagctgggagaaatcgccattctcttccatcttcaaggagaagacatgatggcgcctattcagatggtgggagtgattctagggatgaggattcagatgacgaactcaattatgcaagtagaaagccctctggatcacaagttcctctgaagaaaagattagatccaacagaaagagatgatgatttaggcagtcaggaagaagcagatgatgatggtcgcagcgattgtgatggcgatagcagtgatgaatcaaatattggcgatgatctctacaaggatgaggatgacaggcgaaagctttctgagatgactgaactacaaagagagatgatcttatcggatagggctacgaaaaaggatgataaaaatttattggggaagatagcatcaaagcgtgagaaaggaaaggtagcagtgcccagaaaacagtctccacccatgtcatcatcgcgcatgcgtgcatcagccagatctgctgacaggtcagccaagaatgatgcgttaaatgaattgcgtgcaaagcgattgaaacagcaagatccggaagctcaccggagactaagagaggcatcaagaaatgcagggtcccggcatttttctccaccaaagcgcaaaccattcacatcaacaagtctcagtagttcaagtcatagtgagagcgaaagtaggtcccatagtgacgatgaagggtcaactggggatggaggaattgttgacagtgatgatgacagggcactagctgggtctgagggtccatcatttcaggatgtaaaggaaataactattcgcagatcaaaacttgccaaatggtttatggagcctttctttgaggagttaatagttggttgctttgtaagagtgggaattggtagatcaaaaactggaccaatctaccggctctgcatggtgaaaaatgttgatgcttcagaacctgatcgacagtataaattagaaaataaaactacatacaagtatttgaatgttgtttggggaaatgaaagttctgctgctaggtggcaaatggctatggttagtgactctgctccacttgaagaggagttcaaacagtgggttaaggaagtagatcgcagtggtggccggatgccaagcaaacaagacgtgttagaaaaaaaacaagctatccaaaaagccatcacatttgtctactcagcggctactgtgaagcagatgttacaagagaaaaagtctgcctcaacaaggccactaaatgttgctgctgagaaggatcgactgaggagggaattggagatagcacaaagtaagtatgatgaggcagaagttgagaggatcaagacaagactgctagaattagaggcatcgagacaagcaaagcagaaggatgccaaggcattgaagctggctgagatgaatagaaaaaacaggtttgagaacttcaagaatgcttctgaaatgaagccggtgaatacaggtttgaaagcaggggaggcaggttatgatccattttcaaggagatggactagatcaaggaattactatgctgcaaaacctggtgaaaaggctgctgctggaaataatagtgttaatggcaatgtggctggtgctggcagcaatggaacaggagcaccagtgactgcagaggctggcatggtggctactgctgctgccttggaagctgctgctggtgctgggaagttggtggatacaagtgctcctgtggatcaagggacagagtcaaatatgctgcacaactttgagctgccaatttcattagcattacttcaaaagtttggcggggctcaaggagctcaggcaggatttatggcaagaaaacaaaaaatagaagcaacagttggatttagagtctctgaaaacgatggcaggaggcatgcgttgacgctgacagtcagtgattacaaaagaagaagagggcttctttga

SEQ ID NO: 92709 - DNA, 180 bp, Glycine max
  Peptide Sequence Number=SeqID_209487
atggtttgttacaagcttaaattcaaggatataaaaattgctgttgggattaaccaagattgtccgaaggaaatggttaagctccctcaaaaggaccatgatgaaaagttggaagatgttgcttggttacaagcacaagaggagttgtttgtggtcttacaatataaaaattcaacttga

SEQ ID NO: 92710 - DNA, 598 bp, Glycine max
  Peptide Sequence Number=SeqID_209488
atctgcgtccatatcagtattggtaaatggaagtctctcggctgagttcatcccacaaagaggacttagacagggagatccattagcaccctttctgtataatattgtggctgaaggtttgaatggtctgatgagagtagctattgagaaaaatctgtttagaggattccaggtgggtgtcaataatgtggaaatcaacattctacaatatgcggatgacacaatattttttggtgaggcgataatggagaatgtcaatgcaatcaaagtcattttgaggagctttgaactcgctgcaggcctcaaaataaattttgcaaaaagttgtgttggtgcaattcgaatgatcaaacccaaggcggtgtcagctgtgagattctattatcagcaagtggtccctaacaaagtggtggacaagctggtaagaatacaacgcatatttttatggggtggtggagctgatcaaaacaagattgcttggatcaagtgggagacggtgtgccttccaaaggaagaagagggactgggcatcaaagatatccggaatttcaattgcgttgctgggcaaatggaaattgagtctattccaccacaatga

SEQ ID NO: 92711 - DNA, 735 bp, Glycine max
  Peptide Sequence Number=SeqID_209489
atgagaatgtataaatcggtggtgtaccagggggaggtggtggtgggtgaggtagatgtatacccagaagagaacaacaactacaagaacttccatgtgaaggaaatcagaataagccacttctcgcaacctagtgagaggtgtcccccacttgctgtgcttcacactgttacttcgtgtggtgtttgcttcaaaatggagtcaaagactcagcagcaggacggcctctttcaattgcactccttgtgtatcagagagaacaagactgctgtaatgccactgggtggggaggaaatacatttggttgcaatgcattcacggaatgtcgatagaccatgcttctggggatttattgttgccttgggactttacgattcatgtcttgtgatgctaaatcttagatgtttgggtatagtgtttgatctggacgaaacactcattgtagcaaatacaatgcgatcatttgaggatcgaattgatgcactccagagaaaaataaactctgaagtagatccacagagaatttccggtatgcaggcagaggtcaagcgctaccaagatgacaagaatatattgaagcaatatgctgaaaatgatcaggttgttgataatggtagagtgataaaagttcaatctgagattgttccggcattatctgacagtcatcagcctatagttcggccactgatacggttacaggataagaacattattctgacgcgcatcaatccacag

SEQ ID NO: 92712 - DNA, 1017 bp, Glycine max
  Peptide Sequence Number=SeqID_209490
atggtggctggtcgactagccttttatcctcgtccattgataataagaacagcttggtgccttgagtttgaagctaaaactgtaggaagtatcatggcgagattgaataaagtgaaacttttagaagccatggcaatattttttgaaagatctactagatctagcagtgatgagctgcatgcaactggagaagttgttcgacgatgtggactttgtcaagaatcagacatgttgctaaggaaaaatcgagatggcaattttatggttggatgtatgggttaccctcagaaaaatttgaagtcaagatggcatagttcaattagtttgcctaactgtttgctctctattagagataaactagaggaacactttggacatactcttaagaaggtcaagaagattgaggttgacttaaacaaattggaagaggaaactactgacagacagttatccccccaagaagtactaagaaggaagcaattccaggaagcactatgggtagcagctcaatcacatgaatctatactgaggcagaaggcgagatcaaggtggattaaagagggtgattgcaattcacggtacttcaatttgctgatgaatgcaaaccgcaaacataactcgctgcagggaatcatggttgatggatcctggattgatgaatcgggagaagtcaaagaggtagtacgacagttcttcatgcaaagatttcaagaatctgaccaagacagaccccgcttggatggaatccactttcagaccattggtcatccacaaaatgagatgttggtagggcgcttccaggaggatgaagtcaaacaagctgtatgggattgtggaagcgagaaaagtcctggcccagatggactaaacttcaagtttatcaaggaattttggcatttaatcaaacctgatgtcctccggtttctggatgaattctatgtaaatggaatttttccaaggggctgcaatgcatcttttttagccttaattcctaagatgtctgatccacaattctga

SEQ ID NO: 92713 - DNA, 297 bp, Glycine max
  Peptide Sequence Number=SeqID_209491
atggctaacaatggatatgatgcctatgaagatgaatatgatggtaatgaagatgcatatgaaagcaatgcaggccacaatgacaacattaactatggatcaattgacaatgcaaatgattatgaaatgtatctaaagatgaaggtcatgattttttttggcaatgaagatgtttttgaagatgaaggcggcgcaaaggatgatatacttgttaatgttgacattggtgtaaatgctgatggtagagaaagtcacattcagatcaacaatgtggtcaatatattaaacttggattag

SEQ ID NO: 92714 - DNA, 495 bp, Glycine max
  Peptide Sequence Number=SeqID_209492
atggatgttggctttactcatgctttgcattcataccttttagggaaaatgaagtttgtttttgcagaggacacaacatctaatgtgtttatcaagcaaattttcatccaaacacagcttcaggacgtatgctggtcattgaatattcctcaaccaatgtacaagttgcacgacactaaggttatcaacagatttcaatatcatagataccatggatatatcaaggtcatgtgcacaggccccttgcaatatgcttgctttagcaagtatgggaagaattactacaaggcgatgaaagatgtggcaaacattttactgaataaactgttgaaagcatatgggaaaaagataagagatttcaactattacaacgtacaaaacattgaatctcaactaagaatgtatggtgaccatgatggcacattcaaggtggagatgaacatgctaaacgatgaaatgcaatcgttgaactcatcaaagggctttacacagtaa

SEQ ID NO: 92715 - DNA, 348 bp, Glycine max
  Peptide Sequence Number=SeqID_209493
atgccagatcctgcagacttcacacttcaaatgccgagtattgggagtgagagtgtgttaagatgtcccacattcacttggaatatggttcaagtagcttttttcaatccaaccaaattaacccttgaatcaggagtaacccgaccaccaccacttcttagtgaagctgatctactgagttatatggatagggaggaggcgaaaattggtacagatgctacaatgcaagatcacatcaagaagatgcttgatcgatcttatgcaactaaggatagtagcactcgtttcacaccaactaatcttggtgaggcacttgttttgggttatgatgacattgacatgacgtaa

SEQ ID NO: 92716 - DNA, 207 bp, Glycine max
  Peptide Sequence Number=SeqID_209494
atggctctccttcactcacatcagggtcgggtttttcaaaacagactgaaatggaaggtaggatgtggagatagaatcaagttctgggaggataggtggatttgtggggaggagacactagcagaaaaatatcctagactaaaggttggccagagagaacagcagcaggaagtcaggaggattgctatgaggagttatggagaataa

SEQ ID NO: 92717 - DNA, 192 bp, Glycine max
  Peptide Sequence Number=SeqID_209495
atggtgactggaaaagtttccgggaaaggagaaaaaggtcattggaaagcagaagcaagtcgccggaataagtgtgacgaccataaaagtccaccagggatagttcatcattccactctacttcaaggctaccttggtcaacatggtctttatgaatttccttcatatgagtatattgagcacaatggctaa

SEQ ID NO: 92718 - DNA, 438 bp, Glycine max
  Peptide Sequence Number=SeqID_209496
atggcttctccacttgagactcattgggctgcagtcaaaccaattctgagatacctcaaaggtgctttacattgtgggcttgtattcatccagccactcctaatcaacctctgcctattcatgcattcagtgtggtgtctcaatccaataccatggctgaatataggaatcttgctgccagctgcagcatatattctttggatacagaccttgctcaaggaactttcagttcctcatcatatacctatggttctatgtgacagtcttagtgctatccatttggctcataatcctattccacactacaggccaaagcacatggagcttgatgttttctttgttcaagaaaaggttattcccaaacagttgatagttcagcatattccaggtcaagatcagtgggctgatcttcttactaagccattgtctcccacttga

SEQ ID NO: 92719 - DNA, 1545 bp, Glycine max
  Peptide Sequence Number=SeqID_209497
ggtgaaggaggagacatacctatttttcaagaacagattagatttcaggaggttgagtgggtgagacccaaactaaacgggtgcgggagtgataagactcctggcccagatggcctaaatttcatattcattaaggaattctgggaagttatcaagattgacgtgcttcgattcatggacgagttctatgctcatgaatctttctcgaaggggtgtaacgcatccttcataacccttgtccctaacgtcaaggacccgcagaacctacatgaatacagacctatttctcttataggttgcatagacaaaatggtggccaaagtgttagcaaggaggttgaagggagtgatgccactatttatagatgagacacaatcagcattcatagaggattacgaaaaggcttatgattcagtatcttggaagtctttattatatatgttgaagaggatgggtttttgcggaaaatgggtatcttggattgaaggttgtctaaagtctgcttctatatccatattggttaacggtagtcttacatctgagttcattccccaaagaggcctaagacaaggaggccctctagctccgttcttgtttaacattgttgtggaaggactaaatggactggtgagagaagcaatggataaaaacctgtttcaaagttttagcgtgggcagaaacgaagtcaaagtcagcatactgcagtatgcaaatgacacacttttccttgggaaagcatccatggaaaatgtgaaagtcatcaatgtgatcttgagaagctttgaattagcctcaggcctcaaaattaacttctcaaagagtagatttgggacaattgggatgtcgaagagttggaagggttctgagctgtgggatcctattgttaacaaatgtgagaggaaattggcgaaatggaaacaaaaactactacttttgggggaaggggttccaaaaagcattttggataaattggtgtggttgcagaggtggtttctgtggggtggagggggggaatgtagaggcagtagagtatcaacttggtggaaggatataaacaacataacttttgttggtgaggatggcaaacgtttagctaaaggcatacaatggaaagtggggtgcagatcaaaggtcaaattctgggagaatggatggaaggaggatggagtatcacttaagcaaaaataccctacacttttctctatttcgaagcagcaaaaccaggtcattcagcgaatgggcagctttttagatgaaggttggaagtgggatttcaaatggagacgcgaactttttgacagcgagttggatatggctgaggaggatgcttcgggcttatacacaaccaagaacgggtacaggttgctcatgtcagatcaaattaatgaaaatcaggatggtgcttttacagagctgtggaagttcaagcaaaatcatgccgctttggtgggaatcattatcgaggacaaatacctcagcaccatttccagagaacccgcatatgcacttcctccagcatgtggttgggaatggaaatggcaatag

SEQ ID NO: 92720 - DNA, 210 bp, Glycine max
  Peptide Sequence Number=SeqID_209498
atggggttgtttgtaaatatttttcaatggggggctattttgtacgtggaaaatgtcaccatgcatgcatattgcccgcatgaatggcgagatgcaggtgggaggggactcgccattccttctggctatttgggaggggactcgttattccttctggcgatttggcatgtctatatcgccattaagtctggcgatttgactttgatgtga

SEQ ID NO: 92721 - DNA, 780 bp, Glycine max
  Peptide Sequence Number=SeqID_209499
atgaacgttctgaacgtggcggagaagcccatggtggcgaggacggtggccacaatcctctcgaggaaccagaacatgcgaatgagagaagggcgttcccgctacaacaagatctttgagttcaactacaccattcgcggccagccctgccacatgatcttcacctccgtcaccggccacctcatggaactcgaattcgacgaccgttaccgcaagtggcactcctgtgaccccgccgatctcttccgcgctcccgttcataaattcgtccccgaggacaagaaggatatcaagaggacgctggaggaggaagccaggaggtgccagtggcttattttatggctcgattgtgacgttgagggcgagaacatcgcgtatgaagtcattgacgtgtgcactgcagtgaatcctcaccttaccataaagcgtgcttggttttctacattgattgacagggatatccataatgcggcacaaaatgatcttagagatccggacaagagggtggctgatgctgtggatgttagacaggaaatagaccttcgtataggtgcttctttcaccagattccagaccatgttaatgaaagatgcttttatcattgacactgctacagatgacagaaatcgtgtcttaagttacggcccttgccagtttcctacgcttggatttgtcgtggaaagattctgggagatacaagctcatgagccagaagagttttggtcaatcatttgctctcatgaatcaaaggaaggcactgctgaatttagctggatgtaa

SEQ ID NO: 92722 - DNA, 277 bp, Glycine max
  Peptide Sequence Number=SeqID_209500
aaacccacgacagattccatccccattcccagaaaaaggttatcgatcccccgccactcgtcccccttcgtggcgcggcggccccagagcgccaatttctcgactcttaggcggaaaagcaaaccctaacgctgcctccaaagaccttgaatctggtggactcccagaaggcgcggaacatctccagcggcgtgcgcgcgacgacgtcccgcttgagggtgtcgaggacaacgcagaggggaagaatggtcacggaaatggaagctttgtctcttaa

SEQ ID NO: 92723 - DNA, 408 bp, Glycine max
  Peptide Sequence Number=SeqID_209501
atgaggccttcgtcaccaccgttgtgtagatcggtgggcgtcaatccaggtgatggggtcaccggaaacacgtgtgagagcacacctgatgtcagaggaacgccttcgacggcatcgggtagatcggcagcgggagctcttgatggtgggtttgtcggccaaaaagttggccagagagatggtagccaccagaacaatggtgtgagcggaaaagttgttgagaaaggagaaaagggttgtcggaagatgggtgatgagcagcaaggtccatcgagatttggagagaagggtgacaacaagagagggccaccagaatgcagaaaaaagtggaagaatcgccggaaaaggtgcggtgagtataaaggtcaatcagaaattggaaaaagaatgatagaagaaaggcagtga

SEQ ID NO: 92724 - DNA, 297 bp, Glycine max
  Peptide Sequence Number=SeqID_209502
atggctattgctgtggataaattcgtaaagtactatgaagatcctggttcaagacctatttttgagactgtggatgagatgctgcagtgggctggtctgtataatcttactaccaggactttgcgggatgaattggtggatgctgggttgtctacctcgttgatcaatgaacttgttactgtaagaattctttctactctttcgaatgtagatcacaaattcactattaatgttttggcgattctgttgagtgcattgatggcaatattttgcttatcattactgccagctatgtag

SEQ ID NO: 92725 - DNA, 1917 bp, Glycine max
  Peptide Sequence Number=SeqID_209503
atggaacccgaacatcatgattcttcgaacatgcttttgtttcttcccgatgatgttttcgccatcgtttctcggttcatgtcgccgagagatgtgtgcaatctttgcctatgctgcaagagcttaaacgctcttgtggcatccgagaaactctggctcacgcaatgtgacttattgagcacagtgcctcacaaggaccttgtggaatggagaaagggtgtggcttcttacaaagcgctttgtcgttttctgatgagtgtgaaacctttgattggaatatgggttcatcaaaatcctgagcttgggaacgtggtgtatgtgatgccgggttttgtttctgttgttgggtgcaggataatccctcaggagcttggtcctttggggatcgaagagggtcctatactgtgggcttctgtgtttgaggttgttagtgacttggatggttccatgatgtttttccttcatgggagggagaagggggtgaattatgtttatccgggttcggtcaaggttgcggacaggtcctgcaatgtgctgttgcttgaggttgaacccgggggttgtaggaatgttagtgctttgttgcagagtaagagttttgtgcaccactcgggcgtggaggagtcgtcgtcgtcgaggaaggtttgtaggtcaaatagcgatgtttctagttcacaaagggtggttggaaatggtgaagggatggttagttttgggaagttagctttcagtgataggaggaagttgcttgaggttactactagtcaggttcggcaaaaggttccagataagatgatcggaccgttgtttcctgggttgagggatgatgaggagaattttcagaaggatttggtgcttctgtggaaaaggagatcacttcttagtcaaatgtataaggttggtagtggtcagaatgatgagtataagacgagttctcaagaggcggttgatccaacgcagttagaattggatgatgttagggcgagttttgaccgttcaaggtctatctctcatcctctgcctgaggaggatggtcacactcaatgcatcaagaggaagggttttcggggatatgtctggaatggcattaaacaaatccttggaagatcgaatacgatgaatgcaagtccgttagttgccaagaagcatacttcaaacggcgagattaggcaggcgcggcttcaagaatttcttagatcaagtgacacagtaagactaatgttaaaagcttcaactgtgaagctatcttcgtatcgagcatggccaaatatgcatgacagtcggtttgcgctttacaagttgccattgcgggttcccaaagatgaccaagaatatgctggtttatggggaggaacttttggttggcctcctggaaagccttctgaagacaagcctggaaaggctttattctttcttctgctctcttatgaggagttccagggacaacagcttctcattgcaacaaaaattttggaaggcacacactatgtgttacatcctaacggttcagcaatgtttacagcaaatatcaatgatccttcatccgaaccctttccctgggacactgatgcagactcggttccagtgaatatcaagcaagctttcgtgggagagggtattgcaagtggttacgggttcagataccctggatcaaagcctggttccctctttgttttagaaaatggtatccttgccttcatttggaaggagtcaagggctgttttgaacttgcaaagacttaacttgcaagaacttttgaagaagggtgaaagggttgattacgacgaaggggagggacagactcgtgacacagaggggaaggaggcgtcaatggtgtttagtgtcacagcgcaacagggaagggaagggtgcgtcaatggcgtaggtgattggtgtggggagagatggtgtatttga

SEQ ID NO: 92726 - DNA, 345 bp, Glycine max
  Peptide Sequence Number=SeqID_209504
atgtctggaaaagcgaagaggagagatgacgacggtgcttccgacgccgactctgaaggccacgcgccgcccaagaagtccctcaagaaggattccgatgacgatcccgactctattaccgtttgcgagatttcgaagaacaggagggttgccgtgaggaactggaaaggcagcattatggttgacattcgcgagttttacgtcaaagatggcaagcaattgcctggcagaaaagttttccttgtgcgttgttttaggaatagtaaggggtttagtttctactcccttgttgctaggttagtcattattgataacgttgtcacatcattgaaggttgagggataa

SEQ ID NO: 92727 - DNA, 2109 bp, Glycine max
  Peptide Sequence Number=SeqID_209505
ggtgtgttgatgccaaatgcacgtgatgcactgttgttggctcaggagttggagcttcagagatacacggattccgaggaaggtttcactcttcttacaccctcttcttggactaaggttgataaagcaggggcaactgtgttgtttcaagaggcagatatgggaagtaacaatattggggttgtggtaaacccagttcgtcttaagactcttgaagagtttgggactcctcagttcgttgctgataagcttttacaagcagaaagacgtaaggaaagtacaaaggaggccgagttgattacagttgcagaaagatcaggggagggagggttgcaaatttatgaatttgaatacaaggttgatagtactcggggagggatgaagaggatcttttctgcagcttttgtggcctcaaagaagctatatcttctaaatattgttcactctgataaaccagagagtcctcttgacccacataagagaatgattttagagcaaggaactcctcaactgaaacctggttctatggggagtgaaaacagctttgcagaagtgacaggaaacacaactatggattcagcagagaagaggctcaatgagcttggttacaagcaagaactgagaagagaaatgactatgttcaaaactttggcgatatcattttccacaatgacccttttcactggaattacacctctctatggttctagtcttcaatatgcaggccctgcaactcttgtatgggggtggatagtggtttctttcttcacttggtttgttgggattgcaatggctgagatatgctcatccttcccgacaactggttctctgtacttttgggctgcccatttagctggtccaaaatggggaccattttcttcatggtgctgtgcttggcttgagactatagggcttatagctgggatagggactcaggcatatgcaggatcacaaacattgcagagtataatcctactctcaactggcacaaataaaggtggagggtacttcactccgaaatggctattcttatgtatgtacattggcctcactgttatatgggcagcactaaacacatttgcattggaagtgattgccttgatcgatatagtttcaatatggtggcagcttattggtggattggtgatagtcataatgttacctctggtagcactaactacaaaatctgcttcatttgtattcacccatttggaattagcccctgaatcaacaggagtatcaagcaaaccatatgcagttattctatcatttcttgtcagccagtattccctctatggctatgatgctgcagcacatctaactgaagaaaccaaaggtgcagacaagaatggacctattgcaatactaggtagtattgggatcattacagtatttggatgggcttacatcttggcacttacattcagcattcaggattttggttacctttatgatccaaacaatgagactgctggagcatttgttccagcacaaatactctatgatgcatttcatggaagatatcacaattctgctggagcaatcattctactatttgtcatttggggttcattcttttttggtgggctttcaattactacaagtgctgccagagtggtctatgctttgtcaagagacaagggagttcctttttcacacttgtggcggcaactgcacccaaagtacaaaattccttcaaatgcagtgtggctctgtgctgcaatctgcattcttcttggtctcccaattttgaaggtcaatgtagtctttactgcaataacttcaatatgtacaatcggatgggttggtggttatgcagttccaatctttgcaaggcttgtcatgtctgagaagaacttcaagcccgggccgttttatttaggcaaggcaagaagaccagtctgtctggtggcattcctatggatttgttacacatgttctgtattccttttgccaactctatatccaattacttgggatacttttaattatgcaccagttgctttgggggtaggtttgggtataataatgctttggtggctattggatgctagaaaatggttcacagggccagttaggaatattgacattcaaaatggcatggtgtga

SEQ ID NO: 92728 - DNA, 426 bp, Glycine max
  Peptide Sequence Number=SeqID_209506
atggttgccgacgaagcttcaccattcgagaccagcgagatgctggcaacgttcctgacgtcgacgccgctgctatcggagtcatggcagctgtgcacaaccgccgccgccgccgcgcctcggagtttcgtgaccgagcaacgcggtggcggcgtggtgtacgtggctttccccggggtcgaaatggtggcggcgtcgacggactctagctggagaaactttgtggcgttggatagcatcggcgacatgccactgttctcggcgcgtcgtctcaacaaggaaggcgatgagcctgtgatggtgcatgctgggatgctgaatctcttttccatctttttcgaaccattccaaaaacagagttatttgagaggtacacatgtgaactacgagtcaccgtgtataagaaagtttgacaccacactttaa

SEQ ID NO: 92729 - DNA, 546 bp, Glycine max
  Peptide Sequence Number=SeqID_209507
atggaattggaagtcaccgccgctacttctccaccttctcgcgttctcctcatctccgccggtgccagccacaccgttgcccttctctctgggaatgttgtgtgctcgtggggtcgcggagaggatggacagttaggccatggtgacaccgatgatagactcttacccactcatctcagtgcattggatgctcaacaaattgattctattgcatgtggagctgatcatacccttgcgtattccgaatcacgcaatgaactctatagttggggatggggtgattttggaaggttgggtcatggcaattctagtgatttgctcattcctcagcctattatagcattgcaaggtctaaggataaagcaaattgcctgtggggatagccactgtttggcagttaccatggaaggcgaggttcagagttgggggaggaatcaaaatggtcaacttggacttggcacctcggaggattctcttgtgccacaaaagattcaaacatttcaggcaattgcttcctgcatcttcagacttgcttcatgcacctaa

SEQ ID NO: 92730 - DNA, 930 bp, Glycine max
  Peptide Sequence Number=SeqID_209508
ctacctaaactgcagattgttgtcactacccttttcgtacttgggtatacccattggggcaaacccaagggtcccaaagaaagtggtggacaagatggtgaggctgcagaggagaccgtttgtctacctaaggagagaggaggtatgggagtccgggatttgctgaagttcaactatgctttgcttggaaaatggtggtggaacttgttccaccatcgtgaagcattgggggctcaagagggaagctggttcaaaaatcaagtctcttggaaaaatggaagtggcagcagagtgaaattttggaaagaaggctggaaagaagatggggtcccattgctggaaaaatatcctagactgtcctgtatctcaaagcagcaacagcattatattcagcagatgagttcagcgtcaagtggggtgtgggaatggcagctcgagtggaggagaatgttaatggagggagagatgaatggggcagcacatttcctggaagatattgacgggatggcagttcaggtccatcatcaatatagctggtcatgggagggagatccgggaggggagtactcagtgggaagtgcatatcgggcacttaatcaatatgcagttgaagaagaagatgagagggcattgtctatcctttggaaactaaaaattcccagcaaggtgtctctttttgataggagattgattcgggatagattgccaacaacgaagaaccttagaaaccaaaacgtagttttggatgaagtctgcagcccgttttgcctaaaccatgacgaggatgcagggcatttgttttttggatgcaccaaaatcatgccattgtggtgggagaccctatttggtggatctctctggtttggtgcacttggaatcataggaataggattgttttctcaggtgacagctttgatggtcaaaaactga

SEQ ID NO: 92731 - DNA, 1671 bp, Glycine max
  Peptide Sequence Number=SeqID_209509
atggggtgtgttttgtcaagcattgatgaggatgagaacgttcgtaagtgcaaggaaaggaagagggcgattaagcagttggtgaagattagaggggatttttctgattctctattggcttatttgaaagcattgaggaacactggtgccacccttaggcaaatcaccgagtctgatatgattgagtttgaaactgcctctaatgcggcttctccatctcatcatctgcctgcatcccctctgcggccgccgccacggcctccttttcttgccgacaaggccatggtgcacgaagatgaaatgctagagaatggtgacagcaatgtgcctctgctgcaaattgattcaagtttgagctcgttacggctgtttcaaagcactgatagaagagaaatagtagaatctgtggaggaggacaattgggaagaaatgaaaacagaatttgaggatgaagaagcagaagcagaagctgctgcaattgctgaaagattgcgtaggggaaaacaaaagttgattgaaccagttgacgaaaattcctctgctatgagtttgtatagaagagacactacagctatgcctgtggcggttggtagaagtgggaaaacattggagggtataggtaaagagctggatgatcatttcctgaaagcatctggatgtataaaggaaattgctgttcttatagatatcaatggaggagatactcttcttcggcagaattctgggcatcttgataggaagagaggcaattctgcaaaggtcttcagtgtactgtcatggagtaggtattcaaagtcacccccatccaccaaagatggtgctgaattttctggtcatagtgaaccatgcaaacctggagctcattgtgccacagttaaaaaattatatgtggcagagaagaaacttttcaaggcattaaaggaggagggaattgttgcattggagttcgacaggaagtccacgttattgtgtaaacaagaggatgagaaccttgacatagtcaagattgacaaaactcgatcaagtgttgagaagttggagtctgatttaataagcctaaggcagtgcatcagtgaaacaacttcatcaattttggaaatgatagatgaggagcttttgccccagctggttgcattaactgcggggaccctctatgagtggattaagcttgctgaaagcctcaaggatggtaatgaatgtagcaatcattcttctattcttgccatttgtgatcaatgggagcgtgggcttaacaagttacctgacaaggagacctctgaagcaataaaaagcctgatgtcatgccttcgtttcataactggccaacagattgaggaagataacattctggaaaggttacaaaaacttgaaaggaagttccaaaaatgcttgaactccatggctgagatgcagcaaagaatagatggaggtatggctgatacaagccccaagcatccaatacatcttaagaaaactgaaaccgaagcccttaagaagcaagtggaaagtgcgaaagcaaattatttggattctgttcagtacagtagggcaatgacccttgatcacctccaaaagacacttccccctctcttccagtcactgatggagttttcaagtgaatcagctcaggctattgaggctatcaatgccccaggaaagccagtagagtag

SEQ ID NO: 92732 - DNA, 948 bp, Glycine max
  Peptide Sequence Number=SeqID_209510
atgggatcaagtcaaatgccttcacttaaaaggaggttctatcaagtcaaggtcaagagcctagggaccaccagtctaaaggagttagggcagttaatgggtcagctccagcggcaagcttttcgcaaagcttacggtaaaatctggaacttagccatggtagaagtctccacagaggccattgcctcccttgccctgtattatgatcggccgatgaggttctatccctcattagctagaatttccaagatagtccaaatctcagcgcaggaattagaccacaggaagcaagtcgaaaatagggtggttggaataccgagaaaatatttggaggcaaaagcaagaatcttggcaggtaaaggcgagtgggccccgttcatagatattctcgcactgttgattttcgaaggagtcctctttccgaatgtggatgggttggtggacctggcagtgatcgacgcttttcttgcctatcataaccacatggaaagcccggttgtcactatgctagccgacctatatgacaccttcgaccgaagatgtgaaaagagcaatacaaaggattgtttgctgtactccagctctttatgtatggttagtttcgcacctttttcaccaagaggaagaactggagttcttatttcatgcggaggattttcgaatgttcccttgatggggacaaggggttgcaacagttacaatcccgtcattgctataagacaacttggctacccaatgagaggggcaccgctagaggaagagatcgcgcctttcatttcacgaggtttcgataagaccaacgtggagacgcttcagaagtggttgaaagcccacgtgcaaggtttggattggctcccgagtttgagaatcgctaaaagggaggaagttgaggcaccagaggaagaaacagaggtgcaggaccttagggcagaactcgagcaagcctaa

SEQ ID NO: 92733 - DNA, 2802 bp, Glycine max
  Peptide Sequence Number=SeqID_209511
atggcagggaccttgtgtgatattgttgacaatttcaaggattcaaaagtcgatgatgaagatagtgatgatgacaaggcgatagttcgaggtgttgtcgaggagccggctaatgtggatggcgaaagcaatgacgaggacaacaaggatgatggtgacaacaccaatgaggatgaagggtctgcgagggccgaagcagctggataccaccgcacaccagatcctttcctctctctgtctctcacgatgaacgatttcgatggcctcttaaccaccgatttcgggttcaaaccccaaggcaaatcggcaccaatggcagcatccaaatcctcctcctcctccaacaacaacaaaacttcctctctcaacttcgatttaggttcccgatccgctcgtggcgcctccaattcctccgtcaacgccgccgccacttccctcgacgatctcttcggcgactcctcctccgtctttcgcgcctccgccgatttccgttccaagcccgtcaacgacggaccggtcttcgacaaaccggtctacgacgaagacattttcgacggcgttccgggtctcaagagctcctccaaggtcttctacgacgacgttttcgcttctggagggagcgccgccgccgcgttcgacgatcttctcgttgggttaggtaaatcggagaaatcggagaaggtggagaaaggtgcccgggattttgatgacttgatctctggattcgggagcagtaaggcaaaggcctccactgatagtaaatttgggatgcctggtattgagtttcctttgccgtgcatttttatcttggaagtgtatctgtcattttatctggttgatgatgggaccaggaccgttcctgatattaatttgtcacgagaacctactatcaatgcttctaagacagcctctagtgcagcaaacgacccttttaaagtctttgaatcaacttcagccccaattgattcatcctcagactactttacggacccactggaagaaattagtaaatttactagttctagaagcacaaaaaatgatagttcttcaaattctaatgaagtatataatgatattgatccctttggtggacttggaaattctgtacctgcattctcagcagagagaaatagcatgaagggcagcaactctccaacgccaaggtcaaatacaagttcaagctggaccggagataaagaatcaaatgacaaatcgtctgtgaggagtcctgagagacaaaaacaaaacaagattcctgttgatcatgatcaggaatttcttcaggctgcatttgacatgcccatatattcatctgattcttacaagccagttgaccaaaggtctacttccccttcatatgataacaatggttttagacaggctagtattcaggaagatatgtctccaaaatatgaagaaaagttggaatcaaatgatgatatatggttgatggtatcagagattcctcttttcactcagccaactgctgctccaccaccttcaagaccgcctcctcctcgaccagtacatatccctaagtcaggagcaggttcttcagcttctgccaatgtcagaaagaaggataatgaattttcttattttccaagttccagtcaattttctcagggttctgaatctgctcctgctgcagccaagttatcttctgcatctcagtttgatgaacttgaagattttgccatgggaaagagtcatgataatgacgatgaacgtataaatggtcttgccgacgaagaattagagatgaactcagctgctgcagctatgaaagaggctatggatagagctgaagctaaatttaggcacgcaaagggcgtcagggagagagagaatacaaaagcttctaaaagcaaggaacctgtgcaattggaaaaagatggaagagcggtgtcagaggacagaggaaaacaggaaaggttagaccatgaacggcaacaaaaggagagagaggaaaaggagcaaagaagacgtgagaaggaaagggaggagaaagaaagagaacaacagagacttgagagagaaagagaaaaggcaagacaggctgtggaaagagctactagagaagcacgtgaaagagcagctgttgaagctcgccgaagagctgagagggctgctgttgagaaagctaacacagaagctagaaagcgtgctgaaagggccgcagttcagagagcacaggctgaagcccgtgaaagggctgctactgaggcaaaggaaagggccgaaaaggcttccgcggaggcaaaggaaagggaagtgcgggaaagagctgcagctgcaagagctgaacctgaagcaagagttaaagctgaacgtgctgctgtagaaagggctgctgcagaggcccgagaaagagctgcagcacaggcccgagaaagagctgcagctgctgcaaggatgagccaacaacagaatgacaatgatcttgaatcatttttcagcacaggtgcacgggctaacagtgctccaaggcctcctaggtccagctcttcagactctgtatttgatgcccaatttcagtcagatttaacccggaaatctacaggtgtgtcttcaagcatgaagaaagcatcatcatccactaatattgttgatgatctttcctcaatttttggagctgctccatcatcatctggagagtttcaggaaattgaaggggaaactgaagaaagacgaagagccaggttggaacgccaccagaggactcaggagcgtgcggctaaagcactggctgagaagaatcaacgggacctacaaactcaaagagaccaagctgagagacat

SEQ ID NO: 92734 - DNA, 747 bp, Glycine max
  Peptide Sequence Number=SeqID_209512
atgaacgtggtcgaatccacctcaagatcggctacaaatcctaacggctgcaaggcttcacaagaggcagctaacaactgggatttggctaaaaaaatgggggtcagtttttgcaaccaagaggacattatgatatctaagttggctagtctggacgaaagagataagggcgaagctcagaagatgggaaggagtgcagagacaaaaaaggaagctatagacaaagctttatgccaagcattgtggggatattctgaggtaaaatgggaattgaacccgactattaatagtccggggggtatgctgtgtttgtggagtgaagccacttttaaaatggagaacaagataactggaagtggtttcatctttttacaagggatatggcacggctatggagaaagagtagttattctgaacatatattcaccatgtgatgtgaatatgaaaagaatcttatgggaccagattaagcagttgagaagggcaagcaatgttggtcactgggtggaggaaccaaccaaagtcaaagaggaagttaaacaattctttgttaggagatttaaggaggtgggagaggagaggccgcggctggatggagttgaattaaatacattaatcaacaggacaatgatgctcttgtggcccgatttgaagaaggaggaagttagggcagcagtgtgggattgtggcagtacgaagagcccaggccctgatggactgaattttaagttcatcaaggagttatag

SEQ ID NO: 92735 - DNA, 242 bp, Glycine max
  misc_feature (201)..(201): n is a, c, g, or t
  Peptide Sequence Number=SeqID_209513
atgggattctacgacaaatgggtgaaatggattgacggatgtctgaaatcatcctcaatcttagtgctgggtttaatgagagaggctcagaagaaaaatctgtttgaaggaaatttggtggggagaaacaatgtggacattagcattctgcaatatgcgaatgacactgtttttcgagaaagcaacaatgtccaacatganggccatcaaggttatgctgaggagtttcgcattggtttcgg

SEQ ID NO: 92736 - DNA, 981 bp, Glycine max
  Peptide Sequence Number=SeqID_209514
atgctctttctaattctagcacacactcacctgttgctttttaagggcaataaaaaggtccaactgtttccattcttcaggcggaaaaagtccatgtcagattttcatgaaacatggtggctctccatagttgcagcaatcatgtcttttgtctattccacaattgggctcgctcttggcattgccaaagttgcagaaatgggtactttcaagggtagtctcacaggagtaaggattggaactgtgaccgaggccacaaaagtatggggggttttccaaggtcttggtgacatagccttcgcctattcatattctcaaattctcattgaaattcaggacaccataaaatctccaccatcggaagcaaagacaatgaagaagtctgctaagataagtattggagtaaccacaacattttatatgctttgtggtttcatgggctatgctgcttttggagattcagcacctgggaacctgctcacaggatttggtttttttaacccatattggctcatagatattgctaatgctgctatcgtaattcaccttgtgggagcataccaagtttatgcccagcccctctttgcctttgtcgagaaatgggcttcaaaaagatggcctgaagttgagacggaatataaaattccaattcctggtttttcaccctacaatctaagcccatttagattagtttggagaacagtgtttgttatcataaccacttttgtagcaatgttgattccattcttcaatgacgttttgggacttcttggagcactggggttttggcctttaagtgtttttctcccagtgcagatgagtatcaaacaaaagaggaccccaaggtggagtggtagatggattggtatgcaaatcttaagtgttgtttgtttcatagtatcagttgcggctgctgttggctcagttgccagtatcgtgcttgacctacagaaatacaaaccgtttcatgtagactattaa

SEQ ID NO: 92737 - DNA, 393 bp, Glycine max
  Peptide Sequence Number=SeqID_209515
atgatggaggccatgatgagcatgaagaagataatggaggtcaatgcggctacagttgccactgtcagcgctgtttttggggtggacctgactcccccatctggcctcaacctaataaatcatccaaccgcgaatacgggcgacccccattttgtgcatgtccagaacaaccaacaacctcaatctgatcatgcacatgtctctcgacccatgggggagacacatgaaatgcctcaccacaatctagccgacttcgagccttgccttggatatgccactaaagggcaagcagttggtgaattgtgcctagtgccttatgtcatcatccctccaaagttcaaggtgtcggagttcgataagtacaaggaactacttgccccaagaaccatctaa

SEQ ID NO: 92738 - DNA, 291 bp, Glycine max
  Peptide Sequence Number=SeqID_209516
atgaagaggctatgcgaatcttggattgcaagaaatgcttcaaaggatataaaaccaattggttgtaaatgggtttacaagaaaaagattggagcagattggaaggtcgagacctacaaagctttcattattgccaagggatatcattcaaaggaagatatagataatgaccgaaaaaaatctcatgtggtaatgctcaaatcaattcgaattcttcttgctataacaacatactatgatcatgaaatatggcaaatggatggaaaatggatttccttaatgatgagctaa

SEQ ID NO: 92739 - DNA, 784 bp, Glycine max
  Peptide Sequence Number=SeqID_209517
atgccgatcgcgccaaaatcggcgtcggagaaggtggtgtttggcaaagcccaacgcccccagcaccggcagcagcaataccggcaggaaggtgatcagcagcccgttggcgaaggcgcccagcatcgcgccgcgccgcccgccggtggcgttgccgaacaccccggcggtagcgccggtgaagaagtgcggcaccacgccgggcaggatcagcaccatcttcagctgccccagcaggaacagcccggccaatccgccaaggaagctgaacaggaagccgatcagcaccgcgttgggggcatagggataaaccaccgggcaatccagcgccggccgcgcattaggcaccaacttttccgagaagccggtgaacgccggcacgatttccgccagaatcaggcgcacgccctgcagaatgatgaacaccccggcggcgaaggtgatggcctgaatgatcgaatacaccaggtagttctggccgccgctgagctcgctttccacataggcccgcccggcggagatcgccaggatcaggtagatgacgatcatggtcatcgagatcgaaatggagctgtcgcgcaggaagctgaggtttttcggcaggttcatctcttcggtcgagcgcgagtttttacccaccttcgagccgatccagccggacagcacgtagcccagggtgccgaagtggccgaaggcgatatcgtcgttgccggtgatgcggcgcatatagcgctgggcgatcgccgggaagaacgccatcaccagccccagggtcagcgcgccg

SEQ ID NO: 92740 - DNA, 193 bp, Glycine max
  Peptide Sequence Number=SeqID_209518
atgaaacggagggcagatgattttatagggaacagggacgcgccaggggccccaccactagtggaagtgcctgccaggctaccactagtggtcgcgcctgggccccaccactactggcaggcacgatcacccctgtcacatcgtcctgtccagtcacgccacgtgtcgcgttctggtggaacgctctcctcag

SEQ ID NO: 92741 - DNA, 924 bp, Glycine max
  Peptide Sequence Number=SeqID_209519
atgcctccaaagcaagttagggtcaaagggcatttaattaagtttgatgcggattctctcaacacttttctggagactctggttgttctagagtcaggggagactcttcctgcttactctaggttctgcagactaagaccaaaccctcaggagctggcggcccgactttgtatccctggtaggggatttgttctgaatgctaagggcctgccatggaagctgctgaggaaggacctcactactctagcacagacttggagcattttgtcttatttcaaccttgcccctacatcacacacctctgatctgaacttgggcagggcaaggtttgtatatggattagtgatgaagatggacatgaatgttggagccctcatctctggacacacctcggatttccaaccctcatcactgccttatgcatggcctgaggacccagccattaacttgtcttacataaagaagaactgctggaacttggacgaccccacagttagctttctagggacccgcaagaccagggctagaggatctgagggtctatcttctgctactccccaaacatctactgcaccagctcttattccttcagaaccagttcctgctacttctaatccctccgctcagagcacagacctcatgatggcgatgtttgaggcctcctcagctcaagagcctcaactagatctagagactacacctgctgctcaggaggatgattcagaggtcactcccccagagtcatttgtactagaaactgatccagaggcagatctagtgattgcggaggccagtccacaggtatcactaatatctacaccagtgctggagctgagcacctcgcaaggatcaccagcatgcatgcctgtgctgcatttgaccgatgatgaggccatggatcaggacccaccacaggaccaatga

SEQ ID NO: 92742 - DNA, 372 bp, Glycine max
  Peptide Sequence Number=SeqID_209520
atggagctcccagattgtgtatatcctaggccaccatttaccattatccccccatgtgctccaacaccaaagcattctctctatctatctaatcttgatgaccaaaaattcctcagattctccattaaagttttggtggattactaccctttagctgggaggttgatcaggagcagcatttgtgattgtgaggatgatcacaagcttgaggtggattgcaaaggagaaggtgctgtgtttgctgaggctttcatggatgccactgctgaagaattgcttgaatcttgcaaggtcccaaacgattcatggaggaagctcttgtacaaggtggaagctcagagcttcttagatgttcctcctcttgtaatccag

SEQ ID NO: 92743 - DNA, 740 bp, Glycine max
  Peptide Sequence Number=SeqID_209521
tcgccattagagtgctgcacgccctcgccttcagaggactacacggcctcgtctttagaggactgcacgtccttgtcttcagagggctgcacgccctcaccttcagaggactacacgtcctcatcatcagagggtggcacgccctcacctttagaggactacacgtcctcgccatcagaggactgcacgccctctccttcagaagactacacgtcctcaccattaaagggctgcacaccctcacctttagaggactacacatcctcaccttcaaagggctgcacgccctcaccttcaaagggctacacgccctcaccttcagaggactacacgtcctcatcttaagagggctccacaccctcgccttcagagggctgctcgccctcgcctttagaggattacacgtcatctccttcaaagtactggacgtcctcgcctttagaggactggacatcctcaccttcagaggactagaaatcctcgccatcagagggctgcacaccctcacctttagagggctacatgtcctcaccatcagaagaccgcatgccctcttctttagaggactacacgtccttcactttagaggactgcacgccctctccttcagagggctgcacgcccataccttcagagggctacatgccctcgcctttagaggactacatctcctcgcctttagaggattgcacgtcctcatcctcaaaaggctgcacgccctcaccttcagaggattatac

SEQ ID NO: 92744 - DNA, 216 bp, Glycine max
  Peptide Sequence Number=SeqID_209522
atgaattgggttataacagtgttgtatctcaatgaaagggtatatgaagataatgatggtgtaatatttgaaggcagtaaaaaagtgattcagattaaacatggaattagtttcaatgctttgaagaaaaaaattgaagataaggaaaatatattgccttgcaaatttgtgatgacgaagacgttgaaacgatgctggaaagttttaaacaactag

SEQ ID NO: 92745 - DNA, 237 bp, Glycine max
  Peptide Sequence Number=SeqID_209523
atgacgattattttatgtgtaaaaaccccgcctgtgagccctcgagcaacatcgatccttcttcctagaagcccaaatgctttgagatcaagaagtggaacaccgttgtcagggccgtgtacaaacattttggggcctaaggcgcaagggtgctatttgatacgtgttgtattgctgcgtacccagagtcatgcccgtgaaatgaatcgttccaccaatccatcgggatggagatga

SEQ ID NO: 92746 - DNA, 192 bp, Glycine max
  Peptide Sequence Number=SeqID_209524
atggggccaatctacctggttgggatatccaaaataaaagtgagagtggttgaggaggctacaacaatatgcagagagattgaagaaattgttcaaaacatactaaaaattttgggtcccaaattttcaagtcttccaaatgatcatctagttgggatggaatcccgtgttgaagatttagtaaagctttaa

SEQ ID NO: 92747 - DNA, 138 bp, Glycine max
  Peptide Sequence Number=SeqID_209525
atgtatgcaaagagagtctgtgaccctgggttagttgtttgtcgtcaatgtcccaaacgagctttggtagttctagttcgtggtcattacaacactgtgaaatcatgttttggagcaaggattatgctacttttctaa

SEQ ID NO: 92748 - DNA, 333 bp, Glycine max
  Peptide Sequence Number=SeqID_209526
atgcccccgactgtccctgttaatcattactccgatcccgaaggccaacacaataggatcagaatcctgtggtgttatcccatgctaattaacagcaccggaggcacgacccggccagttaaggacaggagcgcatcgccggcagaagggacgagccgaccggtgcacaccggaggcggaccgatcgacccaacccaaggattgggtaatttgcgcgctgctgccttcctggatgtggtagccgtttctcaggctccctctccggaatcgaaccctaattctccgtcacccgtcaccaccatggtaggccactatcctaccatcgaaagttga

SEQ ID NO: 92749 - DNA, 941 bp, Glycine max
  Peptide Sequence Number=SeqID_209527
atcctaagttcatggacatggagttcttttctgatgaaatgtttgagtgtgttcaagcatttcagaactccggtctcattctgtttgtgtctttaaaaattcctgtttatcctgagttagtgaaagtttgttattcaaacttaggaattcaagaaggttccttgatttctgaggtatatgggattaagatggtcatagaccagtcccttttctttgaactcacccagttatccagtgatggtgtaccgtttgaaggtacacttgatgatgattggaagttcgatttttctgtttttgatgcccgccgattggtttgcatcaaccaagcggatatgaccagaaggcttcttgcaggctcattgacatttgattaccgcatcctccactatcttattgttcgcattttgcttccgagatcttcaaaatttgcacaattttttgaagaagatctcattatcatgtgggcatttcttactgtttgtcaaatcgattgggctcacttagtccgttattgcatgaataaggcattgcgatcaaacactcccttacccaatcctcatcttatttctctctttcttcaccatttcgaggtacctcttgattctaaaccttctattcaaatcaagaattccttttccattggggctgcagtggtcgcctccttcggttatcgcaaagagcgtgatggctcttggataaagaaggatgctcaaccacatgatgttgagggttgctcacccactcgagaggattcttctcttctacagagtgtcatggataggtttgatagtcttcagacctatgttggagagagatttgactccttggagagtcaagtagacattcgattcagagagatggattctaggatcacgaagattgaaggcaacattactttcatcagagattgcttcgaacttccaccgccaccatccacttag

SEQ ID NO: 92750 - DNA, 508 bp, Glycine max
  Peptide Sequence Number=SeqID_209528
atggatgcccaaaaaacaataggggttactccaaaggttccaactgaagggaaactcattgataacaataatgcacagggtcataatttcaagcataagattggagaaggtgccaaatcagaggcaagaacagctagtatgaaaggggggaatgaggacgcggaaaaaattggagaaggtgcaaaaaaggcaagaacggcggctatgaaggaatgcatgcagaattggaatttttataggtgcaagacatggacagaggccaaattctcaagaaaatttagagaagttcaacctaagacagttctgaaatttgggaaaaatggatgcccaaaaaacaatgtgagttctgaaactactgttgccaagcacaggagttacctacaaaaaggtagaggggttactccaaaggttccaactgaagggaaactcattgataacaataatgcacagggtcataatttcaagcataagattggagaaggtgccaaatcagaggcaagaacagcta

SEQ ID NO: 92751 - DNA, 141 bp, Glycine max
  Peptide Sequence Number=SeqID_209529
atggatggcaagcccaagccccgaaggctctacataatgatggactgcccccggtgtgaagatggaggtagagtagaagaagaagatgatgccttggatcctttgcccctagctttacgggttctcggaaaggtgacctag

SEQ ID NO: 92752 - DNA, 183 bp, Glycine max
  Peptide Sequence Number=SeqID_209530
atggatgatgcactaagtgtcacttcttctctggaaaaatatattgtagccgcactaagcgcgccatccagcgctaagccccagatactctctgctaagtgcattttgcaggaccaatcagagctgctgtcggcgttaagcacgtgtcttcgcgctaagcctgggtatgcctctggaacttga

SEQ ID NO: 92753 - DNA, 423 bp, Glycine max
  Peptide Sequence Number=SeqID_209531
atggcaatgagaattatcagcaaaattggcataacgtacaatactatgaagaagcttgtggtacaaagaagagtggagggcgccgccattggcgacctttacgaactccatgagcgtgtccaacacaagttccttgagcgtctcatctccttgcggcaaagtgaggacgtcgaggagggacttgaggaactcgtcgaacttggaacggagccacgagaggtagctgaactcggattggtcgccgacgacggagggagtggcgaaggcggagtgggaagagagcttggggaggagagggaggaagaaggagtggagcgagaggagggattcgaggacgtgaaagtttggaggggagggtttggaggagaagagtggggtgtgacgaagctagagttaagtggggtgcggcacaatgcgaatgcg

SEQ ID NO: 92754 - DNA, 699 bp, Glycine max
  Peptide Sequence Number=SeqID_209532
atggagctgcctgacaaagtttatgctaagctgttgctaaaatatccttggcttctatctacaagtattcaagagaactatacgaagctccttgcctttcatattctatcaagttttttcatgaaatcatattctattgttgaaattgaacagaccggtctataccttgaaatagaaagaactaagctgaagtcgatggtggatcagtttgctgaactaggagttcgaaacaaaaagttaaatcaatatattaccaaaagtcctcaactactattgcggaagcccaaagactttctacaggtcacgcaagatggtaaatactgtttggttttagtttttggggccaaggatctgcagttgtcagattttgaacaaagacagacatggacagaggccaaattctcaagaaaatttagagaagttcaacctaaaacagttctgaaatttgggaaaaatggatgcccaaaaaacaatgtgagttctgaaactactgttgccaagcaaaggagttacctacaaaaaggtagaggggttactccaaaggttccaactgaagggaaactcattgataacaataatgcacagggtcataatttcaagcataagattggagaaggtgccaaatcagaggcaagaacagctagtatgaaagggggggtgcgggagaaaagagaaagaaagctaaccacattgaattag

SEQ ID NO: 92755 - DNA, 852 bp, Glycine max
  Peptide Sequence Number=SeqID_209533
atggctggagattcggaaaagacaaggaagacagcggcacactcagaaccacacaggattgaaggaaagcagcagaacggaacttggcatggggaacactatcaaccagcaaaaggttcgacctcatatgcggaagtggtggccagggacaggaacaatgctggccaaatgaagatagtacccaaactcgatcaaaagtgggctgagtctcgatcaacaatacttctcgacattcattcgaacgacaatcaatggctgagcaatgcatgggtagggcgattgaagaacctaaggtggtttgacagacttgaagaagacccaacgtgggacttcggagcagagataactctgaagtacatgggagatgatatggtgcttctgatagggttaacggacaccacagctaaacgaatgaagaaggagacaacggaggaagaagtcatgttttactcgcttgagaaatggcagccaagtttacgagcgactcacagactcacttgggttcaatgctggggtattccccttgtagtgtgggataagaaatatttccggcaaattgtggccgcaataggagacatgattgatgtagatgatgacacagaagagtcccgaaggttagaccgagttaggatactcatctgcacgccaaggtgcccggcgattcaccacactgtgtgcatcaatgtagggggagacacgtataacgtgtcgattgtggaggaagttagccggggtcgcgagatgtgcgattgtcggcgacggagaatcagctggtcgtcggaggaaatcgactacttggttaaagctaattcgagcttaactacttggttaaagcatactcatcaagaatga

SEQ ID NO: 92756 - DNA, 219 bp, Glycine max
  Peptide Sequence Number=SeqID_209534
atggcaatgagaattatcagcaaaattggcataacgtacaatactatgaagaagcttgcggtacaaagaagagtggaaggtgccgccattggcgacctttacgaactccatgagcgtgtccaacacaagttccttgagcgtctcatctccctgcggcgaagcgaggacgtcgaggagagacttgaggaactcgtcgaacttggaacggagccacgagag

SEQ ID NO: 92757 - DNA, 450 bp, Glycine max
  Peptide Sequence Number=SeqID_209535
atggctaaaaacggaaagttggatcggatagaggaaaggctaagggtcgttgaaggaagtggagattatgccttcgctgacatggtagaattgtgcctagtgcctgatgtcatcacccctccgaagttcaaggtgccagagttcaataagtacaaggggacaacttgccccaagaatcacctgaaactgtattgtcagaagatgggggcgtacgcgaaagatgaaaaactgctgatgcatttcttccaaaagagccttaccggggcagtcgtcacctggtatactaacttggaaccttcccaaatccattcttggaaggacctaatgattgccttcattagacagtaccagtacaattctgatatggctccagataggatgcagcgacagagcatgtgcaagaatctttcaaggaatattgatgcgtcattattttctcctatttcttaa

SEQ ID NO: 92758 - DNA, 430 bp, Glycine max
  Peptide Sequence Number=SeqID_209536
gattctacccgtcgctcgatgggaattgcgcttcaaggcgtctcgcaggactaatctgcctaacgacggtcaccaacggcacgtgcctttggggggccgaggccccctactgctggtcggcaaacggacgacgggcgcacgcgtcgcttcttgcccggattctgacttaaaggcaatgataggaagagccgacatcgaaggatcaaaaagcaacgtcgctatgaacgcttggctggcacaagccagttatccctgtggtaacttttctgacacctctagcttcaaattccgaaggactaaaggatcgataggccaagctttcatgctcatcttaggacaccagcattatcttttaacagatgtgccgccccagccaaactcgccacttgacaatgtcttctgcccggatcgaccggccgaatccgacctt

SEQ ID NO: 92759 - DNA, 225 bp, Glycine max
  Peptide Sequence Number=SeqID_209537
atgcggagacaaaatttggtcattccgtacccctttgccattcagacacagtcgtgtccgatggcacacagagacaaaatatggtcattctacaccctttgtcatccagaggcggcgggcccaatgacatgcggagacaaattatggtcatccgcatgttttgctatttgttccgctggcggggagattcactggccgaatggtgtttcgctcgaacgaaattag

SEQ ID NO: 92760 - DNA, 147 bp, Glycine max
  Peptide Sequence Number=SeqID_209538
atggtcaagtaccgcgccaaatccaagacagagatgaatcgaggtacttggggacgggtacgaatggacgctaggcccatgatcaatagatcgctgtcccgtgtccaactccggacaatccagaagcgctactgggaggcagcctag

SEQ ID NO: 92761 - DNA, 1335 bp, Glycine max
  Peptide Sequence Number=SeqID_209539
atgggtgaccagaatatgcaatacacccagcgaccagcgattgccggcggcttcgcgattgggttccatctctcctccggtatcacgggagaattaggcatggcggtattaaacgccatggctaaaaaagtgcagcagcatccgctgatcaaaataagtgtattactcagaagcgaggctgcacatgccacgtccggcccacttaaaacccggctggatgcgctgcaaaagctaaatatcactgtggtggaaggcgacctgcagaaaaatagcctgagcgaactctcagcattatttcgctcttatgatgtcatcattaattgcagtggttttgtcggcgggccgggaacgcagctcagaatcactcaggccgtgctgaaggcgggtgtcgcccgctatttcccctggcaatttggtgtggattatgacgttatcggcaaagagagtgggcaaccggtgtgggatgagcagcttgaagtgcgccacctgctgcgcgcccaaagcaacactgactgggtaattgtttcgaccggtatttttaccagctatctgtttgaacccgattttggcgtgatcgatgccgggaataaaacggtttatgccctcggcgactggaactatgccctgacactcaccacgcccgacgacatcgggcagctgacagccgatatcttctttcatcagcccgcttttcagaacgacattgtttatatcgctggcgatacgctgacttacgcagagctggctgacctgatgcaatctcactggaaaagcgcggtcaggcgagtattacttagccgggaaaggctaagggaagatgcagagcgtcatccccgtgacactggcgcggcctaccggctggcctttgcccgtccggacggtgtggcatggcctaaacaggaaacgtttaattaccgcgaacacattgccaccaccagcgccgctcagtggctgacgaaccagccagcggaagtcagcagaaaactcatgctcgggtttggtgtgctgcttatcctcagcattgctgtagcttcctgtggcatcaaaaacctgcacgacatcgcggaacgtgcggaaaaactcagccagttgaaaggcattaacgatcagtttgcgcaggctaaagatgcccgcctgcaatacaccgcgctgattgcctctctgccggctgcgatgaacctttatcgtcagcatcgtgcagaaacggtgaacgaagtgcataagcgccagagcattctgcaggcgctgcgctttagtgacgaaacaacgggcggttgccgcgctggccagaaactacgtcagcacacagcaggatacggcaaccgcgctcaatga

SEQ ID NO: 92762 - DNA, 666 bp, Glycine max
  Peptide Sequence Number=SeqID_209540
atgcccggcggtcgcccgtcaggcgatcgcgattcccgccttgcccagcgcctcgcgcaccatcgcgtcattggcttcggtcaccggccgggtcagctcccacaggaacttcacccggaagccggacttcactgcgtcctgcgcgctccacagcacgcagtaatcgcgggccaggccgcacacgtgcacttcgcggatgcggcgctcgtgcagccagccggccaggccggtagctgggcgctcgccatcggggccatggttctcgcggaaggcgctgtacgaatccacctgttggcgcgtgcccttgcgcaggatcaggtcggccacggtccagtccacgcccgggtgcagggcggcaccggcgctgccctgcacgcagtggtccggccacagggtctgcggctgcgcgtgcagcaggatggtctcgaaggggcgttggccggggtgctggctggcgaacgaggcatggtcgaccgggtgccagtcctgtgtcgccaccacggtgcggtagcggcgctgcgccagcagaccggcaatcggtaccaccagcgcatcgccctggtcgcaggccagcgtaccgccgggcatgaagtctggctgcaggtcgatcaccagcagggcgacatcggcgggcagggcagtcatggcaggtccactacaacgtga

SEQ ID NO: 92763 - DNA, 579 bp, Glycine max
  Peptide Sequence Number=SeqID_209541
atggaggcgatcaccgcctccgggatcgactatgcgatcttcttctacaaccccaacatccatccggtgaaggaatacgagctgcgcaagcaggagaacatccgcttcgccgagcagcacggcatcccgttcatcgattgcgactacgacaccgacaactggttcagccgtgcgcgcggcatggaaaacgagcccgaacgcggcatccgctgcacgatgtgcttcgacatgcgtttcgagcgcactgcgctgtacgcgcacgaacacggctatgacaccatcagttcttcgctgggcatctcgcgctggaagaacatggcgcagatcaacgactgcggcatccgcgccgcgtcgcgctacgagggcctgcagtactgggattacaactggcgcaagggcggcggtgccagccgcatgatcgagatcagcaagcgcgagcagttctaccagcaggagtactgcggctgcgtgtactcgctgcgcgatgccaaccgccatcgccgcgagaatggccgtgagcggatcaagatcggcctgctgtactacgggcaggacgctgggacgccgcagggcgattga

SEQ ID NO: 92764 - DNA, 1008 bp, Glycine max
  Peptide Sequence Number=SeqID_209542
caccggtcgcggcaagcgttgccagtgcatcgatgtcatcgcagaccatgcttggtggcagcgcggcgtccacgcgctggccatccttcagcaggccccagcgcagcggccggccatcggtggggaagcggtgcagcagcccgcgatgaccgctcaggtcggagggttgctgcggggtgccgtgcgctttcagataggccggcgaggcacagaacacgaacgggacgcgtgccagttgccgcgcgaccacgccatcttccagctgtgcaccgatgcggatgctggcatccaccgcttccggcccatgttgcacggcgcggtcggtcaggcgcagctccagctgcagttgcgggtagcgctgctgcagcgacggcagcaagggggcaagcacatggcggccgaacgcgctgctgctggcgatgcgcagcggcccggccggttcgatgtcaccggaggtgaccatcgcctgcgcgcgcgccaggtcggcttcgatgtggcgcacctgcgccaggtacagcgcgccggcctcgctgagggccagctggcgcgtacttcggttcagcaaccgtacccccagatgcgcctccagccggttgatgttctggccgactgcggtggcgctgatgccaaggatgcgggccgcggcagcaatgctgccggtctctgcggtgcgggtgaagctgcggatcagttgcaacaggttcatgaccgaccagcttgccacggggagttccaagtatcgcttgggactgaaccaagcaggtcggttgcatccgtgatcatccggccgctgggcagggcgctgccctacactgtggcgatgcgccccgattccatccttaccctgtcctgccccgaccgtaccggtatcgtctaccgcgtgtccggcctgctgttcgaccacggctgcaacatcctcgacgcccagcagttcggcgacgaggagagcggccgcttcttcctgcgcgtgcatttcgaccgcgatgccagcctgccgctggagaccgt

SEQ ID NO: 92765 - DNA, 177 bp, Glycine max
  Peptide Sequence Number=SeqID_209543
cgagcgttcgctaagcacaacactcctgggctaagcacgaggaagactctggaagaagatgagttgtacaggttcactaagcacaccgcttcagctcatccgctaagcgagaaaggcgcgctaagccaaaaatcactaatgtacgctaagcggtccatacatgcgctaagtggttga

SEQ ID NO: 92766 - DNA, 255 bp, Glycine max
  Peptide Sequence Number=SeqID_209544
atgtcacgccactcagccatggcacttggcaaaaactcagtcatgcaagttggctgtgaagttatccagggtgaagcattaggcttccttcatgctttatttggggcactgcagttgggactcccttctgttatctttgaattagactgtaagcttgtagtagattgggttcttacaggaattgatgatgtttctaaagtggggtcaaattttggcagagtgctagtctattctcctttcctaatgcaactttaa

SEQ ID NO: 92767 - DNA, 1446 bp, Glycine max
  Peptide Sequence Number=SeqID_209545
atggagtttatgatgtcatacagtgaagcatctcgagatcctgattggattgaggccatgaatgtagagatcaaagcactagaactcaataatgcttgggttcttactgatcttcctaagcacaaatcagcaattggttatagatgggtgtataaagtcaagcatagatctgatagttcaatagagaggtataaagccaaattggtggccaagggatacactcaagtaaaaggacatgactatctagacactttctctccagtggctaaactgaccacagtgagacttttactggctttagctgcaatcaatcaatggtatctcaagcacttggatgtgagcaatgcctttttacatgttcatttgcatggagaagtgtacatggacattcctcagggtatgaaagtggctagacccgaacaggtctgcaagcttcaaaggtccttatatggtttgaagcaagccagtagacaatggtatgccagactctcatcctttctagtttcacatggatacaaacaatgtgcttctgatcactctttgtttattagacatggttctcacagaattgatgtcttgttagtctatgttgatggcattgtcttatcaggcaataacttatctgagattcaaagggttacccatttgttggatgatactttcagaataaaggatttgggagatttaaggtatttcccgagctttgaggtagccagaagttctaatggtatcaatctttgtcaaaggaagtatgcactggacattcttaatgattctagcatgcttggatctaagccaatgtctactcctgattacatatctaaactacaccaacactcaggacttctactttcaacagaggaagcctattcttataggagattaattgggagattgatttatttgacaaatgctaggccagatatcccttatgcagtgcagcatctatgtcaatttgttactaatcccacttctaatcataagcaagctgcttttcaaatactcaaatacctcaaggggactccaggtgcagggatttttatgtctgctgctagtgattcagattgggtcggttgcattgatactatacgatctatcactggctatgctttctacattggtgattcattaatttcatggaagtctaagaaacaagctactatttctagaagctcctctaagactgaatatcaggctttagcaagtgctacttatgagctacaatggcttacttacttgctcaaagaatttaagatcaaatttcataaccctgttgtcctatactgtgataacaaatatgctcttcatatagcagctaatcttgtttttcgtgagaggaccaaacacattgagattgactgccatattgttcatgagaaagtgttgaatggtcttgtgaagcttcttcctatttcttctgcaaatcaactagcaaacattttgtaa

SEQ ID NO: 92768 - DNA, 1380 bp, Glycine max
  Peptide Sequence Number=SeqID_209546
atgaggatgatgctttcttccgctaaaggctcacaatctttcaaagatatcataacagtagataatgttgtctaccatacttttagagaagcatgctttgcaaaaggtttcctaggaagtgatcaagaatttcttggtgctttgcgagaagctaacacttggggaactccacacttccttcgaaaattatttgtcaacctgttatttatgaatacaatggagagaccagaatatgtgtggcaacaaacttggcggtggatgacagatgatgttgtatttaatcataaaagtcaaggctatgctgccaacccacaccaaaataagctcatctacaatgaaatggcttatgacaaggaagttttggctaccgaatttaacagatgctatcactcaatgacagataagcaggcttctatttttgataatattatgtgtgttgttgcaagtcaattagggggagtttattttctctatggatatggtgggactggcaagacatttatgtggaaaactttgtcatctgctgtgcgctctaatggaggcattgttttaactgttgcttccagtggcattgcttcattattattgcccggaggtagaacaacacattctaagtttgccatacctgtgcttgcaacacaaaattcaacatgcaatattcatcaggagagtgacttggctgaattgttgcagaggacaaagttaataatttgggacgaagctccaatgtgtcacaaatttagttttgaggcacttgacaaaagcttaaaagacatcatgtacaacgatagaccttttgggggaaagttttctgattggttactagacataggtgatggcaaagttggccaagctaacaatggacattgcgaaatcaccatcccatatgagtttcttataatggattttgaggatcctatccaagcaattgttgatgcaacatatccatatttattacaaaactacaacaacgcagatttcttgcaaaagagagctatcctagcctctacaaaagatgttgtcgacaaaataaatgactatgtcctgtctttgattcctagtgacgagaaagagtattgtagtgctgatagtgttgacaaatctgatgaactactcaatcctacttttggagtactaacacctgagtttcttaacaccttgaaaacatcagggattccaaatcacaagctaagaatcaagattggtactcccatcatactactccgaaatttggaccaggcaaatggtttatgcaatggaactcgactaattgtcaccaaacttggaaccaatgtagttgaagcagaggagtatgagcccgggcgtcggtataggcaaaacactagttgtaagaatagtagccaccacttgagccaataa

SEQ ID NO: 92769 - DNA, 1390 bp, Glycine max
  Peptide Sequence Number=SeqID_209547
atggatttgaagttttttcctccatatcttaataacactagtaatcatactttcaatgaaagcgagctcctacggatcaaaagcaagttcacaggatggctaattccagacaatgatacgtttgggccttatgaactgattggcttcaatcttttgggttcttaccaggatgcatctaaaatctctataaaaattgatggtgtaagggcctttacttatggagaattgtcctttgccacaaacaatttcagcatctctgctcaagttggacaagggggctatgggaaggtttataaaggggttctttctgatggcacagttgttgccataaaacgtgcacaagagggatccctgcagggtgagaaggagttccttacagaaatatcattactatcaaggttacatcatcgcaacctcgtgtctctgattggatactgtgatgaagaaggtgaacagatgctggtttatgaatttatgtctaatggcacattgagggatcacctttctgttacagctaaagatcctctgacttttgccatgagattgaagatcgcgctaggggcagctaaaggtcttatgtatctacacacagaagctgatcctccaatatttcaccgagatgtaaaggccagcaacatattattggactctaagttttccgcgaaagtggctgattttggactctcacggcttgccccagttccagacatggaaggagttgtgcctggtcatgtatctacagtggtaaaggggaccccggtgttgaagcttgaaaggttgggtctagggtcccctattcaaatggtatcagagcttgctgtgatagccccaagtcctacattggatgaatttgagaataatgagtacttcttaactcataagttgactgacaagagtgatgtttatagtcttggtgtcgtatttctggaacttttgacagggatgcatcctatctcacatggcaaaaatattgttagagaggtgaacgttgcataccaatctggcgtgatattttcaattatcgatggacgaatggggtcttatccatctgagcatgtggagaaatttttgactttggccatgaagtgttgcgaagatgagccagaggcacggcctagtatgacagaagtggtaagagagcttgagaacatatggtctacaatgccggaatcagataccaagagagctgaatttatatccagtgattctggcaaagcagacagtcacagtacaccatcttcatcttctgcctctgcttctgttatgaagactccttttgtatcaggagatgtgtcaggtagtgaccttggccaattaagtactagggaattgaggaggtataaggttgatctagtggtgaaagaagaaggaaagggaggaaaagccatag

SEQ ID NO: 92770 - DNA, 210 bp, Glycine max
  Peptide Sequence Number=SeqID_209548
atgcatctctggccctgcagtcttctcgacaacaacaacttatctggatatcttccccgtgagctggctgatatgccaagcttacttatcattcaacttgataacaataactttgagggaaatagcattcctgatacatatgccaacatgtcaaagttgttgaagatgagaagcaatcatacaagagaaaatgttggccaagatatataa

SEQ ID NO: 92771 - DNA, 2151 bp, Glycine max
  Peptide Sequence Number=SeqID_209549
atggcggatgacgacattcctaagaccgcgtttcgcacccatcacggtcactacgagtatagggtcatgcctttcggcttatggaacgcgccctcgacctttcaggcagccatgaacgccctactcagtcccttcttgcagaagtttgcggcagccttttttgatgacatattgatctatagtgagtcccttcctgatcatcttcttcatctggagtgtatctttcgtgcattgtcgcaggcccagtactacctcaagcattcaaaatgcttaattggccagcgccaacttgactacctaggccacgccgtgtccggcagtggggtgcaacttgatccctctaaggttcaggccatcgttgactggcctactcctcgctccccgaaggaccttcgagccttccttggcctcacagggttctatcgtaaattcgttaaaggatacgcaggcatggcggcaccactgactaagctactatgcaaaaacgccttccactggacttccaagtctcggaccgcattcgattccttgaaaaccgccatgaccatagccccaatcctcaccctacccaattttggccttcccttcatcctcgagacagatgcatcaggcagtgccatgggagcagttctccagcaacaaggccaccccatagcattttttagtaagcctttctatcctcgacttcaacatgcatctgcatacgttcgtgaattacacacgatcattgccgcagtccgccggtggcggcagtacctacttggccacaagttcacgatattcacagaccacaggagcctctgggagcttatgtctcaggtagttcagacacctgaacaacagttctatctagccaagctcctgggattcgattatgatatccaatataaggctggatcctcaaatatagtcgtggattccctttctcgtgttgactgctcttcccagggtcagtgcctcatcctttcggtccctcaccatgaatttatgatgcagttaaaggagtcgttggaagctagcacagagttccaacagcaacgcgctgccatactctcgcatcctgagaaatacgcgctgccatactcatcagggtaccacgccgcgcctataggaggccatttcggagtgaagaagacactgcatcgcctgcaatcaagctttcagtgggcttccatggcgaaggacgttcgaacattcattcgtaagtgcaacgtgtgccaacaggtcaagcacatcacacaaagacctgcggggttgctacaaccgattccaatacctaacttcgtcacgcaccttccaagttcgcatggtttcacggtgatcctcgtggtggttgatcggttttccaaaggcgtccacctaggagccttacctactcagttcatggtgttcaaagtggccaccttgttcattgatacgattgcatggcacgaccctgcgtatgagcacagcctaccatcctcaatcggatgggcagatggagctatctacggcaagccaccgccttccgtccctagctacatcctgggctcttcccacaatgatgcagcagcaacagttctacgaacaagggcagagattcacacggcactcaaacgtaggctgaccaaagcccaggataccatgaaacaattcgcggataggcagagacgagaagtccaatatgaggttggacaattggtgtacgttaagcttcgcccccatcgtcagctttcggtaccaacagacaaacccaataagctcaccaaacgctactttgggccattttgcattttgaaacgtatcggtcaggtcgcttatcgtctacagcttcctccggggtccaagatacaccctgtgttccactgttcgatgctccgccctcatcacgggcccttcgagttacaaacttcctctcttccacctgaagccattcacaatcaacccctcttaaaacctctagccatccttggctcacgaatggactcatccacatccccacccactcgttcagtgctagtacagtgggctggcttacctccaaaagattctacttgggagaattgggaggatgcccgtggtgaccatcaccttgaggacaaggttcttgggtgtcacggtcctttggcgaatcatgagcctgaaagagctttcttaccagctactgcttag

SEQ ID NO: 92772 - DNA, 1401 bp, Glycine max
  Peptide Sequence Number=SeqID_209550
atgcctccgcatcagcatccatcttcttctcctcgcctacatcagcgcccccccttcaagcttgacgtaccacaatttgacggccacgatccactgggatggatcttcaagatctcccagttcttcgattatcaaggaacgccagaagaagaccgcatcactatcgcatccttttaccttgacagcgccgcactcagctggttccaatggatgtatcgaaatggctttattacatcatggcaggcattacttcaggcaattgaaactcgcttcgctccatcaatttacgatgatcctcgtggcgcattgttcaaactggttcaacgaggctcaatcacggagtacatgacggagtttgagagattggcaaatcgtatcgttggtctctctctttccgatgcactccaacctgtttcattacctcacgccatggccctcgcccgtcttcaagaagataagatcaatgatcgtcggaaaaccccgcggtcttcctttcctcccccacagacccaggctccatccttgcctattcaaacccaaacatctcgacctaaaactcccttcattcagtgtactccagaggacatgatgtacaggcgcaaaaagggcttgtgctacaactgtgatgagaaatggagctcctctcatcgatgtaaaggacgtgttcttttgttcattgtatactccgatgagtcctctacctctgatatcaccctcacagaggcctcgccacaatctatcaatgagacggtgccaccattcgaccccaccccacttcaccctcagattagtctccacgccatggctggcattccggccatcgacacatttcgtctctatggtgtcaataatcacgctcgtgtcactatcttggtggacagcgacagtacacacaatttcatccaaccacgtgttgcgaagtttcttgggttggcaatggaggaaaccatggcccttcgagtgatggtaggaaacgactcagtcttggaatgccggcaactgtgccccgccacctccttgctcatacaggaccactcattcacagtgacgctgcgcattttgccgttaagtggcgccgacgtcgttttgggcattgagtggttaagcatcttgggccctattattaccgattacacctcctttaccatgcatttcagccacttgggccagcccgttagccttcacgcagacgttcacaccaatactgacccaacctcagcccatcaacttcgacgcagcatccacacccactcggtctcgggtttgtttcacttgtctcttatacccgtcaccttacccgaaccagacaccgacccacctcaccccatttccaccattaacgaccttctactcaaattccaaactcttttccagcaacccaccaccttaccaccgccttga

SEQ ID NO: 92773 - DNA, 276 bp, Glycine max
  Peptide Sequence Number=SeqID_209551
atggatgagtggagtaatagcttgggtcatggatcgctatatggatcccttgagcctcaatcaatacacaatgcaaaggacaggcgtgggcaatgtgaagaatatattggaaaatggcttaaggaatcgcagcgacaagttgcatttaaggcattaaagacgactgatgagggaaaagttcctcaaagaattactgatgaaggtgttgccaaagttgttgatggtttggctctcaaagttgttgatgaaggtgttgccaaagttgttgatggttga

SEQ ID NO: 92774 - DNA, 234 bp, Glycine max
  Peptide Sequence Number=SeqID_209552
atggaagacttgaaggttatgttgatagtgatcaggctaaatgtagttgttcaatctttggttgaagcagagtatattattgtagcaacagtttcacatcaagctatttggattagaaaggtggcggatcgagaagtacaaggtttgttggtgggttgtcatcttccttcgcaattagcaagaaaaacttggaagcacactgtaacctctgtggtaattctcatcacaacttaa

SEQ ID NO: 92775 - DNA, 393 bp, Glycine max
  Peptide Sequence Number=SeqID_209553
atggagctgggatcaccatgttacactgagttgtggttagatgccattgagatgggtgacctagcctatgtgagggcaagaatgggcccagatggtattttgattgggtatctagtatggagtatgtcacatgttgatcccatgggttggagtatcctttcaaaattggataaccctaatgcaccaatcacgatctcatcttggttagagtgtaataatggaatcatgtgggttcgtactgcatgtcttcttgagattctttcacaaaatgtttttttttggtaccacatgcatgtgagaaaagagaaagcaacatcacattgtatatgtgcattttgtgaattgtctaacttggagtggatgtcatgtgtcccttatgttatgtttgaatga

SEQ ID NO: 92776 - DNA, 408 bp, Glycine max
  Peptide Sequence Number=SeqID_209554
atggccaacactgtcctttccctcgcccacctcggcttctctgttgtcgcaatcaatgctgatgtcggcctctgcaacctcgacctcctccgaactcaaaactgcacattggcaaagactcaactcgtcgacatattctcccacttttgtgcggcgattgaaggagatgatttggggttgggtggtggtggaagggaagagatacaggcgtttaactctctagcaaagctgtcagagatcgaaatagggtgtggcagtgagagaaaatggaaggaaaaagaaaggatgtcatggaaaaaagtcaccgctggaattgcatatgatagtggtggtacatggctacaaaaaaggaaacatgaaagcatagtaagggaaacatttctcccaattgagaaattagtctattga

SEQ ID NO: 92777 - DNA, 363 bp, Glycine max
  Peptide Sequence Number=SeqID_209555
atgaagatgaaggacacttaccggttgaaggggactcttctctctttcagagtattttggacaggtttgatggactccaaacctatgttggtaaaaggtttgatgctttggaatgacaagtggacacgcgatttgacgagatggactcaaggatcacaaaggattgtcatcatcaaaaagggggagattgtggaagcaatgacttccaagattattttgatgatgccaaagaatcaagagttaagcaaattccaaagattcaagaatcaagtttcaagagtcaagattgaagaatcaagtttcaagaataatcaagatcaagattcaagaatcaagagaagactcaatcaagataagtactaa

SEQ ID NO: 92778 - DNA, 158 bp, Glycine max
  Peptide Sequence Number=SeqID_209556
agcttcgatattatgtagattctcacttatttttcgaggtagaagagccacgccatgatttggagttcctattgactccaattgagtatgatgggcgaggcaacgttcgtcaatacaacgtggagcaagtgcacccaatggaggttaaagaggactga

SEQ ID NO: 92779 - DNA, 288 bp, Glycine max
  Peptide Sequence Number=SeqID_209557
atggtttatacccttattattttaatagaattggatgaagctatagagttgtttgaagaactcgacagcaacaacaatgttccattggggaattttaatgaagcatgcaacttacttgagaggcaaaacagaaagggatgtatacctaatctaattgcatataattgcatcctgacttgccttggaagaaagggaaaagttgaggaagcattcacaatccttgaagcaatgaaaatggatgcagctaccaatcttacatcctacaatattttaattcacaggctatag

SEQ ID NO: 92780 - DNA, 207 bp, Glycine max
  Peptide Sequence Number=SeqID_209558
atggtggcatttctagtgctctctagagttcctctttcggttgctctattaggattcttgagagtcaaagaaaaaggaacaaaaaatgttttgaatgggctgttaaagaggtcatgccagagtgaggttagggatggtggtggggtggcagatctgggtcagaggccggtggtggactggtggtggttttgggatggtgatgcatag

SEQ ID NO: 92781 - DNA, 171 bp, Glycine max
  Peptide Sequence Number=SeqID_209559
atgcctttcattacacattttcaagcaagcaacaccagggcatggacttctgttcgacagggcttagtgatgatgggtcacaaacttctctttcaacgcttggtgaagacaagggatgctggtaaagaccaaagggggcgctgggtgaagagtggaaagggatggctgtaa

SEQ ID NO: 92782 - DNA, 180 bp, Glycine max
  Peptide Sequence Number=SeqID_209560
atggacattttgagaaaggtaaaagaagtcacagaagaagttaaaaccagcaagaaggcccttgaggaagctcttgaaagggtagaggctgcgaatcaagtttgttcatcacttgtgacttgtcatgctacttttagaggtgatttctgtgaatttgactcttgtaagctgatgttgtaa

SEQ ID NO: 92783 - DNA, 204 bp, Glycine max
  Peptide Sequence Number=SeqID_209561
atgggatgggagatacaacatctagagatcaaggatttcaaagcatcttgcattcccatgacaatggcattccagaaattagcattcaagatagcagggtatctgaggtggttttgtgaaaatagaaacataaaacatttccatagaccaaaggcacccttaaatattgtcatgaagatacctacctgcgaaatgctctcttaa

SEQ ID NO: 92784 - DNA, 1053 bp, Glycine max
  Peptide Sequence Number=SeqID_209562
atgaatccatttttgttccaatgcctcaaatgtccacttcgattcaagattgaggagtatgatgggagtgtgccaaatttgatcttgaggccacagtcctggacaaaggtttgcaacattatttttgtagatttgccttttggaactggcttctcgtatgcaaaaaatctcactgctcaacggagtgactggaaattagttcaccatacccatcaatttcttaggaagtggctgattgatcacccagaatttctttcaaatgaattttatatgggagctgattcttattctggcatacctgcccctgctattgttcaagagatttcaaatggaaatgaaaaaggtctccaaccacggataaatctccagggatatctgctagggaaccccataacaacaagaaatgaaggaaatgatcaaatcccatttgctcatggaatgggacttatttctgatgaactatatgcgtgcctttcaggaatcaatactttctatattttggatcgctattgtaaatctgattcgcctaaaaaacatgaagctcagtggaggagatctctgactcagaagtttgaggcctctcttaattctcatctcagagtgccagacataagatgccaaatttttgggtttttccttgccactcaatgggccaatgacgaaagtgttcgcaagtcactgcatattcgagagggaactataggcaaatgggaacgttgttacactacagattttgaggaacagatcttcagtagctttgagtttcatgtaaatctcagtgcaaaaggatatcgttctttaatatacagtggagatcatgatgcagttgttcctttcatgtcaacccaagcatggattagggctctaaactactccattgtggaagattggaggccatggcttctagaagaccaagttgcaggatacacaaggacttactcgaatcaaatgacatttgcaactgtgaagggttcaggacatacagctccagagtacaagcctgaggaaggttttgccatgttcagtagatggatagctaatatgcctttgtaa

SEQ ID NO: 92785 - DNA, 732 bp, Glycine max
  Peptide Sequence Number=SeqID_209563
atggcccttcttgaatccaacccctactccccatcttcttcttctgtgcatccacaccctgcgtctccatctctgactctgcaccatatgaagctagaggtgctgcacttcaatgggaccatgaacgcctcaccatcgcctccttctaatggaggcacctgtgttggcttggctctcgtggatggccgcaatggccaacttacctcatggtgtggtctccttcaagcactcgagactcgttttgccacatcaacgtatgaggatcccaccagaactctgttcaaactaatgcaacatggctccgtcaatgattacttgtcggagtttgaaaccttggctaaccgcatcattggcttccagcttacctcatggaatgttttgggcacttctaaaactgcacaagaagaagaagcttcaaccccaggaataagcacggtttctaaaatgttttgcaattttcacattattcttctaattgctcttgcacttttggtacaaatatcatctcagcttggctccaaggtagaagtgcttcctggctttgaaggccctcttccttttgaactggaaacagggtacgttggattaggagaaaaagatgatgacatgcaagtgttttactactttgttaagtcagaaaatgatcctcagaaagaccctcttatgctttggctaactggtggtcctggctgctcttcattttcaggtcttgcctttcaaataggctcgtaa

SEQ ID NO: 92786 - DNA, 135 bp, Glycine max
  Peptide Sequence Number=SeqID_209564
atgggcctgactgaagtcaaggttggtgaagagtatgaaattgttatgacgaatccagcaggacagagcagtaaggaaggaccacaactacttccgtctttcaaattcaaaaatatgattctgcatactgtttaa

SEQ ID NO: 92787 - DNA, 321 bp, Glycine max
  Peptide Sequence Number=SeqID_209565
atgagaggaaatcaacaaacactattgtattcaggtcatgagagaaaggttccaccgaaggaggttggatcgaaagcgaaaaatcgaaacttttacatcccaactttggccattacagaagatatcaacatacattttgaggaagactataacaagttttatgaaggcttctctaagaacctgaaacttggtattcatgaggattctcataacaagacaaagctagctgaattgctcaggtatgactcgagtaagagtggtgatgagatgaccagcctcaaggactatgttaccaggatgaaggaaggacagaatgaataa

SEQ ID NO: 92788 - DNA, 180 bp, Glycine max
  Peptide Sequence Number=SeqID_209566
atggacctggaagggaatgatggggtaattccctctgattcactgtttaggaaggccagatatagtaaagatactattattgtgaattttgacactgatacagcttggtcttcaataaccagctcttcaacccagaaaaagtcatggatgaagccttattccatacttggtcctggttaa

SEQ ID NO: 92789 - DNA, 180 bp, Glycine max
  Peptide Sequence Number=SeqID_209567
atggaagttgcaaaagctgcaatagcaggtggcatttcagttttggagattgtggtgtctacctcaggttctatagcagctggtgaaagagcatcctataatggccctagagaacgtttgatacaggctacggagatttggatgacgccacttccggtgaaggaagataagtcagggtag

SEQ ID NO: 92790 - DNA, 177 bp, Glycine max
  Peptide Sequence Number=SeqID_209568
atggcacccatagggttccatggaaaaggcttagttttgccctttgagtctgactttgggttggttttgggcacacaagttaggggtgctaagaaggccctcaacctagtgttggaggttgtcatggtggctaatgccaaatgggcctataaaatggataggtgggcaaatccctag

SEQ ID NO: 92791 - DNA, 132 bp, Glycine max
  Peptide Sequence Number=SeqID_209569
atgactgagcagtttgctgctttggctgccataacccagaatcctggcatgtcttcatatcgattctttgtcaatgtatcccatgttataaactttatgtcatatgttgatggtgaggctggatttaattga

SEQ ID NO: 92792 - DNA, 465 bp, Glycine max
  Peptide Sequence Number=SeqID_209570
atgccaagaacacatttccagaaggcctcttcatccctggacgatgggtatgcttctaaagacaaagtcagtattaggcacaccatcagaggagtaaaggtaatgatatctctagcaaccatcgccactatgtttggatgtcttgaagggggtcttgcttttgacaaagattgggaaaaggatatctatcagaaaactagggtcatagactatgtcagtgacagggataggttttacatgtataaattgatggtgggtgagaagaaccttgttccttatggaatgattttcacccaaatcatgagggatgttggtgttgacatgtgtggtatggcaccaattagagaggcaactcaacttaaagggatggccttcatgaaaatggggattgctaacaatttcctaaagtatgctcaaaagcatataaagagaaaggttaagaaagagcccaaggagaaaccataa

SEQ ID NO: 92793 - DNA, 696 bp, Glycine max
  Peptide Sequence Number=SeqID_209571
atggaagttgtcactgttcctaaagaagtggatcctatagaaaaggaaactcttgaggaggctatgtttcacttttttattgaagcttctcttacagaatctgatacaattgatgttgacaaactcaaatgcttagaggagatatatggagcaccagtatttgtctccatacaggatgttataggacaaggaatcaattttcaagagtttcccatcaacaagactattgctccaaatcctggtagtcttatatacgagcatagcccaatagcaagaaaagtatatcctcctggtgccactgtttggaaccatttgagatgcctttctctactccccttagatcttcaacagttgatgggtctcatttgttccttgaatgacagtccaaaattccaagactacgagcaatcagactatggtcttgagctcataatgaagttgttcacctacagggaagaaaacagatcaagaaaagcgtcatttagaaggatccaaaggctcaatacccatttgccttttcgacttaggtcgcaattttcatgtttagccacttcaaagacctggtttcaaataacaattgataagcgtattttgtatcaaaacactaattgctacaaaagcaagaagctactggttgaagaagatgaagatgcttcaccaactagatatgtcaaggctcataaagcagaagactaa

SEQ ID NO: 92794 - DNA, 153 bp, Glycine max
  Peptide Sequence Number=SeqID_209572
atggataaatttaagattataatagcacaaagtgctgcactcgctttgaccatagttaacttttgtaatccttcggacttactaggtgttggttcaatgtcaatgagacatgaaatctattgctttctagttggagaaacaatagcttgttag

SEQ ID NO: 92795 - DNA, 441 bp, Glycine max
  Peptide Sequence Number=SeqID_209573
atgagtgggttcttgcactcaagatacattttgtcaagatccaacactagagagagagttaggatcttgcacaagaacccccaagatcccaaaagatgtgattggcttaaccggtttgggagggaagcaacaacaaaaagatggagagggaagaggaaggggaggcgcaggcaaacaaggaaggggaaaggggaagagaaaagagaggaaggggagaggggaagaggaacagtcatgtatagagaggaaggggaaaaagaggaaggggagaggggaagaggaatggtcacatggagagaggaagaagaaagagaggatgcggataggggaagaggaatggtcagcaagagaggcgaagaggaatacatgagaaaaaagggagaggggaagctaacgatctctacacagattggggaaaaaggtaagggtgagggcgaataa

SEQ ID NO: 92796 - DNA, 429 bp, Glycine max
  Peptide Sequence Number=SeqID_209574
atggtggagattctaagagaggaaattgcagagctagaaacaaagcaattgtatgtgttctgtcaatctctggtgggtaaggatctgacaggattgggtttaaaggaattgcagaatttagagcagcaacttaatgaggggttattgtctgtcaaggcgagaaaggaggaattactcatggagcaactagagcaatctagagttcagattgaggagcttcggtgtttgtttccacaatcagaacgaatggtcccattccaataccaacatactgaaggaaagaatacttttgtagatactggtgccagatatctcaacttggccaataactgtggaaatgagaaagggagttcagacacatcatttcatttggggttgcctgctggtgttcaagaggaaggcccccaagaaagaaaactttgcaaatga

SEQ ID NO: 92797 - DNA, 180 bp, Glycine max
  Peptide Sequence Number=SeqID_209575
atggtagtggtagcttcagtagttgcaacttcagcggaagtggtagcttcagtagttgcagcttcaggggcatttgcggaagtcacagggtcaggaggaaggagaaaggagaaaggacaagagggctgctcaagcttcaggctgatgtatagacttgtggatatcaacatgtacaagtga

SEQ ID NO: 92798 - DNA, 726 bp, Glycine max
  Peptide Sequence Number=SeqID_209576
atgggagatcgattagaagatatgatttgtgatattatacaagagtattttcaccaagcacatgcctctatgtatgatacattggaaaaagattcaaataagtctttgtatctagggtgcaagaagtcattgaaatttttgtcaatggtgttaagtttggttaatgtgaaggccatatatgggtggagtgacaaaagcttcacttcattacttaaggtagtgcaaggtatgcttctagaagaaaacacattgccaaaaaattactatgaggtaaagaagatattatgtctgatggaaatggagtatcagaaaattcatgtatgccttaataattgcatactgtatagagacaagtttgaagaaatgcataaatgccccatgtgtggggtatcacagtacaaagtgaaggatgatgaggagtatagcagtgatgaagcacaaagaaaggtcccccccaacgaaggtttaagcatttgtttgcaaatggagatgacacaaaagaccttagatgacatgcaaatgggagaaactgtgatggaatgctccaccatttggctgattctttccaatggaagaagattaatcgtttgtatccaaattttgggaaagatgcaagaaatcttaggcttggacttgctagtaatttacaacttgcctcattggttgtacatgaagctaaaatacattatgttgtctatgatgatattggggccaagacatccatga

SEQ ID NO: 92799 - DNA, 360 bp, Glycine max
  Peptide Sequence Number=SeqID_209577
atggaggtagtgacatctcctcaggagaagcccaatccaattaaattttggaccagcctaaggaggggtgagcatttgcttgctacaccccattgccatgttatatggaaggtctacaggctctacatggagctacattatatggcaagcatgagggaacctaaacccactaatatcacccttcaccttcctgactgttttgtggtccatcctagaaaggtgatagaggatgtgttgattaaggtagataagttcattttccctactgattttgtggttttagacatggaagaagatgaaaatgtccctatcatattgggatgcccttttctaaataattataattgttggaagaactag

SEQ ID NO: 92800 - DNA, 381 bp, Glycine max
  Peptide Sequence Number=SeqID_209578
atgccaatcaatatacagccaagtaatggattgttgaaacctgctgaggacatgggatttggtttggagttcagaaagagcagcacaaaacagcatagcagttcaaagacagctaaagaaagttctgtattgccccattcgaaacaaagttggaaggatgctgagaagttgaagtcaaagagtgatctcaaacagaaaggcaagttggatgcagaagggaagattcagaactcagaaactgtgaggagaagggcaactgaaagagatgaacttgtcaagcacatgtctaatttgccaggctatctcctgggtaccgataaagtagaaaactttcaagagaaagctttcaatgttggtgttctagattggtctcggctttga

SEQ ID NO: 92801 - DNA, 414 bp, Glycine max
  Peptide Sequence Number=SeqID_209579
atggaaaaacaagcggctactaattttggtgcaacaatgatggctagggagtcggttgatgcaccctcttctaaagacaactaccctccaaattgtaacaatcgtaacaacaaggcagcattggccgtggtggcgactagcagcaaccttggcaaggaggttgaaatagtagatagtggccttggtaatggattccttaggctatctctccatgtccatacccatctgctcattgagccaggcccaatgctcaacaacaccaccttaccaagtagcaagggttattgggcccagaccttagcaggccttttctgctacaactcctacacgacattgagcagacaatgcacacacttaggcttactccttcggacccaaactggtatatggacaccggtgccacctctcacatga

SEQ ID NO: 92802 - DNA, 180 bp, Glycine max
  Peptide Sequence Number=SeqID_209580
atggagaaatctattgagtttagtgagaggttgagcttctccggaatagcaagtagcttggtcctctacctcacaaaggttattcatcaagatcttaagacagcagttaagaatgctaactacgttgctggtttcaccactttgactgcactcctcggaggattcttggctgatgcttag

SEQ ID NO: 92803 - DNA, 558 bp, Glycine max
  Peptide Sequence Number=SeqID_209581
atgactccggttgatactaaatcgaagctgagtgctacttctagcacaccttatgctgatacatcacattattgcaaccttccaggtgccctccaatatctaaccttcacgagacattcgacatctagttattgtgtttttcttggtgataatttgatcccttggtcctttaaacaacaggctactttatctcaatcgagtgcagaagttgaataccgaggggttatgaatgtagtttctaagtcctgttggttaagaaaccttcttctagagcttcattgtcctattcaaaaagctacattggtctactgtgacaatgttagtggaatttatctttctggcattcttattcaacaccaacgcactaaacatatggaaatgaatatttattttgttcgtgaaagggttgctcgtgcacaagtatgtgtcttacatgtcccatcgcgttatcaaattgtagatattttcatgaaagggcttcgattggttctatttgaagattttcgagacaatcttagcgtacggaaacctctcgctttgactgcgggggtgtgctag

SEQ ID NO: 92804 - DNA, 234 bp, Glycine max
  Peptide Sequence Number=SeqID_209582
atgctgacatcgcctttcacgctgatcaaatttcctctcgggttgggatttgcactgagcgcaacatttcacgctgagtgcaattcctctcgggttgcaattacgcttgacatgcttgtcttgctaagcaagaagtctagtgcatgcgtgaatatctatgatttgagcatcgttgtccatgtgaattggttggagaaaagtgggtgcgttgaaggggaatttttgtggggataa

SEQ ID NO: 92805 - DNA, 603 bp, Glycine max
  Peptide Sequence Number=SeqID_209583
atgcttttgtgtggggttggtgacaatgatgatggtggtggtgtcagcaacgacgatattagagatcctagtagtggttgcggtggcaatgatagtaaaagtggtagtggtggtgttggcggtagcgatgacgatagtggtggtggtgacattgttggtggggacgacccaatggtggtggtggtggtgatgatagaggtggtagtagcaatggtagtggtggtgttaatggcgttggcaatgttggtgacattggtggcggtggtagtagtaataatgtcggtggtggcaatgatggtggtggtagcggtggtggcggtgacaagtgatattggtggtggtgggaataacggtggtattggtggtggtggcggtgatgatggtgatgtggtattggcggtagcggtagtggcagtggtattaatgacaatggtagtggtgtgtggtggtggtggttggaacgatgttgatggtgtttgtggcggcagtgacgaaggtgatattggtgttggtggtggcagtgataacaacattggtggtatcacggtggtgatggcaacaaaaaatgcgatagtcaaatatggaaaatacgtgctttcttaa

SEQ ID NO: 92806 - DNA, 681 bp, Glycine max
  Peptide Sequence Number=SeqID_209584
atggatgaacatcaacaaaactggaaggaaatggctaacataatgatgaagattaacaaagaattagatgaaatgttcaacactgttcatgttattgatcagccttacggtgaagtgagtaggtcatttgttataagatggaaagatgaactacagcctacgtggcatctgctacactctagtggcaacatgcactctgtcacatatcaccaagatttggtgagcccagctctacttgctggatggatggaacttagagagttttatggactcactggaaatcatcaagtcaccttgacccactatggacaaagtattttcctcctcaccatcttcaaatgcagctctgaaccaaaagctttccctaaatggcactccttgtaccaccaagttcctaactcagtcacttttaaagtcctacttactaagtacaaagtgacttgcagcagtttggatgtgccgagtaccatgtactcatttatgaaagttgcaagattcactcatctaaacttggaagggacgaagtgtaaaatagtttataatcatcataggaagaccacaaaaattggaaatggacggaggacttttgcacaaacacataattttcttcctggaactcaaattatatttcagttcccagatgcaacttctaactttgttttattctggctttgtttgtaa

SEQ ID NO: 92807 - DNA, 339 bp, Glycine max
  Peptide Sequence Number=SeqID_209585
atggcaaagagacaaagaggtgcgaggaggggaacatgcaaggaggcgaaccgagaggaggcaaacagacaagaacgcgaggaagagttaatattcttcttcaatcaggatgaaataatcaattatctacttgagataatcgattatttagaagcctttgccgtttctaagaaatatgggcctcaagaaggaataggaacaaatgctaaagttgttttcaaagataaaggtattctagttgaagagctgaatcaacagccagagaatgatcgggaggggcccctagagggattgaaggctgaattagtggaacaatcagacgtctttggtaaaccatga

SEQ ID NO: 92808 - DNA, 309 bp, Glycine max
  Peptide Sequence Number=SeqID_209586
atggggtgtggcaaagcaacaataggcacaacaaaagctggaaggataggaaacaagcctagcttaggaaaaaatgcacttaagattttcaagaggtttgctaaggttgaagtttatattgtttcaatatatgtgttaatcgttgaccatgaagatgccaccgcactacgacagcaacttcaaggggcaaaggaatttgaacacattgatatacatgcatgtatgaagtatgacacatgggcaccatcaatgcactgctcgtggataattaaagattctaagccaccctttcactccagagatgcttga

SEQ ID NO: 92809 - DNA, 153 bp, Glycine max
  Peptide Sequence Number=SeqID_209587
atggttaaccaagaggagtcaattcatgagggtcatggtaaattcatgagtgtcttgctcaaattcatgagtgtcgtggtcatccaagagggccatagtcaatccataatggcccaaggcttcaacgtcactttcgaccatggatgtggtgga

SEQ ID NO: 92810 - DNA, 219 bp, Glycine max
  Peptide Sequence Number=SeqID_209588
atgcctcataaagctcctaagaagaccgttgaggtgggcttcactcaactaacaagcttttggagcaagcaggagtgtgctttcctctcctctcctatttctgtgggagctgagattgttgacataatttgcaaaaatttcatgttgaagcccttgagagatgaggtcattttgaggcccatctggaacatgcaaggtgattatcttcttgtgcaatga

SEQ ID NO: 92811 - DNA, 1395 bp, Glycine max
  Peptide Sequence Number=SeqID_209589
atgagaaatagaaaagtccaatcatctgcgatgagcgcaagaagccagggaacttcaagtgaagaagaagccaacctatgtatgatgcttgatgcgaccactagtaaagcagaaccaacactggatgcaagttcatatgatgaggactctcagcctgatgactttgtcaactctaatggtgaaaaggatatcaagaaagctcatcaagttcatttagttgattttgtcttggtaaccacttcgcctggtagtgtacaagatgcctctgcttgtgaggaagtcaaggcattactggatgaaaaggtatccaatggatacaaaaatcttcttaaggattttcaagacttggaggaaagagtaaaatccttaaccataactcttaaagattcaaaagaatggtgcaaggaaatgcttaattacttcaaaaagaatatgtcttttgatttgaaccgtaagcttaagggatgtgaggtcttaaaggaactacctcctgagattgtaaaactctatgaggagatagaaaccttgagagataaactaggaaaatttgttggaggtcatgaagcctttaataaaattattaaggtacaaagaaacctcaaagaaaaatctggccatggtttcaaaggcaaaaagattgtacatggtgaagaagtcactattttctctttctatggaaaaatgggtcatgagacttataaccctaagtctagtggggtggtcactttcagagggaaccagaatggtctgataactggtgtagtcaattatgtgaaagtggattcaacatcacctttaacaaggatatgtgtatcatccagaacaagaacgtcttttcactcttctaagctaataaacaaggaaatctgtatgagattaagtggtgacatgtcaagtcaaactgtgccatgcctactcttagtcaaagagcatcacttgatatggcataagaagcttagtcatgctagcttgagaactgatcacaagggaaagtttgaaaatgatctttatgagaaattttgtgaagagaatggtattcaccgtaaattttcgacttcaagaacaccacaacagaatggagttgttgaaaggaaaaatataactcttcaagaaatggcaagaacaatgcttaacgatcactcaacttccaaacacctttgggttgaagataaccttggaaagtttgactcgaaatgtgattctagaatcttacttggatactttgaatcgtccaaggcatatagagcgttcaattccaaaaccttgactattgaagaggctattgatgcaagatttaatgacaacaagcttgacactacaatgtcaaagctagatgagtcttttgcagagatgaaaatagaaaatattgtgaaatttgttgctatgtccagttaa

SEQ ID NO: 92812 - DNA, 738 bp, Glycine max
  Peptide Sequence Number=SeqID_209590
atggctataaattggaatgggaatcctactacctcttttgctccttctagagatatggaaacctttttctttggtggagagaatggggtccaaatttctcatctcttttttgtggatgacatgatcctagtagctgaagcgtcccaacaacaaggagttagtgataatcttgctacttccttaagtcagaatttgaatgttcctgttactaaggatctgcacttttatctcaggtttaagtccttcacaatagaaagacgagctactatgttccaatcttctttgctcagccttcctacttatgttcttgaagcaacccttattacgattgctattcgtaatgagattgaaaagctctgcagagactttatctcaggaagtaataatgctcgtttttggaaagatgcttggatccctggagtgtcttcccatgattcattattgccgaaacttttcctctggaaactcatgcatgctcgtcttctgacaaatgagcttagagtgacgaggcatataatggatgacagcctttgtcctagatgtaagtatcaagatgaatctattttgcataccattcgtgattgtgaagatgtgaagaaggggcaaaaccttaaggcccctgtgggtttctggtcttcattttttgggatcatgcccgaagcattcaagttcataaggatctccgttggtcctccttcaatctttgatgatggcagaaaggatgattttgcaatttag

SEQ ID NO: 92813 - DNA, 519 bp, Glycine max
  Peptide Sequence Number=SeqID_209591
atggatgattcaaataggccttggtttctaactgttgtttatgcgagtcctaaaacccatctcagatatttgacttcgaaggatttgtctaacatcagctctaccatgaatagtccttgggctgtggcaagtgattttaacaatatgatatttgagaaagagaagcaagaaagaggccctattaatactaactcgacggagcagttctgggagtgtattcagagagtttctaacttgaatattccttcttctgatcactatggactttggctctcaatttcagatgggattcaaaggcatcactcagaagaccatgatgtgcaggaaagtaggattgctctttctatgggaaattacaaaagtcttgggcctaatgggtttcacccagctttttccaagtctcaatgggagcatattgagaaatctgtgtttgagttcatcacgcatgttaggaataatccagccaacattgctattgttaatcagacccttttagctcttattcctgagactaactaa

SEQ ID NO: 92814 - DNA, 267 bp, Glycine max
  Peptide Sequence Number=SeqID_209592
atgactcaccttacaagtaagctctccttggaagccaccagcaacaagaagatttgcaacgaaagaggggctagggttctgataaaacgaaacgaaagaagaataaaagagaagcaagcacagggttcgatttgcaacgaaagaggggctagggttcgatatgcaatgaaaagagaagcaagcacagagaaagaggggctaggagctgagtgcttcgaacttaaacccgtgggcgcttatgagtacttcgaacacgtgcctgcctaa

SEQ ID NO: 92815 - DNA, 522 bp, Glycine max
  Peptide Sequence Number=SeqID_209593
atggtccgcaccaagaaagttgggcagatgacgtcagaggtagcaaaggaaatcgctgagaatattatgcagtctcagtttcagtcacagatgcaatcacagggacttgcactacctctagagcctgaggttggtccctcagttgctcgtgtcagcacaaaggagagttgtgttgatcccttagggaacgatccacagacgggtgactcagacaaatgcgggctgtacatcgaagataatccttcccgcctggttgccctaggaagagtttatgagggatccacaatgattcacaacatccctttgttgcatggccaagtgaaggttgttgttgaagagattaaagatgcagatactcccgttcctgtacccactgacgagattattttagtggggcagacacttaacaccttccttgcttggccgacacatctcgtgaagcctttatcagaacatgaagttgtgtctccagcaaagcctccagataggccggatcctgaaatggcgatcccctatatctga

SEQ ID NO: 92816 - DNA, 237 bp, Glycine max
  Peptide Sequence Number=SeqID_209594
atgattcacaacatccctttgttgcatggccaagtgaaggttgttgttgaagagattaaagatgcagatactcccgttcctgtacccactgacgagattattttagtggggcagacacttaacaccttccttgcttggccgacacatctcgtgaagcctttatcagaacatgaagttgtgtctccagcaaagcctccagataggccggatcctgaaatggcgatcccctatatctga

SEQ ID NO: 92817 - DNA, 318 bp, Glycine max
  Peptide Sequence Number=SeqID_209595
atggctagaaaatcagataagcaaactaaattacctaaatgtcctcccatatcaaatccttctgagcagcagggacttccttctaggtctcccttcccggtggcaggatcgacgtggaccactggtctctctgccccaggtggtctagtggccaaggatcatagctgtgtggctttgcgtgtccgcttcaacgtagacagagatgctgatgctactgcaggaggaggaggtgaggcaggtggagtagctaggggagaagagctgaagaaggcaattggtaatatcgtgtacatagaatgcaactcaaacactcaatag

SEQ ID NO: 92818 - DNA, 204 bp, Glycine max
  Peptide Sequence Number=SeqID_209596
atggaggcagtaatggtgggtcttgaaggagatgcactttcatgggagaaaagggaatcgcacgaagacagtacaaatggaggcttcgatcacttctcaatctctctaatgtttggaagccctatcagagcaatcagagaaaaaaaattgaggaatctcaagaacttgctagagattccgctatcactttcagaagacacgtga

SEQ ID NO: 92819 - DNA, 333 bp, Glycine max
  Peptide Sequence Number=SeqID_209597
atgggagcagtttgggataacacatattgttctaccaattctgcggagaaaagaatgaaatggatatttggaaggctaaagagcaagagattgccttcaattaaagctcccctacccttaaaaggaacaacactaagtgaggcagagcaacaacagagcaaccatgctttaatagtgggcattgcctcagcagcagttgttgaagctgttgattcaagatttgtagcaggcttgagcacaattgactttccagcaatgagcgcaggagcacttttggaaacaacaatgagcgcaggatcaagaatggctaaaatcactcctagtggaatctga

SEQ ID NO: 92820 - DNA, 327 bp, Glycine max
  Peptide Sequence Number=SeqID_209598
atgtaccacaacaagaagaaaaatttgtggtttttggatagtggtttcttctggcatatgatcagagacaaaaacaaattccttagccttgaaaagataaaggatgaagggtatattgccttcggagatgatagagatcaaggaaggccttcaagaagagaagaaagacctaagaggaagaatcccttaattggactaaaagaacttgagaaaggaagatctctaaaggatgaccccaaggttggcctagaaataccaaagagtgcaagagtaaagagaccgaaggagaatttagaggttatcaacacattacatggtaaagcctaa

SEQ ID NO: 92821 - DNA, 663 bp, Glycine max
  Peptide Sequence Number=SeqID_209599
atggctgtcgttgctaatgttttggccaagttgaggactacaaattccaacttggaaaaggaaacaactgagaaagaagaatctgctaagaaggcagaaaagcttgaagtttttgtagaaactgctcaatatgcactagaagttgtagctggtgaaagaacctctattgtgtttgtgaaggattctttgtttgacatgaaaaatatgcagaatctcttcaattctcccatctttgacttttctattaaaattgtctatggccttagtcccttacatggtgaaccctcaaccttttccattccctttccccaatttccttctcattcatctactattgaaccttctaaggttcaagaggaggttccacatgttcgcattcgctctcctccacctattgttaaacctccttcaaggactatgaatgagttatttgagaggttccatcgtcttaaagagtggatctttgacaaggccagacttggcttgatccatgcagttgcccctatgcagcatgagccttcaccaccaccaagagctaccaccatgcctttatctttcgaaaagttctctcttaaaaagcatgattggtctatacccttcgttcctccctttggttttttgcttgacaacaaatggagagaagattacaagagattggtgtag

SEQ ID NO: 92822 - DNA, 255 bp, Glycine max
  Peptide Sequence Number=SeqID_209600
atggattacgcaatcatcccttctttggcttccgtaatgttacggagctttacggattgcgcattaacacttccttttaactcccgacgtgtcacggaacttcacggattgtctaataatgggtgtcaagtacctcaaagtggtcaagcgagggtcgcatcccaacaaacagatggtccctggacgaaattagggtatgacacttggcttatcactttccttgagtatgataaccaactcaaggacgatccataa

SEQ ID NO: 92823 - DNA, 192 bp, Glycine max
  Peptide Sequence Number=SeqID_209601
tttggcggtgaggtcgccgtcggagatggtgatctcggtggcgatgagggaggaggagcccggggcgcgggattgggcgcgcttgcagaatggggcttggtggcagaggaaaaagatcaaaggcagcgtttcgttcctcatcttctcactgtggttgctgcagttgttgacttaggaccatatacccattga

SEQ ID NO: 92824 - DNA, 522 bp, Glycine max
  Peptide Sequence Number=SeqID_209602
atggatgatgtttctcattttgcagatagtaaaggtgatagcttgccaaccgaaggtgtagaaattgcacacttcagtctggaacaagcacactacatgatatatacaccatccgatccccttctttttgttgctgtgaaggatcagaatggggtgttgcaaattgctgacgatgaactgcttgaggatccggctatcactagcgctatagatgaagagactgagtttaatgccttggtggtatgtggttttagtctttcaaagaggaagaagctgcgctccttgattcactcttgggtaaaagataaccccatatttacttttttgcagcagagctgtcccagctcccaagacccaccgatgttttgcttttacgtgtttgtttgcatgttgaagaaagaagctactttttgtaacttcttccttaacgcagatcaaaagttaccaaacatgaagttagtatttttcctctggaatgtcccgtcttggtctgtctgcatatcaacaagtatctggggatag

SEQ ID NO: 92825 - DNA, 192 bp, Glycine max
  Peptide Sequence Number=SeqID_209603
atgattatatacacgaacgctcgaatcgccagacaaaatgtgcatgtgccattgaaacttgtggtgaacaaagagacaaacaaagtcttatttgctgaaacagggaaggactttgtggatgtgttgtttagcttcttgatactgcctttaggaaccattgcaaggcttgttgagaaaaagagtctaacatag

SEQ ID NO: 92826 - DNA, 2257 bp, Glycine max
  Peptide Sequence Number=SeqID_209604
tcccctccaccaagctctggctcccccgagtttctccgaaaaaaacggcgcctactcctccgtctacctctccgacggccactccgccgtcctccgccacgaccccttcgagctcttcgtccgcgacgactcctccggcgaccgcgtcatctccctcaactcccatggcctcttcgacttcgagcagctcaaacacaaatccgaagacgataactgggaagaacaattccgctcccacaccgaccgtagaccctacggcccccaatccgtatccttcgacgtatctttctacggcgccgattacgtatacggcatccctgaacgggccgccagcctcgccctaaagcccaccagaggcccaaacgtcgacgaatcggaaccctaccgtctcttcaacttggacgtctttgagtacattcacgattccccttttggcctctacggttcaattcccttcatggtttctcacgggaaaaccaggggtagttccgggtttttctggctcaacgccgcggagatgcagattgacgttcttgcccctggctgggacgccgagtctggcattgtgcttccttctcatagaatcgacacgttttggatgagcgaagctggtgttgtggatgccttctttttcatcggtccaaaccctaaggatgtgttgatgcagtacacggcggtgacgggaactccggcaatgccacagctgttttcgattgcttaccaccagtgccggtggaattaccgcgatgaggaggatgttgagcatgtggattccaagtttgatgagttggatattccttatgatgtgttgtggcttgacattgagcacactgatggaaagaggtattttacttgggatagggctcttttcccgcaccctgaggagatgcagaggaagttggcttctaaagggaggcacatggtgactattgtggatcctcacattaagagagatgacaattttcatttgcacaaggaagcgtcgcagaaggggtattatgttaaggatgccagtgggaatgactttgatggctggtgctggccaggttcttcgtcgtatccggatactttgaacccagaaattatgtcctggtgggctgataagtctgcttaccagaattatgagggttcaacgccttcgctttacatatggaatgacatgaatgaaccttccgtcttcaatgggccagaggtgacaatgcctagagatgttatacactatggaggcgtggaacatcgggagttgcacaatgcctatggatattacttccacatggcgacagctaatgggctactgaagcggggtgaggggaatgacaggccatttgttttatcaagagcattatttgctggaagtcaaaggtatggagcagtatggactggggataacactgctgattgggatcacctaagagtttctatcccaatggttttgacccttggtcttactgggatgccattctctggtggagaacgaaatacagaattgattaaggatgcaatacatgttcgttatgcacttctcccgtatttctacacattattcagggaggctaacactactggtgttcccgtggtccgtccattgtggatggaattcccatctgatgaagctacttttagcaatgatgaagctttcatggttgggagcagtcttttagtgcaagggatctatactgagcgagctaagcatgcatcggtccatttgcctggaaaagaatcctggtatgacctaagaactggaactgtgtacaaaggaggggtgacacataagttggaggttacagaggagagcattcccgctttccagagagctggaaccattattgcaaggaaagaccggtttcgacaaagttccactcagatggcaaatgatccctatactctggttatagctttgaatagttcccaagaagctgagggtgaactctacattgatgatggcagcagctttaattttctgcaagggggctatatccatagacgatttattttctcgaatgggaaacttacttctatagacctggcacctgcttccggtagcaaggggcgttatccatcagatgctttcattgagaggattatcctgctgggacatgctcctggctcaaaaaatgcactcgttgagccatcaaatcaaaaggttgatattgaacttcgtcccctttgggttctaagagctcattcaccagctgtcacgaccatacgtagacctaatgtttgggttgcagaagactggactataacagttatataa

SEQ ID NO: 92827 - DNA, 122 bp, Glycine max
  Peptide Sequence Number=SeqID_209605
atgattagtagtaaggtcaactatttgaagattagacaaagcagtgaaattaagaccaaggtggaaggcaagggtccaaaaaatgaattgggatgcgcttctaattcttctagctgcaaaag

SEQ ID NO: 92828 - DNA, 1077 bp, Glycine max
  Peptide Sequence Number=SeqID_209606
atgagaaaatcagttaaggtggtttggcatgtacaaagaaggccacaagagattcctgcagagataagcaaatcaaatggaaacaatttacttgtcgatgataaatccaaatacaaatcaatgtggatccgtgcatactcatctctgtggatgctagcgagtgtctcactaatcatatacttgggtcatctttacatctgggccatggttgtggttatccaaatatttatggccagtgagctcttcaatctacttagaagagcatctcaagataaacgtctccctaagtttaagctcttgaactggcattatttcttcacagcaatgctattcgtatatggccgtattctcagtcaacaacttgtgaatactgtgacttcagataaactcttgtatagatttgtgagcaacctgatcaagtatcagatggttatatgctactttttatatattgcaggttttgtatggtttattctttcattgaagaagagatattacaagtatcagtttggccagtatgcatggacacatatgatacttattgttgtgtttacccagtctgcgttcactgtagccaacatatttgtagggatattctggtttcttttccctgcaatcctcattgctatgaatgatgttggtgcatatttcttcggtttctattttgggagaacacctctgatcaagctttctccaaagaaaacatgggaaggtttcattggagcgtctgttgccactatgattgctgcatttacgtttgcaaacttcttgggtcgcttccagtggctaacatgtccaaggaaggatttatcaactggttggcttcagtgtgaccctgacccaatttttaagccagattacattccattgccaggattgatttctcattggcttccttggaaagagatagcagttttgccagtacagtggcatgccttgtggatgggactatttgcgtcaataatagcaccatttggaggtttttttgctagtggcttcaaaagagcttttaaaatcaaagactttggtgatagtatacctggacatggtggatttacagacagaatggactgccag

SEQ ID NO: 92829 - DNA, 249 bp, Glycine max
  Peptide Sequence Number=SeqID_209607
atggcgagtaccaaagttcagaggaaagcgcgcattcagatttggctttttgagcagaaggatttgaggattgaaggccgaatcatcggttttgatgaatacatgaatttggttcttgatgatgctgaagaagtgaacgtcaagaagaaaagcagaaagacattagggaggatccttcttaaaggagacaacataaccttgatgatgaacacgttttgcataaggcaaatgcctattatgcagatgtga

SEQ ID NO: 92830 - DNA, 1974 bp, Glycine max
  Peptide Sequence Number=SeqID_209608
atggtaaagcagatgtggccagatttgatagcgaaagcaaaacaaggaggactagatgtgattcagacctatgtgttttggaatttacacgagccccaacccggaatgtatgatttcagcggtagatatgacttggtgggattcataaaggaaatccaagctcaagggctgtatgtttgcctcaggattggacctttcatcgagagtgaatggacatacgggggattccctttctggttacatgatgtacctggcattgtctaccggacggataatgaaccattcaagttctacatgcaaaattttacaacaaaaattgtgaacatgatgaaagaagagggactatatgcttcgcaaggaggcccaattatattgtcacagattgaaaatgaataccaaaacatccaaaaggcatttggcacagcaggatcacagtatgttcaatgggctgcaaaaatggcagtgggccttgacactggcgtaccatggattatgtgcaagcaaactgacgctcctgatcctgtgatcaacacatgcaatggcatgagatgcggagaaacttttaccggaccgaattcccccaataaacctgcattgtggactgagaactggacatctttctatcaagtgtatggtggactgccatacataaggtctgctgaagatattgcatttcatgtcaccctttttattgcaagaaatggaagctatgtcaattattacatgtaccatggaggaaccaactttgggagaacgggctcagcttatgttataacaggctattatgatcaagccccacttgatgaatatggtttgcttaggcaaccaaagtggggacatctcaagcagttacatgaagtaattaaatcttgctctaccacattattacaaggagtacagaggaacttcactttaggtcaacttctcgaagtttatgtctttgaagaagaaaaaggagaatgtgttgcattccttataaacaatgatagagataataaggctactgtgcaattccgcaacagctcatatgaattgctccccaagtccataagcatcttaccagattgtcaaaatgtgactttcagcactgcaaatgtaaatacaacaagcaacagaaggatcataagtccaaaacaaaactttagctcagtggatgattggcaacaattccaagatgtcatttcaaactttgataatacctcattaaaatcggattcattacttgagcaaatgaatacaaccaaagataaatcagattacctttggtatactcttagcaaaccaacacttagtgttcagtctgctgctcatgttgcccatgcttttgtgaacaacacatacataggaggggaacatggaaatcatgatgtgaaatcattcaccttagagctcccggttacagtaaatcaagggacaaacaacctttctatactcagcgttatggttggacttccggattcaggggcatttctcgaaagaaggttcgctggtttaatcagtgtggaacttcagtgcagcgaacaagagtctcttaatttgaccaattctacgtggggttatcaggttggattaatgggggagcaattacaagtatataaagagcaaaataacagtgatactggatggagtcaactggggaatgttatggaacaaacgcttttttggtacaagactacatttgacacaccagagggagatgaccctgttgttttggaccttagctcaatgggaaaaggtgaggcttgggtaaatggagaaagcattggtcgctattggatcttgtttcatgattccaaaggcaacccttcacaatcactgtatcacgtgcctcggtctttccttaaagactctggaaacgttttggttttgctagaggaaggtggtgggaaccctcttggtatctccttggacactgtttcagtcacagatttacagcaaaacttttctaaattatcattaccctcttctgcttag

SEQ ID NO: 92831 - DNA, 1917 bp, Glycine max
  Peptide Sequence Number=SeqID_209609
atgtatcatggaggaacaaattttgggcgtacagcaggtggtccattcattactacaagttatgactatgatgccccagtggatgagtatgggttacctagacttcctaaatggggacatcttaaggaacttcacagagctatcaagttatgtgagcacgtattgcttaatggtaaatcagttaatatctcccttggtccttctgtggaggctgatgtctatactgactcatcaggagcatgtgctgcctttatttctaacgttgatgataaaaatgataagactgtggaatttcgaaatgcatcatttcacttgccagcttggtcggttagcattcttcctgattgcaagaatgtagtattcaacacagctaaggttacttcccagacaagtgtagttgcaatggttcccgagagtttgcagcaatcagataaagttgtaaattcttttaaatgggacatagtgaaggagaagccaggaatctgggggaaggcagactttgtcaaaaatggttttgttgatctcatcaatactaccaaagataccactgactacctgtggcatacaacaagattattttctgttttttgtacgctttctgtggattgtcatgtagaagaactagagaatgtgaataatactgtatggcagcttccaattgaaaaaaccatggatagttcacagcatacaacttatttggactactattatgaaatagttagcaatctaagagattcaaacagagctcaattttctgttgatggcagtatatttgtaagtgaaaatgaagagttcttaaagaagggaaacaaaccagttcttctaattgaatccacgggtcatgctctccatgcttttgtgaatcaggaatatgaaggtactggttctggaaatggtacacatgcaccattcacttttaagaatcccatctccctcagggcagggaaaaatgaaattgctttgctatgcttgaccgttggcttacagacagctggaccattttatgacttcgtaggggcaggactaactagtgtgaagatcaagggactgaacaatgggacaatagacttgtcttcttatgcctggacttacaagacccttgatggtggtattaagcatggaaatttatattatttttctcagattggagtccaaggagaatatctaaggttataccagggaaatgggttgaataatgtgaactggacatctacttcagaaccaccaaaaatgcagccattgacatggtacaaggctattgtagatgctccacctggggatgagccagttggattggatatgttgcatatgggaaagggtctagcctggttaaatggagaagaaataggaagatattggcctaggaaaagtgaattcaagagtgaagattgtgtgaaagaatgtgattacagaggcaaattcaatcctgacaaatgtgacactggttgtggagaacctacacagagatggtaccatgttccacgatcttggttcaagccatctggaaatattcttgttctttttgaggagaaaggtggagatccagaaaagatcaagtttgtgagacgtaaagtatctggagcttgtgcccttgttgctgaggattacccctctgttgcactcgtttctcagggtgaagataaaatacagagtaacaaaaacattccttttgcccgtttggcatgccccggtaacactcgtatatctgctgtgaagtttgctagctttggaagcccatctgggacatgtggatcttacctcaagggagattgccatgatcccaattctagcacaattgttgagaaggcgtgcctaaacaaaaacgactgtgtcataaaattaactgaagagaatttcaaaagcaacttgtgtcctggtttatcaaggaaacttgcagtggaagcagtctgtagttga

SEQ ID NO: 92832 - DNA, 114 bp, Glycine max
  Peptide Sequence Number=SeqID_209610
atgcacagaaagttagtttttcaaaacccttatgtagggagcccatccatccaacacggacactatgaaaacgacttggataagcctgctatgatagaggtacaaagtcaatga

SEQ ID NO: 92833 - DNA, 801 bp, Glycine max
  Peptide Sequence Number=SeqID_209611
atggggtgtacccatgggcccgaaatctaccctaaggctcataagaaccctagggccttctcttgcatctttggcccaatctacttggagttttctatccaatgcccttgcggggtaggattgcatcaggttgttagtcagaggccagaatttgagctggttgtttctagggcagggacatctttggatggtaaacaaaacccctgggagtgctacgtgggatcttgcgtcaaggagccatcaactttggaagacgctggtacagagcatagaagagcaaggtttggatcctatggtggagttgaattggaaacagtctggactaatgctgagtcagacatgctaaaagggagggttaactactatactaacaggagttttgcatcaaaaggaagatatacagaattttatgatgacccagtgaaatgtttcatcaggtcaaatagcaatggagaggtcaaagttgttcagacttccaagaacacaatacacagcaagaaagcagttatagttgcagctggttgttggactggttctttgatacatgacttgtttagaaattcgggaatggatttacatgttccagtaatgcccagagagttttgccgaaaatgttttatagaatctattggcggtagctacactaatacctttgctaatcaggttatcattgaggaatgctttggtgtttgcgttaattggggctgtggaagcaatgactccaagattattctgatgatgccaaagaatcaggagtcaaaaagcttcaagaatcaagtttcaaagaatcaagattcatga

SEQ ID NO: 92834 - DNA, 321 bp, Glycine max
  Peptide Sequence Number=SeqID_209612
atgctactccctaaccgacggctatcgcttaatgctcatcaaaatggaaacaggtccacatcaaaagatggaaaaagggaaaacagactatctgctcccgtgaattatgtggccatatcaaaagaagatgctgcttctcatgtttctgtaaacgtccctggggttccatccttggggagttaccacagaggaaaaatatgttccatgaaatattacccttggcaagcacatcatgttattcctagatttaccttttcatcccaaaaagagaacttccttcgaagtttggatcaactggttacttccatccttgagctgtaa

SEQ ID NO: 92835 - DNA, 2688 bp, Glycine max
  Peptide Sequence Number=SeqID_209613
atggagctacgctgttgtggtcatcttcatttcatccaggctattaaaggtgatttagttacaaaagccccaaatgttgttcgtggacaaccaaaacttaaatttaaaaagctcactgacatttatgatggcttattgtctcataatgatgatggaatggctgaaagatcatgcttgggtgaaattgaggaaagccctgtgaaaaccaagcctgatgcttccatatgtaatgtcaatgatgatgatgatcagagaatcattaacttggatgatgacaactttgacaattttaccttaagccaaattaaagcaagttgcaaaacaaggaagcgaaaacactcacaaggtcttgactcctctaaaataaacatgaaagttgaagattcgtcattcctggaggactacagagaggagcaaagggcagcagatgattctgatttcctgcagactctcagtagcttgaaatctaaactatcaaagaatatgaagacgaagaagaaaaagtgctttgaagaaccaagccctactgatacccaagagattatgctagtcatcaaatctgaacctgaagagatcctaaacaatcaagagttcccaccctctagcgaagagatcctagactatcatgagttctcaccttctagccaagagatccaagactgtcaagagttctcaccctcctgtgaagagatccaagacggtcaagagttcccacccactagtgaagagataaaaattgatcaagagatcccattctttagtggagattcagttgcccttgttgaagtgaaatctgaggttcctgaagctgattgctatggcgagccagatgactattgtattatagaaagccaagaagcagagataatctatgaatggaatttggagaatgaattagatgagtggcaggagcgtgttgattttattccattacgaatggtgaggccatcttgtatggatattgtgataagtaattatcaactaagcaatgaccagtctccatacatgcctgcaatagaatttgaaagtgaagaatgcatcatcaatccagatctccattacatctccccacaaggaatctctctggttgaagatcataactctgatattcatgacaatcaacccgatggtgacactgacactgctgtctcattacctaatgtggttactcataaagaccttgattgccttggtgtagagtttaaagatgataatattatcctcgatgactgcagtagtaatgaatttacaactggtgctgaggatcaggtagaatgtagctctactatggaacatgactgcagtaatgatgaatttacagctggcaatgaggatctggtagaacccagctctactattgaacatgactgcagtaatgatgaatttacagctggtaacgaggatcaggtagaacccagctctactattgaacacaacagcagtaatgatgaattttcagctggttctgaggatcaggtagaacccagctctactattgaacatgactgcactaacgatgaatttacagctggtaacgaggatcaggtagaagccagctctactattgaacacgacagcagtaatgatgaattttcagctggttctgaggatcaggtagaacccagctctactattgaacatgactgtattgatgaatttacaactggttctgaggataaggttgaactcagctctactattgaacatggccccaatcctgatgaatgtctggtttgtcactcagatgatccacctgaatatgaggagaagcaatcatttgcttctgtaaacattgctgagaagagacatgtcaatgtggctactgatgaacttacttcttgggatgaatgtgatggtagttcaaagctgcatcattctgaaaggctattatcaacaagaaagatggtttcacttcaggcgatttcaccatcttcagaggaaaggctctgtaaagctgtggagtcggttaatttgaatcataaaaacaatttgactttattttttcaaactataaactcaacaatcctggaaagaaatatggattttgttgaaagagaatgcaaggaaaaactatacttttctgagaagactgataagatgaatagtactgctgaagggcttgatgatatcacaggagctcgactaactgatatctttaacaaaattagtgttattcctaggagtaaaagagtttcccaacctagaggcatttccaagaatgctcattcttctcgccaagcaacccgcatagggtgcaactctgtacagagttgctcaaagagtgcaattgcatttacacagcagcagatgcatgatgcagaatgccttgctatgagactcacgaaggaattgaagtcaatgaaggacattgtggatgatatgttacgatctgaattctgtctaaatacgtctttgagacataaagtaaatgaggcaagaatggctgtcaagaatgccacaagagctgaagaagctacaaaacgatgcctggccttcatgtcaagggattgcagccgtttctgtaaaataatgaaatttgctgatgatagtccatctcctcaaaaacctcctccagatgtagtgcgtaaagagaggaaaaaaatagccttcgctgatgaagcaggtggaaagttgttccaggttaagttctatgaggatgacgcagtatctttgtccaaatctaattga

SEQ ID NO: 92836 - DNA, 480 bp, Glycine max
  Peptide Sequence Number=SeqID_209614
atgaaaaaatcaataattgcgaaaacccctaacccccaatccaaaaatcaaaacatcaaaatcaaaaggaaaacaaacaagataactaactcgaatgagatcggagagagtgacctgttcttcacgaaattgacggtcacgggcgatccaacttcttcttcttcttcttctaaatcttcttctcgacggtcatggacggagacttggtgttcatcttgggcgatattgaaagaatatcgtggacttcacgagggagtcacggttggagagcttgacgaggacagccatggcaatgagaacatcgacagccttgatggcagccttgtggagggcgtcagtgacgatggtggggtggatgtcgtgggagaggaggtggaggcactgcttgaggagggcgccgatgatgacgatgacggtggtggtgctgtcgccggcagcggagtcctgggacttggagagctcgacaagcatcttggatga

SEQ ID NO: 92837 - DNA, 144 bp, Glycine max
  Peptide Sequence Number=SeqID_209615
atgcaatcaacaacagcacggttgacacacttgtggagtttctcgggaggttccttcaacaggaaatctgttctttttggcatccattgccaccttttaaatggctgcatatctgagaacatagctaccgggttctggagttag

SEQ ID NO: 92838 - DNA, 183 bp, Glycine max
  Peptide Sequence Number=SeqID_209616
atggcagtagcaagacacggttctgctagattgattgacgacacagttgacacgcggcagaggcacaatatattttgccattctcaacctggcggaaccgtgcctcgctactgccattggcgagttcgccatgtgtcgcgtcccgaccgtgtttcgtcagtctcattggcggaatgccgttaa

SEQ ID NO: 92839 - DNA, 1464 bp, Glycine max
  Peptide Sequence Number=SeqID_209617
atggcgaacgagaacgaacccgcgaagctgctgttaccataccttcaacgcgccgatgagttgcaaaagcacgaaccactcgtcgcttattactgtcgattatatgctatggaacgggggctgaagattccgcaaagtgagcgcacgaagaccactaatgctcttctggtttcgctcatgaagcagcttgaaaaggataaaaagtcaatccagttggggcctgaagacaatttatatctcgagggatttgctttgaatgtgtttggaaaagcagacaagcaagatcgtgccggaagagcagatttgaatacagcgaaaacattttatgctgccagcatcttttttgagattcttaatcaatttggagcagttcagcctgatctggagcagaaacagaaatatgcagtgtggaaagcagctgaaataagaaaagccttgaaagaaggaaggaagcccactgctggaccccctgacggtgatgaggacctctcagttcctttgagttcttcaagtgatagatatgaccttgggaccaccgaaactactgtttccagtcctggaccagaatctgattcatcacatagttatcatagccctgtcaactaccagaatctgccaagcattcagcctactcctaaatttcatgatactgttaacgaccaacattctgcagatattccaccatctatgccttttcatgacagagtagataataacaagcattcttccgttgtttctccatcatctcactcttacacacttggagtttatccttcccaagattatcattctcctccaccttcccaagactatcatcctcctccaccttcccaagattatcattctcctccaccttcccaagactatcaccatcctccaccttcccaagactatcatcatcctccaccttcccaagattatcatcctcctccaccttcccaagattaccatcctgctccaccttcccaagattaccatcctccacctgctagatcagaaagttcttatcccgagccctacaaccatcagcaatactcaccagagaattcacagcatttaggtcctaattacccttctcatgaaacttcctctttttcttatccccattttcagtcttatccaagttttacagaaagcagccttccctcagtcccatccaattatacttattatcaagggtcagatgcttcatattcttcccagtcggctccgctaactacaaaccattcatcaagtgctcaacacagttcaggcagcagaaatggaactgtcgtggaacctaagccaactactcagacataccagtatgacagtagctaccaaccagcacctgaaaaaatagcagaagcacacaaggctgcaagatttgctgttggggcactggcatttgatgatgtctcaattgcagtagactacttgaagaaatcccttgagttgttgacaaatccatcagctggtcagtaa

SEQ ID NO: 92840 - DNA, 561 bp, Glycine max
  Peptide Sequence Number=SeqID_209618
atgggaagtaacttttcattctgttgttctgaggcttattttcggagtcaaagattacctaaggaggactcaggttttgtaaaggccagttcagtagtatggattgccaaaaatatcaagcaaacttactttcttaggaagaaggggatgcaaaagaagaagaataaagaggagcagcatcagaaaaaggggaaggagcttacattagaggagtggcttctaaaatcaccaattatggaaaagcatggtaactgcaacggtgatcattgtgatttaaagcatggctctaactgtgattatccctcggtagctagagaaagtgtctatttttctgaatggggggaatatagtttgtctttggaccaactctcaaatggtgatgattattcagatttgaaagatgaaaagtttgatataaaagaaatggggtttaatccattgactagaagccaaagtagtaaggtgaagaaaagggtgagctttagactgccagaagtgtcggagactatcattttgtatccattagagatggattttaatgagtgccagtgcattaattag

SEQ ID NO: 92841 - DNA, 1149 bp, Glycine max
  Peptide Sequence Number=SeqID_209619
atgaagtcatggaagttgggatttttggttctgctagttttgttcagcacctctacttgttctgcttggtttggtagtaaacacaaaagttccagtggaaggagctcctttcatccagatgaggcttcatcgtcgtcctcgtcgtcgtcaccatacatactaaaccgttttcgtgctggctcatccgtcgtgttcccggttcacggcaatgtttacccagttgggttttataatgttactctcaacatcggccaaccacccaggccatattttctagatattgacacgggtagcgacctcacctggcttcaatgtgatgccccttgttcccgttgctctcagacaccacatccactatacagaccaagcaatgactttgtgccctgcaggcattccctctgtgcatccttgcaccacagtgataactacgactgtgaagtcccacatcagtgtgactacgaagttcagtatgcagatcattactcatccctcggtgtacttctccatgatgtctacaccctcaactttacaaacggagtccaactcaaagttcgtatggcacttggatgtggatatgatcagatttttccagatccttctcaccacccactagatggaatgcttggccttggcaggggaaaaaccagcttgacatcacagctgaatagtcagggtttggtgcgaaatgtgattgggcactgcttgagtgcacaaggaggagggtatatcttctttggagatgtttatgattcttctagactaacttggactccaatgtcatccagagattacaaacattactcagcagctggggcagctgagcttctttttggagggaagaagagtgggattggaagtcttcatgctgtttttgacactgggagttcttacacctatttcaacccatatgcttaccaagcactaatttcttggttggggaaggaatcaggtggaaaacccctaaaagaagcacatgatgatcaaactctccctctctgttggcgtggtagaagacctttcagaagcatatatgaagtaagaaaatacttcaagccaatcgtgcttagtttcaccagcaatgggagaagtaaagctcaatttgaaatgcctcctgaagcatatctgataatatcagtgagttccacctaa

SEQ ID NO: 92842 - DNA, 583 bp, Glycine max
  Peptide Sequence Number=SeqID_209620
tgtagaggacaagaggtcaagtgcatataacaaaggaagggtgtttatccatggggctggtgagagcacagcaaatgcctacaagaaacaattccaaacagacttggcaggctttctgagggcaagaacttcagtggaccccacagaccaaggtggggctggccttctttttgggacccattttcaggatgcttgggatgatcttgtccaagagggattgattagccaagaaaaacgagacgattttaacattccagtctatgcagcaagcctgcaagacttcaaggaggtggttgaggctaatggttcatttgccatagacaagcttgaggtattcaaaggaggaagtccacttgtggtgaaccaaccagatgatgcaagtgaagtaggaagggctctagccaacagctgcaggactgtgtctggagtccttgttgatgcccacattggtgacaaactaagtgaggaactttttctaagagtggaacgtcgagccactagtcatgccaaagaactattagagcaactacagttctttcacatagttgcatcactttcttttgctcaaatgattagagactga

SEQ ID NO: 92843 - DNA, 237 bp, Glycine max
  Peptide Sequence Number=SeqID_209621
atgcatggcgccaccaccattagcgctttcgtcagggacgtgccacgtggcgctggtgtcgccattcctaccagcgccttcccttttggcgacatggcgttgaagacgccagcatcaatggcgagttgttcatggcgccagtcaaactggcaacttacgtgtaggtgcagctttttagctattgcagggagagcaacagcagtgagtgagaagcgcaattacggttggcgacaataa

SEQ ID NO: 92844 - DNA, 207 bp, Glycine max
  Peptide Sequence Number=SeqID_209622
atgaattcggttataacagtgttgtatttcaatggaagggtatatgaagataatgatggtgcaatatttgaaagcagtaaaaaagagattcagattaaacgtggaattagtttcaatgctttgaagaaaaaaattggagataaggaaaatatattgccttgcaaatttgtgatgacgaagacgttgaaacaatgctggaaagtttaa

SEQ ID NO: 92845 - DNA, 888 bp, Glycine max
  Peptide Sequence Number=SeqID_209623
atgtcaggacctgagtgttgctcaaactcaccagttctgaacccgaatgcaggagctggccacgttgaaaaactcgctgctctcgattcctatctctctggttcccctaattccattgccattcttctcgtctccgacgtttttggatatgaagcaccaaatttaagagaaataatcaaagaacatctatttcaacatattttgataaattatgccgccaatagaatttggatgtttcattctgctctctttgccaattctctctttctccatttctgtgatgccaaatgtagtatacccctgggaagtaatactgtttcttctctgatgttaaggaacattgcagacaaggttgcagctgctgggtattatgtggttgttcctgactttttctatggtgatccctataatcctgagaatgctagcaggcctttatctgtttggttgaaagatcatggcacggacaaaggatcagaagctgcaaaatccataattgaagctttgaaaagtaaaggtgtgacagctattggggctgctggattttgttgggggggtaaagtcgtggttgaacttgcaaaatccagactaatccaagctgatgtgctattacatccagcatttgtctctgtggatgatatcaagggtgttgatattccaacagctgtgcttggagctgagattgacaaaatgtcacctccagagcttgtaaaacagtttgaacaagtcctaactgctaaacctggggttgttgattgttttgttaaaatatttcctaaagtttcacacggttggactgttagatacaaccctgaagatgcagaagctgtaaaggctgcagaggaggcccatcaggacatgctaaactggtttgctaaacatcttaagtag

SEQ ID NO: 92846 - DNA, 213 bp, Glycine max
  Peptide Sequence Number=SeqID_209624
atggagttcgtctttgtggagttcgtctctgccacttatcgattgagctcgaagaaaactaggaaaggaaagagtctcgaaaagggtgggaatcgattttggaagtccattgtggttggctttaagactcccagggaagccatcgaaggtgatttcttcgtcttctttagtcgctatcaagctcatgaagttatagaccttgcaaaatcataa

SEQ ID NO: 92847 - DNA, 921 bp, Glycine max
  Peptide Sequence Number=SeqID_209625
atggaaaaagaaatatttctagatattgtttgtttctttttaagtggtcaattccaggattatgaccggcggtctatacctcctgagaaaattctaggctatcggggattttatcccaaaattggtatgaaagttctagttgaaaaatcactcataagttttgatcgttatagtaatattcaaatgcatgacttgttgaaagagttgggcaagattattgtccgagaaaaggcacccaagcaacctagaaagtggagcaggttatgggactacaaggatctccaaaaagttatgatagaaaataaggaggccaaaaatcttgaagccatatgtatttgtaatgaaaaataccaagatgagtttctacaacaaacaatgaaagtagatgctctatcaaaaatgattcatcttaagttactcatgcttaagaatgtgaatttttcaggaattctcaattatctttctaatgaattgagatatttatactgggataactatcctttcttgtctatgccatcaagttttcatcccgatcaacttgtcgaattgattttgccttatagcaatatcaaacaattatggaaagacacaaagcatctgccgaatttgaaagatttagatctcagccactcccaaaatcttattgagatgccagacttaagtggagtcccacatcttaggaatctcaatctccaaggatgtacaaaaattgtacgcatcgatccatccattggtaccctaagagagcttgattctctgaatttgaggaattttctcttacggtccttaatctctcaggctgttcaaaattacttactaataggctgttacagaaaccaagggagacagaacatatggaaaaaattgatgaaaatagaagttccatccaattatcaacatcctctgtatacgaaatgctaa

SEQ ID NO: 92848 - DNA, 234 bp, Glycine max
  Peptide Sequence Number=SeqID_209626
atgaagttagggggcaggcagaaatacccaactggttatccgtataaactctatttcgctatccataagactcaaaagcacgatagcatgcagagactaacgtcgtctactgcaccctttgtcaatcgcggggttagcttatggtttttactctcgtcgtccggaaacattcaagcccaacgacgcgcgagattcttctctgctgggcagggacgatcgactgccatggcatag

SEQ ID NO: 92849 - DNA, 225 bp, Glycine max
  Peptide Sequence Number=SeqID_209627
atgatgggatggtaccactattcagcgcgacatactatggtaatgaaaagtggatacatagaaggttttggtgatatttacctcggtgaaggtagatatgctatatttgacggagttgatggaatattcatggtcttcaaatacgacgatgaagaacacgcaaaagaaagttggaataaaatcacaaagaaatacaacaatcctttcaagttaaagtatttcaag

SEQ ID NO: 92850 - DNA, 837 bp, Glycine max
  Peptide Sequence Number=SeqID_209628
atgcttccactaaagctggttcgctctctggtcttaggtgaaaccatcaaccacaaccctcatcacatcctaacccaaaatcaccaccataatagtgatgatgaaaataaaacctatggcacttcaaaaccccaccatcatacaagaaggagaagaagaagaagaaagtacaaaacccctggcctcatattcctcccaacaaaagagatcataagagacacatacaggcttgccaccattgcaagagacttaggtctagacttgtaccctacaccatccctctctcacatcatcttctccaacccatcatcatccaaaccctcatcactatccatttcttcttcttcttcttcttcttgctccctcccaagcgacgccgttcccatccccttcccttccctctccgcaaccccactcgctcacctccgctgcttcctcacgctctccccacgcgccttcaagatcgttcttttcaactccgaccaccacccagacgccgccggcaccgccggaaactgggactgcggctctttctctctctactctagggttgttggtgttcgcgttgacaccatggaggagttttgtcggattcttgccggaaaaggttggagcttttacaaaaccaagaaaaacccttcttccgatcagcgccgcggcggcgccttttacctcttcagaagggtggatgtgaaccgagttcgggtcggagctctggtggatggggcgtgcagggtgagggagttgaggttgccgcacttggattttggaaatgctccgttgaggattttgcagtatattttgttgatgactgatgatatcttctgtttggcatga

SEQ ID NO: 92851 - DNA, 249 bp, Glycine max
  Peptide Sequence Number=SeqID_209629
atggagaggctttttgtggaagggaacgaacctgagaaattagctgaagagtttagtgttgatgtggagagatatgccatgacagcgggctgcatttgcttgaggctaatgaccaatggaagcagatgggatatcctcatccactccacacccgtgcaaaactggaagatgatggtggtgccaccttctgtgtggtcatctatgaatgcagttacagttgaccagttacttaagagaatgctaccttaa

SEQ ID NO: 92852 - DNA, 378 bp, Glycine max
  Peptide Sequence Number=SeqID_209630
atgagtgaatttcgtttgatgctgcagttacccagggagataacgcacgagaatgttgtgaagcttgtgaaagttcacattaatcacatggacatgtctctttatctggcttttgattatgcagaacacgacctctatgaaataataaagcatcattgggacaaagtcaaccaatccattaaccagtatactgttaaatcgttactctggcagttgctcaatggactaaactatctacacaggcaagttgttttgtttttgaaattgaagacggttatgggtgaaggagaggaacatggaattgttaaaattgctgactttggacttgcaaggatatatcaagcacctttgaagccattatttgaaaatggggtatga

SEQ ID NO: 92853 - DNA, 957 bp, Glycine max
  Peptide Sequence Number=SeqID_209631
atgggcactctagtgggacatgtggctccaggttttggtttcttgttgataggtttgtggcacctctttaaccacatcaagctccacgcccttaacccaaagtcctacaagggcccatcatggttcccaagtgccaagttcagatacatagagcttgtgctcatcatggttggctccacagcctccgtagccatggaactcttcataggccctgagcggcaccaacctcttgacccagatggaaccattccctccaaccatctccacaacttcgagcactcttcaatctccatcaccttcttcctctacgcagcatgtgccatcatcttggaccgggcccgagtccaggcccaattcgaactaacccaattgcttggggccatagcctttgcccaacaactgcttctcttccatcttcattccgcggaccacatgggcccagaaggacaataccatcttttgttacagattttggtctttgtttcagtctccaccgccctcattggaattgtgctcccccatagcttcttggtcaactttgttcgctccgtcagcatattcttccagggtttgtggcttattgtgatgggcttcatgctttggacaccttcactcatacccaaaggttgttacatgaacgacgaggatggtcacatggtcgttagatgctcttctcacgaggcacttcaccgcgctatttcacttgtcaacatcgaattcagttggttcattatcggtgtgaccgtttttgcggtttctttgtacttggttttggtaaaagtttatggggagaagaaggtggagtatttttcgttggggaatgaggatgaagagtcaaacgacgacgttgagtcacaaaagagcggtgcctttgatcacagcagcaaaagcttcattcaggtgggcaaaatcttttctcaaaatgacatggaaaggtgtcttttaattaggagttaa

SEQ ID NO: 92854 - DNA, 951 bp, Glycine max
  Peptide Sequence Number=SeqID_209632
atgttatgcgtttaccaagaattaaacgcattaaaaatcacaaagaattcatggtgtgccgtgttacagaaaggtttgtggcacctcttcaaccacatcaagctccatgcccttagcccaaagtcctacaagggcccatcgtggttcccaagtgccaagttcagatacatagagcttgtgctcatcatggttggctccacagcctccgtagccacggaattcttcataggccctgagcggcaccaacctcttgacccagatggaaccattccctccaaccatctccacaacttcgagcactcttcaatctccatcaccttcttcctctatgcagcatgtgcaatcatcttggaccgggcccgagtccagacccaattcgaactaacccagttgcttggggccatagcctttgcccaacaactgcttctcttccatcttcattccgcggaccacatgggcccagaaggacagtaccatcttttgttacagaatttggtctttgtttcagtctccaccgccctcattggaattgtgctcccccatagcttcttggtcaactttgttcgctccgtcagcatatttttccagggtttgtggcttattgtgatgggcttcatgctttggacaccttcactcatacccaaaggttgttacatgaacgatgaggatggtcacatggtcgttagatgctcttctcacgaggcacttcaccgcgctatttcacttgtcaacatcgaattcagttggttaatcattgttgtcaccgtttttgctgtttctttgtacttggttttgttcaatctttatggggagaagaaggtggagtatttttcgttggggagtgaggatgaagaatctaacaacgacgttgagtcacaagagagcggcacctttgatcacaacagcaaaagctttatacatacatatgggcaaattctcttttcaaaatga

SEQ ID NO: 92855 - DNA, 213 bp, Glycine max
  Peptide Sequence Number=SeqID_209633
atggtgaaatcctttgaaagattttcgtcagttgagtctactaagattttcttatcactccaagcatgtatgatagaaatcatgaagacaaaaggttcaaacaattacaagatcccacatattcaaaaaggagtcatgcaaaggcaaggaactctacctactcaattgaaatgcgagatatcattagttgaagaagttatgcatcatatatga

SEQ ID NO: 92856 - DNA, 1950 bp, Glycine max
  Peptide Sequence Number=SeqID_209634
atggaccggaggagttggccatggcgcaggaagtcgtctgagaaaagtcccggtgaaactgagagttctggctcaatgtcatctcattctgaaagattttttgatgatcaggtatatcccacccaaactacgccgcctccagaaggcatgtttgaagctgcaccaaatgatgaagaagctaatgatgtgaagactctaacagaaagattatctgctgctctcttaaactctcgtgccaaagaagacttggcaaagcagcatgctaaagttgcggaagaagctgtctcaggctgggagaaggctgaaaatgaattattgattcttaaacaacaactcatcgatggaaaacagcaaaactcagttcttgaagaccaagttagtcatcttaacgaggcactcaaggagtgtatgaggaatcttcgacaagctaaagaagaacaagagcaaaagattcatgaagccttaacaaataactcttatggcttggaatccaaaagacccgatcatgagtggaaagttgttgttgctgctaaagcagatgctgctgcttcatcagttcatttggatcttcagcagaggcttgagggtaaggagaaagagaatgcaagtcttaaaatagagctacaatctcgactagaggaattagagttcaggaccatagaaaggaatttgagtactcaggctgctgaagcagcaagcaagcaacatttggagagtataaagacggtggctaagctagaagccgagtgtcgtagactaaaagctgtgactcgcaaaacattatctgctaatgatcacaggtctttagcctcctcttcagtgtatgtagagtcttttactgatagcatgtcagatattggagagaggcaattgatagttgaaagtgatatgcggaaattaggaggttgggatatgaatgaaggtgagccaaaccaccatgactcatggccatcaactttaatcaaggaacttgatcaatttaagaatgaaaacactgctggaaaaaatagtatggtcttttcaactgagatcaatctgatggatgatttccttgagatggaaaggcttgttgcattgccagatactgaaagtgtaagcagttttcctgtggaaggtgctgcatctgaccaactcaatgttggccctagaacaaagaatgctgaagtggaagctattgttcaaaagaacgctgcattggaaaagaaactagagaaaatggaggcagagaaactcgagctagagatggatctaaccgagtgccaaaagcagcttgaagcatcactgagtaggataaaggaagtggaattggaggtagtagagctccaaactaagttagctcttgcaaacaactcaaacgaagaagcatacgagaaactagaagcaactgaagaaaagaaagagatagctgagtcaaaactcagagttgctcatacggaagcagaagaattggtttcaaaaatttgttcattagaggaagagattgagaaagagcgagctttgtctactgagaatatggccaagtgtggaaagttggaggatgagctcttgagaataaagaatgaagctcaactccacaaagacactttgattctgcctggagaaggtgttaatagtgagttaaagcaggagaaggaactagcattggctgctagtaaatttgcagaatgccgaaaaaccatcgaatctcttggactgcagttaaagtcccttgcaacattggaagactttctacttgattcagagagccctatggagttaacttgtgaagttacacaaccaggtttccaaaatggtggtgagcagttgaagaagttacataatggtgatttgaatttgtccaaaagagattctaaggcatcagtttcaccatttgaaaaaacccataatagttttggtaggttcaacttcaacccaagaagcaagagtgtaagcaaaacaagaagtcactga

SEQ ID NO: 92857 - DNA, 207 bp, Glycine max
  Peptide Sequence Number=SeqID_209635
atgggtcctagtaaaattggcaagatgaaatttgagtcacaaagaggtatagttacaccaatgagatggaggccacttgtgatcaaactggggacatgttatttcaagtgttggggagtcaggccagcacatgaaaatcatgcaatgtattttgtgggagaggccagatttattgccattagggctaaggcgatgagcttggaatga

SEQ ID NO: 92858 - DNA, 177 bp, Glycine max
  Peptide Sequence Number=SeqID_209636
atgggtaggagattttccaagttgaggagaatggtgaggcaacaaagagggaagttttacattatgagggccttttgctttgtaccatgccatggcaagacaatcgttatcgatgagaattccaaagtctgggttaatgcaacggtgtacaaggcacttccgggagcagaaaactag

SEQ ID NO: 92859 - DNA, 531 bp, Glycine max
  Peptide Sequence Number=SeqID_209637
atgtaccccccttatcaccttccctttcgaaaccacctccattaccaattaaatgtatgcccccagaggagatggcaatccatcgtgagaaggggctttgcttcaattgcaaagagaagttcagtcaagggcacaaatattcatcctaagttgttttgttttcatactggttccggacatcttatgcgaagtgcatacactccaactattatcactggtccaagcggcagctctggcacgactcaggaagagaagtttaacgaccatcgtcattcgtttcgcgatagacctaacccttatgtttcctcggtaccacattaccccattacttccactttaacccatgtaccccccttattaccttccctttcgaaaccacctccattaccaattaaatgtatgcccccagaggagatggcaatccatcgtgagaaggggctttgcttcaattgcaaagagaagttcagtcaagggcacaaatattcatccaatttttttctcctcctcatcgatgaagtggataaccaatag

SEQ ID NO: 92860 - DNA, 585 bp, Glycine max
  Peptide Sequence Number=SeqID_209638
atggcacaacaagttcaagtattcactacatgttattgtccaccacctcaatacgaataccttcgccgaatcggaatttcgaagcaattaaagtgtgctactattccttcactatcagtttccgcctcttctgttcttcgtaacgcgtcgttttgctgcacctcttctgtccactgcaatttaccttcttcacccaaaatcttcgtcaaagagaaactcctcttgaacccgaagaagacctctttattaggaatgcaaagctacatgctggaatttcacaagttttctggaatcctgggcaggcttcctctctcaacctctgaaggacgtctgatgaaggtgttttcagagtttggtgacgttactctagagtttggtgaagttactctagtccagcttccaatagatagagagtctgggcagtctttaggatttgcatatatttggtttgtcaaggaagagtctgcccaattggctgtgcaagagatgaatggaaagttttttgatggcaggtttatttatgttacaattgcaaagcctggatcatcaaaaagttccaagaggacaacagcctacaaattttaa

SEQ ID NO: 92861 - DNA, 615 bp, Glycine max
  Peptide Sequence Number=SeqID_209639
atgatcatccgtctaagcacgagccccttttcatctccggttctcttggttaagaagagagatggatcttggcggttttgtgttgactatcatgcctttaatgcaattacggtaaaggattgcttaccaatctctaccatagatgaattgcttgatgaattaggaggtgcttgctggttctccaaattagaccttctacaggggtaccatcagacattgatgaaggagaaagacatgagcaagacctcattaataactcatcgtgatcactatgagtttcatgtcattccattcaaactgtgtaatgcaccctcatcgtttcaggcgaccatgaataagccttgcgagtgtggaagcaatgtcttccaagattattttgatgatgtcaaagaatcaagagttaagaaagttccaaacaatcaggagtcaaaaagcttcaagaatcaagtttcaaagaatcaagattcaagaataatcaagtttcaagattcaatcaagtttcaagaatcaagattcaagaataatcaagatcaagattcaagactcaagattcaagaatcaagagaagactctatcaagataagtactaaaaaagtttttcaaaacattgagtag

SEQ ID NO: 92862 - DNA, 198 bp, Glycine max
  Peptide Sequence Number=SeqID_209640
atggtggatctaagctctgatacggtggttcgaggctcccatgcgttgtcgggaaaatccattagatgcccatggccacgtgtatccagtggttgtcaacgggcaaagtttatcccttgtcagttgctaagcgtcggcgatgctcaaagatctcgacggaggcatctcaagatacctaggtctgagatacatctctaa

SEQ ID NO: 92863 - DNA, 867 bp, Glycine max
  Peptide Sequence Number=SeqID_209641
atgggtatcacaaagacccttgcatgcatgggtgagaacttcatttggcccagaatcaagaatgatgttcgacaatttatcgtagtgtgcattgactaccaacacacaaagtacaacactcgcaaacaggttggtctactctgcccattagccattcattctcgaccctgggaggacctatctttagacttcatcgtgggactgccagcttacggtggtcacactattgttctagtggttctggatcacttttcaaaaggaatccatttagggatgctccagtctaattatatgacttacatagtcgcgtttcttttcatggaaattgtcgcgaaaattcatggaatgcctcgcaacttggtcttggatcgtgatcctctattcattagtcgtttctggaaggagttgttcaaacttagtgggaccaagctatgtgtttctccatatgaagttacttctggtaagaagccacccagtattcctcaatacatagcagtcacatccaatatcgaagcagttgatgaattcttcgttaatcacaaggctatgttcaacagtttgaagaagaagtttttcagttcaattctcaaaccatgtcaccagccatcaatatcagcaggcactacagttgagttgctaccaacaatagttgataatcaaccagttatttcacctctcgtgattctcaacacacgatgggatcaccctgaggtggaaggcatatctcctaatgatacttcttgggaagactggggtagtctcaaaactgcttatcaccttgaggataaggtgttgttcgatgaaggaggggatgttaagaaaggaataatgcaccaaccaggcactacaggcacgagcatgaactag

SEQ ID NO: 92864 - DNA, 444 bp, Glycine max
  Peptide Sequence Number=SeqID_209642
atgaagttcatggagactcaactctccaccatgaaagatcttttgtcccaaagagctcctaagactcttccttctcaaatagaggttaatcctaagaatgaggagtttaatgtagtgagcaccagcatcggaaagcctatggtagagtcgaagaagacaaagaaagccactccaacactagaaaaagaggctctcactgaagaaagtcacaagatagaaaaagtgggtgaaaaaagggtattggcacctcctcagaagttggggttgcaagaacttctacctactaaagtctatcttcaacttgtagataggaccctcacttacccacaacggtcactaaaaacatggaagtcattgtggctaggcatcagccaagtgtgggaaggaaaacactttggaagaaaacatcattccaaaaaacctttgaagtggcatgagggatag

SEQ ID NO: 92865 - DNA, 948 bp, Glycine max
  Peptide Sequence Number=SeqID_209643
atggccatgtgcatcgattctactgtggtgagtgatatcttggggaaagctttgcaagaacttaaatctactgatctacatatttctggtgctgaacatcaagaacttctatctgctgtcatgcaaagaattggtgatattaatgatggagaacaccctacaatgctggacgatgatggtgataaaattattattgcgactgataacgatcttgtggctgccgtcagctatgctaggtctgcaggactgaaggctttaaagttggatttggagtttcccaattcaaccaaaccaacaaaactgcaacctggtacagccactatacagaaaaccagtacattgcgtctccgttctgtgtgcatgctggaggctctttcgcttgatgattttgatgctaagtggaaagaattggttgacaagtataagttgtctgaaaactcatggatccataggatgtatgagaaacgccataagtgggaagaggcttactttaggggacatttctgtgctgggttgaaaagcaccagagcagttaatgaagtccggtggaatgaggggaaggttgaatatgatgccacccatgttcggtttgctctcccaactcctcatcattacttgcctcgcgtgtctaatgatgttgtggcgagaatgatgcgttttggtaacatgatgtccctttcttcagtaccatgttacttggcgtctacatcagaccagttatttatcgtcgtacacaatagatttcaaaagttattggatgaagtaaatgagttttcttctgcccctgatgcaagcaatagtgatgcacttaatgagaaaggaggtgcacctgtctcaagtgaaagatctaaaggtgatgatgctctttccagaaatgtggaacagatcaaacatgggtgtcctgaactcatcaatgctgtaattagtgtggctgagaaagtcccatag

SEQ ID NO: 92866 - DNA, 2307 bp, Glycine max
  Peptide Sequence Number=SeqID_209644
atgatcgcatccacctccaccaacgttggacctcaccctctgcgttttctgtccaaaccaaccacacattcctctacgaggtttctgtctctcagactccactctcggggcagcgctgttgcactttcctcgtccacacggaccacacccttgaagcccacgtgtcacttcaacggcaaagatggaagctttgagcagcacgaggaagagggtgagcgtgaggtgcattgtgaggttcaagtgatatcgtggagggaacgcagagttaacgcccaaattacggttgatgctgacactgagtccgtttggaatgctctcactgattatgagcatctcgctgatttcatcccaaatcttgtatggagtgggagaattccttgtccttacccaggaaggatatggttagaacaaaggggattccaaagggcaatgtattggcatatagaagcccgcgttgtgttggatcttcaagaagtcgtcaattcagcatgggatcgagaacttcacttttccatggttgatggggactttaagaagtttgatggcaaatggtctgtaaaatctggaacaaggtcatcaactgctattttatcttatgaagttaatgtgataccaagattcaatttcccagctatttttttggaaaggattatcagatctgatcttcctgtgaaccttcgagctctggcttacagagctgaaaggaactttgtgggatatcagaaacttccagtgtcagaaaaccacttgcacaaaacttatgtggccattaacgggtcatctgttaaaaagataaatggtgctttgtctgaaagttttaaaaagatgaatggtgctttgtgtgaaagtgataagttgccacctgcagagaacaaaaaagaaattgccacctcagtttctggttccatgctcacatcttccagtgaggttagaagcaactggggtgtatttggaaaagtttgcaggcttgacagacctcggatggtggatgaagttcatctccgcagatttgatggacttctggaaaatggaggtgttcatcgctgtgttgttgcaagcataacagttaaagctcatgtttgtgaagtatggaatattctaactgcctatgagactcttcccaagatagttccaaatttagcaatcagtaaggttgtatcacgagataacaataaagtccgcattcttcagcgggtgttttactatcattatccgcaatcagttaatcaaacttgtatcctttcccttatcacaatggaagggtgtaagggtcttctttatatggtgcttcatgctcgtgttgtgttggacttgtgtgaatatttagaacaggagatcagttttgaacaagttgaaggggacttcgattcgttccggggaaaatggatttttgagcaactaggaaatcatcacacactgctaaagtactctgtggagtcaaaaatgcgcaaagatactttcctttctgaggccatcatggaggaggtcatttatgaagatctcccatcaaacttgtctgcaataagagactatattgagaacatgaatgcatcaaaatattcggaagtttgtgagcagaatatgaattcagggcaacaaattctttcatcgggctatctaaaagatgacaactctggttcagccgaggaagttcctaattgcgatgttcaatgttcatctcagcaaagatctaaagtgccaggcttacagaggaatattaaagtactagaatctgaactcctgaaattcattgcagaacatggacaggaaggatttatgccaatgaggaagcaactccgtttgcatggaagagtggatattgagaaggctataactcgcatgggtggattcagaaagattgcaaccatattgaacctttctttggcttacaaacatcgcaaacctaagggttactgggacaatcttgaaaatttgcaggaagagataagtcggtttcagaggggctggggaatagacccttcatttatgcccagtagaaagtcatttgaacgagcagggcgatatgatattgcgcgtgcgctggaaaagtggggtggactgcacgaggtttctcggcttctgtcgctcaaggtaagacaacggagcagacaggacaaccttgctaaggataagaggagtggtgatcatacagatagtgaaatgaagacaccattaaggctctatgattcttcaccacgccattcacctcttccgtgtcttggtctctttcacatgcattttgtttatcctgatgaggagaaagaaaggaggcttggtgtggtgtatgataccacctacattaactga

SEQ ID NO: 92867 - DNA, 879 bp, Glycine max
  Peptide Sequence Number=SeqID_209645
atgggcgcaacggggacaggaaagtcaaaactggccatagagttggccacgcaattcccaccagcggagatagtcaactccgacaaaatgcaagtgtacgaaggcctaaacatcaccacaaacaaagtcaccgaagaagagcgtcgcggggtcccacaccatctcctaggcacggtgaatcccaacaccagtttcactgcacaagacttttgcgaccaggccactctcgccgttgggtccatattgggccgtgacggtttacccatcattgcgggtgggtccaactccttcctcgacgcgttggtcaaccatcacaccgagtttcggttacgctacgactgctgcttcctctgggtcgatgtctcactccccgtcctccattcctctctctccgcacgtgtggatcgcatgatccactctggccagctccacgaggttcgacagagttttcaataccacaaccaggattataccttagggatacgaaaggccattggcgtacccgagtttcatgattttttcagagccgaagccgacggagccgatcagaggaccaaacagcgcctcctccaggctgccattgcttccctcaaaaccaacaactgcaccctcgccaagcggcagctccagaagattcaccgcctttatagcatgtggaaacggaacatgcaccgcctcgacgccaccgaggttttcctcaagaccactcgccaggaggcagaggaggcctgggaggatcacgtcttgtccaagaccagaaggattctccataagttcctgtatgaggacacgcatgttgttcccgcaggtattgcgtctgttgttattgcttcttcgccgccgcccatgcctgccaccgccgccgccgcaactcactag

SEQ ID NO: 92868 - DNA, 213 bp, Glycine max
  Peptide Sequence Number=SeqID_209646
atggaagccatacaccaaaggctccctatcattctcctcacctatcctcaacacaaccttcaactccttcaacccttgagccatgaattcgaagacctcgcacgcctgcgaaacgacgttgttgcagagggagaagaggcacacgaagtcgtcatggtgcaagatgaggtaggacttaacatgagagcagatttggagggactgcaactctag

SEQ ID NO: 92869 - DNA, 801 bp, Glycine max
  Peptide Sequence Number=SeqID_209647
atgtttattagtcttgacgctcgtgaatcatgtggtgaggatggacacaacaaagaaagcaacaaagaaaagagcttgtgggttccaaaaacttggaggattgatgactcaaaagcggcaaaaagctctataagggcaacactagggattaaaaatgacaaggctaacttagttcctggggaaacactctttaaatccttcccttcaaagcatgatgagaacatgattatgcaagcctcgccggtcttgcaggccagtccagcggcattgtctaggtgcagcaaactgatttggcagtgttcatccggtcctatgggaaacacatgttgtaaaggcatattgccaactgaagaaagagcaggatggttctttatgcatttccttctaagagtgacaaccaaaattctatcacgtacgatcagctcaaagaataacaccaaaaagttgaagccattgcattggttgagactatctagagcagtggaaggaagtttgtgggctaagacacaaaatctggcgaagcttctaagtaatgttgattggctatgggccccaaagattgatatgttagaccttgagagtctcttcttagcagaagtcttttcaagtcctgccaaaaagtcaaatgtgcaaagctcaactggtcctaaatatgataaagtgcaacaactgattaagcataggcgagcatataattgtgaaatcatgctttcaaaagtgaaagtgtcgttggatgatttaatgagtctaaagaagatgactttctttataaagattgttattttagaagtgcttatctag

SEQ ID NO: 92870 - DNA, 465 bp, Glycine max
  Peptide Sequence Number=SeqID_209648
atggacggaggagcaaaaactcaaattcctgctcaacgtcaaggctcagaatatgatgttgtgtgttttatccgaagaagaatacaccaaggtacacaacttcagaaatgtcaaacaaatgtgggacactatagttgtaacatacaaaggaacatcataggtaaagatgaacaaactcaatctcctcattggaagtggagaccacaggtaacaacactaaaagccttaaagaatcttgattctatgttccttgaagaactagttggtaccctcaaggttcatgaacaagaacttcaacaggacgaaggaatcaaaagagaaaagtctttatctcttagcagccaaaagaacaaaaaggcatcaccatctaaagcacaagtaccaagatgtttgtccaaagttcttaaggttgatgatgaatctgaggaagactctaatgaagatgagctcaccttcatttcatga

SEQ ID NO: 92871 - DNA, 285 bp, Glycine max
  Peptide Sequence Number=SeqID_209649
atgggagaagaactacgactctcatgccgagatttgggccaacattctgaacaagagtattctccacaaagcaggcttaaaaacaacattaacagatcttcacagaccgctctcatgaacaagatgctcagggatgaaggcgtgtatcatgtcttcaacaagatggatgatgactctaagcacactctaatagccaaggcagttggaacttcagccccacaaaggctgaagaacctgagtgagactaatgaagaaaatgaagaatttgtagaagttgctctctag

SEQ ID NO: 92872 - DNA, 345 bp, Glycine max
  Peptide Sequence Number=SeqID_209650
atggctagaaccatgctcaatgataattcaacccctaagcacttttgggttgaagtggtgaatactgcatcaactagctcgtccagacataatccagagacagaggcatccactcaacaagaagttcaagaagaggtaaaagaacccatcagatgcattttaagaagaaatcatctagaaattcaaatcattggtgacccaatagatcatgttcaaacaagattatcacttagaacacaagggcatattgcactaatctctgaaatggaacccaaactcatcgatgatgctatgcaagatgataactggattaaggcaatgcaagaggaacttcaccagttttag

SEQ ID NO: 92873 - DNA, 708 bp, Glycine max
  Peptide Sequence Number=SeqID_209651
atgcccaaagaaaagaaagataaagacaagagctccataatttgttacgaatgcaaaaagtcaggacacttcaaatatgaatgtccaggactggagaaaggtcaggataagaagaaatacttcaagttcaaagaaaagaaggattgggacaactgtcagggaaaaaactactcttctcaagaacttcaggagttagaaaagaatttgaaagatcttcaaaatgatctgaaggagcttaatgaacttcatgattatcaaaaggaagaaaggaaggtatatgttcatgataaggacaccattgtttgctatttatgtggcaagattggtcatatgatatccaagtgtaaagatcgacctaagaaggctacaatcaatacctttatggataacacaaaaggacctaaaaagatttggttacctaagaaaaagattattcatgttgcagatgcccttgataataggaagcaaacaactatcttgggtacatcctttgtgatacaagtagagggtacatctacttgggttgttgtagctgagaacaagagagggtacatctcttgtggatcagttcaagtggagggtacatccacttggttgttcaaagagaacaagggagggtacatcccttgtggatctttgcttgtaaaggtttttacaagattgaaaagaaatctcaaggaccgcaggttgcttggggactggatgtag

SEQ ID NO: 92874 - DNA, 318 bp, Glycine max
  Peptide Sequence Number=SeqID_209652
atgatgcttccttgtcttgtgatgattctttacatccagaatctccaatggggtgaagtagatgaagaggaggatttgagtaatatccaggacaagggaagttcgtgtactgtaatggtttctttggaatttgttaaggaagatgagtattttactgtggtggtctctaagtctcagcaaaagaagtttcacaagattaaaaagcaagtagataaagcttatttgattccaatatccattcgaggatgggacctaaaactcttgcttgatgaaggttttatactagaatgcaagaggtgtggctattgtttaggttga

SEQ ID NO: 92875 - DNA, 333 bp, Glycine max
  Peptide Sequence Number=SeqID_209653
atgcttactcgtagactaagaaaaggacaaagagaaaaagcaataattgaggcagaagatgctacacagacccttatggattattgcacccctcacttgaaggaaaccaacaacattcaattgccaaccttgcctcaagggatgattgaaagcaacatgttcagtggagcttcctatgaggatcccatgatgcatttgtggagaatcagaaagcatactaataagttgctaagggacattggaaacttcacccaaagtgaacaagagaacttgtttagaagcttgggaaagattctaggagttgataaggagttgcccacatcatgggtttaa

SEQ ID NO: 92876 - DNA, 183 bp, Glycine max
  Peptide Sequence Number=SeqID_209654
atggttgaagttaggcttggtagactcaccctctggttaggcaacacccttaatgatccttttgagagagttctcactcatgaggactctgaatgggcaataagccctgatgaagaggaagtattgatgcttcttcaagctcaaccggtgtctaatccacataggtttgagaggttggagtag

SEQ ID NO: 92877 - DNA, 387 bp, Glycine max
  Peptide Sequence Number=SeqID_209655
atgcaagaagtgctaatgcaatacatctcccaaaatgatctgcacatgaagcttgtggaaacccaactttcttctatacactctcttttgtcacaaacagctcctagcacacttccttctcaaactaaaattaacccaaagaagaaacatgtcagggctataatgacaagaagcaagaaagctagagagaatatgaagcaaaatgggggatccacttcagatgccacaaaggaggtttttactaaagagaacctagtgccagaaaaaaaggtagaggaaagggagatactaacatctcccaaggtcattctagcaagagctctagaggcacaaaatcaacaaaaagttctggaaggagaaattgggaaaattgaagataaaagctag

SEQ ID NO: 92878 - DNA, 363 bp, Glycine max
  Peptide Sequence Number=SeqID_209656
atggaaggcgagttggctcaagccatggatgagttcaaatatgtaggagaactgatccacaagagatgtaccctctcttgttctcaattaacaacccaagtagatgtaccctctacttgtaccacaaaggatgtaccctccaatgtgttaagacaaagttctcaggcgcttagtccttcgaaactttgtgaagggggaaacaaaagaattctcaagcgggagaagggagacacaaaagaattcaagcggttagtccatcattcttttggaaaagggagaagagagacacaaaaagaattcaggcggttagtccttggcgaattctttttggcaaagggagaagggaatgaaaaagatgaatag

SEQ ID NO: 92879 - DNA, 186 bp, Glycine max
  Peptide Sequence Number=SeqID_209657
atggtgttccctaaagaacctggttccattccattccctacccttggtcttaagaagccaccattagaagaaaaactagaagatgtcaaagcacacccatgggtgaagaagcaggttgttgcatatccaccaattttgcatgttaaggagtcaattgagttcaaattctaccctgatagaatttga

SEQ ID NO: 92880 - DNA, 821 bp, Glycine max
  misc_feature (42)..(42): n is a, c, g, or t
  Peptide Sequence Number=SeqID_209658
aagctgacctttcaaatggagaagtagagagtgaagctgacncttcacaaggtgcagtacatagtgaagttgaaccttcaaatgatgcaatggagggtgaagctaaaccttcacaaggtgcagtggagactaaagctgagccttcacaagatgcagtggagagtaaagcttctctttcaaatggtgcattgaaccgtgaagctgaaacagcaagtggtgcaatggagagtgaagcaaaaacttcaagtggtgcagtggagactgaatttaaaccttcacatgatgtagttgaaagtgaagctaaacctccaaatggtgtagctgagactgaaagtgaaccttctgttgatgtgtgtcagacgaaaaaagatgtagtgaatagtaaagctgaaacttcaagtggtgccctgcagagtgaaagagaggcttgtgttatgtctgagatgaaaaacaatgcagtggagagtgaagctcaaccttccgttgatgtaaatcacaagaaaacaatcgcaattaatagcgaagctgaactttcagttaaaggtgggctttttgttgaaagtgaaggtagtaatcaaggagatgaagattcaagacttgcctcagatgctttggatggacagaatgtgggtacaaaggagaagactaaaattcaagatgctattcgaatcgaaaggcagactataaagcttagggctacaatagcagcccatagagctgctcgtgacttgctcaaatccaaacggtgggaaatagatttagtccaatccataatgaacagattaaacaatgcaatttatgttggggatatagatggcaag

SEQ ID NO: 92881 - DNA, 493 bp, Glycine max
  Peptide Sequence Number=SeqID_209659
ggaaccaaagccttaaagaagatgaagaactcagcttcagagagcggtttgtacataattgagagcgatgaagatgtggagaaggatatgcagaaagacgaaaacgatggaaacgattcggattattcgaatgattccaatggaaacctgtcaatgaggaaacccagcaattacagcatcgcatggcctcaaagttacaggcaatccattgatctatatggtagtgtgccatcaccaaatattgggtttctgggcaccacatcactgtcaagattaagcagttcttttatttcttcatctttgacaagaaggcacactcttgaagtattacaaccagagaaaaaaccactcttgcaacccacagaagaggagcaaccgcgacataccttgcttcctccccaaatatctaggaagtcttccattaagatttccaaggtttctcatgaacctcacattcctggccaatgcacttttggacaagctgtgcttaatg

SEQ ID NO: 92882 - DNA, 345 bp, Glycine max
  Peptide Sequence Number=SeqID_209660
atgatttttgtataccacggacatgccatcactatccaaggcagcatcacaccaggcccatctgaatcactcatggataggttaagcgcctcgtgtccacacagcaagttgcgaccctattccacctccaacttcagatggaattggcacaaggtttccaccaaacgcatggctgagcatgatatccttaagacaacttttcgtacttatcaaggtcactacgagtacgttgttatgcccttcggcctctgcaatgcaccctccacattccaagctacaatggacgctgatgtgatactgactaagagcggatcgcttgatacaggctacggagattttggatga

SEQ ID NO: 92883 - DNA, 1032 bp, Glycine max
  Peptide Sequence Number=SeqID_209661
atgccagtatcgtcttcccccaaatctctgcacagttttttggacctgacaaggttttaccggtgcttcgtcaagaactatgcagagattgcaaacccgttgacccatttactgcgtaaggaccaattcaaatggtctcccgaggctcaaatggcatttgatgctttgaaacaggccatgaccaccacaccggtgctatccctgccagattttagcgttccatttatcgtcgagaccgacacgtcggggacaggaatgggagctgtgttgatgcaacagggccacccaattgctttcttcagtaagcaattttgctccaaatttctccgttcttcaacgtacattcatgagctgcatgccatcaccaccgtcgtgaaaagatggtgtcaataccttctaggtcatgccttcgtcatcctcattgaccataaaagtttgcacgagctcatgacacaactagtacaaacaccagagcagcacatgcaatgcactgattgcttacagaccaaatatgttcaccaaaatccggcgggtctcctccaaccagttccaccgccgtcacaatcatgggaagatttggccctggacttcatcacaagtctaccaaacttcaagggagccacggtgattatgaccatcgttgatcgcttttctaaaggcccccactttggtacactctctacccatttcatggctcacatggtggtgcaacttttcatcaaccttgtctgtaagcttcacggctttcctcggagtttaatatctaatcgggatcccatcttcataagcaggttctggtgcgagctcttccgattaagtgggaccaagttgcgaatgagcaccgcctatcaccctagagcgacggccagacggaggtgctcaactgcatcgtggaacagtaccatgtgccattcctccaccaatttgtccccatacgaggttacttacaacaagcctctttcgggaattccagattaccttccgggttcgtccatagtggaagcagtggacttccttctctcctctcgatag

SEQ ID NO: 92884 - DNA, 219 bp, Glycine max
  Peptide Sequence Number=SeqID_209662
atggtcaagatattcgatgtgacgttggccaaaaatgcatttggacgatttcaggtgaaaggccccctattgcagagttcatatgacacaatcgagatggccgagaacagggcgtttgatgagaatcctgaaactggccaaatacatgctaaaggcccaagtggagaaggacgaaggcccaagtggagaaggacaaagcccccgagtggagaaggatga

SEQ ID NO: 92885 - DNA, 774 bp, Glycine max
  Peptide Sequence Number=SeqID_209663
atggcagcaacatatgagatagagaagttcaatgaggatgcaattgaaggcataccaacgcatatcattgatgaaaggtcgaaggagatggatgaaaatgcaatcgccaatttgcacttaacaatggaaaacgtgaaggatatttgggatactttccacaaattgtatgagatcaagtcacttcagactagaatattcttgaagaggaaactctgcactcttcgaacgactattcttgaagaagaatgtaggcgaaaaaataagaaagatagactggaaaattccaagcaagtagaagctttaacaatgacgagaggtagatcaacaaaacgtggctccactgggagtcaaaatcatggatttgtgttcatggggaatgatcatgccttggaaattgttggggtcggaactatcaaattaaaaatgtatgatggtatcgtacgcacaattcaaggggtactccatgtaaagggtttgaagaagaatcaattgttcgttgggaaattggatgacctcgagtgcaaaatccatattgaaggtgagatcttgatgggaagctttatgtacgtcatgatttgtactaaaccaaacattgcacaagccatgagagcgattagtaggttcatggtagatcttggtaaagagcattggagtgttgtgaagaggatccttagatacatcaatggaacctcaggtgttgcattatgttctgaaggatccaaatttattgtcatgggctatgtcaattcagattttgtaggtgatcttgattag

SEQ ID NO: 92886 - DNA, 565 bp, Glycine max
  Peptide Sequence Number=SeqID_209664
ggaatgatgagaatcatgaaactggccaaatacaggctaaaggcccaagtggagaaggacgaaggcctaagtggagaaggacaaagcccccgagtggagaaggatgaaggcccaagtaatccttgtggcgtctaccctgacttatcttccttcactggaagtggcgtctacccagacttatcttccttcactggaagtggcgtctacccagacttatcttccttcactggaagtggcgtctaccctgacttatcttccttcactggaagtggcgtcatccaaaccttcgtagcctgtatcaaacgatccactcctactcagattgactgggctcatttggttcggtaccgaatgcttaaggcattacgggccaatgcacctctaccttacccacaattgataactttgtttctgcgtcattttcaaattccgtttgatgatgaaccatttgttcaagtcaagcgttcctttgcaattggtgctggtgcagtgacttcctttggttaccgtaaggatcggaatgttcaatggctgaagaaggacgcactccctcctcaagatgagc

SEQ ID NO: 92887 - DNA, 363 bp, Glycine max
  Peptide Sequence Number=SeqID_209665
atgaaacaggccaatgtattcccactgaagaaaacactcaagaaattcattatatgggaaatcaacagtgacaagggtatactcaaggaggattttcaagcttcctacaaggtccctataatcaacaaggacagtggaggacacaccctggtagcaatgtcaaaccataaaagcactgagtcagcactgaagaaccttgaggtccagaatcccaaggaggaatgcaaagttgtgatgacaagtaaaaggtttgtggaggctgaggatgaggatagtgttgtacataagaagaaaactgctgacaagaaaggtactgattgcaagaaaaataaggtgagaggtgaaagtaatcaagaaaaatag

SEQ ID NO: 92888 - DNA, 246 bp, Glycine max
  Peptide Sequence Number=SeqID_209666
atgagttctggatgcttgctagtagatcccaacggtcaaaagcttgtgctgtttgaatgttgtattacttggatgttagggaagcttgggaggattgatggggacccggtattgagagaaacgaggatatgggctatgtgggagtacgtgagctcagttggaggtgggcaacaggggatggtgggtttatgcgcgctttgtggatgtggaaaacttgttgtgcaccatatcccgaccgccacctag

SEQ ID NO: 92889 - DNA, 270 bp, Glycine max
  Peptide Sequence Number=SeqID_209667
atgagggagcgggtgctccaaatttctattttccctcccattcttctcattccccccctttattggtgcagtgtgcagagcagtgcccttcactctctttgtcgtcggtgcagtgtcttagctccctcgctcgctccaggtgtttctgtggtttcagaacctcagggctcgagaagaaccagatggggaagaagaaggctatgtaatcctccatggtacatcattctagtaaacttcattgaagatgagacttgctggagaagatgctaa

SEQ ID NO: 92890 - DNA, 312 bp, Glycine max
  Peptide Sequence Number=SeqID_209668
atgcaggcaattgaaagattgcgtttaaaggcgatgagcgatgcaacaaaaccatccttgatcggtgaacttccatcctcaaaagttgtctgtggtggctaccacacctgtgtcctgacaaattctggtgagctttatacttgggttcaaatgaaaatggctgccttgaggctctttgctatgcgaaggtatgggggagggatgttgtacgcagccttacccttgcatatgcaaagaggctgtttccggattcgaacccatgaccaacaagtcaccaaggcacaactttaccgctgcaccagggctcgctaa

SEQ ID NO: 92891 - DNA, 543 bp, Glycine max
  Peptide Sequence Number=SeqID_209669
atgcctgtgttggagctcataaattgttctcctttcacagacaatggatgcgtttatgctactggtcttaacgattttggacagcttggtgtatcagagagtaaacactactcagtggagccactttgtgtttttggagaggagaagaaagttgtgcaggtctctgctggttataatcattcttgtgcgattacagtggatggagagctatacatgtggggaaagaatacaagtgtgcagcttggacttggaaaaagggctccaaacatagtgcctttgccaactaaagtggaatacttgaatggaatcaacattaaaatggcagctctgggttcagaccactcactggctattagtgatatgaattgtatgatgataaacttgtatgacagcggaagcaattttgagaccatccatgataagtatggtcccaacccaactaatttcatcatgatgcattgtggacctatggtggagaggcctttagttggggagttggagtgtctggtagacttggtcatggtcatgagtcaagcatcctag

SEQ ID NO: 92892 - DNA, 231 bp, Glycine max
  Peptide Sequence Number=SeqID_209670
atgacattccattgtttcccacttgatcttaatgctaaacccgatgaggaggaggaaccaatttcttgctccgaggaagcaagtgccaacattggtggagagtgtgaaaccagacccgcaacttctgaaccagacgacaacattcgagcagaagttgcagttattgacagaaccaacgttgttaaacgaggatctactctgagaataaattttgtatttggaacttattaa

SEQ ID NO: 92893 - DNA, 408 bp, Glycine max
  Peptide Sequence Number=SeqID_209671
agggagtggaaagaagaagttgacttcttgaaacttttattctccactctctttccctcattccaaaccgaggttaaaagaaaaccgaagaatactcagtttgacaaagttgaacaaaaagtgaacctgttaagaagagggtgtgagcaccaccacaagcaatggcctttagggttcggtcgcggaacgcggggcagacgacaggtttccattgcgaatccaagttgccaagacccaattctcccaaaatcaccgttcccccacaacgccacgaacctcttccccgaagctctgagactgaggtggtggagcttcaagaagtttcggcgccacatttgtccagagaggaaaaagtggatggtggagaagggtgaagaaggaggttgttggggtgaggaggaatcatga

SEQ ID NO: 92894 - DNA, 252 bp, Glycine max
  Peptide Sequence Number=SeqID_209672
atggcttcgaggcacttactgctttctctatttcccatagcccctccaccactgcttccatccaaacgtgattctacttccatccaaacgcgtagctctttctccatggaatggaacgcgggggaaaggaacagacagggtgacatggagaagaggaaaagacgcgaggataaaaaggaaagaggaaaagacacgatgagaaagaggaaagaggaacagaagaggagaaatgaatgcaagggaaaggaatga

SEQ ID NO: 92895 - DNA, 750 bp, Glycine max
  Peptide Sequence Number=SeqID_209673
atgttgctagagcagttcgaaagaaagttaaattcaatctatggatgtatccataaatctcttgactaccttatgcagtttcgaaatggtcagatccagggaaataatttgatggacgttttgtttgaaaaaaatactgcttctactctggaagttggggttactagccacatagttcaaaataagaataacctccctattttgggaaatccgcatccaccaaaaaagaggaggttagaggaaaatcaggttcggatacctagtggaaaaaaaattgttcaaggcttgcaaggaacagggccaccccagagtgcgggttggatgcagcaagctcttgatgaatctgtgcgtaatgtgcttacttctgcgacttccaccatttcctaccaacctatttcttctgtgacttcccctgtttcctatcaacttcctgttcctatttctagtaccaatgttaaggtgaatccagggacaacttctcatttttccttaaatgcaggagcttttggacatccttataacccaccttccataaagcctcatgttgcacctcaaacttcccaagatttttttgccacaggatatgtagaattgtacctgctagttacgggagtagtcgtcattgcctatcacacggcagatgtgcttgccagcacagagggcctgggtcatgttgacgaaggtgttcgtcggcgcggagggcctgggtcatatcttgtgccgttgactgaatgttgtgatcaagtgtga

SEQ ID NO: 92896 - DNA, 5667 bp, Glycine max
  Peptide Sequence Number=SeqID_209674
atggctcaacaacgcgccacctccgatactcgccccaacaacctcgccgtcacaccgccattgcagatctccaaagatgtccaaggatctgacaatcccattccactctcaccacagtggcttctgccaaagccaggggagagtaaacctggatcaggatctgtggagaaccatgtggtctcaaactcaccatttggccatcattcagagactgttaagacatctggaaatggagaggatgttcttgatacccataagaaaaaggatgtctttaggccatccatgtttgactcggaaagtggacgtcgtgaccgttggcgtgatgaggagagagacactaagtcctccatccggaaggatcgttggaaggatggagacaaagacctaggtgattctcgaagagtggatcgacggacagataatttgtctgcaaagaactttgcagaagcacgccgtggtgcatctgataaccatagatggaatgattcaggaaatcgagaaactaactttgaccagcggcgtgaaagtaagtggaacacacgctggggtcctgatgacaaggagccagaaggcattcgtgaaaaatggagcgactctggcaaagatggtgattcatatttggaaaaaggtttgtttaacatttccaatcagggaaaggatgagaaggagggagatcactatcggccatggagacctaactactcacagagtcgtggaagggtagatccttcccatacgaccccaaacaaaccagcctctacattttcctatgggcgtggccgtggggataatacacccccagtctctagtcttggacatggcctggctggttcttttggtagttctttgagtagcacatacccaggaacagcattggaaaaagtcgaaggtggccgtgaagaaaatcgcccctttaaatataatcggacaaaattgcttgatgtgtacagaatgactggtatgggtacagatagaaaactagttgatgattttgtgcaagtacctaatcttactcaggatgaaccagtggagcctctagcttttctggccccaaattctgaggaactgactgtcttaaagggtattgacaaaggggagataattagcagcaatgcacctcaggtgccaaaagatggaaggagctcaacagattttactcatacaagacgaatgaaacctggtagtgcacctttccaatatagaggtgaagatggaggttcttacaaagtgcctgatgaggtatccagcaatagagattcatccgttgaaggaaatagctctgttcatcctggtgctccatggcgaacaatgccgatgggagaacatgctaccgcccagtttcacgatagcagagatgtaattagtgatgttagattcagaaaagcagatctgaactcaccccaaccaaaagatcctcataatcagtgggagaataatttgggttatttatctgaccccaaagaagtagctaagtggcaagctaacgaagatcctgtcattaagaggcagttgtctggcattttggacagtgaacttgaaaccagaagagttccacagactgctccagaggagttatcccttttatataaagatcctaagggtctaatccaaggtccatttaaaggaattgatattattggatggtttgaggttggatattttggtattgatttacctgttcgtctggaaaattcagcggtggactcaccatggttttctcttggtgatgttatgcctcatttgcgagctaaagcccgaccaccacctgggttttctgcaccaaaagcgaatgactttacagatgttcctggccagcaaatttccagtacttttgggaatacccttgctggtttgaatgaggttgacattttgagaagtgattctgggcataggcagggttcggatactgaagctgaaaataggtttctggagtcacttatgtctggtagcaagaacagtcccccccttgataacctgacattatcagaagggttacaagggtttgttggaagtaatcctggtaatatgggcccatcaggagttgatagtggaaataatctttacttgcttgccaagaggatggcgcttgaacggcagaggtccttacccaatccctacccatattggccggggcgtgatgcagcagcttcatttgctccaaaaacggatgttgtaccagatgcatcattgcattcaaaattattgtattcagtgagtgataactcccgtcaacctcagtcccaaagttcggagttaatgtcaatcatccaaggattatccgataggatgtctgcaggcttaaataatggtgctgcgggatggccaaattatcccttgcaaggtgcattggatcccctacagaataaaattgccttgcttcatgatcagaattttcctcaaatgccatttgggattcaacaaagactgccgatacaaaaccaattgtctttaagcaatttactggctcaagctgctgataacccgtctaacactttgacagcggagaagctactttctacaggtttatcacaagatccacaaatattaaatatgctgcaacagcaacacttgttgcaactgcattctcaagcagctgctcaagcacagcagatgcccttgattgataaactcctgttgctgaagcagcaacagaagcaggaggagcagcagcagttactgcgacaacagcaacaactgctttcacaagtgttgcaagaccaacagtctagccagctttttaacaattcatcttttggacagttgcaaggtgtaatacccttggggaatttgcgtgttgatccttctcaacttcaaccaccacaagagatctttcccatgagctctcagatgccaattcccagtgtgcataatgaccatagttctaattctttgaatttaccaccgaaagatagtcaagacacaagtggtaatgtaagcagtgaagcttctatacatctgcctcaccaattatttggtggtaatagttgtccagaaaattggggccctaatcttacggaacaaattagtgaaaagtctagccagctttttaacaattcatcttttggacagttgcaaggtgtaatacccatggggaatttgtgtgttgatccttctcaacttcagccaccacaagagatctttcccatgagctctcagatgccaattcccagtgtgcataatgaccatagttctaattctttgaatttaccaccgaaagatagtcaagacacaattggtaatgtaagcagtgaagcttctatacgtctgcctcaccaattatttggtggtaatagttgtccggaaaattggggccctaatcttactgaacaaattagtgaaaagtatcagaacaaaaccttccccatatcaactcttgttgagagttctccgttgcttgatcagaacagacccagagaggaaccacacattgggctggaaccccattctgtttctgattacactgctaactcagtggagcagttgccacctagcaattttacacctgatgttgtcgtgacctcaatttctaagcctgatgagaactctggacatctacattgtgttgcacccaccattgccttatcttcagctggatctaacaggattgagttaccacctgtgagtggtcctggtatggaggtgaagaccaaattggatattgtgcatgaagagcaacattctggaagagacatctcagtatccgagccctctccagcagacatacgaagcattaaatctcatgaacccaaaaaggctaccgagaagaaatctaagaagcaaaaatcagccaaatctcagtcttctgatcaaacaaagggagtgctaaagagtgtcacttcgcagccagcaaatcaggcagaagttgaaataccaaaattaagtgagttgggggaagccaacagggctgaatcattacatgaaacaaacatgcaacaaacaagagttaagggaactcagattggaagtgcagtcatagaggcagttgatcaccaacaagctggtggctggtctgctaatgttactggcaacgtcactggatcagttgatgtgggtgaggccaaggcagctagctctattgtgatgcagaaagctgaagtacctgcaggacgagcttggaaacctgctcctggtgtcaaaccaaaatctttcttagaaattcaacaggaagaacagaggaaggcagagactgaaatgcttgtatctaatattgctgtttctgtcaattcaatgagtctggtaagtccctgggctggggttgtgtccaatccagactctatgaaagtttctagtgaaagtcacaaaggagccaatacagaatatcctgttaaatctgaaacttctcaaaatcttaaaagcaagaaaagtcatctacatgatctattagcagaagaagttttaaagaaatctaatgaaatagaagctgaggttctagatagtatattgcccttacataatatagctgtacgttcagaatccgtggatgatggcaattttattgaggcaaaagatactaaaagaagccgaaaaaagtcaggaaaatcaaagggttcgggaactaaagcttcattgccagttgcatcttctgaggcacctatagtttcaagccccattgaaaagggaaaaaactcctgttcagcacagcaagagaaagaagaattgcctgccatcccagcaggaccctctctgggagattttgtactatggaaaggagagcgagaaccaccaataccatctccttctccagcatggtctactgattctggtagagttccaaaaccaacttcattaagggacattctgaaggagcaggagagaaaaggctcttctgcaattcctgtgagcccaatgcctccccctcagaaatctcagcctcctcagtctacatggagcagtgcttcgtcacggtcaatttcagcatcctctccatctaaagctgcttctccaattcagataaattcccaagcttctcaatcaaagcacaaaggggacgatgacttgttctggggtccaatggatcaatctaagcaagatactaagcagtcaggtttccctcagcttgtgagccagggtagccggggttcgaaaaatgttcccttgaaaggtaattctcctggattattgacaagacaaaaatcagtgagtggcaaaccaactgagcggtttttagcatcatcacctgcctcttctcaatcagtgctgaagttgaaaaaagatgccatgacaaggcattctgaggccacggacttcagagattggtgtgagaatgagtgcgttaggcttattgggacaaaagatacaagtttccttgaattttgcttgaagcaatctagatcagaagctgagatgcttcttatagaaaaccttggatcatatgatcctgaccatcaattcattgataaattcctcaattacaaggagttgttaccgtcagacgttttggacatagcttttcagagtaggaatgataagaaagttactggatatggtgtggaaggcacggcatcggttagtgcagatatactggatgtggactacactgaaggatcctctaaaggaggtggaaagaagaaaggtaaaaaggggaaaaaggtcagcccatcagttttgggatttaacgttgtgagtaaccggatcatgatgggtgagatccagtctgtagaagattaa

SEQ ID NO: 92897 - DNA, 474 bp, Glycine max
  Peptide Sequence Number=SeqID_209675
atgtccgaagttatgagatatgtggattctgactatgctggtgatctagatgatagaaggtttacagcaaggtatgtctttacttttggaggtgagcctgtttgttggaagtccataattatatctcttgtggcaatgtcaacaactgcaacagagtacatgatagtagcagaggctatcaaggaagctttatggttagtagggctagtgaaggagttgggcattaagcaaggtggagttcagttgcattctgatagtcatagtgttattgacttggcaaagaatcaagtgtatcaatctaaaaccaagcataatgatgtgaggttccataagattagggagttaatgacatctggccagattttgctcaggatggttcacacttcagagaatgcaattgatatgttaaccaatgcaattacaattaggaagttcaagcattgtttagacttgttgaattttgctcagtgctag

SEQ ID NO: 92898 - DNA, 378 bp, Glycine max
  Peptide Sequence Number=SeqID_209676
atgaaaggcaacaactaccaggacaagctattgtggaggagcaaaatagctttgccaatgctgctgagaaacgtcacttttctaacaaaggacaaggagtttcttatgatggtgctaagggaaatcccactcacaaaagtggaaatcaaggctcaaacaaagagtggacacacaagtcacactgtgggcgtttgttacagcaagcacggacaacctcctaggcatcctcgctatcccgaaaggccaggataccataatcatgcatccagtggagctgctgccaacaacatcactgcaaatgcagtccatgaagcaacaaaaaacaatggaaatgaggaagattcatttggactaagtttgaatgtcgcaccagcataa

SEQ ID NO: 92899 - DNA, 780 bp, Glycine max
  Peptide Sequence Number=SeqID_209677
atggcatcaagagatctggagctcttgattcccgtttcaagcatttcagaaaatggccccaaatcatctgctccttcatctcctagcgttacgtccacccaaaatcactctagccatgaggcgttttcaaaagtgattcgcagttgggcatcaaaaaagtttatgtcaggatgtgtcatcctccttcctatcgcaataacattctatgtcacatggggatttattcgctttgttgacggtttcttctcccctatatataatcatctaggaattaatatttttggtcttggatttattacttccatcactttcatatttttggttggaattttcatgtcatcatggttaggaacttcagttcttacccttggtgaatggttcatcaagaaaatgcctcttgtaagctatatatatgctgcctctaagcaaataagtgcagcaatatcaccggatcaaagctccaaggctttcaaagaagttgccatcataaagcatcctcgtgttggtgagtatgcacttgggttcatcacttcttcagtggttctaaggaacagagatgagaaagagcttttttgtgtttacattcccaccaatcacttgtaccttggtgatatttatctcatcagcccagaggatattctaagacctaatttgtctgttcgtgaagccatagaaattgttatatctggcggcatgtcaatacctcaaatattgaccactgtggatgctgatcatgccaaatttgctccaagaaagccaacctatgaatcaaaagtataa

SEQ ID NO: 92900 - DNA, 900 bp, Glycine max
  Peptide Sequence Number=SeqID_209678
atgacagagctagtggcacatgttgaatgtcgttatcgaactccattagctgagtccagaactgagcctgcttcatcacccaaatgcaacatgtatatgactgctgcccagcatatatacttgaatgttaagaaagaatttcttacacaggaagctcaatctgaaggaaattatgcggaagctttaaagaattattatgaggctatgctactggaaattgatccctatgatcaggattcacttcatacacgggagctcagagatcctatattaccatttgtgcatttaaccattatcgcaatcaacgaagggttgtctcgtctcccattttcttcttcagctattgtctttgttattccgagtggcaaccaagtggtgagtagtgaccaaagcaaacgcactcactctattattgaagggaagatgaaagatgaagatggcacaccccaaagtgcaggtaagggacagtacaagttgtgggtgttgggtgctatcattcttcttgctctttggtccatgttcactgcttctctcactctcaaatggtcagctgggaacctcaaccgtgacttcgattctgccactctcaacgatttcgatgtcctggaagtggaggagagggagaaagtggtgaggcgcatgtgggatgtgtatactcaaagcaagagtggcaggggaagtggcttacctcgtttttggagtgatgcttttcatgcggcttacgaccacttggtcagtgatgttcagagcgtccgagatgctgctgtctccgaaattgccaagatatccctccattctcttcctctgcaccacctcaaatcacattccaatatcatgggatcacgaaaaatgaagcaagcagagagtattgtgaacactacaattagcagtgatcaataa

SEQ ID NO: 92901 - DNA, 228 bp, Glycine max
  Peptide Sequence Number=SeqID_209679
atggaagagaaaaagatggaaaaagaaaaaggttctttctctctactcttggcttatgcatccgtttccgttccattgtttagcatgaaggctactttgaaaggcagctacgacatcggaaaaaacgccggtgctgctgccactctcgccgtcaacaccagcgacgttaagctcaaggtttccataacggaagccactttcaaaaacagtcccaggctaaacggttaa

SEQ ID NO: 92902 - DNA, 2544 bp, Glycine max
  Peptide Sequence Number=SeqID_209680
atgaataataaacagattcttctcttccgtgaaatctctcttcttctctttgtttcttggagccgacactcgctcgaagagtgcaattttcgatcacctagacaacaaggtgcatcattggtgctttcatcgatcatggacccttccgatatcatgaacgcccttcaatccaaattggacgctcaggcaaccatgttccgagaacttattcgcgacactctcgaatcccactccgattcgattcagacaatgttacatcatcaccttcaggaggtcgattccaaggttgccgctagtcacaatgttcaatctcacagatcaaattttgtaacacacaacctcaaattgaatgtccctcgctttgatggtaccaacgtgatggactggatttttcagatcgaagcattcttcaattttcacgacacatcagtcgacgcacgcttgcagattgtgtccttccacatggatggtcgcgccgccgcttggttccagtgggcgatgcgtaacaacctattgacttcgtggcaggtttttttggagttggttcgccaccgtttcggtcccactgcttatgaggatgttgaaggtgacctctccaagctgtctcagacgagatcagtggcagaattccaggcccaatttgaggacctcatgaataaggttaacgacatctctgaaaccttgcttatcagttttttcatcacagggttgaaacgctcgttacactgggagctccaatttcatcgtcccgcttctttgatggaggcatttgctatggcgcgtgcgtatgaagcacgtcaggatgatacactcggcccaaacaaaaattggattcgaaacaattctctagacactagccctcaaactcaggcccaaaaactaactcaccaagccccagttaaacctacatcatcttcgactctgccacccctccttccaacaccacaaaataatctccctgttcgccatttacctccggcggagcttcgtgaccgtcgtgcaaaaggcctatgtttccggtgcgatgacaaatgggggccttcgcatcgctgtaaaagcaaggttttactcctccttggggttgatgaagatgcaccggagattgacactgacgattctcaatccgaagatgtttccgacgacatttcaagtttgcacgctctttcgagccaattgttgggtcgttcactacgtgtttccggtgtttacagtgcacatcaatttcagattctcatcgacagtggtagtactcataattttatcaacccggcattggtggaacgtttagggttggagatgacaccatgcccacgctttagggtcgcgactggttgtggttcgtcactcttgtgccaatattgttgtgctgctgtccctttaaaattgcaaggtatcacttttttggtggatttatttatgctggcaattgaagtccctgatgtggttctagggttcccttggttgcaactcttgggaaaggttagccatgattactcggcactcacaatggagtttacatggcaaggtcaaccggtaacgttgcaaggtgactctgtcccggtttctcattcagtttccttgcttcagttccaagctctattgcatagtaatgaagttgctgacatttttaccatcaccacatccacaccagactcgcccaactcggaacacaaccagtcagactttccacctaacctacccctgtctatcactgcggtcctacaacgttttaagagcattttcatgcccccatccgggctaccccctcatcgatcagtcgaccatcgcatccacttggtggaaggcaccaatcccattaatgttcgcccttatcgttatcctcaatttcagaaaacagaaatggagaaattgatctgggagatgcttgatcaaggtatcattgtacccagtcatagcctggccttgaacaccgccaccatcaaagacaagtttcccatccccaccattgacgaactactagacaagcttggtggtgcctctgttttcactaaacttgaccttcgtgcaggttatcatcagatccgggaatcgattgattatctcggtcacattgtcttttctcaaggagtccatgccgacccgggaaaattggacgccatggctaagtggcctgtgcctaagaatgttaagcagctaaggggttttttgggacttactggatactatcgcagatttatcgctaattacgcagcattcgcattccgggccttaaaggatgctatgatggcttcccctgttcttcgactccctgatttttctaaagaatttattatcgagacagacgcgtcaaatgtgggtatcggtgctattttgatgcaagaaggccacccaattgcattctttagtaagaaattgggtccaaaattacaagcagcctctgtgtacatcaaagaattatatgctattactgaagttgttctcaagtggagacaatacttgctcagtcatttttttttgattcggacggatcacaagagtattcgtgaactcctacagcaagttatccaaactccggatcagtag

SEQ ID NO: 92903 - DNA, 504 bp, Glycine max
  Peptide Sequence Number=SeqID_209681
atgccgctgtcgccgtcgacgcttactctaacaggtgtttcactcatccgtcacttcgccaaagcctccctctatcgtcgcgcgcattctttggtgccagaccaccctcattcaatgcaaaatcatgaggctttaatcattgggcatcttttatctctagaccgtgggtttgattacatttcaataaaaatagctttggctctgaacaatcttaacaggacaaactcagatgcattaaatgtgaggttaaaactagaacatttaaatattgcaaattttgagcctgagtatggactaaatccaatgtttcatttcgctttggttggatctgagtggcaagtcagaattcaaggtagagctagcaattggcaggacaaacttgtggtgacctcaacactttctgtggaaccggttgcattcccaaatgattatcttgttgggatggaatcccgtatagaagaattagaaaagcttttaatgttcagatcaattaatgtcgtttga

SEQ ID NO: 92904 - DNA, 324 bp, Glycine max
  Peptide Sequence Number=SeqID_209682
atgcaggacgagaagaagatgaaggtgaagaaaggattccttggtgttcaagtgggtttagaagacgacgaagaaggtggctattcccctcaaagattcgtgatcccaatctcttacctttcccaccctctcttcaagcgccttctggacaaggctcgcgaggtttacggctaccacaccgatggcccactcaagctcccgtgctccgtcgacgatttcctccatctccggtggcgaatcgagaaagagtctgctccaaaccaaaaccaccataaccacagccaccatcgccttccacacgctttgcacttccactcttgttag

SEQ ID NO: 92905 - DNA, 456 bp, Glycine max
  Peptide Sequence Number=SeqID_209683
atgccattttatggttatagagttgaggttttgccatcgatgcctatagaaggtactttttctatagcaattatggttgtgactgaggatatggtggaaaagtggcagttactcaactcttttgtgagcaggaaaaaagaatattttctgactgttcatagaccattcaacgtgcatcaaacaaagtgtgaacatgagaactccaaagatacagacttcaatggatgctgctggataccagacatagcagaaaatgaaagacaacagagaatgccagttcaaacagaccacctatttgaagagtttactctaggcataggcatagagtgcaataactggcatgaggtagctattttaggagtatggcagttatatattatgtccgtaattagtatagagtgcaataactaccttgggattatggcaattatcatatcagtaattttcacaatgtag

SEQ ID NO: 92906 - DNA, 562 bp, Glycine max
  Peptide Sequence Number=SeqID_209684
atggctgagggttttgaggcttaccatgtgccacaacaaagcagaagagataagctgagggttgtggcgacacagaaccaacatggtctcgttgagccctcgtctttgcttcctttgtacgacccttcttcgtttatatcttctgatttgttgacaagcttccacaacggccaaaaacacaacttgggttgtggtatgaaggaagaacgtgcgaatttgatgatgggttttgcagcagcagcaggagggggaggagttatgaacaacggctcttcttcttcgtgttgttcttctaactcctcttctgtttcttacttggatcctgaatcgtctttgcctttgaaccaagccacaattcaggttattaacaatagcaacaacaacaacatgtttctctaccaagcacagaacctgagagagtttgatcagggttataataataataacaacaataatagtgaaatcatggtgtttaagcccgagcctttgtctttgtctctgtcatcacacaacaacggtgtgaatcttcagcgatatggatctgtggtttatggtgatacag

SEQ ID NO: 92907 - DNA, 421 bp, Glycine max
  Peptide Sequence Number=SeqID_209685
atggccaagtatgatacgtttttgagcttcagtggtgcagagacacgcaacctagtcgcttccctctacaaagctctcctaagagaaggcgttcatgccttcacagatgatcaaagtctcaacataggcgaacaaatacaacccgcgctgtttaatgctattgaagggtctcgtgttttctatgtggtcatctccaagggctatgcttcctctatttggtgcttgcaagaactagcacggatctgctactgcgttgaaacttcggccagacgtgttctgcctattttttatgatgttgatccatcagaggtgcgaaaacagattggatgttttgggaaagcctttgcgaaacacgaagaaagactcagaggagataaagagacgatggaggaagtgcagagatggagagaagctctcacac

SEQ ID NO: 92908 - DNA, 180 bp, Glycine max
  Peptide Sequence Number=SeqID_209686
atgaagacacatatgaagggtgatatagacaagagaagaaggaagttcagatctcgatacaagaatgttgagtgtcattattgtcacaaaacaaggcatatccagaggaattgttttctatggaagaatgagagtaaagacaagaagccaggaatgagttcttcacatcttacacttcag

SEQ ID NO: 92909 - DNA, 381 bp, Glycine max
  Peptide Sequence Number=SeqID_209687
atggaattttctattgctagtagttcacacttagtcgcggaaatgagtgggcttattattggtcctcttgggtctgcgattagacaccctgctgctggtgttgctatcatttccctcgcctggaagaacaaccttgtccccaaggttgctggccgcaagtcaggtttcgtttggtccttggcagcttggactgttaggatttgcgcagttgtgtatgctgttgcagtggcagtgtcattgattttggaaaggcctctgatcccagttgtgtatgctgttgcagtggcagtgtcattgaaatccggcaatactggcactattggtcttgggagctgtccatttatttgttgtggctggcagatttgtattctaggattgtag

SEQ ID NO: 92910 - DNA, 1182 bp, Glycine max
  Peptide Sequence Number=SeqID_209688
atggggccatttactggctatgcttctatattgaagggatcgaggttcttgaagcctgcgcagcaattattggaagagttatgtgatgttggtggggtttgtgctgagaagattgtggctgatgcatcattaatggagcctattcctccagagagttcaagtgaagatccattaggggatcatgggggtgatcagggtcgcaaaaaatctaggctcttaactatgcttgatgaggtttacaggaggtacaggcaatactatcagcagatgcaagcggtagtaacttcatttgagtatgtttctggcctgagcaatgcagctccctatgcaagtttggctataaaagctatgtccaaacattttagatgcttgaagaatgcaattactgatcagattcagtttgccaataaagctcattttcatatcagcaacaggaaagatgaatctccaaggtttggcaacagtgatagaggcccatatggccaaaggcctgggtttcttgagcaccaacctgtttggcggcctcaaagaggactccccgagcgcgctgtgactgtcctcagagcatggttgtttgagcactttctgcacccttatcccactgatactgacaagctaatgttggctaaacaaactggtctatctcgtagccaggtgtctaattggttcattaatgccagagtaaggctctggaagccaatggtggaagaaatacatatgctagaaacacggcaagctccaaagaatctgcagaaggaagaacattgcacgaacaagccaagtgatcatttgccttctgataactccattgtttctgagaatccatctacttccacagataaatttcaggaagctccttacaagcgtgccataaacgagcttcctaacataccagtcaggactcaggaacagctgaatcttccctgcacaagcaatcagccagggggtgttggagtgagcatgggtggcagtgcaagcaatagtgtgtcactcacactaggcctctatcaaaaccatggtattggtttggctgaacctttccccttgaatgcagcgcagcgatttggtgttgctcttgaaaccaacaatgaaggctacgttatgagtgattatgagtcacaaaataggcattttggaagagatgtcattggaggacaactgttgcatgactttgtaggctga

SEQ ID NO: 92911 - DNA, 1155 bp, Glycine max
  Peptide Sequence Number=SeqID_209689
atgcactaccctcaaggacaagatagaaaaattgagggcagttgtagagatttgtttaggacaaggaactttcacgagagcaagaaaggaagcatgataggagtcaagagtgcaaccaaactcgagagacaacgaaaccacaactccaggatgggacttcctcacccgaaactcggatttgagatgcacaatgattccatggtagtcaaaatggagattgctagtttcttagtgtggaaggtccaaattgacctgggaagctcggcggataccctctactggtctgctttcaaacaacaagatatcccagaaagccagattgagttgttctcagaacaactcataagcttctcgagtgagacaattgaaacaatgggacacgtcaacttgctagacacttttggagacgataaagattccaagaccatcatgatcagccgaccaagcaatgacataggaatgttatgcttcaagcctcaagattaccaagggaaagaagagcccactgaagaagtgaagcctttccaactcgacaaagaaccatctcaatgcactaagctaggattccagatgagtatagaagtggaagagtcaagagaccaagtgctaacaaagaatgctgacctcttcacatggtcaacatcagggaggactctattcatgatcaacactacaaattattgctacttggttatgccattaagttataagaatgatggggccattacaaacaccacttcttatgtgaaagacttggcaaagatctttgcagatgtaagaaagcacgacatgaggctaaatcctgagaaatgcatattcggaggaaaaaggaagaaattccttggattcatgcttacccatagaggaattgaggccagcccagagaagcgtggctcacgggtgcgctttccaaaagaggaaagatgcgcggagtcgccaccaacgtttatttgtggaaaacgtcggaaaaaccgaaggaaaccggtcgaaatgaaaattctaagttcgggagttgtatttacgtttgaggaaggtattagcacctctcacgttgacaaaagcgagacttttgctcctacgtaccctccattgaagaggaaatcagacctacgtagttctttcttaaccgtgaatcaagcgattctttttacttga

SEQ ID NO: 92912 - DNA, 1056 bp, Glycine max
  Peptide Sequence Number=SeqID_209690
atggtgcataagagttgcaggtttctttctgagagatgccccttaatccgtgcctatggagctatccgtttcaatgcaaaagctaaggtgtcatcagagtggctggcttttggttctttctacttcatgattcctcaggttgagttcaatgagcttgaaggaggatcaatgcttaccataactattgcttgggataataatctttcttggtcatgggaaaatgcaatcaatgccctccaagaaacactacgcaacgtttcttcttccattgtgaagtttccaaaacaaactcctccaacattaatatcaagcagccataacattcctagtaaagtagactgggatcttgctgttaatggagctttgcagatgataaagcgaaatgattccttactaactaaggttgtgctagctcgtagcactagagtagtgcctactgctgatattgatcctcttgcatggttatcgtgcttaaaggttgaaggtgaaaatgcttaccagtttttacttcagccaccaaatgcaccagcatttattggaaacacaccagagcaactatttcacagaaaatgtctccacattactagtgaggctttggctggaacccgtgctagaggagcatcacaagcactagattgccaaattgaacttgacttacttaccagtccaaaggatgacattgagtttactatagtgagagacaccataagaagaaaattagaggcagtatgtgaaaaagttgtaatcaagccagagaaaatgataagaaaactccccaggattcaacatttatattctcaattatctggcaggttaagaagtgaagaagatgagtttgaaattttgtcatctcttcacccgagtccagcagtttgtgggtttccaacagaagaggcacaacttttaattgcagaaacagaaactgaggaacataacttgcactatggcatgaaagttcatgtaaggactggaaatttaggggaattggaaatttggaatatgttgtttgggcagagtgtgatgggaacagaaatgatacttgctcatattatgtga

SEQ ID NO: 92913 - DNA, 525 bp, Glycine max
  Peptide Sequence Number=SeqID_209691
atggctggtacattctttcttttgaaaaagcaaaatagtttagagattatgagcgggacgccacagtttgtccatggacaagggagttttatgctttgtctaattacaccttctcttttgtggggtccctgcccttctccagattcttcttcacagaccatgtggatcctatcattaaagaagctaaatttgaggctgaagctacttctacttccatggctatccaagtatatgatccttcaccctcacatgtttatgttcatctgcatgaagctgaactcgccagaacaaaaaaaatcccttgctcaagccttacaggatcgtgctcatgctaaaaaagaggctcgcaagtggttcatgattggggattatttttataacaaaatcactagatggaaattttatcttcctcctaggcatcttggtagtcatattcatctctcacgtgattttgatgactctagtgatgagtttgttagcaagcttgatgaggaagttgccaaacaaaagggggagaaaaagtaa

SEQ ID NO: 92914 - DNA, 375 bp, Glycine max
  Peptide Sequence Number=SeqID_209692
atgaacagagatgcactggagtatagtagtcaaagaggtttgaagaacctcggagaattagtgagtggtgactacctagcatttgagcttggggaccggtgtacattgtatccatatgtggcaattgctcctgattgtcatccaccgaaatgtataagaccatcaagacctgagaggattggtggcaaaggttgtatgtcttctttatttgattgtttgcttgtggcatttgaggagtggaagactcacccctacaacaaacaaattttaggtattaacgatgtcgaggacactgaggagtacagggaacttctatggcagttagagccgacgtccaaggaggagagtgatgatccttctgagtacacgtcttag

SEQ ID NO: 92915 - DNA, 561 bp, Glycine max
  Peptide Sequence Number=SeqID_209693
atggatgtgaaaagtgcttttctaaacagatacattgaagaggaagtctatgtttctcaaccttctgattttgaggattataaaaaccctaatcatgtgtataagcttaagaaagatctctatggacttaaacaagcaccaagacaatggtatgaaagcattaccaacttcctccttgataaaaaatttgaaaaaggacaagttgataagacacttttcatcaagaaatcctatcattacatcttgcttgtccagggggagtttgaaatgtcaatgatgggggagctgaactacttccttggtctacaagtgaagcaaatgaaccatgaaacttttctccatcaaaccaagtattgcaatgaacttctcaagaagtttgatatggacaaaagcaaggaggctgcaactcttatgcctacaaattgctaccttagtgcaaatgataaagggaagcccattgaccaaaagaaaaaaagagttattttggctggagctctagaggccaaaaatcaacaaaaagttctggaaggaaaaactgcgaaaattgaagctataagctag

SEQ ID NO: 92916 - DNA, 726 bp, Glycine max
  Peptide Sequence Number=SeqID_209694
ggtcttggaaatatttttgaagaaggggagattaatgtcaaggtgctgaagtccctcgacagaacatggcagccaaaggtcataactatctctaaatcaaaagactttgctactatgacacatgctgagttgtttgggaagctaagggaatatgaaatggacttgataagaatggctaaagaagaagcgatagataagaagaacaaaggtttagctttgaagactaaaattccatcaagtgacaaaagtgaggatgacaatgtgaaagggtcggatgttgaaaaatttgaacttgattgtaagaaagttcaacaagcatatataacttgggatgacaatgaatcaaccacaactagtggcagtagtgaagacgaagaaggaaacttgtgcttgatggcaaacaacaatgctgaaagtgagtgcatgataaaaaggtatggagttccaagtgggaagtataaatgggttcccaagggaactaaagaggtgtgcctaatagctgaaaggaaactatggtatcttgatagcgatgactcaaggcatatgacaggagacaagtcaaaatttgtgtctctaaaagctaaagaagaaggatttgtaacctatggagataacaacaaaggaagaattcttggtgtaggtagtatcggtaattccctaactacttccatagagcatgtcttatactcggaagggctgaaatacaacttgctaagcataagttag

SEQ ID NO: 92917 - DNA, 300 bp, Glycine max
  Peptide Sequence Number=SeqID_209695
atggcaagttgtgttggcacttcacctctatatttaccagttggtattggaaattttcctcatgctcatgttaagcttactagaccaaacattgttgggatgaaacccttaccatataacatcagaaaaggagaacttaagattgctacattgcaaaatccatcatcccatgtcagacatgctgctgctttgccaggaattggattggaagatgtgaaaattctgcggaaagaggtgcaagtccccattgagtctaacactcttcagtctgtccactatccttcccgctttcacttctag

SEQ ID NO: 92918 - DNA, 795 bp, Glycine max
  Peptide Sequence Number=SeqID_209696
atgatgaaaattgggttgagaaaagactgtgcaagcccagaggctagaggagaggttctgctcccagattcggacggttttgtcgccgttgcaagaagcgaagatgagtgggataccgtcgagactggaggtcgggttccaagccaagctccaaaccttatcggtgtggaattcgagtctctgaatctcttccaagcaaagcaatctgaggatgagcaagccttcgatcccaagcctcacggccgtgattctaccggtctcaaactcctcggtctcctcctccaatgcacggagtgcgtcaccatggacaaccttgacttcgccaatgacctcctcccagagatcgtggagctctcgtcgccgtacgggacctcatcggaatgcgtcaatgcatacttcacgcaggtgctgcaggctctcatggtcagctcatgcatcggctcctactctccactgaccgcgaaatcgttctcgcacttcaccgtgaaccaggcgatcttccaggacttagacggcgaggatcgcgtccacatcatcgacctcgacatcatgcaaggcctccaatggccaggattgtttcacatcctcgcctctcgctccaaaaaaatccgctctgtgaaaatcaccggattcggatcctcctcggagctcctcgacgactccatcggccggagactcaccgattttgcgagctcgctcggtcttccattcgagtttttcctcgtggaaggcaaaatcagaaacatggagaccgacggtcaagagcatggagaccgacagactgctcattcataa

SEQ ID NO: 92919 - DNA, 627 bp, Glycine max
  Peptide Sequence Number=SeqID_209697
atggagccagaatactgggataagaatccttttaaagcaaccgccaaagaccctaaggacccaaacctaaacacccactccacaatccaaatcctaaaggtaatgcatccacgacattatggctccaatttaaaccaacccaagaagttttctgcaccttttgaccctgcaggatacaattattgggattacattgacgcctggaccaatgtgttccggcaccaaaatagtaaattcaagcattcgtggtatggaaaaaccgaaaacaacaagcagtatccgccgttacaaagacatgcctttgtaaaatggtggtcacaatttgatacctcaaaggctactccagatcaagtcaagaactggtttcagagaaaccctgagttcctcaaacctgctgatccagagacatccttgtttctgaatcagaagtctcaactcgcagcattcttggcaagctcaaagttcaaagaaagtcttgcccagaatctcaaggaagttctccatctacttcaacaagaagaagatgaagaacccccaaaaaaggaggccgaatcatcagaaaataatgatgatccattctaccagaatgaggacgattgttttggtatatcactagatgacgattaa

SEQ ID NO: 92920 - DNA, 354 bp, Glycine max
  Peptide Sequence Number=SeqID_209698
atgaaaggaaggaaggaaagaaaaactttgcagatctggttcgtcaaagggattgcgtgttgttgttcgaatcagagttcaacgtctacggggttgacagtgccgatgggtgccccaacagtgatttggttggtgacaattgtgtttgatggtggtgcgtcgaggtcatggtggtttgggtcatgggtagttggtggtgtttctgggtggcgcgctggtggcggggtggtggttttgggtggcttgagcgatgtggggttgattcaggcaagtggtgtggtggtgtttggcggagcaatggttatggatgtgggagggagaaaggctgcgacgagagaaagagaaagagtgtga

SEQ ID NO: 92921 - DNA, 416 bp, Glycine max
  Peptide Sequence Number=SeqID_209699
atgccaccactgcctatttgggaaaatgttggtggtgattttgagtgtgtttctactttggagggacatgaaaatgaagtgaagtgtgtgtcttggaacgcggctgggacgttgcttgcaacttgtagtagagataagtctgtttggatatgggaagtgctgcccgggaatgagtttgagtgtgtgtcagtgctgcaaggacacacgcaggatgtgaaaatggtgaagtggcatcccacagaggatatcttgttttcatgttgctacgataatagtgttaaggtttgggcggatgaaggtgatagtgatgattggcacattttgatgccaatcccttatggcagtgatgatcttacactgaaggtatgggaaacagaaagagtagggacgcaatctggtggtggatttgcaccttg

SEQ ID NO: 92922 - DNA, 315 bp, Glycine max
  Peptide Sequence Number=SeqID_209700
atgaaggagttgaatcaaggctacatcttaaagcttggatggaatctcataaatgacgctgatgctatttgggtgtgcattcttcgtaacaagtatgggtgtggctctcatactcttcctagtatgaaccacaggaatgttacatctcatacttggaaagctatcactagcttaaggcaccacattgattctgaattgagatgggtggtcaataatcgtcaacaaggcaggtttttggacgaattgttggattccagcccgaatttttacaattcagagaaagtgaaagagaaagatagagaaaagaggaattga

SEQ ID NO: 92923 - DNA, 236 bp, Glycine max
  Peptide Sequence Number=SeqID_209701
ataatttgagtgaaccagatcagacagagtttgtgggaacttttgttaatttgttccatggacaaggccataatatcaaagtaactagttttaaggtagggatatcgaaagtgctcgattgtttagaagctgaagaagatgatgttgtgctagttactttggtgcctaaggttggaaaaggagatgtcatcataggaggcatcaaagttgagtttattccaaagtacaaggattag

SEQ ID NO: 92924 - DNA, 318 bp, Glycine max
  Peptide Sequence Number=SeqID_209702
atgtcgggtcaggccttcaaatccggcagcagcgacatagtgtcagggtttgcagcggcagaggctttttggatgcaccagcaggttgatgccgtgaacgtcacggtaacattcccgcttaagccagagaatcaatacccctcgatagtctcaaatcccggtaaaagtatcagccggtttgtttttatttatattacgccaaaggcaggagcgcaatacaaccgggagctaacatgtggcattgagttgtgttgtgccaatagatatgcgcaatgggttgctacaattgcagtggcgcaaccacttttgtcagtatag

SEQ ID NO: 92925 - DNA, 495 bp, Glycine max
  Peptide Sequence Number=SeqID_209703
atggcatatagatccatcaaccagaatgtgctagcaaatgcaccttgcttggtcggaattctagtggataaaggcttaagtggctctaaccgtctggcgggaaatcaagtatctcataatgtagcagtgatgttcttggaggaccagatgagagagaagcattgtgctatggatggagaatggtggaacatcacaagattagccttaccggtgttgacagtgcaaatagttaggaatattcagaagcagcatcatgagaagcttatacatgagtttaggatgaggtgtggggatgatgatgcagttgattatgttgagaaggtggtcagcaatggtgaggacacagtggcagcaataagaacaatggatgacattcatgaccttttcatagttgggagaggtcaaggggtgatatcaccactcactacaggactcactgattggagtgagtgtcttgagataggggcaattagggatatgctagcaactgtataa

SEQ ID NO: 92926 - DNA, 873 bp, Glycine max
  Peptide Sequence Number=SeqID_209704
atgccgattttgcaccaggtggccggtagccgccagaccgaagctgagcgtttggccgggcaaatgcatgcaaaactgcattatggccgcatgctggatattgtcagagatgggttgcgcctgacgccgcgcaacgggtatgggcaagcggtcaaacactggcagatcaaggtgaatggccaattgacgccatttgaagatgcttttggcaatctctcgcataccctggtcatagaccagacgcatgactcattgctgattaccgtctcgggtgcagtagaaaccgggctgcaaaccgaacaacctgaacaggctctgccaccagaaatttacctgcgggatacaccgctgacacaggcagatgccgctatgctggaatttgcccggccgtttgcgaatgctccgctcaccgagctgatgcaagccctgcgcgaacgtatgcagtacatcaaaggtgcaactcaggtagacacgcccgcggctgaagctttccggcttggcaaaggcgtctgtcaggaccatgcgcacgcctttatcggctgctgccgtagcctggggctgcctgcgcgttatgtcagcggctatttgtttactgtggatggcagcctcatgcaaacgcacgcttgggccgacgtctggcaacaagggcaatggcaaggcctggatgtctctaacggcacattggttaacgagacccatgtcaggctagcacacgggctggattaccgcagtgccagcccggtgactggttcccgcatgggcggtggcatcgaaggcatggccagcgtggtcagtgtgaaccagcaagaaagccgggccaagccacaagaccaggcgcgcttgctgcaacaggcgcaaagtgcgcagcagtag

SEQ ID NO: 92927 - DNA, 354 bp, Glycine max
  Peptide Sequence Number=SeqID_209705
atggacccatatgagatcgtaaaacatcttaagaagatgtacggtggtcaaagcaggacggctatatttcagttatctaaggccctgtttagatcctcatttgctgcaaatgaaaagatgagttgtgacttgcatgagatgcttaatctgctaaatgattatgagaatcaaattgcttctgagaagaagaaaggaactgtcatggtagttggcaagagctccaagaagaaagacaaagtaccaaaaaggaagaatcttggacctaagggtggtatgaccaaacccaagaacaaaaggattaagattgaccaaactgatgctgaatgtttcttttgtaaggagaaaggtcactag

SEQ ID NO: 92928 - DNA, 513 bp, Glycine max
  Peptide Sequence Number=SeqID_209706
atggatttccctagctctcccaaccagcttgtgagaaatgaggatgaatggccaagatttttagttttttttacaagtttaagagaacttgttggacacgttttggtgttggttccaagcccatggaaccatgacactccttgcctcaattgggtagtcttttcttttcgcaaaactataaaaaatggtaggggtagggtttgccaaaaacaggctgaaattatgagatttcgagttttacctcaacctattccggcttgcaacccaagtctactcgttttgactgttgggattttcaaaataatatctggagtatgggatatgatattttcgcctgggcgagtcttgcaagctacaaatacattcagcagcataaaacaaccatttttgcttccttcttctcccctaaaccctcaccgaacaccccaacctcctcctccaccaccactgaccaccggtgaccgctataaaccgcctttgttttccaccaaaccaccacatggagaagaatag

SEQ ID NO: 92929 - DNA, 162 bp, Glycine max
  Peptide Sequence Number=SeqID_209707
atggagttgcagtggaagataaaggagaagaggaatattccaagaatatgccaaaggcatcttaacatattccctttagatgacacaagcatggaaggtgtgactctagcacatgggaagcttccttgggaagcaaggaagaaagcttccttaagaagctag

SEQ ID NO: 92930 - DNA, 420 bp, Glycine max
  Peptide Sequence Number=SeqID_209708
atggtgtgtctattggagtgcgagaatcttgaacacaagggtgagggatcccaagatctcattaacaaagtgttgaaatgtttaagcaggcaatggcaaccaaaggtaactgcaattgcaaaattgagagatcttgctaacataactcttgcaattctttttggaaagcttcaggaacatgaaatggaacttatgagactaaaccaacatgaagaaaatgacaaaaaaaagaaaggaattgcacttaaagcctcatcttctactcaagaagaacgtgacaaagaggacttgaatgaaatagaagaagatgatgatttcaggctttttgtgaaaagattcaatataaatttcctagaaacaaaggaaatcaaaagagatcaaacttcaattcaaagaagaaaggagaagattcctccttag

SEQ ID NO: 92931 - DNA, 162 bp, Glycine max
  Peptide Sequence Number=SeqID_209709
atggagttttcacttaaaattgaaatgccacattttagagttagtgatattgtagcaacgaggcgggtcgttacattaatgggagtgatggctgggcgggatggtcgtgtgatagctgatgccctccgggacttagcccaagactatggggaatcagaatag

SEQ ID NO: 92932 - DNA, 813 bp, Glycine max
  Peptide Sequence Number=SeqID_209710
atggataagtctcacctggtcttgcttctagtcatcaaacctgttgacttacatgcaacaaggagatgtctgggtcgtccaatgatagatcgtctagtgtctaacaaaggttgtgacaaaacaaagaaagcatttagcaatatgaagttatatcatatggatacaaaagaggaaatttgtgttgaacaacctccaggatttgagagtgaaactcttccttattatgtttttaaactcaacaaatccttatatggacttaaggaagctcctagagcttggtatgaaaagctaagttcatttctcttgaaaaatggctttgagcgagaaaaagttggcataactctctttcgcaaaaactatgattcacaacttttattagtgcaaatagagtttgaaataagtatgatgggagagctgaaattctttcttggactacaaataaagcaaacacctaatggtatctacattcaccataccaagtatatgaaagaactattgaagaaattcaacatgaacgatgcaaaagaattgaagactcgaatgcatcctacaatataccttgaaaaggaagaggaatcaataaagatggacggaactcaatacagagcaatgattggaccattgctctatcccatgacagtcaggcttgatatcatgttcaatgtttgcctatgtgtgagatttcaacaagaatcaagggaagttcatctaactacagttaaacatatctttagatatcttattggaactcataatcttggtcttttgttcaaaagaagagaaatttttaggcttgctagcttctaccgataa

SEQ ID NO: 92933 - DNA, 522 bp, Glycine max
  Peptide Sequence Number=SeqID_209711
atggtgtcgaagaaggaaaagtggtacaccataatggtggttcaatgcagcgtggaggttcatggtcatagtcgtgtgcatggcggtgtgatgtggaggtggcattcggtggtgtggtcatggaggtttggggggcagacatctaggttttctagggaaaggaaaggcaagatgagctttgagggccctgaaggcagtggtgaggttgcaagctatatttcgtggttggcaagtgagaaagcaagcaactattactctaagccaaggaatgtggggaactctcaagaagggaaatctgcaaatgagcggtgcaatgaagctgatcctgttaagcaagctgagcaagggtggtgtgacattccaagaactgtggaagaagttaaggcaaaattacaaatgaggcaggaaggagcaattaagagggatagaacaaaggcatattctcagtctaagatggttttaagattctttcttgtaagggtttctgcaactcaactactggcatttttctgttacccatga

SEQ ID NO: 92934 - DNA, 162 bp, Glycine max
  Peptide Sequence Number=SeqID_209712
atggaatacttggtgttcctaaaggagtttgttgatgagggcagcatagtagatgtcatccattcatcccaaggtcttcatgtcattctagcaagagctctagaggcacaaaatcagcagaaagttcgaggagaaattgcgaaaattgaagataaaagctag

SEQ ID NO: 92935 - DNA, 411 bp, Glycine max
  Peptide Sequence Number=SeqID_209713
atggaaaatctagaagaagtcttcggagaactctgtaaatatgacatgcgcctaaaccccgaaaaatgtactttcggggatgagacctgcgaacaagccttcctggttttcaagaagaccatagccacatcaccatttttgagcctacctaggccaggagtacccctactcctgtatctctcagtagttgacgaagccgttagctcagccctcgtggaagaggaagggaagcagcagttccctatctatttcaccagctacatactccatgacaccaagaaacactaccaaaagatagaaaaggcagctaacactcattaccttggcccaatgactcgggccctacttccagagtcatcaagtggtagtcaaaatgaactaccccatcaagcaggttttgcaaaagcctga

SEQ ID NO: 92936 - DNA, 682 bp, Glycine max
  Peptide Sequence Number=SeqID_209714
gcacaagccacacaagcgtcggcctctcccaaaaaggcctaggtacgagcgttacaaacccttaacggccaaacacactacaattctggaggaagctttcaacttagaggagcaagacctagaggacaccaagaggagcaacataggaaccacaaagcagatagaagaagagatagagcagaagactgaggaagacaaagacatctccaacaatggcatgagtgacaacctccacaagaacaagaacccacccagaatattagagtcccagaacatcaacatcaatgcatcatcacaacaaagtctccctcccatgatctttacggataaggacttcaagagtatcaaccctgtcaaccaggataacctcgtggttgtctccatcatcattgtaaacttgatggtgtccaaggtccttatcgacatgggaagttccactaatctcctatattggaaaactttccaaagactcgaggtctcactcgacactgtccacccttacatcattccactcctcgactttacaggcaagagagtagagaccagaggctacatggactgggcagattgtaaccgccaaggcagactaaaagaaagcacaatagtgctaagcagagagcttgaaggtagcattatatcctcccaccagggagcctaccaagcctcactccctagtggttga

SEQ ID NO: 92937 - DNA, 387 bp, Glycine max
  Peptide Sequence Number=SeqID_209715
atggacaggtttaaatgtattgttgtccaaatccgcaatctcaacccaaaggtagcattacactccatgctcctcgctctaagccttggtatgtttgcagacaatctatgcaaaaaatcgcctagtagcatagacatgttgcgtgaacgagtcaaaggctacatccatatggaaaagatgtccaagttcaggaatgagggcagtccagctagtcctacaagcgtcacctccacaccatctgggacatcaaactatgtggatacaccatcagtacaaagtgtccctccaatcaccttcactggtagagactttaaaggtatcaatcctattaaccaagacgaccccatagttgtctccatcataatttccaagttcatggtttcctag

SEQ ID NO: 92938 - DNA, 567 bp, Glycine max
  Peptide Sequence Number=SeqID_209716
atgggtgaagagagagagaccacagggtatgtttgtcgcggccccatagtgggcgccaaatgtatttaccaaaatccagagttgtcccacatcagggtggatgtggccaaagtgggctttaagatctcgcacgtcaaactgagagtttcctttgttaagaggacaagatgggggacctggaaaacaaaggactccaacgctcaagctccacaatctcctacgtcggatttgcaggtgccctccaccgaatttgaagggacttcgatgctcgagtatggtggtaacctcgacaaatctgagggttgtgggcttgtcaagccccccagcttcgataaacattttacggggacgatttttgaagtattactcctcgataacggaggacgagttcccgttcatgcatgctgcttcaagttgtccacccttcttctacgtctaccattgcatgttcgaggtcctgaacttgaccctttcattgaacactttccaatgtgccctgctgaggcacttgagcgtggccctttcccaacttcatcccaacagttaggtgatggtaagggcctttga

SEQ ID NO: 92939 - DNA, 219 bp, Glycine max
  Peptide Sequence Number=SeqID_209717
atggcatccacatcatcaatcacaaaagttagaccaactcacaataatgccatcaaaactaaggatgaaaccattcacaataacacaagaggaaacacgagcgaactcgaacatcttgttggacaagctattcagcgacacccaaccaatcttcttggtcagcttcatttgaaagaagtaaaggaacatgggcacgttgggtttaatattgaagaatga

SEQ ID NO: 92940 - DNA, 153 bp, Glycine max
  Peptide Sequence Number=SeqID_209718
atgaggaaagatcaaggtactggtttgggatacatagcaatggatcatgaagattttatgttccagaaagtgggttttgaatctagagtctccaacttgtacaattgtggaagaatgagaagtcaggaggccatccgttattccatgggatag

SEQ ID NO: 92941 - DNA, 285 bp, Glycine max
  Peptide Sequence Number=SeqID_209719
atggttaggtcaacatctattctagatcttcctcttcctcctcctcgaacaacgagtcaagttaccaatcgccaacatcaaaagcagaagatagctaaggctaaggcaaaattgaaagttattgtagaggtgaaaatgaggttaaaggttgaagcaattattgaaatccaagaaaaagatgtgtctttttccaagaagaataaggcaatgaaggatcttcatgagaaggcgaacaattttgaatccgccatggctatgaaaattaaagaaaatgagagttggtga

SEQ ID NO: 92942 - DNA, 141 bp, Glycine max
  Peptide Sequence Number=SeqID_209720
atggatactaaggatgatatagttgttgagggtgatttggagagtggtgtgattaagattcctatttccttcaaggaaacttggaagcgtaagaaggttgagggaaaaacaaaggtagttaagaaaaataatgaagagtaa

SEQ ID NO: 92943 - DNA, 255 bp, Glycine max
  Peptide Sequence Number=SeqID_209721
atgaccacaaagtggcattcggagatgacagcatggcatgatcaacctgggtgtgtggcgttgagtcatgacgttagatcacatagcttacttggcaacctcgacaaagtatacgagccaatattggttgggaaaaagtaccttctaaggatacctcttgagttcaagtgggtacatcaggttaactcgggtatcaagaaattcatgatcagacttatcgaggatgacactcttatgccttatcttagatcatga

SEQ ID NO: 92944 - DNA, 159 bp, Glycine max
  Peptide Sequence Number=SeqID_209722
atggaggtgatcaacccaaccatgatagaaagtatcacatatgtgatcaattcagtaatcgttctgtctataaagagagagcatcataatgaagaggtactcccacctcgcctagaccggtatattgaaccaaggaacaaagatcatatcaattactaa

SEQ ID NO: 92945 - DNA, 252 bp, Glycine max
  Peptide Sequence Number=SeqID_209723
atgaatataagctttttctctaacttcttcaatgatgtccagatcaacaactatgttctcaacattttgtttttcctcaaaataccttcttattggcgaaggtccatcgacctctattggaatcatggcatcagtgccataggtcaatctaaaaggaatttctttactcgtggagtgaggtggaaggtgccacttccagcaatggaagataagccaaaggaaggcgccacaaaggtgatggatagcccctga

SEQ ID NO: 92946 - DNA, 186 bp, Glycine max
  Peptide Sequence Number=SeqID_209724
atggaggctggatctttgagcttcaataaggtccttcaatggtggttttcagccatggtgttgcagcagaagataaaggagaagagcacattggaagcttccttgagaagaaaggaaggtagcttccttgggaagctagagggagaaagcttccttgagaagctagtgggtagaaagcttccttga

SEQ ID NO: 92947 - DNA, 423 bp, Glycine max
  Peptide Sequence Number=SeqID_209725
atgagttgtttggaaaaagagactaaggtgagaagaggttccaaatggatttccaccttaagggaaattgagcatcacattgatctcattcttggagctttattgcctaactggcctacatatagaagtaatccccaagagaccaaagagattcacaagcaagttgaagaattgatgaacaaagaatgggtgcaagagagcatgagcctgtgtattgttccgttgcttttggtacctaaaaaggaaggaacttggaggatgtgcactaactatagggctatcaataacatctcgatcaagtatagacaccatatccctaggttagatgatttgctggaagagttgcatagtgcttgcatattttctaatattgacttggaaagtgattaccatcacattaggatgaaggaagtggaagaatga

SEQ ID NO: 92948 - DNA, 531 bp, Glycine max
  Peptide Sequence Number=SeqID_209726
atgttgagtattgaaagatctgatatcttcacaaatcaagttagtcaaagcacttggatgggtccaatatggagctacctagtgaatgactctttgctagttgatgaacataaggctagaaagattaaattgaagtcgactcactatgtcgtcattgatgaggaatatgtgaaatgcatacatgaagaaaatcaaggcatcttgggtgattcgagttgtcttaatcccgataggaggtggcgggctaggagagggagaagagatgaagaagaaggatcaaggcaaaatagagttaaaggagttaaactaattgttcctccatttaaaggtaggagtgatctagatgcatatatggagtgggaactgaagattgaacatttgttttcttgccatgactatattgaggagcagaagagggaaaggttgagagatgaggaaccagaggttgatacttgggctgaaatgaggagaattatgagaaggagatatgtgccaaccagctacaataggactatgtgtttgaaactctag

SEQ ID NO: 92949 - DNA, 165 bp, Glycine max
  Peptide Sequence Number=SeqID_209727
atgacaagctgggatctctcaatggatcaaagctctgaagtcaatataaagattgaagttggggagattaagggtagtgccaagagtggcctagagagtagtcgttgtagccagaaatggcatagagaatacttggttgtaatcaaagatttgattagtggatga

SEQ ID NO: 92950 - DNA, 174 bp, Glycine max
  Peptide Sequence Number=SeqID_209728
atgatggaagaaggatttgctgtgaacaagtctcccatgttcaagggagccaactatgaatacgggaaggaaataatgattgccttctttgaatcttctcacattgatatgtgggatgttgaagaaaaggatttctttacaacaagagaccttcggtctctcaatcccctttga

SEQ ID NO: 92951 - DNA, 165 bp, Glycine max
  Peptide Sequence Number=SeqID_209729
atggagatcgacacccttttcgctatccacagacaatcaagtctgatggcacacgaagaaaacatggtcatccgcaccttccttgccatccagagacaatcaagtctgatggcacgcagagacaaaacatggtcatccgcctttttgcaaaccagagacaatcaa

SEQ ID NO: 92952 - DNA, 690 bp, Glycine max
  Peptide Sequence Number=SeqID_209730
atgaaggttgcatgcatctgcatcccaaaaatcatgttcatattaggctataagtgcatagatttccctaatctacttccctatctttttgagtttaggatgacaggccttctcaaagagtcaacctcttgctttctcataaggttgagccctttggtactagtacctattggcttgtttcataggactcaacgtcctttgctttatgatttcatgggactcaaagtcctcacttttatctttcataggactcaaagtcctcacttttatctttcacgggactcagagtcctcgcttttatctctcataggactcaaagtcctcgcttttatctttcacaagactcaaagtcctcgcctttatctttcacaggactcaaagtcctcgcttttatctttcataggactcacgtcctcacctctatctttcataggactcaaaatcctctgtctttatgctttcataggactcaaagttctctatgaagaagaaaatgaagaagaagattcagatgatgaagaagacttctcactctttgtgaagaagtttcaaaaatttgttaagaaaagaagaatcgagaggcgtcagaactttaacaatggaagaagatcacaagaagactctcaagttcttagatgctacaaatgcaagcaacttggtcacatcatagctaatttgtccttcaaatga

SEQ ID NO: 92953 - DNA, 201 bp, Glycine max
  Peptide Sequence Number=SeqID_209731
atgggagatcgaggagcccatcttgactatgtcaaccccgacattagtttgctccaaatgttgccacccccaaaaaattccaaccctccttcgacgatgaccatgacagacaatgatgccttccgtaaacttcaaacccacgtcgcagagatggaacactaccacgaagaggaactgagaaagttgaaaaggccgtgttag

SEQ ID NO: 92954 - DNA, 474 bp, Glycine max
  Peptide Sequence Number=SeqID_209732
atgttttcttcttcttcctgcgcttcctacctacagcagctccacacgtctgagctagcagggctagctacgaggtcacgtcgtcaagctaggaagcttctcgactgttttgaagcaaagtttaatggctgttgttttcatatttgtttagcattgtttcgtagattgaattccatagtgaagataaatgatgacaaggaaacctggaagattgttgtccgactaataaacatgtgtactataccaagatcacctagttggtctttgtgggaggcacttgctatggagcttaaggaatgtttggatagccatgagtgtatgtgtgtgattgtggctactataacaaaattgttggtagccaatggtttgatttatgatgcttgtcccaaatgtaacaggaaggttgatggagaggctttgactattttttgtgttggttgtggaaatgaaagtgcaagtacaattccaaattaa

SEQ ID NO: 92955 - DNA, 297 bp, Glycine max
  Peptide Sequence Number=SeqID_209733
atgtctagccattctacaagccttgagccaaaatcccgactcaccataaaccttgacccaggaagaagaagaagaaaaagaagaagagaaaagaaggaaaattccccaatcaaagagtgggagaaagcaaaaagaaaagaaaggaaattcccaatcaaagaatgggagaaagtaaaaaaggaagaagaagaaggaaagaaagctcctgatcggggatcgaaggaaaaacagaagaaatgtgcagagaggtctttggaccggacaatatctgaacaatacagaattgtcaccaaatga

SEQ ID NO: 92956 - DNA, 180 bp, Glycine max
  Peptide Sequence Number=SeqID_209734
atgggtgcagaagacgatgtttgtctctgcgtcctatcaggcttttcgtcttacagacagaaaaagaaagtttatacggataaccactcggattttgtgagcgtggaagatgacgtaaatctttgcgtgtcaacgggcttgtccgtcacgattgacgaagggcgcagaagacgactttag

SEQ ID NO: 92957 - DNA, 324 bp, Glycine max
  Peptide Sequence Number=SeqID_209735
atggacaagctccaaaggtttagacaagggagtatgagtgttgaagaatatagacaacaaatggaactactccttttaagagctggacttagggaggaggaaagaacaagcataactaggttccttagtgggcttaatatggaaggaagggacaaggttgaactccttccatatagggacctagatgagctagtccagctttgtataagaggggaacaacaacttaaaagaaattctaaaaccgtcgtgaaaagttgtccacattctacgatggtggattccatgacagttaaaaactgtcctgctatgctaggaagtccttaa

SEQ ID NO: 92958 - DNA, 192 bp, Glycine max
  Peptide Sequence Number=SeqID_209736
atgtgtcctccaccctcgagtctggagcccctcgaatgtcattgcctagcgctgttcgccatcattttaggaacttttaggaataactgggaaacgtattttaacgatcctagttcattggagccagagagattaaaggcattgcggatccagtgggcacactattatctccgagttagagatcagacctag

SEQ ID NO: 92959 - DNA, 183 bp, Glycine max
  Peptide Sequence Number=SeqID_209737
atgaaatctgtgcaatttcagttaagcttagctcatcagtggactgagcacgcatctatcgctaagcgcaacttgagcgtgcttagcgcgattgaagaatctagcaggacatcaatatcaaggtcgtgcgctaagcgcaagatcagtgtgctaagcccaacagttgtcttcagccaggcttag

SEQ ID NO: 92960 - DNA, 405 bp, Glycine max
  Peptide Sequence Number=SeqID_209738
atgtggaaccctctgaaagtgaggacgcgtagtcctctaaaggtgagggcgtgcaacccactgaaggtgaggacatgcagtcctctaaaggtgaggacatgcagtcctctgaaggcgaggacgtgtagccctctgaaggtgagggcgtgtagccctacgaaggcgaggacgtgcagtcctctgaaggtgaggacgtggagtcctctgaaggtgaggaagtgcagtcctctgaaagcgaggatgtgtagccctctgaaggtaaggacgtctagtcctctgaaggtgaggacgtgcagtcctctgaaggcgaggacatgtagccctctgaaggtaaggacatgcaatcctttgaaggtgaggacgtatagtcctctgaaggcgaaggcgtgtagccctctgaagtaa

SEQ ID NO: 92961 - DNA, 204 bp, Glycine max
  Peptide Sequence Number=SeqID_209739
atggggatgaggtttgtcatcaatgttaggggcgctgtgcgccccttttttacagcgccatcgccagccgcgtcccctgatcgatcgcgcggcgggcatccagctcggcggccacgtcggcgccgccgatcagatgcacggttttccccatcgccagcagcggctgctgcagctcgcggcgcggttcctgcccggcgcagatga

SEQ ID NO: 92962 - DNA, 579 bp, Glycine max
  Peptide Sequence Number=SeqID_209740
atgcatacagctcgccgaacagcgaaaggtgcgtcagatacagccgggtatcgaactccagctggtggtaatccggctccatatggcagcacaggctgtagaatgccttgttgtgatctttctctttcaggtgcgccagctcatgcaccacgatcatgcgcaaaaaggttcgggcgcgaccttgaacaccgtcgccacgcggatttccgccttggccttcagtttgccgccctgcacgcgcgagatggcggtgtgcaggccaagcgcgtgcttcatgacgtggattttgctgtcgtaggccaccttgctcagcggctgggcgttgcgcagatactggtttttcagatcgacgcagcacgtctcccagccgattctgatggattagttgctgcacctggctttgcagatgcgttgggtagccttgcagccgcacacgctgcgcatcggactgtctggcttcccagcgatcgtgtgccgcctgcaggtttagccaaaagtcagcggtcgtttcgaacagatcggcaaacagattggcctcggcaacgctcatgcgtcgatgcccgttgcccaggcgattga

SEQ ID NO: 92963 - DNA, 387 bp, Glycine max
  Peptide Sequence Number=SeqID_209741
atggaagaaaataatcgaaaccacaattgcatatgtaataaatccaacaacctatgctcgaagtgcaccaatccagataacaaaaacgcgaaaccaaaacaaccaacaacatcaacttcgttaaactcaaaaacttcgacatgcttaccttcacacaagcaaggtcgcgacaccactccaaagggcacgagatcggatatgtggtggtggtcagaacaatggctagggtttttgttcttggtggtcgaaaaggcaatgtcacggtgggcacgacggagtcgtcgctgggatgacttcaggcaacagagcgcatgcgtattagggttttggtatagctttttcgaggacgcgagagtgttgaatcatcgtgaaacaaggagtatttaa

SEQ ID NO: 92964 - DNA, 221 bp, Glycine max
  Peptide Sequence Number=SeqID_209742
atggcgcctcctctcacctcttctcctttgtcttccgctgcatctccatgggagaaaaaggaatatcatgaagacagtacaagtggaggtttcaatctcttatccgtctctctgacatttgggaattctatcggagcagtcggaggaataactgaaggaatctcagggaaccgctatagatgttactatcgttggctgaagagacgtgagtccgctcagag

SEQ ID NO: 92965 - DNA, 480 bp, Glycine max
  Peptide Sequence Number=SeqID_209743
atgtccagccgttctacaagcattgagccaaaatcccaactcaccataaacctttccctcaaaagaaaacaaaacaagaaaagagaaaagaagaaaagaaggttctcgatcaaagaatcggaagaaagcaaaaagaggaaattcccaatcaaagattgggagaaagcaaaaaaaaaaaagaaaggaaagaaaattcccgatcaaggatcgaaaggaaacaaaagaaatatgcagaaaggtcttttggaccagacaacatctgaaaaaatacagagttatcaccaagtaagcacaaaaagaaaaggaaaccatgacctgaagtggtcctcttcctttgattgccaaccaaaatcctgtgcgtcggtgacttgttcgcctcgtgccaaacaaaaacaaaaaaggaaaaggccaaaaacattcaaagccaacattcccacaaaaaaaacaccattcccaagaaaaagtcctactgatccatga

SEQ ID NO: 92966 - DNA, 165 bp, Glycine max
  Peptide Sequence Number=SeqID_209744
atgacgaaattaaagacgacattgtctcctgaaactaaggcagctgcacctaagtggattgaagttaagactcacgttcaactaggatgttatgaatgtggatattacgtaatgcattggatgtggaatatcataaccagcgagataaagagtgactggtccatg

SEQ ID NO: 92967 - DNA, 840 bp, Glycine max
  Peptide Sequence Number=SeqID_209745
atggggctggagatgttatcaaccatgtttggtggacttgcagctggtagcctggctgttcctaacagatcaaatgagccaccggagcaattgtatgccacccaactttctcagctgcaagagatgaggttctttgacacgcaagagaacataagggctcttattgctacatcagggaacatacatgcaacagttcagcttgaaggtcatcttgaagaacttggttcaactctgcatatcttgttgcttagaaggtcattgtcacaaccaaacacaatgatgatgaacaatcagcttgagtaccttgaggagcgccgcttgaaggatttgatcaagaagcattctgagttcattagctacccaatttttctttggattgagaaaactaccgagaaggagatctctgatgatgaggatgaggaagagaagaaggatgaggagggtaagttggaggatgatgacgaagagaaggagaaggaagaaaaaaagaaaaagaagattaaggaagtgtcacatgaatgctccttggtgaacaagcacaagcccatttggatgagaaagcctgaggagatcacaaaggaggagtattctactttctacaagactctcaccaatgactgggaagagcatttggctgtcaagcacttctcaggtgagggacagttggagtttaaggctatcctctttgttcctaagagggcaccttttgacctctttgacacaaggaagaagcctaacaatattaagctttatgtccgccgtgtctttatgatggacaattgtgaggagttgattcctgagtatttgggctttgtcaagtgctttgtcaagggtacctag

SEQ ID NO: 92968 - DNA, 282 bp, Glycine max
  Peptide Sequence Number=SeqID_209746
atggcagcgaagagcaagatcctagtccttggaggaacaagttacattggaaaattcatagttatggcaagcgtagaagcaggtcaccccacttttgccttagttagggagagcaccctttctcatcctgaaaagtctaaacttattcagagcttcaagagctttggagttactcttctttatgcaatcaagcaagttgatgttctaatatttatgctaggtgggcagcagatagatgatcaagtgaatgtcatagcaataaaagaagctggaaacatcaag

SEQ ID NO: 92969 - DNA, 264 bp, Glycine max
  Peptide Sequence Number=SeqID_209747
atgacgaaattaaagacgacattgtctcctgaaactaaggcagctgcacctaagtggattgaagttaagactcacgttcaactaggatgttatgaatgtggatattacgtaatgcattggatgtggaatatcataaccagcgagataaagagtgactggtccatgtggtttgctgatgagacaccgttggacatcgacaacataacaacaattcgaaagaaatgggcaacatattttttaaagactgcgtgtaaaaagggctaa

SEQ ID NO: 92970 - DNA, 255 bp, Glycine max
  Peptide Sequence Number=SeqID_209748
atggatttcttggccacggtggcttaccctaagccggatgacaaaatcagaagcaccaccttgaatgtatcttcttattcttctttcacatttcatgaattcatttgtgtacttgtgctcttcacattgattgatggtggcttttcacagggtgaaggaggtggcaatgtcggcaacgccttaacctgccttgctcgcttgggcttaaacccaaggctcatttccaagagagagagagatactatcaatcaatga

SEQ ID NO: 92971 - DNA, 420 bp, Glycine max
  Peptide Sequence Number=SeqID_209749
gagccagcaattattccgcacaacaaggatgcacatgtgccaaagccggctaatgtggacgcagatgatccgttgtgtgggctgataaagtatagttttgatatttatgacaagccagttgaaatcaactttgatgggagctgctttggtattgtacatgcacctacatcaatattcataacatattcagatgctagtgaaataatagcaggagacaaaagtcttaacatatatgtacaacaattatggtatatgcatgagtggagtcaaaccttgggtcaaggttcgatgtatgcattccttgagccacatttgctggtggtttcaaaggatagacgcagcgaatgccaacaatatcttgaaaaatggattaaggaatctgaccgagaggtgtacattggaccttacttccatcagtaa

SEQ ID NO: 92972 - DNA, 471 bp, Glycine max
  Peptide Sequence Number=SeqID_209750
atgagggttcggagcgcgccgcgcgcaaggcggtggactccttcgatcggattttccaccacgcgaagcgcaccagcgtcgctgccgcagtcctctggtagtcgctgcgctcggtgctatcctcggcgaaccacgaggtccgctctggcttcgagattcgtatcatggcacttctcgcggacatcgccgcagcgaactccgcccgcagggccacgatcgtcgggcaggaggctgcgtcgtcatggactgattgctggagtcagtggcggcggcggcacccaggcggagtacgcgagggcactagcgtatctgattgcggaccctaacgtgtctatggcggttcttgggagacctcatgcagttttgagtcttctgaggttcatcttctcgtcccaacagtggcaggtgtggttgagtttcttgaaggagatggtgggcttttgggctccctcatctcccgcagcgccatga

SEQ ID NO: 92973 - DNA, 459 bp, Glycine max
  Peptide Sequence Number=SeqID_209751
atgcctcccatctctgtgtggctatgtcttggagagtactatcaccacatgatgtccaaaggaagaagcagctggaactcgccttctaatacatggaaggacttgcttgcttcagatgatagtcatgttgatgctgacacaccgtatgctgaagttgaggtcatgaaaatgtgcatgcctcttctttcgcttgcatctgggattattcatttcaaaatgtctgaaggtcaagcaatgcaggctggtgaacttatagcaaggcttcatctggatgatccttcagctataagaaaggcagaacccttcactgggagcttcccagttctgggacatcctactgcaatttctggtaaagttcatcataaatgcgttgcaagcttaaatgttgcacggatgattctttctgggtatgaccacaatattgatgaagtgagtaaattcttcaccttgattcattaa

SEQ ID NO: 92974 - DNA, 147 bp, Glycine max
  Peptide Sequence Number=SeqID_209752
atggatacaaatgcacaactttggtacattatcagagaatatatctctaattctgagtgctcttcatcatccaatttgatgcaggatagaggtgttgatgcagatgaccttatctcattcatgctggaatcagttttgatggcatag

SEQ ID NO: 92975 - DNA, 267 bp, Glycine max
  Peptide Sequence Number=SeqID_209753
atggttgaattttctgaattagtggattttaaatgtatcgagaggaaagatttggcatttatttttcaagaagtgtccttatgtttattctccatgactaatctgtctacaccggtaaaaaacttgctaactgaattagacaagtctaagagcctcccagctgcattgacatccaaaaaagtatggagtgggaaaatgggagttgttaaaagcttgcatatccagagaatattgtctacaccttcaagcttttgccaagtaggttaa

SEQ ID NO: 92976 - DNA, 753 bp, Glycine max
  Peptide Sequence Number=SeqID_209754
atgaagatcacggcattgttggtgcttaaatgcacaggtgagggttccgatcccgttattctggcgaacgcttccgacgtcagccacttcggttacttccagcgttccagcgtcaaggagttcatcgtcttcgtcggtcgcaccgtcgcccgtcgcacccctcagggccaacgccaatccgtacaacacgaagagtacaaggtgcacacatacaacagaaatggtctttgcgcgttgggatttatggatgatcattacccgattcggagtgcgttttctcttctcaaccaggaatcaaagataggtaccaaggaacaacttacacatcctgctctaccaactgagctaaaccccctggtacttgagagtttgacaagatgggttatatcaactagtaatgatttcatgaaagtttccattggcttgatggcagacaaaggagggttaagtattgtggtaatagatgaatatcaaaaaaactttggcgagtcatggagaaatgctcaggaagacagtactcaaccatggccctatttgaatgaagctctggcaaaattccaggcatgtaaatacctcttttatgttgatcctgcagaggctgacaagttgatgaaaattcagagagagttggatgaaacaaaaatcatccttcataaaactattgatagtgtgctggctagaggggagaagctggacagtttagttgagaagagttctgatctgagtgccgcatcgcagctttggtctgtgtga

SEQ ID NO: 92977 - DNA, 162 bp, Glycine max
  Peptide Sequence Number=SeqID_209755
atggagatgattacagtcgatgcaggttcgatttggcaatggttgtttcacgacagcatgcgacacacgatgacatcatggaggaaggagtgtgacaactctctaacaacaatgacgaggaaggcatggtcggggagagacagaaggaaggagaaggaatga

SEQ ID NO: 92978 - DNA, 2439 bp, Glycine max
  Peptide Sequence Number=SeqID_209756
atggctgacaaaggaggaaaatcatgtcccatatgcactgaggagatggacctgactgatcagcagctgaagccatgcaaatgtggttatgagatttgtgtctggtgttggcatcacataatggaaatggcacagaaggatgaaactgagagccgttgtcctgcctgtcgttcaccttatgacaaagaacgtattgtgacaatggcagcaaactgtcaaagattggtagctgaaatgaattcacagcataaaaagaaaatgcagaaattgaatttgaagcctaaatcagtggatggaaggaaacatcttagtgatgttagagtcattcaacgtaacctagtgtacataattgggctgcctctaaaccttgcagatgaagaactacttcagcgcagggaatactttggcaggtatggaaaggttatgaaagtgtcaatatctcgaacagcaaatggcataatccaacattctgcaaacagcagctgttgtgtgtatataacatactctaaagaatctgaagcagttcaatgtattcaatcagtgcattgttttgtattagaaggtagacccttgagggcttgttttggaaccacaaagtattgccatgcatggttgagaaatgtgccttgcagcaatagagattgtttatatctacatgatcatggttctcacgaggatagctttaccaaagatgaactagttttagcatttgctaggagtagagtccaacaaatcattggtgctacaaataatttgcatcggcgttcagggaatgttttacctccaccagtagataatcctaaacatatgtcatcagccaccaaactagtgtcccaaagtcctttagataaatgtgagaaccagattaaaggatttgcttcaggtattggggctgtcacttcaactgtgcttcctgctgtgacctcttgggttaggtgtgtgtctggcaatcttccacatgatacaagttcatcatgttctggtaatctggcaaatagaaagattgaggcatctaatgatccacaagcccttgtgtccggagttgcttccactgaaaggtctattaatataagaaaatcaggggaagctgaaaatagctctgatgtgtgttccaatggtgccttcgtaccttcagagacgaacaaccataatagtggtggaaattctaaaacatgtgagtcaagtgttttcaatgaagttactttggaaaaatttcctggcattgtattgcctaactgtgaaacatatgtggcagcttttatggacaatgatcaagatactgtagcaccttctgtgagcacaggcttcctggagctctccaggcaacatgatttcaatattgatactgcagttggcattaattcaaatggggatgttcatggcttatgttcagggttatcatctattagcattaatattcatctagaagattcatatttaactcctgattcagacggattaccttttactcgtaactcaatcgattcctctctagggcagcatttacagcaagataatgagtattcaacagaacattcatccacaccagcattttgggaagatatcattgtggatgacgtactaaacatagactctaaacaacaaaaattcagcaaaggcatcaattattcgtcatcatctgggctccattctagttgtctaactcagaatgtaaaccactcaagccatcaaccatttcagcaagatcaaatttgtcaccagaatcatttcagaaaaccttctactgagtcttttaatgaacacttggagacaggacatgttaaatatggggagagtaaagataatggtgcaggtgttgatagtatggttgcttcagacatgggagagaacaacattatatctgatattttgtctttagaattagatgcatgggaaggttcattagttaatttgttgggtgagagtgatgaactgtacagaccctttaaagcacctattttgcggaaagtccaagacaaaaatcagtcaaggttttcctttgcaagacaggatgatttcatgaatggggcatctaatttgctgcaatcatttgcggttactggacgggatcctgaagggaacttttcatcaggtgctttaatgggaaacaaagatacactcactggaaaatacccacatgtcttcccatctggcaattctgtaccatcagataaacttgttggaagtcagtctttggtgccatctaatttttccttgggagaaacatggtattttgagcacttctacagtcctgctttgtggatggttctttttagttcttcattggctcattatgtagccctggagtttgttgtaggcagacattactggcaaatggtgtcaatttttctgggttacagatggcttggcctccgagtattttatggtgaaaggctggatcagtcatatagggctaaaaatctttactcagaatcatag

SEQ ID NO: 92979 - DNA, 261 bp, Glycine max
  Peptide Sequence Number=SeqID_209757
atggatgttgtcatatggtgtccttatgagcgccacaagggtgttaagcatttctccaacaaaccattttctctagtttcatcatatggtgtgctgaggcagtttggtcatattcaaagcatctcgtgtcatccattgcaacatctcacatatcaggcttatgatacaacatgggcggagtggcagcaacatgttattcctctaggcgatgttgtgctacctaggggtcattgggcttgcactcctaactatctaccttga

SEQ ID NO: 92980 - DNA, 279 bp, Glycine max
  Peptide Sequence Number=SeqID_209758
atggagaatagggtacccttcttcttcttcttcttgttctctttctcactcctgctgctacttctcttggaactttcttctgctcagatgccaggttttgtaagtttggattgtggtggtaaagaaaattttacagatgaaattggtcttaattggactcccgacaaacttaggtatggagaaataagcaatatatctgttgccaatgagacacggaagcaatacacagcactacgacattttcctgctgattccagaaaatactgctacacacttgat

SEQ ID NO: 92981 - DNA, 261 bp, Glycine max
  Peptide Sequence Number=SeqID_209759
atgtcgcgaaacttcacaaattgcttaacgatgggtgtcaagttcctcgaagcggtcaagcgaaagttgcatgccatcagacaatggtccccgaacgaaattagggcaatcaattcgtggggcttcggactcgatggtggaggatgcatgaatgacaatcaattcatggggctccgaataagatttgatggtggaggatgcacgaacagcgctaggcaatcaattcgtggggctccggactcgatggtgggggatgcatga

SEQ ID NO: 92982 - DNA, 162 bp, Glycine max
  Peptide Sequence Number=SeqID_209760
atgcatccggccactcgcattggcaatacagggtgtttcgtcaacaacattggcaaaacagctgctggtgtcaaaagagcacagcagagcagacatagtctcgctaccatggcaggcgaaatagcaacagaggaggtctcactagcatcgctggcgaaatag

SEQ ID NO: 92983 - DNA, 275 bp, Glycine max
  Peptide Sequence Number=SeqID_209761
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccccggcagcaacaatggaacaggtctcttccaaaccatagttggtttgaagataagagatttatatgagcagctaatagccaccaaggctgagactccagtggctgcaaaagcttag

SEQ ID NO: 92984 - DNA, 248 bp, Glycine max
  Peptide Sequence Number=SeqID_209762
aggaaaggctgagtgccattaaaggaggaggaaattatgcctttgttgacatggcagagttatgcttggtacccaacgtggttattcctccaaagtttaaggtgccagattttgataaatacaaaggaaccacttgcccaaagaatcatctgaaaatgtattgcaggaagatgggggcatatgcgaaagatgaaaagttgttgatgcatttcttccaggagagtctcgttggggcagctattacctag

SEQ ID NO: 92985 - DNA, 297 bp, Glycine max
  Peptide Sequence Number=SeqID_209763
atggagagaaagatgataacaatgataacaaacacattaccaatgttctactatgagaagatggtaggttacatgccttcaagttttgcagatttagtgtttgctggtgagaggatcaaagtaggtctaggaacatggaaatttgattatgctgattctacgggttctagtaataggggacccgagagtagtggtgagatgaagaaggagggagaacctcatgttgtggctgcacttcccgcatggccaaactttccactagcctcttataatcccatgtaccaatatccttcctag

SEQ ID NO: 92986 - DNA, 228 bp, Glycine max
  Peptide Sequence Number=SeqID_209764
atggatgtcgaagaacggttgaaaaccttcacctttcgaagaagttacggaaactcacggattgcgcaacaacacctccttttggtttccgccacattacggaatttcacggatcgcataaccctgcttccttttgacttccggcgcgtctcgagacttacatattgtgcaacaaagggtgccaagtatcttgaaacgaccaatcaaaggttgcatgtcatcaagtaa

SEQ ID NO: 92987 - DNA, 4572 bp, Glycine max
  Peptide Sequence Number=SeqID_209765
atgggaagtcgaggccaaaagcgtcccgaaatggttgatgaactgcctgccgataagcgggcgtgcacttcgttggattttaggccaagcacttcaaactcatcagttcaaacccagatgaattcaacagtggaggcgcatgatcatgacatggatacttcctcatctgcttcggcttctagtcaatcagagggagagccagagaaggattcagcttatggatcgtgtgattcggatgacatggagcaacatcatagcactctccgtgaatatcacaggcagagactgtccagtgatcatgggaaatttaaaaatattatatatagcttgagtgagggttcaatctccagcatgacttcagacttgttatcaccactacttgtaaagctggcacagaatgagagtaacccggatataatgttgttttccattagggccatcacatatatatgtgatctgtatcctcgatctgctgcttttcttgttcatcatgatgctgttcctactttatgtcaaagattattggcgattgagtatcaagatgtagctgaacagtgtctccaagcattggaaaaaatatcacgcgagcaaccacttgcttgcttacaggctggggcaattatggctgtactaaactatattgacttcttctcaacaagcatacagagagtcgcgctttctactgtggtgaacatatgcaagaagcttccttctgaaagcccttcacctttcatggaggctgtgcctatactatgcaatcttcttcagtatgaggatcgacagcttgttgaaaatgttgctacctgcttaatcaaaattgtggagcgagttgtgcagtcctcagaaatgttggatgagctttgtaaccatggattgattccacagggattgataggattacttgtcaaactttcatctggatcacttgtagccttcaggacattatatgaactcaatataagcagcattttgagagagatattatctacatttgacctctcacatggagtatcaacttcacagcatgttggtggacactgtaatcaggtatatgaagcactcaaattgctaaatgagcttctccctgtccaagctaaagatcagaatgatcaactcatgctaaacaaagaatcctttctggagagtagcccagatctcctgcaaaggcttggaatggatgtgtttcccatgttaatcaaggtgttcaattctggtgcaagtatatatgtctgccatggatgtctatctgtaatgtacaagctggttagtttgaggaaatctgacatgcttgttgaattgcttaagaatgccaatatttcaagttttttggccggagtattcactcaaaaggatcaccacatgctaatgttagcattacaaattgccgagataatccttcaaaatttttcagataatttcttaaagttgtttgtaaaggaaggtgtcttttttgccattgatgcactattaacaccagaaagatcttcaaagttgatgtacccagcatttggtggcattcagctgtcattggactgtagtcaaaagtcttcttcaagagacaccctcaagtgtttatgttatgcattttcaactagtcaatctcctacatcatcagaaaccagaaattgcaaactggacaaagactccctttataatcttgcggagcatataaaaaacaaattcttagcaccagaattatttgattctgagaaaggattgactgatattctacagaatcttagagcactttctaatgatttgttgagcatgtctactgacaatggtgctcttggtgtacatgaagagaagatcaataatatattgtatcaaattatggacaagcttactggcaaggaacaagtttctacttttgaatttattgaaagtggagttgtgaaatcacttattaattgtttatctcatggtcagtatatcagggaaaacaagggagtacagggtgtttgttattataatcctgtcatagaaaaacgatttgaggctttggctagtgtatgcttatgtgcttctcagcatctctcaagtgaaaaacccctttctatgttaatcaggaacttgcagactgcactgacttcattggaagctttccctattgttctgagcaatggaccaaaactgagaaattcatttgctagtgttcccaatgggtgttccattccttacccttgcctgaaagttcattttgtcaagggggagggagagactttcctgaatgactacactgagtattttcatactgttgacccattttcttctgtgcattccatagaaaggtatctatggccaaaggtcagtgcaaaaagcacagagcatactaaatcgtcatccatccaagtagtgttgcaacccgaaagtcctccccttcaatcaccatcaaatgcaagttcagtcccagttgaaattcctgtaattttagggactcctgacaggatgacagatctccctgaaccacagaaggaagagccaaagttgtcacagcctagacgtggtcaagcagtcgacgagaacgttggggagtcatcatcctctggaactcagggttatgctgaacaagaactgcaaatgaacgcagaaccaaactcaaaactagaaaaacagcatcctgcatcttgtagcaatgaagctggtcaaaagcttgttttttaccttgaaggacaacgtctggatcctaaattgactctatatcaggcaattcttcgcaatgcaataaaacaaaatgcagattctttttctagtgcaaagctgtggagtcaagtgcacataataacctatagaagggatgtagaatctgaggacatattacctccagaatgttattcttcacctcagcatttctctgacgaaaaagttttatcttattatcagcacactccttttttctccgacatgttctcttgtgaacttgtttctgatttggagaagtccagtccaacttatgatattttgtttcttcttaaaagcttggaaagcatgaacagaattatatttcaccttatgtcacgtgaaagaatttgtgcttttgccaaagggaaagttgataacctggatagcctagaaataacagttccttctgtgccacaatttgagtttgtaagcagtaagttgacagagaagctagagcaacagatgagggactctttggctgtctccattggtggtatgccattgtggtgtaatcaattaatggcttcgtgtcctttcttatttagttttgaggcaagatgcaaatacttcaaattggaagcatttggtcagccacaagtccaacctcacatatctcacaatggctcaggaacagtaagtgacaggcgactgggccctggtggattgcctcgaaagaaatttttagttcatcgcgaccggattttggaatctgctgcacaaatgatggacctgcatgccagtaataaagtggttcttgaagtggaatatgatgaagaagtgggcactggtcttggaccaactttggaattttataccttggtgtgtcaggagttccagaaatctggcttgggcatgtggagagaagatgcttcttcctttaccctcaagacaaacatggaggctgaggacataggaacccattccttttatggactatttcctcgtccatggtcatcaatgcaagatacatctggtggcatacagttctctgaagtaataaagaattttttccttctaggccaagttgttgctaaagcacttcaagatggaaggatcttagatctccacttctcaaaagctttctataaacttattcttggaaaggaactttctctctatgacatacaatcctttgatcctgggcttggtaaggtcctgcaagagtttcaagcattagttatcaggaagaaatttgtggaatctgtcagtggagggaattctgagttgcaacatggactaagctttcgagatacaagaattgaagatctttgtcttgattttacccttcctgggtttcctgatattgttcttgcttcagggaccgatcataccatggtgtggcatatgacatttttggtaaatacgagaaacttggaggattatgtttcacttattgttgatgcaacggtgaggtctggagtttcaagacaagtggaagcttttaaatctggctttaaccaggttttctccattgatcatcttcggattttcaatgaagaagaacttgagcgaatgctttgcggagagtgtgactcttgggctgtcaacgagcttggagatcacattaagtttgatcatgggtacactgctagcagtcctcccattattaatttgttggagattgtccgagagtttgataatgaacagcgacgagcatttctgcagtttgtgacgggcgcacctcgccttcctccgggaggattggcatctctcaatccgaagttaactattgttcgaaagcattgtagcaaccgggcagacacagacctacctagcgtgatgacttgtgcaaattatctcaagctacctccgtactcatcaaaagaaaggatgaaagagaagctcttgtatgccattacggagggtcaaggatctttccacctttcataa

SEQ ID NO: 92988 - DNA, 432 bp, Glycine max
  Peptide Sequence Number=SeqID_209766
atgatgcattgcgcgattggtcttctttttaggcatcggaagggaaggcagttttcaggtttggctcacagcggcgatgaagatgaggttccagtgatgaccaaacttgcttggtacgcaacgagagatggaggttgctcggtgggaggaaaaagtcggagcgcaaaaccccctcttcttggtagcgatggtggtcaacgacgggaaagaagaaagagagaggaagggaaaggaaaaggattgtggtgggttggtacaaatagcacttttgttggtctgcagactctagacagaagagggggtaaaaagaatatttgttactctgggaatggggttaacgtcaatggtgctaatcttgaacaagtccacgtcaagcttgttttaacgtgcgagaatgcttccaaatgtgctagagcgttggtggatgactag

SEQ ID NO: 92989 - DNA, 2089 bp, Glycine max
  Peptide Sequence Number=SeqID_209767
gtatcctgatgacccatttgatagaatttgggagtcagattctgtcaagaaagcaaattatcttgttgatgttgctgccggaactaggaaaatttccacaaacaaatcaattgatgttaacagtgatgaaatgccaccgatgaaagtaatgcagactgctgtggtgggcacaaacggatctctaacttaccgtttgaatttggatggttttcctggttttgcatgggcatttacctattttgcagaaattgaagatttggctgaaaatgaatccagaaaattcaggctagtacttcccggtcattcagatattagcaaggctgtggtaaatattgaagaaaatgctccaggaaaatatcgcctttacgaaccaggatataccaatttatccctaccctttgttttgtcctttagatttggcaaaacatctgattcttctaggggccctcttctaaatgccatggagattaatgagtatttggagaaaaatgatggctctcctgatggagaagtgatatctagtgtactttcacactacttctcagctgattgggcacaagaagggggtgacccgtgtctacctgttccatgtttgttgtctagtaaaaacttgaccggcaatattcctttggacataacgaaattgactggtttggttgaactacggcttgatggtaatatgttgactggcccaataccagatttcacgggatgcatggacttaaagatcattcatcttgagaacaatcagttgacaggtgcactctcaacctctttggcgaaccttccaaatttgagggaactctacactggaaacactaatcttcataaaggtagcagaaaaaagagtcacttgtatgtgattattggttcagcagttggggctgctgttctacttgtggccactattatatcgtgcttggttatgcgtaaaggaaagacaaaatattacgaacaaaacagccttgtttctcacccttctcagagtatggattcttctaagagcattggtccttctgaagtggcacactgcttcagcttttctgaaattgaaaattctacaaataattttgagaaaaaaattggttccggaggttttggagttgtttactatgggaaactgaaagatggaaaagagatagcagttaaagttctaaccagcaattcctatcagggaaaacgagagttctccaatgaggtaactcttctctcaagaatacatcatagaaacttggtacagcttctcgggtattgtcgagaagaaggaaatagcatgcttatttatgagttcatgcataatggaactctcaaggaacatctttatggcccattaacacatggacggagcatcaattggatgaagcgccttgagattgcagaagactctgcaaaagggattgagtatcttcacacaggctgtgttcctgctgtcatccatcgagacttaaaaagcagcaacattcttcttgacaaacacatgagagccaaggtttcagattttggtctctcaaaacttgctgtggatggagcctcccatgtgtcaagcatagttcgtgggacggtaggatatttggatcccgaggtgcctattctcttattaaccacaaagcttatcattgtgactttgaataggtactatatttcccagcagcttactgacaagagtgatatttatagttttggtgtaattcttcttgaactcatatctggtcaagaagcaatatctaatgacagctttggtgctaattgccgaaacatagtccagtgggcaaaattacacattgagagtggagatatacaaggtattattgatcctgtgctacaaaacaactatgacctacaatcaatgtggaaaatagcagagaaggcattaatgtgtgttcaaccacatggacatatgcgaccatcaatttcagaagttctgaaggagatccaagatgcaattgctattgagagagaggctgaaggtaattcggatgagccaagaaattcagttcattcttcaatcaacatgggttctatggatttggctgcaactgagaactacctctcaattgatgaatccattgcacagcctattgcacgatag

SEQ ID NO: 92990 - DNA, 315 bp, Glycine max
  Peptide Sequence Number=SeqID_209768
atggtgaagatcaatggaggggagcagacacgcggcataacagagaagggaaaggaaggaggcgtgaatgtacttttgtcaccaaagtttgttagtaaacttagtttcagctcaaagcaacatcaaccatgcttttcagcactttttggaaatcttgttcagattgagcatgttttgacaactcttgtgttggatctggacaaacgtctatgggaattaaagctggaaatggagttggcattgctacatagtacacagaacaaactgccatctatatggttgatgaaacaccagtccttaaaattcagttattaa

SEQ ID NO: 92991 - DNA, 678 bp, Glycine max
  Peptide Sequence Number=SeqID_209769
atgggattggcctctgttgttcacattcacgctcctcctttcagatgctctgtacttcaccaccccatctcttccttttgctcagtgtaccattatcgtcctcctcgccgtttcccacttctgtgctccagacgaattggccatgacaattatgcctcagaagtaaagaggatcagtgctcaacaaaatgatgacataggcaaagttgagaaatctcccactcaggaatctctgggaaatgagggttacaattcttccgtcagaactgtagccttatgggtgtgcactgcagtggcatttggtgttggtttgggttttaaggaaggttttgacaaggcatccgaattctttgctgggtatatattggagcaaagtctttctgtagataatctctttgtatttgttctaatattcaattacttcaaagtgccagttacatatcagaatcgtgtgctttcctatggtattgccggtgcagttgtatttcgcctgacaataatacttattggaacagccaccctgcagaggtttgaggcagtcaaccttctcttggctgcgatattactctactcgtcatctaagctatttgccagtgaagaagatgaatctgacttatctgataactttgtggtgaagacatgtcagaaatttatccctgtaacaagtaattttctctaa

SEQ ID NO: 92992 - DNA, 1737 bp, Glycine max
  Peptide Sequence Number=SeqID_209770
atgcataaggttggcacgtactggggatcagtgtcttcggaaatgaatttctgtgtgtctgatttagtatggggaaaggtgactggccatccttggtggccaggtcagatctttgatgcctcagctgcatcagagaaggcaaagaagcacctcaaggaaggctgtcacctgatagcgtattttggggatggaacatttgcttggaatgatgtgtcaatgcttaaaccatttcagacacatttttcacaaatggagaagctgagcaatttggaaaatttccaccatgctgttgattgtgctttagatgaggtctcgagacgggttgagttcagcctatcctgccattgcatgcctgaagatgtgctttctaagattaaaactcaagtaattagtaatgctggaatcaacaatcagtcgtgtagaagaaatggaggggacagaattatgaatgcaatgtcttttgaacccatgaaacttgtcaattttgttaaatcattagcacagtcgccacttgttgaatctgataggctggattttgtaattgcacgttcccaattgtcagccttctattgctcaaagggttattctcaactacctgagttcccagtgcttggtgtgttgttcgagaatgatatggaaactctactcatgagggagaaagagcaatgtgattatcaaacccatgtcagctttttgcaacaggatcacaagcacatctctggggatagcaagtggcacgggaagaaacttaaacttctgtcagatttgatgtctgagaagggcttctgtatttcaaatggtgaaggcacatcagaacaggaggctaagtcagttccacagcgtcgaggcaggaaaaggaagacagctttcaatacttcagaagattatttccataattcccaaaatggaaggctcacccaattacagtatgcttctacaaatgacatgaggtctcaactctgcttggctgccaaggatccaactggagaaagttgctctagtgacatggtacatttctttgcagaatttagaaaattcattagccatgattattatgcttccctggatcaggaaatgtctttggaacgaatgaactatgatgagaccggagtaacctctacagcagcattggcttctatgacacctgcaatggagccttgcagtgattcttattggactgatagaataatccaaagcattcccaaggagctatcattgacaaaataccagaatgagagagtggtttttttacctgagactctaactgaggctaatcctctttctttcaagttgcaaccgtctgctgaaactaccacagatttatgttataagcagcaagatactgatagaaatcttggatcagaatcttctaagcttgtggaacatttggatgggagttctaaagagaacttctgtcccactgctctgacactgaaatttacaaacttcgattctgttccttcaacaaccgatctcaacaacatttttggccgctttgggccactgattgaatcaaagactgaactgctagagaggacaaaccgtgccagagtggttttccaaagacgttcggatgctgaaactgcctttagtagtgctggaaaatacagcatatttggaccttcacttgttagttaccgcctcaagattttgcctcgtaagccaccacaaggtacaggaaagcgaggcagaaaaagaagaaaagaaacaagttctgtggatggcacagcagtttga

SEQ ID NO: 92993 - DNA, 982 bp, Glycine max
  Peptide Sequence Number=SeqID_209771
gcctttagaggactacacgtcttcgccttcagaggtctacacatcctcgccttcagagggctacacgtcccccccatcagaggactacacgtccttgccatcagagggctacatgtcctcgcctttagaggactacacgtcctgcccttcagaggactacacttcctcaccatcagaggactccacatcctcaccttcagattgctacagggcttcaccttcagaggattgcgcgtcctcaccatcagagggctacacatccacaccttcagaggcctacatgccctggccttcagagaactatacgtcctggccttcaaaggactacacatccatgccttcagaggaaaacacatcctccgtctgtagaggactacacttcttcaccttcagagggctacacgccctcacgccctcatgccctcaccttcagaggacttcacgtcctcgccttcagagggctacacgccctcgccgactacacgtcctcaccttcagaggactacacatcctcaccttccgaggactacacgtcctccccttcagagggctacacgtccttgcctccggagggctacacgtcctggccttcataggactacacgtcctcaccttcaaagggctacacgccctcgcctttagaggactacacgtcctccccttcagaggactacgcgtgctcaccatcagaaggctacatgtcctcaccttcagtggactacatgtcctccccttcagagggctacacgccctcaccttcagaggactatgcatcctcaccttcaaagggctacacgccctcgccttgagaggactacacgtcttcgccttcagagggctacacgtcctcgccttcagagagctacacgtcctccccttcagtggactacgcgtgctcgccatcagagggctacacgtcttcaccttcagagaactacacgtcctccccttaagagggctacacgccctcaccttaaaatga

SEQ ID NO: 92994 - DNA, 276 bp, Glycine max
  Peptide Sequence Number=SeqID_209772
atgaagaaaacaaatagaaataacagcccctctttcaaggcagagtccagcatacgccttggggtcggcaacctccatcatggctcaccgggcctccgcgtcgagggtcaattgctcttactcgaatgtcgccgtatcgaagatcttgttgttattctggctgtcgccgacaactttcaccttgaaccaactgctgtggggattcgtagagaaggaacgaagggtgcagagaaaggaggggttggggaacttggtgttgaacataaatggatgtga

SEQ ID NO: 92995 - DNA, 2025 bp, Glycine max
  Peptide Sequence Number=SeqID_209773
atgatactgctctctggtttttcggtatttgttcaagtcaagagttgtgtgtgtgcttatattgtcaccttggttgttctgtgttcaacagcacttggtggtaatggagttagtttacttggagtttctttgaagggattatgtgcggtttgtttgttagattactattgcagaaagtgtgggtcaggggctttgaaggagagaactggtacttcagaagtgccccaaaggaagtctcctgcttctcctcagaatgctcgcaaattgaagacaccaggctctgataccgactcagtctcatcatctccaaagccaggaagtaagacacccaaaaataaaagtccaaaggtcacagaacgcaagtcaccaagaagtccaatatctgagaagaagcaaccaagtagggtccaagagtcggagtctcaacttgctcaacttgaagaagatctaaagagaactaaggacaaactcaactcatctgagtcatggaagaggaaagctcagcaggaggctgaagaagcaaagaagcagcttctagccatgtcaaaagagctggaggaatcccagcaacagcttctggaactatctgcttctgaagaggaacggcttcaagaactccataagatttctcaggaccgagatcaagcatggaagtctgaacttgaggctgtccagaagcagcactcaatggattcaactgctctaatgtctgccatgaatgaaatccagaaattgaaaatgcaacttgaaagagtgtatgaatctgaagctgttcacattagcaatgctgaatcagataatgccgagattgaggatttgaggatggagcttgatgaagcactcactttagtggaaaagctgaaaaatgagctaagtgattgcaaagaatctgaatcccgggatttggaacaaaccaagactgttgaaacactccagttagaaggtgagaaagcatccgaagcttacaaatccttagctttagagttagatcaagcaagagctcaagtgaaatcattggaagaacttgtcagcaaacttcaggctgatttggttggtggtgctaacaaaaatatgttaggtctagtcattgaagcagaacctgaacttgcaccgaaaaacgtggaaaatgaggagataaaccagctcaaagctgagcttgtttctgcgaaatctgaagcaacgcagttaaaatctgcactggatgtttctgaggtacgataccaagaagagtatattcggagcacattgcagatcagaagtgcttttgaacaactggagcatgcaaaatcagaatcttctcgaagacaaggtgaaaatgaggaattgaagagagctagagctgatattgaagagttgagggagaggctgatggacaaagaatctcagttgcagggattatcagaggagaatgagatcctcatgtcaaggatgaagcaaaaccagcctagtgaaaaagaatctgaacctgtggtggagctcaaaaagttagatgctgatatggccaagttgaaggaaagattattggacagagagacagaactgcaaaatgtgactgaggaaaacaatgcactgaagaaggaaataaagagggaggagttagagaagaataaaatccctgatgaggctgttgcttctgctgaagcagcaagggccacagagcgcgaggctttggtgaaacttggctacataacagaagaagctgataaaagtaatcgaagagtagcacagataactgagcagttagacgctgcgcaggctgccaattccgagttagaagctgaattaaggaggttgaaagtgcagtcagaccagtggagaaaagcggccgaagcagctgctgctatgatttctgctgggaacaatggaaagtttgtggaaagaacaggttcacttgacagtagctacaactctattactgccaagatgagttcaccttattcagaaaacacagatgatgactctcccaagaagaaaaatacaaacatgttgaagaagattggagtgttgtggaagaagaatcattaa

SEQ ID NO: 92996 - DNA, 243 bp, Glycine max
  Peptide Sequence Number=SeqID_209774
atggaagaggaagaactcccaaagtggatatttttgcttcaaaacatgccctacacaaaccaccttccaatggaacagtgtatcccttatattttgggaaagtcattgcccaatattggtgatgggcctatcattcacatgatgggtatggtggaaaaacaagccatgatgaaggtggatcatccaacaaatggtggtggcaatcatgagtgtaatattgaagattgtaataaggacatctaa

SEQ ID NO: 92997 - DNA, 456 bp, Glycine max
  Peptide Sequence Number=SeqID_209775
atgttgatcgacaacgatccatcaacttcattttcaaccttgatagcgtatgtcaaaagcactaaaggacacactgacgtacatgaaagcatggttggcaaacaaaaggctattgaaaacatctatggaaactggaaaaaattgtaccacgatttaccaagattgttgcaagctatgcaaacatatctttctagtatggtcatagagaaagaagcactgtcaatgcccatcgaacaagaaaatacaaaagggactctccttgtgacagttgcacaagatgggaacaacaaattccttccaatagccttcgttgttgtcgagggtgaaacagtggaaatcagatttgtcttcctcaacaatttgaaaatgcatgtcacatcacaaaatgatctttgtttgctttcagatagacacgagtcaatcaaaagtgtctactcaagacgagatagtgggtga

SEQ ID NO: 92998 - DNA, 210 bp, Glycine max
  Peptide Sequence Number=SeqID_209776
atgcctccgttgagacatggagtcctgaaggaacgaatgaggagattggagaagcgatgtgtactcaccaaaatagtcgaggatcatcttaaccccaatgaatcccagaacaacagcaatggatggctaaacaaaacccaaaaaatggatatcaataacaaggatggaagcataagcaaacagaagcattgtaagataccacaacaatga

SEQ ID NO: 92999 - DNA, 1272 bp, Glycine max
  Peptide Sequence Number=SeqID_209777
atggaagacgcacaaagaaaggacaaccctcactatgttcttgagttcgctcgttgcaatacatggttcttagtgcaagagacaattaacctaagagaggtgcaaccagttggaaatttcacacaagcttatcatgagtataaggcttacatagatcctatgtacacgttgaaaagtgtctcaaatgtgtatataggattgcttgacgaattgtgcaatgaagagttttgtggcgtgcgaccagttcttccccctccattaacttccatctccgacccacctcctcttttcgatggcaccaccaggttgtacatcagttattcttgcccctatgcacaacgtgtgtggatcgctaggaactacaaggggctacaagataagatcaatttggtccctattaaccttcaagacaggccagcttggtataaggagaaagtctaccctgaaaataaggtgccatccttggagcacaatggcaaggtgttgggagaaagtcttgatttgatcaaatatgtagatgcaaactttgaagggacacctttgtttcccagtgatcctgccaagaaagagttcggtgagcaattgatatcccatgttgatacattcagcaaagacctgttcgtttcattgaaaggggatgctgtacagcaagccagtcccgcttttgaatacttggagaatgctcttggtaaatttgatgatgggccattcttgcttggccaattcagtttggtggatattgcttatattccatttgttgaaagattccaaattgtctttgctgaggtgttcaaacatgacatcacagaaggaaggcctaaacttgcaacatggtttgaggagttgaataagctaaatgcttataccgagactagagtcgatcctcaggagatcgttgatcttttcaagaaacgcttcctggggcttcaagacaagatcaaattggtccctattgatcttcaagacaggccagcttggtataaggagaaagtctaccctgaaaataagcacaatggcaaggtattgggagaaagtcttgatttgatcaaatatgtagatgtcaactttgaagggacacctttggttcccagtgatcctgccaagaaagagtttggtgagcacttgatatcccatgttgatacattcaacaaagacctgaactcttcattgaaaggagatcctgtacagcaagccagtccttcttttgaatacttggagaatgctcttggtaaatttgatgatgggccattcttgcttggtcaattcagtttg

SEQ ID NO: 93000 - DNA, 1293 bp, Glycine max
  Peptide Sequence Number=SeqID_209778
atgccctcttcttctgttagtaacaaaggtcctcactttattctatttccttatgagcctttgtttcatattcttcctcatgtttttggctctacttgttttgtgcatgatctcaattcaggtcttgataagttgaaagctcgtgctattaagtgcatttttcttggttattcacgcactcagaaaggtcattcatgttactctcttaccaacaactatttgtacatgtattgcctattccctctgtcattccttaccagacagtttcttctcttccgttgtccttgttctcaacctgtggaagaaccccttattgaagagaatagtgcatcatctcctgctccaatcattcaccctgttgcggatggcgatcgagtgatgattgatgaaatgcaagctctagaatctaatcagacatgggctcttgtccctccacctccagggaaatctcttgttggttgcaactggatatttggacttgactacaatgacaccttctctttggtcgccaagatagcctatgttcgtctcttactgttgatggggagtctagtggatttgtttgcaagttacgaaaagcccctatatggcctcacacaaagtccgagagcatggtttggcagatttggttccgtccttcagagttttggcatgactcatgatgatattgttattacaagagatgaccacaggggtatccgagaccttaaaagtcatttgtttcagcactttcaaactaaagacttgggtcaattaaaatactttcttgggattgaagtagcccaatggtattgccatttgccaaaggaaatatgccctcgacatcctaaaagacactgggatgcaaaattgaagatatcgaagactagttgggaagctgaattatctcaccagactagacctgatatatcctttgcagtcagtgttgtaagtcaattccttaactctccttgcacaagtcacactgatatcgttgcatatacagatgctgattgggctggatctacgagtgatcgcatgtcaacctcaggatattgtatcctaattggtggaatctcatttcttggaggagtaagaaatgaaatactgtggccagtcttccatgaatggactactcacattgaaattgactgtcactttatgagggagaagatagtgtctagagaagtcaccactgcctttgtcaactctaatgatcaactgtcagatatttttaccaagtctcttagagggccagggatatcctacatttgttccaagctggatgcatgtgacctatatgctccaacatga

SEQ ID NO: 93001 - DNA, 363 bp, Glycine max
  Peptide Sequence Number=SeqID_209779
atggttttaaggttcctcgatgaaatcatgaaactgaaaagcaatgaagcagctggggcttcaatgaatggcttgaagtctctggagagtgtgttcctaacacttctctcagtaaatatcattgtttgcacttctcgaatgctgaactggaagactggtcgtgtacaaagcccaaggtttgaaaatccctcccggaaaattggtctgctaagttttggacttggctggcgtgacagaaacaagagattatcccttacacatcctatgaaacagggcaaaccaaatgctgaggaatctagcgaaagtttgcatgacaatggctctcccagaaaagaatctgataaccaagaaacagatagatag

SEQ ID NO: 93002 - DNA, 495 bp, Glycine max
  Peptide Sequence Number=SeqID_209780
atgaccgcggttgctgacgtgggcgaagtggaaggaggaagatacttccacgtcggcgtccacgtgaatgaaatcaaaagccgggtgctcgaacgcaacggagaggatcttcaaagatttggggaggaacacgtggcgcgatctcgcttgagaagtttctggctttttgtggaacgtcgtggttcacggagtttgaatcggtttgaaatgacggagcactcaggatcgtatgtgttaacttctatcgccaaagcgtttgaaaaattgtgtgatgggtttcatttgaggttgggtgatggtgggagtagcttttggtttgaagatttgaatattgccctggaggtttcctttgtggatgttcatgacattggcttgagggtgtgtgatgtggtgaatggggatgggaactgtgacctctccaatgtggattctctgcttcatggggatctgatgttactgggttttgtgggaatatcgggcatgcagatattttga

SEQ ID NO: 93003 - DNA, 501 bp, Glycine max
  Peptide Sequence Number=SeqID_209781
atggacccaacaatttatgagtgcgatatatttaccatgactgtaacatgggatggaaagagcgcaaagtttacaagctatgggatattctacaagaagggaggggtagaagacttgtttgctttcacaaattctgattatgcaggagatgaggaagattctaaaagtacatctgtgtcatggatgtccaagaagcaaccaatcgttactctctcaactactaaagcagagtttattgttgctgctgccagtgcttgtcaagttgtgtggatgagaagagctttgagaaacttaaatcatgctcaagaaggagcaaggagcaagcatattagagtgcgttttcattttttaagagatcttgtaaaagatggagaaatcgagttggtgcactatggaactcaggagcaggttgcagatttgatgactaaagccttgaaacttgaggccttgcagaagcttagaaagaagatgggaatgcttgatctcatggaagtaaactaa

SEQ ID NO: 93004 - DNA, 120 bp, Glycine max
  Peptide Sequence Number=SeqID_209782
atggtgccgcgcgggttttgcgttttggggagcttggactgggttttgaccctaacagtgaaagttgtcaattttgatgtgaaggcttgtgtgatgcaatttggaaatcctaacaactag

SEQ ID NO: 93005 - DNA, 717 bp, Glycine max
  Peptide Sequence Number=SeqID_209783
atggcggccataacccgcctcgcgaagcgcgcgttcgtcgtctcttccctggcgaggaggtgcctgagctcctccgtagtcaactgccacgcgccgccgcacgacgccacgtcgttccgcccgtttccgctgcgtgaagattcgagcaagcggtgcgtgcagtgggtgttcctcggctgccccggcgtcggaaaaggaacgtacgctagtcgcctctcgaacctcctcggcgtccctcacatcgccaccggcgatctcgttcgcgacgaactcacctcctctggccccctttcttcccaggaaatattggaaggggtaactgacattgacttggtaatcaatctgaagcttcgagaagatgttctgcttgagaaatgccttggtaggagaatttgcaatcagtgtgggggaaattttaatgttgcttccatcaacatcaaggctgagaatgggagccctggaattattatggctccacttcttcctcctgagaattgtatatcaaagctcattactcgatcagatgatactgaagcagtggtcaaagaaaggcttcgaatatacaatgaaatgactcagcctgtggaggaattttaccgttcaagaggaaaattattggagtttaacctgcctggaggaatcccggagtcttggcctaagttgctacatgctcttaatcttgatgattatgaggacaaacgatctgctgcagcataa

SEQ ID NO: 93006 - DNA, 1254 bp, Glycine max
  Peptide Sequence Number=SeqID_209784
atggcagacaacaaaaaacgccggcgcaaggaccccgccggcgacgagctacccttcaagaacaagctgaaacccgactcagcaatcatggaaaccctaaagcagttctccgcctcctcctcctcctcctccgtctcccaaaccctaaccctccaggacctctccatccccttccggtgccgcgaggtggcagacctctccctctcctccgtgcagtccaacatcgagtccctcatcctcaggatcgcccactccatcctctccggccacggcttctctttcgacgtcccttcccgctccgccgccaaccagctctacgtgcccgagctcgaccgcatcgtcctcaaggacaaatcctcccttcgcccgtttgcgaacatctccactgtgcggaaatccgccatcaccgcccgcatcctgcagctcatccaccagctctgcatcaagggcatccatgtcaccaagcgtgacctcttctacaccgacgtcaaactcttccaggaccagatccaatctgatgctgttctggatgatgtgtcctgcatgctggggtgcactcggtccagcctcaatgtcgttgctgcggagaaaggggtggtggttgggaggttgattttcagtgacaatggggatatgatcgattgcaccaaaatggggatgggagggaaggcaattccgccaaatattgatcgagttggggatatgcagagtgatgctttgtttattttgttggtggagaaggatgctgcttatatgaggttggctgaggataggttctacaaccgttttccatgcataattgtgactgcaaaggggcagccagatgtttccactaggctgttcttgaggaagatgaagacagagttgaagctgccggtgctggctctagttgacagtgatccttatgggttgaagattctgtcggtttatggctgtgggtccaagaacatgtcttatgacagtgctaacttaaccacccctgatatcaagtggcttggggttaggcctagtgatttggacaagtacaagatacctgagcagtgtaggttgccgatgaccgagcaggatattaagactggtaaggacttgctggaggaggattttgtcaagaagaaccctggttgggtggaggaattgaccttgatggtcaagactaagcaaaaggctgaaatacaggctttgagcacttttggttttcagtatctgtcagaagtttatttgcccttgaagttgcagcagaaagattggctttga

SEQ ID NO: 93007 - DNA, 1008 bp, Glycine max
  Peptide Sequence Number=SeqID_209785
atgctgttcagcacaagtcctgaagtggagtatttcaacggaatctcctctggttcaaacttcgctgatgtatctgcaagagactccgatgctcaagtttgtttggtgacatcttgtggtttattcagatttgacagggactggaagaaaattgaagattttgtaggttcaaaaacagttattcagattcgaagccatgctcagaagtacttcttgaaagttcaaaagaatgggacagtggcacatgtgcctcctccccgtccaaagcgcaaagctgctcatccttacccacaaaaggcatcaaaaaatggtttgcttctatttgagatgttgatattctctgcccttaaagttttggtgccactaccagcttctgttggttatgcttcatcaagaaatacgcttgcacctgggtttgcctcatgggatgaaacttccctgctgatgaatgccggagctgataaacccatgacctgtcaggatgaactcaacaatgttcatcatggaaatgaaggcatgcatactccttttgtttgttctgatattggatcaaaggggataacacagattaccaacagcagtctcagtggtgttggaaattctactagaacactactgacttctgagataccaaagcaagggaaacaagctccagtgcttcatggtttgccagattttgctgaagtttacggtttcattggaagtgtatttgatccagaaacaaatgaccatgtccagaagctgaaggaaatggatcctataaattttgaaactggtaaggctgcgtacaatatccctcccccataccttcgtatagcgaaaagcctctgggcaatgggtttttacactagtttgttgaagcaagataaggttttgttgctaatgagaaacctcactgtcaacttgtctagccctgacttcgaacccattggtgtacaaccccatctcctcgatgttttgtgtttgagaaaattaaacaagagcgtgttaatcctgttagaagtataa

SEQ ID NO: 93008 - DNA, 429 bp, Glycine max
  Peptide Sequence Number=SeqID_209786
atgtgtaacattaaagataaagaaggcaggacatctgggttcacagacagttgtgcgcctaaatctgtccatgaattttctgagagattcgtcgtctacttatcgcagactagccaaggcggccgagatcatgcggtgagacctgctggtgtcatactgcacactgaattgttcgacgagggtgttgaagctgtctatgggcctgggtgggagtccatcatatcagtcaacaaagggatgccaatagacgatcctccctgttggacgatgcatatgggtgagactcaagtcatctacaatgttgtctgtgcgtcaaggcctccaactaatcatggccagcctttagctttgtcaactcctcatcatggcgttgctccatctccgcgatgcggttttggagttgatgtaaagcgtctgtgtttgtcatag

SEQ ID NO: 93009 - DNA, 210 bp, Glycine max
  Peptide Sequence Number=SeqID_209787
atgccaaaaatcaatgctaatgttgattctccagctgctaagatggttagattgcctccaagaagaggtcaaatcaaagccaaaataatgaccgacttggtcagaatggtagaagaagtagggagagcaatgtgcagcaaggaaggaaaaggtagcagaggacatagcatgaggatagtaattctagtcttctatgctccgtctttataa

SEQ ID NO: 93010 - DNA, 189 bp, Glycine max
  Peptide Sequence Number=SeqID_209788
atgtctagttttgctctggaaattgcttctgggatatcaaagatgtttgctcagaagaaagtcacgctgagcccggggaggcacaagatagtgatactggatgaagctgataggaacctgattcggttggcaatgccaaagctcatggaagctgatgttcagtttgctgtgtttactggtagggtataa

SEQ ID NO: 93011 - DNA, 177 bp, Glycine max
  Peptide Sequence Number=SeqID_209789
atgatagaactgggaatttggcatgatgttagtttgcttagaacctctaagcctacaaaggatcaagctgaatgttttgatgatgccaaaggttacatgaatcatatgcttctcaaagatttactcaagacaaagcaattagagatattcaagatggataatcaagacaatctatag

SEQ ID NO: 93012 - DNA, 869 bp, Glycine max
  Peptide Sequence Number=SeqID_209790
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtacaccaaggcatccttcctgcagaaggggcgcgaaacccccatgctggcccgattctccacagtcgccggtgagctcggcagccctgacacctggcgtgatgtgcgtggattctcgttgaagttctacaccgacgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 93013 - DNA, 783 bp, Glycine max
  Peptide Sequence Number=SeqID_209791
atgtgcgttgattacactgatctcaataaacactgtcctaaagatccttttggtctccctcgcatcgacgaggtggtcgactcaacggccggatgcgaactcctctcttttctagattgctactctggttatcaccagatctcgctaaaggaagacgatcagataaaaacatccttcattactccttttggcgcatactgctacacgaccatgtccttcggactcaaaaacgccggagccacttatcaacgggctatccagcaatgcctccacgacgagattcgtgatgacctcatcgaggcctatgtagatgacgtggtcgtaaaaacaagggacgcaagcaccctaatcgacaacttagaccgaactttcaaggcgctaaatcggtacaagtggaagcttaaccccaaaaagtgcatctttggtgttccttctggtctactactcggcaacgttgtcagtcgtgacggcatacgaccaaacccttcaaaagtaaaagcagtacttgacatgcggccacccaagaatgtcaaggatattcagaagcttaccggatgtatggccgccctcagtcgcttcatctcaagactaggagaaaaaggcctccctttcttcaaactcttgaaagcgtcggaaaaattctcctggccagaggaagctgacgctgcattcactcagctcaagacttttctcacttcaccacctgtcctcacagcgcctcagccaatgaagacctacttctttacattgctgcaaccgacagggtcgtctccacggcaatag

SEQ ID NO: 93014 - DNA, 1095 bp, Glycine max
  Peptide Sequence Number=SeqID_209792
atgggtcgccattcctgttgtttaaagcaaaaattaaggaaaggtttatggtcccccgaagaagatgagaagcttttcaactacataaccagatttggcgttggctgctggagttccgtccccaaacaagccggactccaaaggtgtggaaagagttgcagattgagatggataaactacttgaggcctgatttgaagagaggaatgttctctcaacaagaggaggatcttatcattagtcttcatgaagttctaggaaataggtgggctcaaattgcagctcaattaccagggagaacagataatgagattaagaacttttggaattcgtgtttgaagaagaagcttatgaagcaagggattgaccctgcaacacacaagcctctcctcggtgctgaagaacacataattataaaggaagagaaggaaaccatattggagacaccacctaatcctattctattacaagtgtctcaagggattttagtttcctcaaatgagtcaccacttgtagtcaacaattcaagttactatgatggtggactgaatgtaacagaagaagcttcaagggacgttttcatgagcaagaatgctgctttagactaccctttgtcttactttgaattccaaatgggttacaacccaattagacaatttgatcagaaccatattgtggggaccaactcaagctatggattctcctcattgccgtgtctaaatagttcttctgatcatgggaacatgttggtggaggcggagttttcagataacaactcagcttctaaaatcagtgctttgatgaaggaaagttccagcaatagcccaagcatgagtgtttatccagctgggggagggtgccaaatgatggaaaatgcagggttctcatgggatggtgagaaccacaataataatactaagattgatcctttgttacagtttcatgtcaatgtggtaaaatctaaagagttcaagacaagttcgtggcaagaagggcagattctgactcagaattcgatagatttcactagctatccgttaatgtcactgtctgaggatctaaccggagcaaattttgatgttttccagcacatgtga

SEQ ID NO: 93015 - DNA, 836 bp, Glycine max
  Peptide Sequence Number=SeqID_209793
tcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 93016 - DNA, 878 bp, Glycine max
  Peptide Sequence Number=SeqID_209794
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcaagttgttccaaattctttgtccccacagagaatggatgctgtgaaggcggctgcaataggagtgaacaacatgatgatgggctattctgtcgatatcactggttatataagaccacaacatcaagcttatcgataccgtcgacctcgagggggggcccggtaccagcttttgttccctttagtgagggttaatttcgagcttggcgtaatcatgctaactcacattaattgcgttgcgctcactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 93017 - DNA, 321 bp, Glycine max
  Peptide Sequence Number=SeqID_209795
atggagacccttgccttcgaatttgcattctcccaagccagagatacattcatgttaagagaagagtcaagggagctctcggtcttcttcagatcaatgttcaattttccaacttctaaggagccattcaaattgaaaggttacctagatgctaattcaactacaaaggcccgcgatccaaagcctaaaaagcagcaagccactgagtggctacttccctttaggtctctacctccaccacctctactagttattcctgttgagccagatgtgaatgtcagatactaccctggctttagagatcataaagtgatggaatga

SEQ ID NO: 93018 - DNA, 264 bp, Glycine max
  Peptide Sequence Number=SeqID_209796
atgacggctcgtggtggctaccggtggtcgtggtgggtggcggagaagaagcgtgctcgtctcactaagtgggagtccacttttggcgctaagcgtgacaattctcgctcagtgcaattccctcttgggttggaatttgcgttgagcgtgacaattcgcgctgagcgcaattcctcttgcgctaagcgcaataattctcgctcaatgcagttccctctcgagttggaattgcgcttagcgagaggtcaaaatttgttattttaa

SEQ ID NO: 93019 - DNA, 1119 bp, Glycine max
  Peptide Sequence Number=SeqID_209797
gtttcagaacccgtcgactcgcacgcatgtcagactccttggtccgtgtttcaagacgggtcggatggggagctcgcaggccgttgcagcgcagcgccccgaggggcgcgccttgcggcgcgcggagaccggccgtgccgacgacggcgaccggaggcacctagggcccccgggcttaggccgccggcacggccgacaacagtccacgccccgagccgatcggcggaccagcagaagccgttccgcatacgaccggggcgcatcgccagcccccatccgcttccctcccggcaatttcaagcactctttgactctcttttcaaagtccttttcatctttccctcgcggtacttgttcgctatcggtctctcgcctgtatttagccttggacggagtttaccgcccgatttgggctgcattcccaaacaacccgactcgttgacggcgcctcgtggtgcggcagggtccgggccggacagggctctcaccctcccaggcgtccctttccagggaacttgggcccggtccgtcgctgaggacgcctctccagactacaattcaggtgacgaagccacccgattctcaagctgggctggtcccggttcgctcgccgttactaggggaatccttcgggtggtcccgactgacctggggtcgcggtccgagcaacgatgtgctgcggtgcccgaagggtccttagggccgatgcaccggccacgtgtcggggcgctgcaccgagaacaactaagtgtcgcccaccacgtgctgtgcccgacacgaatcgccggcagccccaacttcggcccaccgcgccatgcggcacggggagccaaaaaccacatccctccccgagggtgggttgggagtgtctgttggcgtgacgcccaggcagacgtgccctcggccggaaggcctcgggcgcaacttgcgttcaaaaactcgatggttcgcgggattctgcaattcacaccaggtatcgcattttgctacgttcttcatcgatgcgagagccgagatatccgttgccgagagtcgtgtggattaagatatcatcgctgctcagggagcggaaggcatgccgaccactccgctgtgcaaggcaacatgagtgttccttga

SEQ ID NO: 93020 - DNA, 867 bp, Glycine max
  Peptide Sequence Number=SeqID_209798
atggagggggcatcccttaattggttccctcgctggaaggaaggaagaatcgggattctatcctcgtgcgaaggatttgcaaatgttcccttgatgggaacaaggggttgtattaattataatcccgttatcaccatcagacagcttggctaccccatgagaggagcgccgtcggaggaaagcatcgcgcctttcatcgcacggggtttcagtgaccccaacgcaaggatacctcaaggagttcgcaaggcatgggatgcagtgcaaaggaaggacaaaaagcttaggggaagtagtaatgggatcatcggtggctattggaagtggctgagagtccgcacacaaggcttggattggctcccaaagctaaggcctgcaagagaggaaaaggttgaagctccgaaagaaagtgaggaggtacaagccgtaaaggcggagcttgagaaagtccaagcagtcaaggagaagttcaagtcaacagccatcaaagtccgaaaggagtatgatgaactgaagaacatcaacatagccaccgccgaagccttggaacgggaaaccaagagggcccggaaggaagaacacggccgaaacaagttccgaggagctttatggggcaacaatagtgagcttaagcttcgaagagacgagagggatcagtcacgggtcgaaggcatgatcttgaaggacgagttaaaggcttaccttaggtccaaaagaagtttgtcccaacagttaagagagacaaaaggaaatatgttggccatcattgataaatacaaagaagagctaaacctagcagctgctcatgagcaaaggctaggggatgagtacgccaaggtatcaccggaaaaggaagcaagggaaagg

SEQ ID NO: 93021 - DNA, 332 bp, Glycine max
  Peptide Sequence Number=SeqID_209799
atgccagctattacagaaccacggttcaacttgattcatgaaaaaaatttaacacccggagatgaggtagctttctactaccgttttcacgagcatgcatgggaattgctcatcaggaaaactattgaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 93022 - DNA, 408 bp, Glycine max
  Peptide Sequence Number=SeqID_209800
atgtgcaaaggctattgtaattcgtttttgggcactagtaatcgattacatactttgggtgtttgggagaccctcgaaggcaatgagaggtgccgattccgtggcacaattcaactcactgctacttcactagtacatccggagcaacccgcatgcacacttcagcagcctttggagtggatactacctacacctacaccatatcgactagttgagcctgttcaattgatagaggtgtcattatctgaagaggattttgaagtggacccagaggagctacctcctgaacctgctatggatgcccctgacttaccagagggtgatgaggacccgctgttgattctccagaggatattatgtcagcatctgaggcaaactctacagaggagagtggccctggagggatag

SEQ ID NO: 93023 - DNA, 720 bp, Glycine max
  Peptide Sequence Number=SeqID_209801
atgcgccagttgttccgggagtctggctacgagacagaatatcgcatactaagtgcagatgactatggtgttctgcagacacgcaaacggattattctggtcggtagaaaaggatgcatgacagggttctatcctgaacctgaaaaatggaatcccgcagttagagtagcagaagtatttaatgatcttccatctctcaaagcagcagacggtcaggtttccccctgccaattgaaaccctacgctggaaaatggctgtatgaggctggaataaggaatgatgcaatgcctgtgacttggcatcagtcgcgtccgaatacagctcaagatctggagatctatagaagggttgtagagcaatggaaccagaagcagaagcgcctagaatacaatgagcttccagattacttaaaaactcataacaacagaaccgcttttgtggacagatttaaagttgttgctgctgacttaccttcatctcacacggtggtcgctcatttatcaaaagatggacactactatattcatccagatatcagccaaaaccgctcaatcacaccgagagaagcagcaaggcttcagactttcccggacgactattattttgaaagtattaaaccgaaaccaggaagaacagccgcattcaggcagataggaaatgcagttcctgtattgctagccagaaagattgctgaaaaattgaaggataaatggatatga

SEQ ID NO: 93024 - DNA, 384 bp, Glycine max
  Peptide Sequence Number=SeqID_209802
gcccgtaaccagagctggaaaccccagggccctgttggacttcttcggggccctgttggacttcttcgggtccactgggcatcttgtggggggagattggcattgtggtcgctgggcaaaatgttgttaaatagcaatgtcatccacgtaagagtggtcatgttggtgcgcatgatccacactcatctttttgcagcggcactggtgaaatcttgccccggcatgcatagtagatgtgtgatagcctccctctctggatgtgctcgcacagttggtcgccctccaatatcagggggtggcccaggaactgataaaaggaaactactggccctcgtaaccgggagtgcaagtctcggtgaagcatctaagggcaaaggaccttaa

SEQ ID NO: 93025 - DNA, 234 bp, Glycine max
  Peptide Sequence Number=SeqID_209803
atggattctatttggatgaggggtatttgttcaaagacggaaagctttgcatactgttcaattgcggcaagtgcaccggatcgcgaaagtagtataaaacggtgtgtaactaactatgaaaaaggaaaatcatattcctcttgttggactaaactcgaccagaaccgcattaagacaaacatacaacaactaggttaccgtacctcgatccctcgtgataatacgatatactag

SEQ ID NO: 93026 - DNA, 360 bp, Glycine max
  Peptide Sequence Number=SeqID_209804
ggcgatcggtgcgggcctcttcgctattacgccagctggcgaaagggggatgtgctgcaaggcgattaagttgggtaacgccagggttttcccagtcacgacgttcggaccagacgatgtaggtgtcgagtcattcagcaatggcgcggtggcagagagtgcagacaggtgtattggcgataagggactgactggtgattctggtccagaattgggaatcgacactgtgccttttgataaaactgagaatggatctagtgcatattcgattggaagtgtaaatttttgtcctaatccagcaggaaagggaccaaacgtccatgggattactggagtatcggatggcccaataaatctcaa

SEQ ID NO: 93027 - DNA, 444 bp, Glycine max
  Peptide Sequence Number=SeqID_209805
atggcttttgtttctctggttgaaccaggaaacattgatgaagctttgtgtgatgaacattggttaatgtcaattagaaccaagtcgatgcttcaaaataaacttgacgaatttggaatcatactgaggaataaagcaagattggttgcaaaaagttacaaccaagaagaaagaattgactatgatgaaacctacgctccagttgcaagactttttcatatggatgtgaagagtgccttcctcaatggtctcattgaagaagtgtatgtagatcaaccactaggatttgtggactacgaacatcccaaccatgtctacagactgaaaagggctctgtatggtttgaaacaagcaccaaggtcatggtatgatagattgagtagctttctaattgagcaatctttcactagaggccaagttgagaaaacattgtttattaagaaa

SEQ ID NO: 93028 - DNA, 624 bp, Glycine max
  Peptide Sequence Number=SeqID_209806
atctgcaccgacgaccgctccggccgggctcgcgccctgggttttgcagcgaccgccgcgccctcctactcatcggggcttggtccttgccccgacggccggcgcggaggtgggaaacgtaacccagcttccggttcatcccgcatcgccagttctgcttaccaaaaatggccacttggagctctcgattccatggcgcggctcaacagagcagccgcaccgtcctacctatttaaatctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacc

SEQ ID NO: 93029 - DNA, 912 bp, Glycine max
  Peptide Sequence Number=SeqID_209807
gacgaggtgttccccgaccgcgatcatttcggccgcatcttctacaaccaggccaacctgtcggcgcagggcattccgcagatcgcctgcgtgatgggcagctgcaccgccggtggcgcctacgtgccggcgatgagcgacgagacggtgatcgtgcgcgagcagggcacgatcttcctcggcggcccgccgctggtgaaggccgcctccggtgaagtggtgacggccgaggaactgggcggtgccgacgtacacactcgcatctccggcgtggccgaccacatggctgacaacgatctgcaggcgctggcacgggtgcgcgcgatcatcgcacaggtgaaatggcgcaagccggatccggcgatggcggtgcaggcgcccgaggaaccgctgctgccggcgcatgaactgtatggggtgattcccgccgatacgcgcaagccctacgacgtgcgcgaagtgatcgcacgcctggtcgatggctcgcgctttgatgagttcaagccgtgctatggcgcaacactggttaccggcttcgcgcatttgaacggctacccgataggcatcatcgccaacaacggcatcctgttctccgagtcggcactgaaaggcgcgcacttcatcgagctgtgcacccagcgcaacatcccgctggtgttcctgcagaacatcaccggcttcatggtcggccgcaagtacgaacagggcggcatcgccaaggacggcgccaagctggtgatggcagtggcctgcgccaaggttcccaagttcaccgtggtcatcggcggctcgttcggtgccggcaaatacggcatgtgcggccgcgcctattcgcccaacttcctgtggatgtggcccaacgcacgcatcggcgtgatgggcggcgaacaggccgccagcgttcaggccacg

SEQ ID NO: 93030 - DNA, 216 bp, Glycine max
  Peptide Sequence Number=SeqID_209808
atggtgggttacacaccttcaagctttgcggatttggtctttgctggcgaaatgatcgaagtgggtctaaaaagaggcaaatctgatcatcatgctttgataaatgcaaaaactggggcaaataaagaggccataacccctgctaggtttcctcaacatccatttttccgaggatacgacttgaacgcaacatgtgcatatcatggggagccctag

SEQ ID NO: 93031 - DNA, 567 bp, Glycine max
  Peptide Sequence Number=SeqID_209809
atggtggcagcagaggctagagtaacatacagcaggcaaaatgacaatctatggtttgctataatcttaatcacttctgtggtggccacaatgtatcaattgtactgggattttatcaaggactggggatttcttaatccaaaatccataaatccatggcttagaaatgatctaattctaaagaataaaaacatatactatatgtctattgtcttaaatattgtcttaagagtgacgtgggtggagactatcatgcacttcaaagtagggcctgttcattcacaactactagactttttattagttgcacttgaggttattcggagagggcattggaatttctacaaggtattggatagaagactccaagaggcttgggctagagctactaaagaagaccctagggttctcatgaaccttagggtagatttgatggaagcttgcttgtggggcttctatggaggctggatctttgagcttcaatggggtcctttaatggtgattttccaccatggagatgcagcggaagacaaaggagaagaggtgagaggaggcgccatccactag

SEQ ID NO: 93032 - DNA, 261 bp, Glycine max
  Peptide Sequence Number=SeqID_209810
atggaggaaaagagtgaaggttacaatcattactctactgatggtggcggtgtaattggggctgcaggagaaaagactggctgtggcttggcttctactgatgttggcggtgtaactggagttacaggctcacttggcgtggaatgttctcaggcaacccttgaagactatggtgggaactggattatagtctatgtactcataaggaagctgaaggaggatggtcatcactatgaagcagatccccaagacacactctag

SEQ ID NO: 93033 - DNA, 222 bp, Glycine max
  Peptide Sequence Number=SeqID_209811
atggcaagtctaatgacgcgcggagaccaatcatggccatctgccacctttgtcaaccataggcaagcgagcccgttgatcgatactactttagtttcaccttcatcatccaaagacaacaattcagatgacacgtggagacaacatatgttcgtccgcacccttcctatccaaagactatcgaagtcccctttatcatctagagacaggaaagtccgatga

SEQ ID NO: 93034 - DNA, 783 bp, Glycine max
  Peptide Sequence Number=SeqID_209812
atgtggaagccgcagaaagagtcattggaaacgactttccagtcctttgaggtggtaagtaatgcttccatagaatccctcccaatgcagtcccacatgtctggcatgacaatgatggtggcccgggtaatgttagggcatggctatgagcctagaatgggtttgggcaagaataatgatggcatggccggcctagtagacatcaagggaaaccacgggagattcggatctgatgacgagtcttgtgaaggtactaataccgaggacccaaccatcgattttgagcaagaagcaagtcgagcggaggatgaggaagatgaagatatagggtttttccaagagctagaaaggataatcactcaggaagaccgagagatgaagttgcaccaagaagaaacagagattgtaaacctaggtgttggcgatggaaggaaagaagtaaagatgggtacgcatatgaccacacctatccgtgatgaattagtggctctactatgggactaccaagacgtctttgcttggtcgtaccaagacatgcctggtttgagccgcgacattgcgcaacataggttgcttttgaatcccggttgttccttggtgaaacaaaagctaagaaggataaagcccgagatgtatttgaaaatcaaagaggaagtgaaaaagcaatttgatgttggcttcttggaagtggctcgaaagcttgagtgggtggccaacattgtgccagtccctaagaaagatgggaatatgcgaatgtgtgtggactatcgggacctaaactga

SEQ ID NO: 93035 - DNA, 531 bp, Glycine max
  Peptide Sequence Number=SeqID_209813
atgtgggactgcattgggagggattctatggaagcattacttaccacctcaaaggactggaaagtcgtttccaatgactcttctgcggcttccacatatggcatagagaaggggcagctcaccagaacatcttcttcccccgaaacaatggctaaatgcccttccaccatgaatttcattttttggtggagtgtgggatcctatctgaattgggatgtcgatctcccctcttacttctcggcaattgccatcgaaagcctggaccaccatggagcttggcctcaggctcgagccgttgtcgatgagcaccttggccatgatgtgttccatgcatttgaccgatacatgcagagctccattatgccctcatccttcggcaggaatctcctcctcggcgaaggtgaggtagttgttgggtgtgatgtcgatgacaatcccctcgaagccttctacggagatgtcttaggccacatgggccttgttcaaaaccttaaccaacaatgctcggtgaggctcagagctcatgagtaa

SEQ ID NO: 93036 - DNA, 282 bp, Glycine max
  Peptide Sequence Number=SeqID_209814
atggatattaacccagcctatagtttcttgttgggccaaccatggattcactcggtgggagtcctcccctcaacactccaccaaaaaatgaaattcatggtggaagggcatttagccattgtttcgggggaagaagatgttctggtgagctgccccttctctatgccatatgtggaagccgcagaagagtcattggaaacgactttccagtcctttgaggtgggcatggctatgagcctagaatgggtttgggcaagaataatgatggcatggccggcctag

SEQ ID NO: 93037 - DNA, 141 bp, Glycine max
  Peptide Sequence Number=SeqID_209815
atggtgatccgatgcctttgtcaaacggaggcaagcaagcctgttgacacgcagagaccaatgtggtcacttgcgcattttcgacgaagactcaatgatgcaatcctaccccggctccataatgtaggtagggtaccctag

SEQ ID NO: 93038 - DNA, 312 bp, Glycine max
  Peptide Sequence Number=SeqID_209816
atggtcaataccgcgtcgaatgtaagacaaagagaaaccaaggcccgtggtcagcagatcattatctcacgtccggctcaagacgttaaagaagcgctactgggaggcaacctagagatggctctgaagaagctttccacgaagaggtccagaaaggacgctactggagaaagctccagcgctaccccgggttttgaccggcaccgatttcggagtgccaagcatcagcagcgcttcgaggccatcaggggatggtcattccacaaagagaggtgggtccagcttagggaggacgagtgccctgatttctag

SEQ ID NO: 93039 - DNA, 386 bp, Glycine max
  Peptide Sequence Number=SeqID_209817
atggaggagttaaaagatggttacatttctgagaatgggaaactggttgatcatttcttgcaagccattcatgctgcagagaaaaggcaggctgacttagatgcatatgtttctaatgaacagaagaaactgttaaaaggaaatatatggaaagaagttgaaagatgcagctaccagagaacttatgctcgccgaggaggttgcaatgttggacaggacatccaagatgctcacaatctgaaaacaagcagccatgtacctcaacagatgctcaccagacatgagggaagttcaatggagctgatggtgacaccaaacgactggggtgacgaggagacgacaatgacgggtcacaaaatgcagtgtcgtgcaggagggagacggcg

SEQ ID NO: 93040 - DNA, 534 bp, Glycine max
  Peptide Sequence Number=SeqID_209818
atgaagaagattctaggcctacaagctccaatggagcttacatcactcaacgtctatcgaatgagactatcgcaaccctttttaattgccatcctgagacaatcgagttcgatggcgcataaaggctataatggtcacacactctttgctatccagagacaatcgagtctgatagcatacgtagacaccacatggttatctgcaccttcgtcatccagagatggcaagtctgatgacgtgtggagaccaatcatggtcatctgccacctttgtcaaccagaggcaagcgagcctgttgatcaacacgcggagacaacatatggtcgtctgcacccttcctatccaaagactaccaaaattcacctttgtcatccaaagacgatcaagtctaatgacgcgcaaagactcttttttgcttaccagagacaatcaagtttgatagcatgcagagacgtcatggctatccagttttatcactttcaaggcactgaggtttttgctgatgcccctgatgctcttttctgctctttctaa

SEQ ID NO: 93041 - DNA, 501 bp, Glycine max
  Peptide Sequence Number=SeqID_209819
atgtcggctacatcttacattagggatttcatagtcacattgggaaatttgttagctcaaagatatgtttgtctaagtttgttgagcaatttcagaggcgccttacttattttagatatagggaattcgaggcagattttgatagtgattatggtggtccaaaaatgccaaaaaaaagttattcggaagaggttcaaagatggagtgcttaattggaattcaaatcttatagcgagacatgctcaattgcattttagctttagggaaattgctctattgtcgtattgttttgatgatgattataatcacatagttgacgtgcttgctggagagcattcaaagttgaggttgaagcgtggttttgacaatgctattgaagacaatcataaaactaaatctatcaatgcaatagtgcaagatcctatcattgttagaagtaaaggatgtggtggtactatacagtcaacctcaggaagatccaagaggatcatcaaatgttga

SEQ ID NO: 93042 - DNA, 763 bp, Glycine max
  Peptide Sequence Number=SeqID_209820
atggctctcaagaaatcagaactctattcctcgctttggaaaagctgcgacgcgctgcgcggcggcatggatgccagccagtacaaggattatgtactggtgctgctgttcatcaaatacgtcagcgacaagtacgctggcaagccctatcaaccactcaccattccgcgcggcgccagcttcgccgacatggtggcgctgaagggaaagagcgacatcggcgaccagattaacaagaagatcatcgcgccactagtcgacaagaatcctcagctttcgctctccgacttccccgacttcaatgacgcggccaaactcggtaccggcaaggagatggtggggcggcttaccgacctggtggcgatcttcgagaacaaggcgctcgacttctcgaagaaccgtgctgacggcgacgacatccttggcgacgcctacgagtacctgatgcagcacttcgccaccgaaagtggcaaaagcaagggccagttctatacgccagccgaagtgagccgcgtaattgccgcgacgctgggtatcgccaacgcgcccaccacgcatcagaccaccgtatacgacccaacctgcggctcgggctcgctgttgctgaaggtggctgacgcggcgccgaccaaggtggcgttgtacgggcaggaaaaggacgccgccaccagcggcttggcacgcatgaacatgatcctgcatgaccagcccacggctgagatcacgcagggcaacacgctggccgatccgaagttccgggatg

SEQ ID NO: 93043 - DNA, 366 bp, Glycine max
  Peptide Sequence Number=SeqID_209821
atgattcatgatcttggacaagaatcttttcagcaagcacatgcctctatgtatgatacattgcaaagtgatttgaagaagcctttgtatccggggtgcaagaagtctttgacgttgttgtcggcaatgttaagtctgattcatgcatgccctaatgattccatattgtacaaaaatgagtttaaagaaatgcacaactgccccaagtttggggtatcacggtataaagtcaaggatgatgacgagtgtagcagtgatgaaaacaccaagaaaggccccccagcgaaggtgttatggtatcttccaatcattccaaggttcaagcatctgtttactaatgcagatgatgcaaaagaccttacatga

SEQ ID NO: 93044 - DNA, 405 bp, Glycine max
  Peptide Sequence Number=SeqID_209822
atgagtgattacaaggtggagatgattaatgatggaatgcaagaattttatgtgcaatttcatggacccaatgacagtccttatcatggtggtgtgtggaaagtaagagttgagttgccggatgcttatccttacaaatctccttccattggctttatcaacaagatctatcacccaaatgttgatgagatgtcaggatcagtttgtctggatgttatcaatcaaacctggagtcccatgtttgatcttgttaatgtgtttgaggtgtttctacctcaacttctgctgtatcccaatccatcagaccccttgaatggagaagctgcagctttaatgatgcgtgatcgaccaagttatgaacaaagggttaaaggtattgatcctttcctgtttttcattttctaa

SEQ ID NO: 93045 - DNA, 405 bp, Glycine max
  Peptide Sequence Number=SeqID_209823
atgggccccgatgggtgcagagaaacgcgagagactggaaccagagaaacgacatgcaaaccgaggcaggattttagcatttcaaaaggaaaattcagaagctcttctcgccttctcatgttgcttttcttctccccttctcatccaccattgttgcccattaaagctccaaactttgctcacaatttctactccaaattgcaaaaggaagccatttttggagtcgtgaagcgcacctctacgttgtgggacttcaaatttcaggtagaaaagtgggagattttgagggttagagaagctaaatttggggttagtgtaaatgggagtctaaagacttgtgggaaagcttgggcagagcaaatgaggaaaatgagtgaccaaagtgaaagcaagagtcatttctag

SEQ ID NO: 93046 - DNA, 372 bp, Glycine max
  Peptide Sequence Number=SeqID_209824
atggatatgaacataggagcacttatatctggacagatctcgctcatttctcagtccaactcctcgaggcttggatttctagccctcatcactgccttgtgcaaggcccgaggagtcacctcagattctctcacttatgagtcactcagcccagccattaatttggcttatattaagaagaattactggaacctggatgacccttcggtcacttttctagggacccacaaatccagggctagaggatctaagtccccatcttcttcagctgcccctgctccccctacttttgctctcccttcaactccagcagccccaattcttccaggtcccttcgttcagagctcaaagcctttcatgtctatgctgtag

SEQ ID NO: 93047 - DNA, 753 bp, Glycine max
  Peptide Sequence Number=SeqID_209825
atgtggtccaccttgacgctttcccgggacctcgctcatagtggtggttacgcttgggggtttgccgcgctggttcatatgtatgaccagttagatgaggcttgtaggaccaccacccgacagcttgcggggtacttgacgctacttcagtgctggatctatgagcacttccctagtgtgcatcagtgcgtgactgaggatacataccaggagacgtccccacgtgcttcccggtggttgacgtcgaaggcgcacatgaagggcatcacaggagcaccctacagggcacgttgtgatggtttgaccgtcacagatgtgtcctggttgccgtacacggagcatcggggtgttagggcgtttcaggagatttcatcgttccagggtcagctcagatggggtcctatgatcgtcacagttcgaccggagagggtggtacgccagttcggttacatccagagcatccctccgccgcctgttagtgcacgattgtcacaggatcagatagatgacaggtggatggagtttgcagatcacttactacctgcgggtcagccttgtctagtgcctgggcaggatgattacgagggatatgaggcgattgcacagaggttggagcgtgtgctcaaccttaggatagtcactgcaggcacagagttatatgacattctgcaggactgtctgacgatcgcaagagggggacccagtgctgacgggacggtcagggctcgtcagagacgtcgcacggaccattga

SEQ ID NO: 93048 - DNA, 327 bp, Glycine max
  Peptide Sequence Number=SeqID_209826
atggatacctcagagccctacattggggcaatgaaaggcaccatgcgtgagcctcaggcaaacctaggggcaagtcaaaacatctcacccggtggacccttgggtactagtaccctcaccttcagagggctacacaccgtcgccatcagaggactacacgccctcaccttcagaggactgcatgtcctcgcatttagaggactacatgtcctcaccttcagagtactacacgtcctcaccttcagagggctacacgccctcgcctttagaggactacacgccctcgcctttagaggactacacgtcctcacctttagagggctacac

SEQ ID NO: 93049 - DNA, 253 bp, Glycine max
  Peptide Sequence Number=SeqID_209827
atggctcagcagttcgctggtttccaccagcggcaatcccactacggcgtgataacttccattgatgcggcgcacaaagttgccgcccaggccctgaataccgtacgcgccggctttatccatcggctcgccgctggcgatatagtgcgaaatttcctctgccgtgatagtgcggaatgtcacgtctgtggtcaccaggcaatccagttcaccctgcgcatcggccagcgccacggccgtcatgacctgatgg

SEQ ID NO: 93050 - DNA, 229 bp, Glycine max
  Peptide Sequence Number=SeqID_209828
atgtttcctttcgactcccgacatgtcgcagaacttcacggattgcttaacgatgggtgtcaagttcctcgaagtggtgaagatggatccactcctggaaatggtgcctcagctgatgctggcactggtgactgggctgtaaaactttcattatctcccacaaaagaagataagtctgctaaagctggaagtagggctgaagtagaagatgtagggatgccaactattg

SEQ ID NO: 93051 - DNA, 528 bp, Glycine max
  Peptide Sequence Number=SeqID_209829
tccctcagcaagttgaagaaaacacttcacaagacagtctccaaggacaaaaaggactttccccccaccgttaagttcgacgaactcgccctcgctgccaaggacatgcaagccatgagagattgctacgatagcctgctttctgcagccgctgccacgcaaaacagtgcttacgaatttgccgagtcactgcaggaaatgggtacttgtctactggagaaaactgccttaaatgatgatgaagaaaatggtaaagttttggggatgcttggaagtgtgcagcttgaacttcagaagcttgttgatagctatgtgagcttttatttgggtcgttctcacatagtactgacaataaccaatccatcagagtctcttcttaatgagctaagaactgttgagactgttctactcactagagatgacaagaggatgcaggacgagtggggtgagtgggacaatggtactgggggtaaaaagttgtgtggtcccacagctctgtctaaaaacgtgatgcctgtttctacatga

SEQ ID NO: 93052 - DNA, 156 bp, Glycine max
  Peptide Sequence Number=SeqID_209830
atgatgatatacatccaagaactgcaacaagaacagatctctcgacctccatactggcagcagatgaatcccaaacaattcatggttgtgggaattgcagaaggtgagaatgaagaagggatgggtgctggtgttggattaggggtgtggagttga

SEQ ID NO: 93053 - DNA, 1668 bp, Glycine max
  Peptide Sequence Number=SeqID_209831
atgggcttgccacagattcccccaaatgaaactgctgaaaaagttgcacttgtgggtgcagctttaactagctcaccgcagttttctgatgcaagtccctctgccataggcagcatgaacagtgtaaacactggtgggttggccgggtgtactctgggatcttcgtttgatgatttcccgaagaatgcctccttagaaatttcaaatgtttctgacagtacattttatagaggagccatggaagtcacttccaatgtccacagtttgaagattggttcagcagatagaagtactccttttgctccaaaaagtggacggaatgttcatattcctgcttcaagggttgttggttttgaatcgggccgaactaatacttcaactgatggtttgactgatgtttcagctgtaaatcttcattcttctgtttttactaatttccctgccaatgacactgaatctgccagttcattagtcaggaagcgacttttatctccactgagcagtatgctctccccaagtcatttcaaaggtgatcctcttgacattggctgcagaagtaatgagaccgaatcccttgttaagaatgataactttagaaattccatcgcacaggataataagaaggcaaatattggaagtaaaagcagttatacagtgtcttcttggtccttgacaagttgcttggaacaaagaaccgtgccacacagtactgaatccttttttcaaagtgatggtcctttgaaggaaaatagaggacttctgtctcagggtagtttacccactgctggaattgatcattttagtgaattgagtcaggttaggcctcaaagtggcataatatccatatctcctaaaactgtgagctctcctctgtccttgtcacctcttggtcgtaaattctctgaaagaataaaaactgctggaggatgtaggaatgttgttgaagagataaataattggaatataacttcaaggagtatagaacaatcacttgataattccaattcacgcctcatgtcaaattgtaaggatgacaattccagagttgcacgcaaatcttttgatgaagttgaattcttatgcaaagatttctgtccatcttctctggatgatattgccgagatgagttggccactatgtcaagaatcagctcccacttctcactccatgagattcactagaagtttgagtgggctttcggtcaggaggtctttagttggttcatttgaggagtctcttttatctggccggttcttatctggaaacaatagcaagaaaatcgatggttttcttgctgtgctaagcattactggtgggaacttttctcctaaatctcagaagcttccattctctgttactagcgtggatggagattgctatctactgtattatgcatcaatagatcttgctggaaattcctcttcaaacaagttaagaggccaattgctgaaacgagggtttggaaaagatgattcccaaattgtaaaaagccgtctgcgtataccaatgaagggacggattcaactggagaagtgtggtatccttagcattaaggacaaatgggggggggggggggggtacacagcctacagaccagttcacatggcccacaaggctgcacaggctcaggttggtgtgaactgggctataaagctagtccccacttaa

SEQ ID NO: 93054 - DNA, 735 bp, Glycine max
  Peptide Sequence Number=SeqID_209832
atgggttgtggcatctcaacaccaggcgttgaagatgcatcctttactcaacatacaaagggtcgtcaccatgttattgtttcacctgttgtagacaaaaagaaggattttgagaatggtgacaaggatgatgtgacattgttgcataggaacaacaataataataaggatgttgtcatggtaatgaagccattgggtgatgatgaaggcaatgatgggagatcaaatcggaaaaagttgaaagacaaaagtgttgtggaaacgaataatattaataaggaggaagaaagggtgtttgggaatggacgaaaagaaaaacataatggtggtgatgataaatattgtgaaaataataatattgaagagaagcatgaggatcatgatgataacttcattgttggcccagggtcaccgagttttagggaatattgtaatgactatgattatggggatcgaagttctgtggaagattccaatgattatgactctatggaaagcatcaagaatggcagtgaagattcatcaatcaataagaataagtcaaagaatgagaaaagtatcaattcaaaaaaggaccttgagaagaaagagagaagaggacgaggatttaagaatgttataaataagggaaaggtaagaggaaagagaaatcttctaaacttcgcttgctacaatgctagtagcgagtctcatgttgaaggttctttcaacaaaatagctccaaaaactgcatga

SEQ ID NO: 93055 - DNA, 225 bp, Glycine max
  Peptide Sequence Number=SeqID_209833
atggatgagtttggtatttactttggtcatgtacatctgaatgaacaagtgaatgaggctctgaatgacactatgattgaggatgttcctatagacgaggatgatatagttgttaatgaaaatgacattgtgaagttaagtgaagattctttattggagatgtgcattcagattcagacatggataaaaaattttgaagaaaggggattggatggaagaaaatag

SEQ ID NO: 93056 - DNA, 327 bp, Glycine max
  Peptide Sequence Number=SeqID_209834
atgaagaacaatatgaatggacctcaacatcagggaaaaccatacttgacctctcctaagcaatatggtaatccccctaacaatcggaggacaattgctatgggctttgctagtggtagtggtcgcaaacccactactttctcaacccatatcacttgttacaagtgtggtaagccaaggcacatctccgcaaattgtgcttataaaggcacgacctgtttcaactgtagacaaaaagggcatattcagagagattgcccatatcccaagaaggagcagaatgatgggggcctaaatgaccaaactggacatctgaaggccacgtga

SEQ ID NO: 93057 - DNA, 456 bp, Glycine max
  Peptide Sequence Number=SeqID_209835
atgcgggaaccatttggtcccgcactttttcaccttttgtcatccagaggcggcgggcccgatgacatgcgggaaccatttggtcccgcacttttttaccttttgtcatccagaggcggcgcaccggatgacatgcgggaaccatttggtcccgtactttttcaccttttgtcatccagaggcggcgcaccggatgacatgcgggaaccatttggtcccgtactttttcaccttttgtcatccagaggcggcgggcccgatgacatgcgggaaccatttggtcccgcacatttttaccttttgtcatccagaggcggcgggcccgatgacatgcgggaaccatttggtcccacacttttttaccttttgtcatccagaggcgacgggcccgatgacatgcggagacaaattatggtcatctgcacactttttctatttgtaagactcgatgagtga

SEQ ID NO: 93058 - DNA, 307 bp, Glycine max
  Peptide Sequence Number=SeqID_209836
ggatcgcgcccgcaagacacccagtggacccggagaagtccaacagggtcttagggtttctagctctgattacggtactctgtcagttctacagagtgctcgtcacccccaacaaggtcatcaagcctctattaacagggctttcatcaagaagtattgcacccccaggcaggcagagggagagacaccacaacatcctagggatggccaacaacaggcaacaaatgcaccaccgccacccccagagcccctcagctcatccacaaaaaggttagagtattgcctacgacacatggccgaccaatag

SEQ ID NO: 93059 - DNA, 777 bp, Glycine max
  Peptide Sequence Number=SeqID_209837
atgtttgatgagttcctccaggaactcaggaggtgtcgatgggaccaggtgcttacacgactatcggagaagaggatcgatgtggctctggtgaaggagttctactcgaacctttatgatctagaggaccacaatccccgattttgccgggtgcgaggacaggtcgttcgctttgacgcggacacgattaacgacttcctcgacaccccagtcatcttagaggacggggaggagtacccagtctacaccagatatctcaacactcatcccgatccaaacaccatccccgccacattatgtactccaggagggcgttttgttctaaacgccgatggtcttccttggaagctgctgaggaaggacatgacgacactcgctcagacatggagtgtcctctcttattatgatcttgcacccacttctcacacatatgatgttaatcttgacaaggcacgcttgatctacagcttggtgagccggatggatatggacgtgggcaactttatatctcagcagatcagtcagattgcccagtccagtacctcgaggctcgggttcccgacgttgatcacagcgttgtgtgacattcaaggggtggtttctgataccctgatctttgagtcactcagccctacgatcaaccttgcttatgtgaagaagaactgctggaaccccgccgatccatccattacatttccaggggcccgctggactcgcaccagagcaccagcgtccatatccgaggcaccccctacttctcagccttcctcccagtga

SEQ ID NO: 93060 - DNA, 336 bp, Glycine max
  Peptide Sequence Number=SeqID_209838
atggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 93061 - DNA, 198 bp, Glycine max
  Peptide Sequence Number=SeqID_209839
atgataaaagtctttgaaaagggtaaggcactattccatgtcagcaagtttggtacaaaaacacgtcatggttccaacgaaagtagaggcaaaaaatggtattcaaccagaaccacagtttctcagagccccagaagttttgaaattttagccacagatgctaagggctcagagaaggtcaggatcagctacttctga

SEQ ID NO: 93062 - DNA, 621 bp, Glycine max
  Peptide Sequence Number=SeqID_209840
atgggagccaagcctgaaggcgaaagcaaatctattgttgccgatataattgcagctccagaaaagacagtcgaatctatcaaggctgctgttgcagatgttaagattccaggcatggaaaccaagcctgaaggtgaaagcaaatctattgttgccgatataattgcagctccagaaaagacagtcgaatctatcaaggctgctgttgcatatgtcaagattccaggcatgggagctaaacccgaaggtgaaaataaatctgttattgctggacttggtgttgcagcagctgcaactgcgactgctgcagcggcagctattggtgttgcaatccctggtatgaaaaaagaatcaaccgaaactgttgtatctgcagctgctgagactggcgtagaacctgcattagcaagttcaaaagctgctgccactttggatgcattaaaacctccagttgcaaaaaagattccaattcagcatgaatatcatggagttaaatatagcgatgattatcactggcttaaagaccagtctcccaaaaacaagaaaccagaaattattgagtatttagaggctgaaaacgcttactctaaagctttccattacgataaaaccaaatcttga

SEQ ID NO: 93063 - DNA, 177 bp, Glycine max
  Peptide Sequence Number=SeqID_209841
atgcccaacattgtgaatttaatgtgtttcaacttcaatttcagcgaagcttgtgcgcttagcgagagtcatgcgctaagtgaggcactcagcccgcttagcgagttgggagaatatggaggagaatctgagaagcatctgtgcactcagcgaggcgtttgtctcttcctgcgctaa

SEQ ID NO: 93064 - DNA, 201 bp, Glycine max
  Peptide Sequence Number=SeqID_209842
atgggtgttaaacattttgaagtggtcaaacaaaagtcgcatgccgacaaacaatggtccccggaagaaattaaggagatggccccgagaaagctccccgcgaagaggtcccggaaagacaccattggaaagggttccagtgcggccccacaggctgatatggactttgatagacaccgattctggagtgtggaacactag

SEQ ID NO: 93065 - DNA, 345 bp, Glycine max
  Peptide Sequence Number=SeqID_209843
atggctcagctgatttctaacgctatttaccagattgcagggatagcgcctacaagacacctagtggacccagagaaagtgtcggtcgcccccaacaagcttattcggcctcctattaacaggactttcattgagaagtactgcatgcccaggcaagcgcaggggcaggcgccagagcagcagccagaggaaggccagcagcaggcagctacagacacaccaccgtcaccaccaaagtccacctctactcacctgcggaggttggaatgctgtatacgacatgtggctgaccagcaggcggccaaccataggggtcaagtatggctgaatgagagtttctattag

SEQ ID NO: 93066 - DNA, 576 bp, Glycine max
  Peptide Sequence Number=SeqID_209844
atgacttccgtggccctagccagtttgcggcaggcagatgacgaatcactccataagttcatggacagatgtcaaggttcggaagtgaggtccgacatgccagacaaaagcatgataaaaggtagtaagatcggcttgcacagatcagacaaaaggcacaaacaggacaagcgccagcctttcccaaaaggacctagatattcaaccaccaaggagctccctctcataacattaattgacaaagatttcaaaggcatcaatcccattaaccaggacgaccctatgtccttattgaccaaggaagctccacagaaatacttttgtggaagcaatgacttccaagattattttgatgatgccaaagaatcaagagttaagcaagttccaaagaatcaggagtcaacaagcttcaagaatcaagtttcaaagaatcaagattcaagaacaatcatgtttcaagattcaagattcaagaacaatcaagtttcaagaatcaagattcaagaacaatcaagatcaagattcaagactcaagattcaagaatcaagagaagactcaatcaagataagtactaa

SEQ ID NO: 93067 - DNA, 132 bp, Glycine max
  Peptide Sequence Number=SeqID_209845
atgtcggactgtaggtaccctctgttaggagaacacaaggagggacctgcaaaacagaggactccaatgctcaagtggtgtgttcatgctcctgtgtcagggctgatatggaaggctgacatgcatatttga

SEQ ID NO: 93068 - DNA, 729 bp, Glycine max
  Peptide Sequence Number=SeqID_209846
atggagaagatgaatgtgcacaaaacacaagggggacccctaagggtgcatatatcacattcaaatataaaaaaaaacaagactaaccaacggtcacacgaagaacaccgaacaaggaacaatgtagggttcgatcacggtcacaattgggtagagcctcaacttcatttcctcttcttccttctcattctctctcaattctctcaatatccttcaatgttgagccttggaacccttcctcaacttcccttcacacctatttatagcaaaaaaaggcatttgggaccatggcagctcgcccaagcgagctgtagttcgagaactccaatagtggctcacaagggtgaacagggaaacaaaaaggaaaaaaaggatcattgtataatggatcattatgcgaatgaatttcccgatgaattgcaagaatacattttggacattattgatgtccaagcagatggaaatttgtggttacaggacaattgctgtgatcaggaggagtcttggtctctcatttgcgaagatttgattcaagaacttcaaacatggaactctgtctatgttcaattatttggctcagaagagagactattggaactaataacctctttgtatgttgaacatggctcaataccttatgagaagcaaatgaccattctcgatgtgggttatgccattgctagtcggtacaatgttgtattggtccacttatctaggctgtacaattga

SEQ ID NO: 93069 - DNA, 267 bp, Glycine max
  Peptide Sequence Number=SeqID_209847
atgaagggtggcgtacctcctcagtgccactggtgcatggcatcacaacacgaggctaccactgggatgatctcgccggtgaccatgaagctcaccggtgagatgaacaatgaggctttgaaggagaagaagaagaaacatggaaaagaggaagaagaagagataaagagggagaagaaatgtgatagagtgagggaacacgggctacctggtgatccttctttcttctccaacgtcgtggccaaatggcgcgatgtaattggttga

SEQ ID NO: 93070 - DNA, 216 bp, Glycine max
  Peptide Sequence Number=SeqID_209848
atgatcttagggtcaataatagaacaagaggagaagagatttgtgtaccgggtacatttttcttccaatgagaacaataggaggaggaaatggaggaaggaatcggagtatcctgagcctcagagtgccgttggcttctactcgaagaacccttgtgcttcttcgatggttccgccatttgagagagttattgaaaatttcaatcgattgaaatga

SEQ ID NO: 93071 - DNA, 282 bp, Glycine max
  Peptide Sequence Number=SeqID_209849
atgccaattgatatgggtgaaggctggcctgcaaggcaagctggaacgaaatcgagtgttacggtcgatgatgatctatatgcacttgatccttcaaattctgttgacagtgcaaagatcaaggtatgtgattatgaaggtgatacttggaaagttgcagcaggagatgttcctattcatgatttcaccgaattggaatctacttatctcttcactagattacttgaaaaacttcatgatgacatgcaaaatgaacatgttgagtcagctttctctcaatga

SEQ ID NO: 93072 - DNA, 609 bp, Glycine max
  Peptide Sequence Number=SeqID_209850
atggcaccgccaccagagatcacctctaacggtggcacacagcggggaaagaggctatggaaggttgggaaaagtgctaaaattttggaagtttacttgaatttgatttgtggcttaatctctgttagcactctcctctcgacgattccctgtgatctctctctctctttctctctctttctctctcagtcttctctcgctgtggttcagatttcagagcaggatccaaaagccttgcttggtcaagactcattcatgtctgttcctaatgaggaaaacttgtcgtcacattcccagctttcttctcattttttcttggatctccttgattccatcatagttgatgtggcatcagagtgtcacagagtagcaaggctggggcttgattctaatttggaagaagaagatgaagaattgaagctatcggcacaagccagggttagggtggctgatcctagtaacagtaatgaagcaaatggcaagtatgtggttgacatatttggacaaacccatcctcctgtggcaaatgaaatatttgattgcatgaattgtggtcgatccatcatggctgggaggtttgctccacatttggagaagtgcatgggaaag

SEQ ID NO: 93073 - DNA, 158 bp, Glycine max
  Peptide Sequence Number=SeqID_209851
atggtagggggagtacggtgtgggggagtggatcgagatgacgccaaattgggagtcacgggtgaggttcacgaaaccgaagttgtcagtggcacgacccgtggtttgagggagcatggtgatgaccttgcccgaggggggggggggagggggcgaag

SEQ ID NO: 93074 - DNA, 561 bp, Glycine max
  Peptide Sequence Number=SeqID_209852
gggcagcgaagttggtgtgcgttcagaatggattcccggcctgcaaagctcattggcagtgtggcagctggatattgattccgagctcctgtttgtgggcgatgccggagaaaccgaacccagccgcgccagccgccgctatggcgtagagtggaacaaccactacgtcgtcaacgactggctgttgctggatatggatctcgcgctttcaaaagcccgctttacgcacaaagaccctgcgggccaatatatccccggcgccattaataaagtggcctcaatgggtgccacggtgaccaactggggtaactggtttggcagcgtgcaactacgctatttcgggccaaggccactcattgaagataactccgtgcgctccaactccacctttctcacctacgctcgccttggctatcgctacaatccacacaccacactgacgctggatgtatttaacctgtttgaccgcaaagccagcgatatcgactattactacgaatcacaactggcaggcgaagccacgccggtgaacgacaagcactttcatccggtggagccccg

SEQ ID NO: 93075 - DNA, 448 bp, Glycine max
  Peptide Sequence Number=SeqID_209853
cttacctatcaatgcagatgaacaaaaaacaatttatcacagaattatccaagctgtcaacaacaatgaaggtggaatgttttttctatacggatttagaggcacaggaaaaacattcatatggagaacattagcaagttcattgagagcagaaaatcaaattgtaattattgttgcttctagcggaatagcctctctattattaccaggaggcagaactgcacattctagatttaaaattcctatattatctgatgaggacaagaccaagagcaagggcaaggatccacttgaaggacttggaagacctatgacaagggctagagcaaggaaagccaaggaagctcttcaacaagtgctgtccatactatttgaatacaagcccaagtttcaaggagaaaagtccaaggttgtgagttgtatcatggcccaaatggaggaggactaa

SEQ ID NO: 93076 - DNA, 291 bp, Glycine max
  Peptide Sequence Number=SeqID_209854
atgatccgcaagtgcacggatatcggtgagcatttcacccgggaggatgatctattgttctattggggaggctcatggaatctagacaccacagaggatgttcaacccgcacctataaaccctatcgatcctgctaacaagatgtgggctgcaaaggtaactcagaaatgtcacgttcctcgctactaccacggtccagctagtcaggggatatctatgagtaccctgcccaaacaccacgtttacgctagagatgattactctaaactctacgcgaagagatcaaagtaa

SEQ ID NO: 93077 - DNA, 231 bp, Glycine max
  Peptide Sequence Number=SeqID_209855
atgaaaccactacagaaactcttgagttcatccttgctcagggacgagcaagagggggttatcaggaaatatggaagaaagcccacacgtcggaagactctagaagccacgggaacaaacgggaggccgaacgggcccgggggcagggcgcccgccctacccccctgggcgcccaccctcctctgctggccaatcagcacgagtctcgtggatcatgctccaccgacctaa

SEQ ID NO: 93078 - DNA, 640 bp, Glycine max
  Peptide Sequence Number=SeqID_209856
gaggaagaatacattgaacacattaagaaatcttttgcacagatggttgaggctgaaggtgttgaggcagtgagccgacgaaaggagttcaatgatgttgatcaagcgaatgatctatctattataatggtaacacgtaattggatgtataatgtcgatcggcgctccgaagagttcattaatggcgtgcactatttcttaagtgtggccgagtcaaataagagggacggtttcatgtgctgtccatgtgccgtgtgcaagaatttgacggaatattctaactcaagaactcttcattcacacttattaaagtctggtttcgtaccaaactatatttgttggaccaaacatggagaaagcggaattataatggatgaaggtgaagaagaagaagaagaagaattggaccatgccaatattattgctcagtacggtggcttcaatgatgttgcaatggggggagataatgaagaagaggtggcggcagaagatgatcggagcgatgatgcttttggtgatgccatctgtgatgcacaaagagaatgtgatagtgataaagagaaagccaagttcgagcgcatgctagaggaccacaggaaatcgctatatcccaccgctgaagaggggcaaaaaaagctgg

SEQ ID NO: 93079 - DNA, 201 bp, Glycine max
  Peptide Sequence Number=SeqID_209857
atggatccagagaaacaagtcaataagtcaaatcaacatgtgcatgtgtggcgaatgaatgatgcatggggaaaaatagaaatgtttttggctattctctcccggattaggagtagaatatttttaggtgattctggagatggaaatgggtggatatatgtggatgcgtacttccagagtagaagcagcatgtatgagtga

SEQ ID NO: 93080 - DNA, 141 bp, Glycine max
  Peptide Sequence Number=SeqID_209858
atggtgaaagtttaccctaacacagagataagatcttgtttgaacgcatgtgtatctttaaggcatggaaccactgcagaaactcttgagttcatctttgctcagggacgagcaaaggttaagcttgggggagcttgttga

SEQ ID NO: 93081 - DNA, 1743 bp, Glycine max
  Peptide Sequence Number=SeqID_209859
atgagcgagactctcacttacgcgcctcgaaaggccatcaaatcgcaagccctggtagacttcgtcgcggaatggacagactcccagcttcccccgactcaggtccaggcggagctgtggacaatgtatttcgacgggtcactcatgaaaactggggccggggccggcctgctgttcatctcacccttgggcgtccacatgaggtatgtaatcaggattcattttgccgcatctaacaatgtcgcagaatatgaggccctcgtcaacggtcttaagatcgctatcgagttaggagtccgacgcctcgacgtccgaggtgactcccaactcgtcatcgaccaggtaatgaaaacctcgagttgccatgacccaaaaatggaagcatactgcaaggaggtgcgtcgactcgaagacaggttccacggcctcgagcttgtccatgtcgctcgacgctacaacgaggcagccgacgaactcgccaagattgcatctaccagaggcacagtgccgcctgatgcattctcaaaggatcttcacgagccatccgtcgacctaggcacgggggctggcgtcgacaccaccatcgcccaaccaaccaatgccgtcgatgcgctcttgatggaggaagaggtgatggaaatagaacgacgaccgggtcgaccattcgattggcgcacaccgttcctcgactgccttatccgcggtgagttgccagaagacaagacagaagctcgtcgtatcgcccgacgggccaaatcatatgtgatctatggcgaagacaacgagctatatcgacggagcccgacggggatcttacaacgttgcatcaccgtagaggaaggccgaaaactcctcgacgacctgcactcgggggcttgtggccaccacgccgccccacggaccctcgtaggaaacgcttttcggcaaggcttttactggccaacggccgtggcggatgccatcgagctcgtacgctcgtgtcatgggtgccaattctacgccaaacagacgcacctgcccgcccacgctcttcagatgatccccatcacctggccgtttgcggtgtgggggctcgatttagtaggacctctacaaaaggcgaaaggagggtatacccatttgctggtggctattgacaagttctccaaatggatcgaggctcgacccatcaccaacatccgctccgaaaagttcttggatttctgcgatcagcatcacatccgtgtgaactggtccgcagtagcccaccctcgaactaacggccaggtcgagcgtgccaacggcatgattttgcaaggactcaagccaaggatctacaatcgattgaagaaattcggcaagagatgggtcgaggagctttcctcggtcctatggagcttaaggacaacgccgagcagggccaccaaatacaccccgttcttcatggtctacggctctgaggctatcctccccacagacctcgagtatgggtcacctcgactcaaggcttacaatgagcaatcgaacaaagaagctcaagaaaacgcgatcgaccaactcgaggaggctcgagacatggccctcctcaactctgctagatatcagcagaaactccgacgctaccacgacaagcacgtgcgcaagagggacctcaacataggcgaccttgtcctacgacgccggcaaagcaaccaaggacgccacaagctaaccccaccttgggaaggcccgtatgtggtggccgaggtccttaagccgggaacg

SEQ ID NO: 93082 - DNA, 330 bp, Glycine max
  Peptide Sequence Number=SeqID_209860
atgaagagatgtatgatgcaatcaaggaacatgtcagaggactatcagcaacaatgcatcactaaaataggaaaactcaagatgaggcttcactattatcaagcgagtcagagacccagcatgaccacaaatcgacctccactccttgtggctcacatagacccgggtatagggcctaatatctcaatgtgtgtgcaaggtgtaggtgtcataaaaaccaaaaagacaaaggtctacggattttttaaaggagggtttgaagttgtttatgtacagagaagggtcgacaagggtgttgccctcgctcctacgtattctcaggtgggatga

SEQ ID NO: 93083 - DNA, 357 bp, Glycine max
  Peptide Sequence Number=SeqID_209861
atggtgggtatagcccacactgctctactaccttatgttgagcctataggaatcattgagatttcgtcttcattgtcttctttggacatgcctgagtatgtgtcagggccaccttatgtcgaggaagactttcctcaatatgtgccaagaccaccccatgccgatgagaactctgagcatacagtgacaacctctctcaccctagcacatgtttcaggggatgagatcgaggaggacctaaagatgttagagcattttgtttaccgagggaagcttccccaaggaggagccagatggctcactgaggaaagcagtaaggaggatccatataaggatatatgggatgtttcctcatga

SEQ ID NO: 93084 - DNA, 894 bp, Glycine max
  Peptide Sequence Number=SeqID_209862
ccttctgttgggttaggcacttggcaagctgagcctggtgttgtagccaaagctgtcaccacagccattctgaatactaattcaactgaagaatatttctccactggttttagtttttcttatgatttgagtttagttctaattcttgttggatacaggcatattgattgtgctcaagcgtataacaatcaagcagagattggttctgctcttaagaagctttttgatgatggtgtggtgaagcgtgaggacttatggatcacctccaaactctggtgttcagatcatgcttcagaagatgtgcccaaagcattggataaaacattgcaggatttgcaacttgattaccttgacctctatctgatccactggccagtgcgcatgaaaagcggatcagttggattcaagaaggaatatctcgatcaaccggacattcccagcacatggaaagcaatggaggcactctatgactcaggcaaggcaagagccataggagttagcaatttctcttcaaaaaagcttcaagatctcatgaatatagcaagagtgcctcctgctgttaaccaagtggaattgcacccaggatggcagcagccaaagctgcatgcattctgtgaatctaaaggagttcatctgtctggatattctccactgggctcaccaggagttctcaaaagtgacattcttaagaatcctgttgtgatagagattgcagagaaattggggaagacaccggcacaagttgcccttaggtggggactgcaaacaggtcatagtgtgctgcctaagagcactaatgagtccagaatcaagggaaactttgatgtgtttgactggtctattccagaagaagtgatggataagttctctgaaattaagcaggcgagtagttag

SEQ ID NO: 93085 - DNA, 486 bp, Glycine max
  Peptide Sequence Number=SeqID_209863
atgactgttgggggacactttaggccatggtacaatggaaatgctctcatagaatggttttgccacacatctggcaggattgccaagtcgacactctggaaacaaaaccacaaactcaacatcgttatccccaaggactctcaagccagcgagcatacctcaggtactaaacatcatctaatggcgaaccaagtccgggaatcttccagacttaacatcataaacaaaagcaaggacttcatccacatcttgtggtgcgaaaccgccaatctactgtcgcctagcgagctttcactacttcagcatgatcccccacattactctcttgaagaatatctcaacattccatcgcgagtccatgcctgcatgcatatctctcaagctcattactctctcggagaaaacatcttaaccacacagaacaaggtcctagttaacagtgggactcgtgctcgagtccttgtaactaccacacacaaggtctga

SEQ ID NO: 93086 - DNA, 597 bp, Glycine max
  Peptide Sequence Number=SeqID_209864
atggagaaaaagggaaaattggatcatatagaggaaaggctcagggccattgaaggaggcggagattatgcctttgctgacatggcaaacttgtacctagtgtctgacgtcatcatccctccgaagttcaaggacctaatggtggccttcattaggcagtatcaatacaattctgatatgactccaaataggatgcagctacagagcatgtgtaaaaaagagcatgaatctttcaaggaatatgccctaaggtggagggatctggcgactcaagtagcacctccaatgacggacaaggagatgataacaatgatagttgacacgttaccagtggtctattatgagaagatagtgggttacacaccttcaaactttgccgatttagtttttgccagcgaaaggatcgaagtgggtctgaaaagaggcaaatttgattatcctactttgataaataaaaggcctggggaaaatagggtgaatgagaaggagggaggaacctatgttgtgactgccattcctacatggccaaattcctcactagctcaacaatatcaatgcttctcattacccaccaccctaccagtcaagaacacctaa

SEQ ID NO: 93087 - DNA, 270 bp, Glycine max
  Peptide Sequence Number=SeqID_209865
atgtcttcagtcatttatgctttcaaaagctgcttggcaccagttgttgcgcaatctgaaaggttttttgacgtgttagaaaagaatgcggaaaatactcaaaagcaatggcaaaagggtcatttttacaatttttcaggctcctggctcgcttgggccaccagaaagcttagggctgatgtaaccggctcgcctgggcgagcaaagttacttttggaggaagcaactagctcgcctgggcgagctgagctcgcttgggcgagttgctga

SEQ ID NO: 93088 - DNA, 417 bp, Glycine max
  Peptide Sequence Number=SeqID_209866
atgaacttcaagatcacctcattgataaaaggtataatctttggaaaaacgtatgcacaagctcacaaagattatgaggacttgaaaaatagtaaacatgatatttgggtagaatatgaaaattgcaaaatgtctgtgaaattcttaaatgataagtttttaaataatgaagtcttaaaggatcaacctcaagatgctataaaactcaatgaggaaattgatactttaaagacaaccttggccaagtttgttggaggaactgcaaatcttgacaaattgttaagatatagcaaatgttcgacaaacaaatttaaccataggaaagacacatcgatcatggtacttgaacagtggtcgcccacgacacatgataggagaaaggtgtatgttccaatgcttgacctttatccatggtga

SEQ ID NO: 93089 - DNA, 173 bp, Glycine max
  Peptide Sequence Number=SeqID_209867
gggaaaaaagaagaagaaggtggttgattgaagcatggacagcgaggcaaacaaaggcaaatggcatgagaccgaagaaaattgagactgagtcagagtcagagtcaggaagatcagcaaagacaaagccgggagtgttgcggatgccaccacatgaacagcatctaaactaa

SEQ ID NO: 93090 - DNA, 336 bp, Glycine max
  Peptide Sequence Number=SeqID_209868
atgaggctactacgaaatatttactcatggtgttggggcaagctcttctattctggttcatggtttctcttggctatatggtcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgatgctacatagttggttctcatccttcagagactacgagtataataggagcatccgtcaacaaaaggatcaccctaagatga

SEQ ID NO: 93091 - DNA, 122 bp, Glycine max
  Peptide Sequence Number=SeqID_209869
atggggtctgttatgacgtggatgccgccattgttgccggcgggaaagcttgtaccgccattgacaactgcaggaacaaggatcccgccattggcaactgcgggactcagcctaaaccgcca

SEQ ID NO: 93092 - DNA, 435 bp, Glycine max
  Peptide Sequence Number=SeqID_209870
atgtttatttataggcatcaagcctggattagaaaggaggactcacctattggaaagttcatagaactagaagcaaataaagcattggagatttcatttcaaggcttgtgtttatgcactgtgggaagcatcatgggattagtcagtaatgaatactcaaatggatctgttcagagctgcaatggattagaggagaagcttgatgatcttcgcggccttgttggcaaggctgatggtgatcctttgagaatagtgagtgttggtgctggtgcttggggcagtgtttttgcagctttgctgcaagatacttatggccaattccgcgacaaggtgcaaatcaggatatggagaaggccaggaaagacagttgatagagccactgcagagcacctctttgaagttatcaactcaagggagtatgtgttgaggagatga

SEQ ID NO: 93093 - DNA, 471 bp, Glycine max
  Peptide Sequence Number=SeqID_209871
atgactcataattggaagctatggtcaaaatattcacagcttgttcaggatagaatgatattgaagtttaataagcttcttgaaggaaaaggttctgatgggcctaactcaattgaattggatcttgaggcagagttttctagtttagctctgatattattctgcttggtgtgctcaactctgactttggttctgtcaccaaagaatctccagttattaaggcaatctatggcactctttttgaagctgaacatagatccactttctacattccatattggcaaattccttaaatttaaaggatgcaagtcttttgcgtttcctgcagaacttgacatgcacttagatgttgttcatggccttgatcatacattaatggaaaggatcattggaaattggttctgttggaaaggtctcagtgaaggtgttcaaatctttttgttcatacagaagggaattgttctaccgtaa

SEQ ID NO: 93094 - DNA, 222 bp, Glycine max
  Peptide Sequence Number=SeqID_209872
atgacttatcaagtcttctccattcactgccttaaaggtctccctgagttgttgtctttcatggtgggttacacaagccagagatgtgatcaattgactcaaactccccaaagaatcatgagttctcttgcaatcaagttcgaaattgaggtttgtcatggttcaagtaaatatatagtccaccaaccatatgtatttaagcaacaattacttggagggtaa

SEQ ID NO: 93095 - DNA, 639 bp, Glycine max
  Peptide Sequence Number=SeqID_209873
atggcacattgccaatgggcaccgagaaaggttcttgatgttgtttctcatgatatttggctcaagcatccatggttggatgtaaatggctgtaatccttataacatagataagcggaaagacttgaatccacaaaattctgtccagctatatagggatgatggtgatggaacgattgagaatgaaggcttccctggtcaaacttattacacatggtctgtgtctgatgttagtgcatatagtggtgaactgtgggtcagcatttctggaagttgcatcattgaaacaggacgatgcctttctctggaaccatcagtcgttctaatcatggacaaaatagctgagccatcagatatattggtgtcactcgatgagttttcaactctttgtactagaatatcagatgactctcgatttgcttgcaaagttggtgatgtgctggttgaaccaagcactcgttggcagaatatgttaaagggatcttctctgtaccaaaagtttctcaattcggtctttataataatactagctatgcatggaatccattatgttctgcttgtgaaacctggagcacatgattcagagtcttgtttaaaagcagcaatttgccttcctttaggtggatacaaatgccaatga

SEQ ID NO: 93096 - DNA, 414 bp, Glycine max
  Peptide Sequence Number=SeqID_209874
atgacgagttcactgcggaatggatgtgtagcaagtaaaccgccagcacggttggcgacttcgcctaaggtggatttcgccacctctactggcgagttagccagtggcgtccaggctacgcggtgcagcagtgcaggctacgatgcagtgtcacatgctgaagctttgactgacttcgtaactcgccaccagtactggcgatttgcttgttcaaataatttttgggctataaagcaacgtgagacaactgctcccttatgcatgcattcgtttcttctctttggatcccttcccttcactacattcctttcttctcctcttattcatacttccagtgcactagtttcttctcttcctactacgggtgaagcttttgatcttgtttgtcctacactgtttggttgcttttcttag

SEQ ID NO: 93097 - DNA, 420 bp, Glycine max
  Peptide Sequence Number=SeqID_209875
atgtctattgaccaagactactttagtctccattttgtcaaccaaaggcaagggatatcgttgactcacagagacaaatatggtcatctgcaccctttcgtcgaagactcactgtctattgaccgagactactttagtcaccatttcataaaccagaggcaagagagcttgttgacaagcatagacaaatatggtcttctgcaccctttcatcgaagactcaatgtctgtcgaccgagactactttagtctccattttgtcaaccaaaggcaagtgatcccgttgacatgttgttctcttccggcaagtgcaccgaatcgcgcaagtagtataaaatggtcgaaaaaagcggggcttttgctcctacgtaccctccatcgaagtggaaatcaggcctacgtagttcttttttatgcgtga

SEQ ID NO: 93098 - DNA, 222 bp, Glycine max
  Peptide Sequence Number=SeqID_209876
atggctgaagaaaatgaacaactgaccgttcaaacattcatcgcatttattagacaaaaattcggctacaccattacatatggaaaagcatggctagctaaacaatgggttctcgagaagacatgcattgatgcatttgcattctgtaaacccatgatacaaatcactggaacatggctttatggaccatacaaagggacgttcttaattgcaattacataa

SEQ ID NO: 93099 - DNA, 375 bp, Glycine max
  Peptide Sequence Number=SeqID_209877
atgaaagttatactaagcaagccaacaagaaaaggaaggaagtggtacttgaacctgacttatcaaggtaatccttgtggcgtctaccctgacttatcttccttcactggatgtggcgtcatccaaacctccgtagcttgtatcaaacaatccgctcctactcaggttcacatcaatgcacgtcaggattcgtgcctagacacagttcaaacactgttcatggcaattaccatcaaagacgatgaggatattgatgagatgtttgatgtctataaccgacatgaatgtataagttgctttgagttgttcgtacaatacggacaacctttttctaccactaatgttgaaacaactaatccatcaccacaaatttag

SEQ ID NO: 93100 - DNA, 279 bp, Glycine max
  Peptide Sequence Number=SeqID_209878
atgaagaacctcatgctagaggacacgggaacacaacgctctggggtagagggtgtcacagaagacgcacccgtgagccccgcctcgctcgcccgcaaaaggcatgaatctggattctggagattccaacatctgaataagatagacatcaattccaagaacaagccagctaaatgggcctcagccaatggttggagtgaagcagatgatggatgggatataatttctttgaatgagaaatttcaagataggcacaccaaaaatagtttgagaccttga

SEQ ID NO: 93101 - DNA, 219 bp, Glycine max
  Peptide Sequence Number=SeqID_209879
atgcagctacgaagtagatccacatcagcaagagcaaatgaagtcaaaagaattttgatccataaaacacaacagaagcttacggatccagtaaccaaaaacagcataatcagtgatcaaaacgcaccttgcgcaaacgaaacgctatttgaaggggaagtggttcagtggtggagcaaaggcagaagcagcaacaacaacagttgcaaagggaagtga

SEQ ID NO: 93102 - DNA, 225 bp, Glycine max
  Peptide Sequence Number=SeqID_209880
atggaggcaacttcttttgagtttgtttctggtgctactaattctaaatccagcattctgataaaaacttgcatttgtttggtagaacttccagggttgcctttgctctctcctgtgaaggattctgataaaaatagggatcttttaggggcatattgggataagctctccgtagaagaggcaaaggaagttgtttcattcaagaatgtgatgttggagatatga

SEQ ID NO: 93103 - DNA, 261 bp, Glycine max
  Peptide Sequence Number=SeqID_209881
atgagagatttctttgaggatcaagcagcggagcagttctactctgatctcagggacttgacccaacgtgtcatcaagttcggtgtctcggattctgcagtcttcctcccacaactcatcgcatccattactgctatcatacaactcgcagaagtcattggcgagtttggccagcctttgacacgtggcactggtgagaccagtgccattggcgatttgagctccacgggactcgccagtttgactggcgagttgagctag

SEQ ID NO: 93104 - DNA, 591 bp, Glycine max
  Peptide Sequence Number=SeqID_209882
atgacattaactctatcgcaggcaacagtggaagagtatacaatgcatgcaggtatgtctccatttgagatgcaagacatcttactgccttccggcacaaatggtgttaaagacctacacatttcggtttctcatagtagtagcctagctctctttgcttctctaggaaagaaattatcagtgctcagcttggacagcggcaaccttgttgtcaattatgacctacagtttaacaggggtacaagtgccatgcaacattatgtggcaacacgtccaatgttcattgatgtggaaataatgaatgcagacactaagctggttcttggtgacctggctggccaagctagtcctagtaatgttgctcgtgggctttcctccttgtacaaagaaatcacagatactgttcataaagaagctgcaacaatcacggccgtattcccttcaccaagtgaagtcatgtcaattttagttcagtctaagtgctctagtcttgcttcatggcaactttcaagcaggacatttgactctattaattttatgtaccttacccatcttaggagggcagattgcaatgccaaggtgcatccctag

SEQ ID NO: 93105 - DNA, 472 bp, Glycine max
  Peptide Sequence Number=SeqID_209883
atggctcacagcagttctgagaatgatactgatattagtgaatctgaaattagtgagtataaagataaaacttatcaagagctgaaaagtggaagtcagaaagtgaaaaacttggatgagactttcacttgtccctactgccctaaaaggagaaaaagagatgattattcatacaaggaactccttcaacatgcttctggggtgggtcggagtagctcaaagaagagaaaggcaagagacaaggctaatcatttggctttggtgaagtatttggagaaagatcttgtgagtgtagatattccagccgaagtttcaaaaccggaagatgaaagtggtacttctgttaattctgatgagcaatttgtgtggccttggattggaattgtagttaatattccaactagattgacaggagatggacacagtgttggggagagtggtaccgggctgagggacgagtacaaaagcaggg

SEQ ID NO: 93106 - DNA, 435 bp, Glycine max
  Peptide Sequence Number=SeqID_209884
atgaaaaatatctatggagaacatctacaaaagatgtgcgatgtcaaaaccatatctcaacttatggaagaagaagctcgaaggcaggataaacttgtctccactttgactaatgttattcaggtcaagaaccagcacataaaagagattgaagtgaaatgccatgagactacgcataaaatggaccttgctatgatggaaaaagataaacttattcaagcttataatgcagagataaagaaaatacagtcaagtgccacggatcacctcaagaagatttttactgatcatgaaaagcttaaattgcaactgaaatctcagaaaaacgagcttgagctgcggaaagttgaattggaaaaacgtgaggcacataatgaaagtgaaagaaaaaagttgacaaaagaaatcatggagtgctttcaaggaaggaattaa

SEQ ID NO: 93107 - DNA, 582 bp, Glycine max
  Peptide Sequence Number=SeqID_209885
atgaaactggctgaagatcaaaagagacaaaaagaacaacttcatgctaaaatcattcagcttcaaaaacaacttgataagaaacaagagcttgagttggagattcagcaattaaaaggatcattaaatgtgttgaagcacatggatgattatgaagatgcagaagttctgaagaaggtagatactttacaaaaggatttaagagacaaggaacagtcactccaagacttagatgaattgaaccaagcactaatcattaaagagcgtgagagtaatgatgagctgcaggaagctagacaagcattggttgatggtattaaagagctatcatctcatggcaatatttgtttgaagagaatgggggaactggacactagaccattccttgaagcaatgaagaaaagatataatgaggaggaagctgaagagagaactgcagatatgtgctcattgtgggaagagcttctaaggaacccagattggcatccattcaaagttatcatggttgaagggaaagaaaagggagtgtttggaagttgggttttggaggggaaggaatgggagggtaaatttttattttga

SEQ ID NO: 93108 - DNA, 138 bp, Glycine max
  Peptide Sequence Number=SeqID_209886
atggttgcaacaataggactcgagggaagtgagaaaggaaaagggtggcttcagaatcttcactatggtgtgtttggccttggaaacaggcagtatgagcatttttacaaggtgataaaggtaggtgtcgccgattga

SEQ ID NO: 93109 - DNA, 438 bp, Glycine max
  Peptide Sequence Number=SeqID_209887
atgtcttctgaaaattttgttcaaccggccattccacattttgatggtcactatgatcattggagcatgttgatggagaatcttttgcaatccaaggagttctggcaagttgttgcagatggtgtgacaacaccaagtgatgacgtagctcttacagattcacaacaaaaagagtataaagtgatgaaattgaaagacttaaaagccaaaaattatttgtttcaagccattgatcgttctatccttgaaactattctttgtaaagatacttccaaggaaatttgggattcaatgaagaaaaaatatcaaggctcctcacgagtgaaacgtgctcaacttcaagtgttgagaagagactttgaattctttcaaatgaaagaaagggagtcagtaactgattattgttcaagaaccatgggtattgctaacaacatgtga

SEQ ID NO: 93110 - DNA, 1476 bp, Glycine max
  Peptide Sequence Number=SeqID_209888
atggaggagcacgcattgaaggcttctaccaatactcattccaacaactctagaggaaggggtagaggtagaggtagaggaagagggtgtggagatcgaggaaatagagatttcaacaataattctaaagacaataatgatcaatttcaaggcaatggtagaggaagagatcatgataaatcaaaggtacaatgctataaatgtcataaatttgctcattatgcctctaattgttatactagattgcttaatcttaaagaaaaaggggaaagttcaaattttatcaaggagaaagaagtggaaaccttatttatggttgttgaagacacaaaagatagtgaggcagaaatctggtatgtagacactggttgtagtaatcacatgagtggaaaaacaatttctagtgtgctatatgtcactgacttgaaaagcaacttgttaagtgctggtcaattgcaagaaaaaggttatgaaatttttattaacaaaggtacttgtgaaatttttgatcctattcgaggtgccattgcaattataaaaatgaattcaaacaggttattctcactaaaaattgaaagcattcattccagtttaatggccaaagatattgtttctacttggttgtggcattatcgttatggtcatttgagttttaatggattgaagacccttgaacaaaaaaacatggtgataggccttccacaaattactattccttctcaagtttgtgaagaatgtgttgttagcaaacaacatcattctcagttccctaatggaaagtcatggagagcaaaatgtgttttggaattgattcattcagatatatgtggttcaataaatccttcttccaatggagaccatgatggagagtattgctcagatgaattttctactttttgtgtaaatcatggaatctggatggagttgacaacaacaacatatacaccacaacaaaatggtgtctcagaaacgaaaaatagaaccattctcaacatggtacggtgcctcttgactaagagtggcgtttcaaaagaattttggcctgaagttgttaattggagcgtgcacattctaaatagaaatcctacatttgttgtgaaaaatatgacaccagaggaggtatggagtggaagaaaactaacagtggaccacttcaggatatttggatgcattgcttatgcccatattccagataagaaaagatataagcttgatggtaaaggtgaaaaatgtatctttcttggtgttagtgatcagtcaaaagcgtataaattgtataatcctaccactaaaaagatcattattagtcgtgatgttgtttttgatgaagaaagattttgggaaaataacatagatgaaacaaagaaaattcttgaaaactttgatgaagataatgaagatgaagagttgcagacaagggtgctagaagaacaacgaattccagccatcatagttgaagatgaaagacctcaatga

SEQ ID NO: 93111 - DNA, 540 bp, Glycine max
  Peptide Sequence Number=SeqID_209889
atgcatttacttgctgctaaaagaatccttcgctacttgcaaggaacaagagaatttgagctgttttataagagaggtgaagagttcaatctgttgggattcactgatagtgattatgttggagattcagatgacaggaaaatgatctcttggtcatcacgaaagcagcccattgtcactttatccacaacagaaactgaatttgtagtagcttcagcatgtgcttgccaagcaatttggctaaggaatattcttgaagaagttcacttcaagcaacaaggtccaactctcatctattgtgataatagttccaccataaagttgtcaaagaatcctattatgcatggaagaagcaagcacatagatgtgagatttcattttttaagagacctatcaaaagaaggaattattgatcttatctactgcaagagtgaagagcagattactaacatcatgaccaaaccattgaagttgtctgcatttcagaagctaaggaatttgcttggagtctgcatgcttaatgattctcatttaaactga

SEQ ID NO: 93112 - DNA, 177 bp, Glycine max
  Peptide Sequence Number=SeqID_209890
atggtgacaactccaatcgttgcaccgaccaccaaggtagggcaaactggaaagatcgttgctcctgaactctatatggcttttggtgtatctggagctattcaacacttggcagggatgagggattccaaggtcattgttgctgtgaacaatgatgctgatgctcctatatttcag

SEQ ID NO: 93113 - DNA, 135 bp, Glycine max
  Peptide Sequence Number=SeqID_209891
atgaccacattgggctctgcttgtaaatcggacttggggtctccaaataacaagactctcgggttgctgggtagcaaagggtgtgtgcgggttagcgtcgggtgtctccgcatgccaccggactcttgggtcacg

SEQ ID NO: 93114 - DNA, 348 bp, Glycine max
  Peptide Sequence Number=SeqID_209892
atggaggcaagggattataactcagcggtagagtgtcaccttgacgtggtggaagttatcagttcgagcctgattatccctaaacccaatgctcgtgggattacacgaggggtgggggggctatatttctgggagcgaactccagtcgaatatgaagcgcctggatacaagttatgcattggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacgggtga

SEQ ID NO: 93115 - DNA, 630 bp, Glycine max
  Peptide Sequence Number=SeqID_209893
atgaaggtcacagctctcaaacaaaccagccacgatatgattgcacacataggtaaagctcgggcagcagtggaagaattgaagaggttccttgtggctgaatcgttggaggaagtgaatagaaagctagataagttctatatggttctcatcttgagaagtttacattcagactttgatcacgttcgtgatcaagtcttagctggagatcaggttccgtcgatggattctctcatcactaggctgcttcgtgttccccatgcattgaaagaagaaaatccggctgatgtagtggagacgtcagccatggctgcacctcgtgggagagggggaggacgtaacagtagaggaggccgtggtgggagaggtggacgtcctcaatgcacatattgcaagaggatgggccacacacaagagacttgctactccttgcatggcttccctgacaaagtagctcagctgaaatctgagaaatccagcagccagacttcatcttcctctgtaccatgttattcaacagcatgtatttctcaatctattgatggtcccagtccttggatacttgattcaggtgcctctgatcatatttctggaacatggcacgggtcgattgattggagaaggacgtga

SEQ ID NO: 93116 - DNA, 793 bp, Glycine max
  Peptide Sequence Number=SeqID_209894
gaaagaaagcgctttatggcacccttaccgaacgcgtgctaaagataaggtaatgagtgaaatagaggaggtgcaagagcatatgaaggccaatatagaggccatgaaagagcagctgaccaaaatgatggaagtcatgatgagtatgagaaaaatgatggaggtcaacacggctacagtcgttgccgcaagtaccgccactgagatggacccgactcacccatctggcctcaatcaagtaaatcctccagcctcaggtatggtagggcagggaggcaaagcgttaggaagtaaggacgtcccccgttttgtgcaagttcaaaacaagcattccttcccaccatatgggttgcctcccaactatacaccacccaatgttgcacacgctcccgatgagaatgttgataactctactctcataaccattgagagccaacatcccaaatctggtcatgcacaggtccctcaacccataggggagacacatgaatatcacccacaaccacaaccctttcattttgcggtgggaagagttcctcctgccatggtggaaagggagaaatttgatcatatagaggaaaaactaagggtcatcgaaggaggcataaattattcctttgatgacatggtagagttgtgcctagtgcccgacatggtcattccttcgaagtttaaggtgccgaatttcgacaagtataaggggactactttccctaagaatcacctaaatatgtactgtaggaaaatggggacatacgtcaaagataaaaaattgttgatgcatttcttctag

SEQ ID NO: 93117 - DNA, 405 bp, Glycine max
  Peptide Sequence Number=SeqID_209895
atggatgcctgggaaagtttggttgattgtcctttggaacatcagtttcatgattaccttaagaattttgaaattgcttgttcaccatggccagtgtttgtttactatgttaacgaaacatggataattccccacaaagaaaaatttgttacaacctggacgaataagaatcaagagttaagcaagttccaaagaatcaggagtcaaaaagcttcaagaatcaaggttcatagaatcaagattcaagaacaatcaagtttcaagattcaagattctagaacaatcaagtttcaagaatcaagattcaagaacattcaagatcaagattcaagactcaagattaaagaatcaagagaagactcaatcaagataagtactaaaaaggtttttcaaaacattgagtag

SEQ ID NO: 93118 - DNA, 312 bp, Glycine max
  Peptide Sequence Number=SeqID_209896
atggccaacaaaaacatatcatccaatgaaacatactcccccacacttattcccaaaacaattccaaagctccaaaattccttaagggtaggaaaggggaacataggctcaaaggggatatcaaaggaattaattcaaggtaggctcatttggctagaggcttataagaacaaaattcctaaatcatctcccaacatgcatgtgaagcaagaagtatcaacaagagtcaagccaaggctattgtgcaagcaatcaatggggcaaaacacatcgaataaaatagatgatggctcaaattctcaccaagggtaa

SEQ ID NO: 93119 - DNA, 186 bp, Glycine max
  Peptide Sequence Number=SeqID_209897
atgtacatgacagactgtccgttgcatcatgagtatggaccgcggtgttttgcatcgcgcgctgaactcacgcggattgttgagaaccacgttaacaaggtaaatgtacgcatcgtcattgttggattcaagagtaatgattttgtcttgtcacttctgaaaactgcatttgcacttgaactttga

SEQ ID NO: 93120 - DNA, 402 bp, Glycine max
  Peptide Sequence Number=SeqID_209898
atggcaagacacaaggtcacacgcacacacacacacacacactcacgcaggcacaaggcggaggaggggcttggtccaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 93121 - DNA, 300 bp, Glycine max
  Peptide Sequence Number=SeqID_209899
atggcgtctgcatccacttttggagcctcctttagagttttctccattaccaccttcatagcttttagtgctgattttcattcgctcgctaagccattctgccagcttagcgagccattcgctgagagcaacactccatccgctgagcgcgaggaagaatctagaagaaggatgagttgtgcatgtttggtgagcgagagttgcgctaagcgcgcaaacaccaacaaggctgcctatttaagccggaaatcagaaatggagagggagttttggaaattctcaaagcttttgcatgtttag

SEQ ID NO: 93122 - DNA, 226 bp, Glycine max
  Peptide Sequence Number=SeqID_209900
atggcaccgggtgcagaatcatctcatccgacatcgacgtcaaggagccgcatgacccccgacagcgctcgtccttctctgcccgccggtcttcgctggtctgcggcgacgtccgcgttccagatcgaggggtcacggccgaccgggctcaccgggcgctccatctgggatgacttcctggaggttcccggtgcgatccgtgacggatcgacggcggaacctgcat

SEQ ID NO: 93123 - DNA, 408 bp, Glycine max
  Peptide Sequence Number=SeqID_209901
atgccggccgacacgtccctgacgacgaagaaggcccgcaccggtgacgggcgggccttcttcaggaggttcgagtcagagcgacgcgacctgcttggcgagagccgacttgcggttcgacgcctggttcttgtgcaggacacccttgctgacggccttgtcgagcttgacggaggccttcttcagggcggtttcggctgcggacttgtcaccggcggtgacggcagcgcgggtcgtgcggacgagggtcttgagctcgctcttgacggccttgttgcgctcgcgagccttctcgttggtcttgttgcgcttgatctgcgacttgatgtttgccacgtgtggacgctttctgtacaggattgttcggaatgccggtcgcagaagagggctgcagcccggcggtcgtga

SEQ ID NO: 93124 - DNA, 276 bp, Glycine max
  Peptide Sequence Number=SeqID_209902
atgaaagaagggttgagagcttcattctttaccgaatccttaaggtggattttggacattctgctccaattaaagcattcctctctgtgtggtggtccaatgacaagcaacggtggctcgtggcggccaccgatggtcatgggtggtggaggaggagggttggggttttggatcttgcttagcgagctcgtctcactaagcgaaattcaacttttggcactgagtgtgacctcttgtgctgaacgaattacctccttgagctggaattgcgcttaa

SEQ ID NO: 93125 - DNA, 255 bp, Glycine max
  Peptide Sequence Number=SeqID_209903
gatgacaaaaagtgtggggcggttgacaaaagcgaggcttttgctcctacgtttcctcaatttgagatgaggaactcagacctacgtagttctagcttacacgatgtgcggataaccggaaggtgtctccacatgctaccaggctcttgggtcatgatagcaaaaggtgtggtgattgacaaaagtggggcttttgctcctacgtatcctcaacttgtgatgaggaagtcagacctacgtagttcttgcttgtga

SEQ ID NO: 93126 - DNA, 1168 bp, Glycine max
  Peptide Sequence Number=SeqID_209904
gaaagtggaaatctatcacacaaagctggatgaattcaagggcgagctggagaggcataactttcacaagcgcctcaccaacttagctgatagtagcattggcctcccgttggtgaagaagttctacaccaaccactatagttctaaggggcctgcacctaaacaactcaaaattcggggccacttaataaggattgatgcagacaacctcaatgcctttctagaaacacttgtggtgcttgttgagggtgaatctttgcccgactactcaagatattgcaggatgcctactaacactaaagaaattaaggctgcactgtgcatacccgaccaagggtttattctaaatgctaaaggtcacccggggaagatcctcgttaaagacctaaccacccttgctcaggtctggagtgttctatcctactccaacctggctccgacctcccacacatcagatctgactgtggatcgagctagcttctcttctctctcttccttctccattccactgccattcatcttccaagaagcaaaggaatccattgatgaagaagatcctaggcctacaagctccaatggagcttacatcaccagaagaccaagggcaaggctagttgagactccttctacatcagcagctcctcatccagcttctacattagtagctcctcctccaactcgtattacagaagctccttctaccccacttcctgcaaggtttcaatgtttcaaagccatgcttcgaagcatacatcaggggcagattattttgctgcaaagtctccagctggtagcacctcttgactccatccctacagtagaaaaatttaatgaatgggtagcctggccagggactcagcctcctcttcacagggatgacgaggatcccgctgctcaggtaccacatcagccatcggatgagtcatcaaagtcttccacccctgagcccttgatcaggaagaggagggtagttgtaactcaggaagctgcagccactcctaaaaagtcctctgaggccactctagagcctccggcaccactggcagataccacttctccacagcaagcagcagatccttcaatgcctgaagttcaaaccaccccagttctgtctccaaacacctctcctgtagctactcttgtactacatttgactgacgaggaggag

SEQ ID NO: 93127 - DNA, 1098 bp, Glycine max
  Peptide Sequence Number=SeqID_209905
atggctaagaatgagaacaaggaaaaaattatgatttttccatggatcaacgaagaagaacaggacatagaagctatcgggtaccacagtgataatgatagtgatcagtgtggcagagatagtgaggggaatcgtagaacagaacctctttcttcctcttctcagatatggcctcaaacttacggagaagccactgattcttattcaatttctgctgctccaaatcttgaatcaattatacgagcaccgagtgttatttattcaagctttatcggtggtggtggttttggttcaaagagttacttagaacacgatgaaaggacttcttttctatctggcgaggaactcactaatcgagggatctcaagaagacaatcaacatggtgggagaaagcttcaattcaaatgcaaattcctgaagaattacctgttgtttatggatgtagcctctctcaaacaatattcaatggtatggtacttcatgaatggataatccttgaacgttttattttgttatttcaagggattaatgtgatggcccaagttggccttctatctacaccttatacagtgaaacaagctgggtgggcggcagaccttatgagacactgctttgaaagcagagaagggatcattagctacccagatataggacaagctgcatttggaagatatgaccgacttattgtatcatcatattgtgtggagtttatcatcttggaaggagataacctcaccaggctgtttcctggaacatccttacactggggaagtttccagttagactccaaacacttgtttggaattttaacagcacttgtcattctcccaacagtttggttgagggatcttcgcataatctcgtatctctcagcaaacacttacagcatcacttgtgatgattctgcagctggaggggttatttctacagcattgattactatgtgtgtgtttttggttgggacatctgattctgttggattccatctcactggtccattggtgaaatggagcggcatgccctttgcttttgggacattgtctcagataacattgaatctaccaccaaatgcatttgcttccaaagttgccttgtag

SEQ ID NO: 93128 - DNA, 138 bp, Glycine max
  Peptide Sequence Number=SeqID_209906
atgagctcacttagcacactgcacatgatctgcacccgtctcctcgccacgcaacttgctgatggcctcctcgtcaaaccccgaggcctggctcctcctctggctaaactcatagcgctggccctcctccaagactaa

SEQ ID NO: 93129 - DNA, 195 bp, Glycine max
  Peptide Sequence Number=SeqID_209907
atgccgctggagagggttccagagaggcgagtccaattgagggacggagattatgtcgagttccatgaggaaatatccaagaggcaatggactcagcttgtgtcacccatggctaagtatgattcggagatagtcatggagttctatgccaacgcatggcctatagaggagggagccagggacaagcactcctga

SEQ ID NO: 93130 - DNA, 258 bp, Glycine max
  Peptide Sequence Number=SeqID_209908
aagcgtcgtggagatgatgacacaaacaaaaagccactggcaaaagcagaattccaggagatcatgcaaaatttggtgaagacatcaggattcactggtattggagcaaaggaagcaatcttgtgcatctttggtgttccattggctgctttgctcataaagcagagagtgatgcctgaggtagttcgtgatgaatttttcattccaggagtaacttctgccacggttttcacccttgctgctcttaacaagatttga

SEQ ID NO: 93131 - DNA, 144 bp, Glycine max
  Peptide Sequence Number=SeqID_209909
atggggaggggtgaagccattcttcaccctaattcttccccaaactttcaaaaacccaagtgctcatgggaatcacgaatccagcagcccccaagcccctattgtgcattcatccctacaggcctatcttgggttttggtatga

SEQ ID NO: 93132 - DNA, 2271 bp, Glycine max
  Peptide Sequence Number=SeqID_209910
atgattggaaaagatagtggtgttatgaaggcatgggaggcaacgatgagaaagacacatgcagttgcaaagaagcgtgcaaacagcatatttgggacgatatctttggcacatgttgtggatgaagaagaaaataacaacaatgatgattatgatgatgataacgaagagaatgggaaaaatgagacatttgatgtatacattgaagagaaggttctaccaaatggggattactacacaggggaatgggcaaataacttccctcatgggctggggaaatacctgtggacagacgggtgcatgtatgttggagaatggttcaaagggaaaaccaaaggaaaaggtaggtttagttggccttcaggagcaacatatgaaggtgacttcaagagtggtttcatggatgggaatggaacatacacagggtgtaatggagagacttataagggacaatgggtgatgaacttgaaacatggtcatggtttcaagagttatgcaaatggggattggtatgatggggagtggaggaaggatttgcaagatggggagggaaggtatgtgtggaaggatgagagccattatgttggggaatggaggaatgggactatttggggcaaagggtcatttgtttgggctgaaaatgggaaagtgtttgaagggttttgggaagatggtttgccaaaagggaaaggcacttcaagtggcctaatgggagtttttatgagggaaattttagtaaagatggtaaggatcaaaatggtacataccacaattcatgcgagtcatcatcagatggtgaagaagggcatagtgaattatgggatcctcaagatttgccctggggagaaggttcaggtgatgccatcacacaagaggcttgcggtttggaggtctacaaagacaggggagagtgctaagaacaggagaatatcgttagatggaagggtgagcattggcttggagaagccaagtgataggttgcaaatatgggatggtggggagagtgatgctagtggtgctaaaactcctactatggggagtgatttggatgaagatttgatgggtttgcgtgtggatgatggtggtgaaagtttgggtcaactccaacctattaaagcaccaaagaaatcaaagaggcagggagagaccatatgcaaaggacacaaaaattatgagctcatgctcaatttgcagctgggaatcaggcattctgttgcaaggccagctccaacagcatcacttgatctcaagccttcagcttttgaccctaaggagaaagtgtggacaagatttccacccgaaggatccaaatacactccaccacatccatcgtgtgactttaaatggaaggactattgccctgtagtttttagaacactaaggaagctattcaaggtggatccagctgattacatgttatccatatgtggaaatgaggcccttcgcgaactttcctctccaggaaaaagtggtagcttcttttacttgaccaatgacgaccgttacatgattaaaacaatgaagaaagctgaagtgaaagttctattgagaatgcttccatcttattacaataattttcgagaccaccaaaatactcttttgacaaagtattatggcctgcattgtgtaaagttaaatggacctattcagaagaaggttcgatttatcattatgggcaacctcttttgttctgagtatatcacccatagacgctacgatttgaagggttcctcacttggacgcttctcagataagcctgagacagatattagtgaaaccacaatccttaaagatcttgatcttaattttatatttcgactggagaagtcccggttcgaagaattttgcagacaagttgataaggattgtgagcttctagaacaggagggaattatggactatagtttgctattgggcatttatttcaaagatatatcaccagatggggaaattattcctttacaatctcggactcctgttggtgattccgaaaatgaagcaaatccccatacttcatgtgaagacacagaccaacctccttctgatccttccagagagtttgaagatataaggtgggttgaatgggtaagggagaagaaaaggggaggaaaggtcgcggacatacttcaagactatgacattagcaagaagcttgagcatgcctacaaatccattcaatatgacccgacttcaatatcagccgttgatcctatacaatattcaaggcgttttcgtgatttcatatttagaatatttactgaagactcttga

SEQ ID NO: 93133 - DNA, 153 bp, Glycine max
  Peptide Sequence Number=SeqID_209911
atggagggagctattgatgacactcaacaccatgtcagtgaggactggttgcagatttggaacatgaaaactcctccaagagtcaaaatgctcacttggcgaatttgtagagatattatattgctccaactaggactagacttcgcgagaaag

SEQ ID NO: 93134 - DNA, 369 bp, Glycine max
  Peptide Sequence Number=SeqID_209912
atggtgcaaaaaggggaacgacggattcatggggatcctcctgtagagtattggaatgatcttaagagtgcccttaggaagaggcacattcccccctactatgaaagggagcttatggacaactccaaaggcttaaacaaaggtcacattgcctctcaatgccccacaaagaaaaccatgattatgagaggtcaagacatttatagtagtcaagaggaaactacttcttgcccttcctctagtggaagtgaagatgaagtaaggggtgaagagtctagtgaggaagtctacccccatgaagaaggtgacctcttcaaaggccaaggggaaggaaaaagaggaaaaggattcctccaagaagattgttaa

SEQ ID NO: 93135 - DNA, 102 bp, Glycine max
  Peptide Sequence Number=SeqID_209913
atggattgtggagggaaagattgtaaccaaggtcaccggcatcttgcaaccatgaatattggcctacaagctacaatgtacacaggagatccaaatggttga

SEQ ID NO: 93136 - DNA, 393 bp, Glycine max
  Peptide Sequence Number=SeqID_209914
atgaatcataagcacatgggaagtgttaacctcatcttgcaaattttgttgtgtgatgacaaggtggggacaagtctaagctgtgaagtcagtatctgttattccattataagccttaaagagtcagatattattaaaacagacacattgcttcatcaaataggtcagattgttattgccattcaagtggatcctagtgtcactaaggcccaacacacatttatttccacacctgtcctccttttgttcaatatggccctatttgtgtttttcacaagtcgcgggcaagccgaggaagagaaagggatgttgcgggtctcgcaacaaagtgaaggtcgtggggaaggagacacccagcaaagtgagggtttggaaggggaggtttcgaagtaa

SEQ ID NO: 93137 - DNA, 615 bp, Glycine max
  Peptide Sequence Number=SeqID_209915
atggctccgaaaaacttttccacaaagagatctaggagggacgccgcgactgaagggaccagtgccgcccctgagtttgatagccttcgtttcaggagcgtcgagcaccagcagtgcttcaaggccatcaaaggatggttgttccaccgagagagacgcgtccagctcagggacgatgaagtttatgctaatgcttggcccacagtagagggagtgtgggacatacggtcatgggtgaggggtcagtggattccctttgacgcagatgccctcagccaattcctgggtgacccactagtgttggaggaaggccaggagtgcgagttcagtcagacgaggaacagggctgacgggttcgacgaggaggccattgcccagttattgtgcataccggggcaagatttcgcccggaccgctgccaggagacgagtgcagatcatgcgcaccagcatgaccaccttgacccagatgtggatgacgttgctgctcagcaatgtcttgcctagtgatcataactccgatctccctctgccaaagtgtcagctggtataccacccaccagacaccctctggacccggatatgtctaacagggccctggggtttccagccttga

SEQ ID NO: 93138 - DNA, 288 bp, Glycine max
  Peptide Sequence Number=SeqID_209916
atgctgacagcaaaaccgagacttcttgagcccgtgtatctggtggaaatacaggcacctgatcaggctcttgatggtgcatacagtgttcttaaccagaaaagagggcacgtgtttgaggaatgccagaggcccggcaccccacttcacaatgtcaaggcatatttgcctccatctgatccactagaacctgtcactcctgctgctgctcgtgttgcggagataagaaggaagaaaggctttgatgtagaaatgaggcctctctctgagtttgaggacagactttga

SEQ ID NO: 93139 - DNA, 963 bp, Glycine max
  Peptide Sequence Number=SeqID_209917
atggcagatgcttctctctgtgtaacaaaagcaatgctgcatgaattggctcagaactggggaataaaattaaatgaggacttgtttcagcctctcggtgtcagagattgtgttagtaatggaacctcattgattgctagccatcgccaaaatgaaactctgtttacaactgagtttggttcaaacatatatttgaagccaaatagaccagcacttgttgtaagcagtatgagctggacaccagacaaagattttgccattctcttggaagctgctgtaatgtatgatagacgtgttgctgccataataggtgaagatgattcagtagatgaagaggtcatgtggaaagaaatatctgatgcaaaacaatgtttatatcccagattgttattcatcataactggcaaaggtccagaaaaagaaaagtatgaggcaacaataaagggaatgaaacttaaacgtgtggcatttcgtaccatgtggctgtcagctgatgattatccattactgctaggatcagctgatctaggtgtttgtctgcatatgtcatcatcaggattagaccttccaatgaaggttgtggatatgtttggctgtgggctgcctgttcgtgctgtttcatactcttgcattagagaactggttagacttgacaaaaatggtcttctcttctcttcttcgtctgagctagctgatgaacttctgcttctcttcaagggatttcctgatgactgtgaagctttggaggtcctcaaatatggtgcattagaaactggttcttcagcaaggtgggctactgaatgggaagaacaggcaaagccgctgataactgaggcaagttcattctgcaatgctatgcactatctcattatcaggtcatctactcttgtggtagtgtgtctcagtgatcaattcccgatttatcggaatagacaaaatcttcaagtagacagaatcttctga

SEQ ID NO: 93140 - DNA, 408 bp, Glycine max
  Peptide Sequence Number=SeqID_209918
atgatggagcgaagacagaatcaaactccacaaggccaaatagctagggttttggttgaattttttggaggtggctattactgctgttgtttttctcaaaggggtttatccttctggttgttattggcaaataaatattgtaaattgattggaattcatttttgtgggcgtggaaaaggtgcctttgagaggagaaggtatatgaatgtggtgattcaaagggctctccatcgtcagcttaggtattacatgcatgctactgtttcagggcttctaccctctatgcaaaagttgggaatggtggagagagtagctgttatcttcttcaatgctgacaatgttccattggagaaatttgtattcaagcttacaatgaaccaaactaagttcagaggtggaagaggttga

SEQ ID NO: 93141 - DNA, 177 bp, Glycine max
  Peptide Sequence Number=SeqID_209919
atgttggaaaccctgctgcatacctattttgtacaagactacaaggtttgcatgcaatcagcacatagtactagtcaactctccactggatcaggccaacagcttgatccaataatactgttagagaagttaaagatgtcttctaagaatcaacagtgtgtcaaaatcttgacataa

SEQ ID NO: 93142 - DNA, 282 bp, Glycine max
  Peptide Sequence Number=SeqID_209920
atggagagagaaagagaggaatcaatattcttcgacggaaagttggcgtcggtaccgaaggctcttgccaaacgcggatgggtcccaaatactgtaccctcacttgatggcatccacaatgtcgtgacagctgaaattgacgaagcaaaagcacgagtgacaaggaagtacatgacgttggaacaacctttggccgcaaagaaagttgtagatctaagcattggtggctatgacggtagcacgaaggtggaggttgggttaggtgaaggtggttataactag

SEQ ID NO: 93143 - DNA, 258 bp, Glycine max
  Peptide Sequence Number=SeqID_209921
atggctgcgcttcacgtcactgatggagcacttgtggtggtggactgtgttgagggtgtctgtgtccagacagaaactgtgctgagacaggcccttggagaaagggttaagcctgttttggttgttaacaagatggataggtgcttccttgaactccaccttgatgcagaggaggcataccttacatttcagagggttgttgagagtgcaaatgtgatcatggcaacctatgaagatgcagcacttggtgatattcag

SEQ ID NO: 93144 - DNA, 1041 bp, Glycine max
  Peptide Sequence Number=SeqID_209922
atggctgtgacaagcatagatgagttggaggaaggaacagtcggtgtccaaggactggtagaaaatggcgcgacaaaagttctgcgaatgttctactgtgaacgcactaatgacagtgaaggctcaaccagtgaaccaaattcaaagttcagtattcccaccattgacctcacaggcatccgcgatgatcctgttttgcgagatggtgcatgtgagaaatggagattctttcaggtcataaagcgtgaaattccaagtgatgttctggatgagatgatcaaaggtagtggcaggtttcaccaacaagatgtgaaggtgagaaaagagtactacacctgtgatccgaacagaaaagttgcttatgtttccaattatagtctataccatgatcctgctgctaattggagggacacacttggttgtgtgatggcacctcatccaccagaagcagaagaattgccagcaatttgcagagatattgtggttgaatactcgaagagagtaaaggcatttgcttctacattgtttgagttactatcagaggctctaggcctaaatcgctttcaccttgaaaaaatcggttgtgctgaatggtttcttcttctatgtcactattaccctgcatgccctgagcctgaattaactatgggaaatagaaagcacacagacaatgacttcataacaatacttctgcaagatcagataggtggtcttcaagttcttcatgacaatcaatgggttgatgtaacttccatccatggagcccttgtaataaacattggggatcttttgcagcttcttactaatgacaagttcatcagtgttaagcacggacttttagcaaatcatccaggtccaagaatttccgttgcatcgttgtttagaacagatggtgatgactcactagtctatggtccaatcaaggagctgttatctaaagaaaatctaccactatacagagacgtttctttaaaagagtacttgacatattactatgcaaagggcattggaacttccggactatcacacttcaagttgtga

SEQ ID NO: 93145 - DNA, 561 bp, Glycine max
  Peptide Sequence Number=SeqID_209923
atgacattcctaagagctcaaagcactgtggagctcaaccccctgatagcccaagcatttgatgactcaaaagctgacctttcagaagttggccaagaaccgagttcacgccaagacggttcaggttgtgaaccgtggcatccctgtgacggttctagaggacttgaaagatggggtgcaaagatgagaccttttgtgtataatagcaattattatctctatggttcaccagcactcaattggccgagggacacttttttgtgttacctggctcctaatcctccaaaacctgaagacttgccagtactgataacaaatgacagattcaagagcgtagaacatagagtgctggcaaatctcaaaggtccaagaatattatctattgcatgctttttcagcgcaggtcttaaatcatcaccgaaactctatggacctataaaagagttattatcagaagacaatcatcccaaatacagagaaaccacagttgcggaatatgtacgccacttcaatgctaaaggtcttggtggaacctctgcacttcaacacttcaggatttga

SEQ ID NO: 93146 - DNA, 228 bp, Glycine max
  Peptide Sequence Number=SeqID_209924
atgcgaagtaaaatcctatgccccaatgtcacacttatcagagcatgtctctatcaccagctaagtctctcagtctctatcatggactcatcatatgatggctcacctgaaacaaaatggcaatcagcccaaacacaaacacacacccgtatgaaaaacctcgttgggcgcctaggagtacatgacaggacatgcctcacaatgggtaagtcaggtcaatctcactaa

SEQ ID NO: 93147 - DNA, 330 bp, Glycine max
  Peptide Sequence Number=SeqID_209925
atggtggccacaagcacagatgagttagtctctagttatgacaggaaaagtgaaatcaaggcatttgatgattcaaaggttggtgtccaaggactcgtggaaaatggtgtgacaaaggttacaaatcatggaattccaactcatattttggatgagatgatcaaaggaactcgaaggtttcatgaacaagatgccaaggtgaggaaagagtactatacccgtgatatgagcaggaaggttatttatctttccaattttagtctctatcaagatccatctactgattggagggatacacttgcatttttttgggcgcctaatccaccctaa

SEQ ID NO: 93148 - DNA, 150 bp, Glycine max
  Peptide Sequence Number=SeqID_209926
atgggcactagcaggcacacagagggtaacttcatgacaatacttttgcaagaccaaattggtggccttcaagttcttcatgaaaatcaatggattgatgttcctgcagtacatggagctcttgatatgaacattggggatcttctgcag

SEQ ID NO: 93149 - DNA, 279 bp, Glycine max
  Peptide Sequence Number=SeqID_209927
atgggtgcagaagccagaaagctagtgactaatgacaaattcatcagtgttgaacacagagttttagcaaaccatctggggccaagaacatcaattgcatccttttttagaattggtgatcagttaccagagagtctctcaaaagtctttggtccaatcaaggagctgttatctgaacacaatccaccagtgtacagaaaagcttctttaaaagactacttggcacatcaatacacaaagagcattggagcttcctcattgtcattgttcaggttgtga

SEQ ID NO: 93150 - DNA, 108 bp, Glycine max
  Peptide Sequence Number=SeqID_209928
atggcagccacaaatacagatcagttggaggcaggaatagtttcaagttatgacaggacaagtgaactcatggcacttgatgattcaaatgctggtgtcccaggactg

SEQ ID NO: 93151 - DNA, 144 bp, Glycine max
  Peptide Sequence Number=SeqID_209929
atggccgaaccacgtttaagagtaacagaacttatacaaagaaccaacaccctcctattgggagttcatcctgttgataagagaagaactgtcagcgagtaccgaaatatttttccagcaattgatttttcactgctactgtaa

SEQ ID NO: 93152 - DNA, 135 bp, Glycine max
  Peptide Sequence Number=SeqID_209930
atggcttatggcgtggtgatgcgtggcactgtgggccgtggtgctacatatgtttccaatctactttatgctactaacaggaattttgaaactgctcctatggatgtagtgtgtttgggtaaaacaaaaaattga

SEQ ID NO: 93153 - DNA, 2277 bp, Glycine max
  Peptide Sequence Number=SeqID_209931
atgcatgtgcatagtgggaaagggaaaagagggcaagagaaggataatgagcctcaatataaaggcctggaagtgtatgtaaggaggaggaaaaaggttgcacaagaagaattggttcttggttggaggcctgttcctgtaaatacttctgtagtaggttactatgcaaaggagaccatgcccaatatacagcaggtatttgttaagattgtgaaagaagaaaacgttgatgacattgaacgagaactgtacatctgtcggaaattgattgaaaaagcagtaagctcagaaagttggggaaatgagctttatttctgttctttatccaatcaaaccataatttacaaggggatgcttcgctcagaagtgcttgggtacagcacaaatactagtcccagatggcctcttgcacaaccgatgaggcttcttggtcataatggagagatcaacaccatacagggtaacttgaattggatgcaatcacgagaaccgtcattgaagtcacctgtatggcgaggtcgtgaaaatgaaattcgtccatttggaaatccaaaggcatcagactcagcaaatcttgacagtgctgcagaattattgataagaagtggtcgaagtcctgaggaagctatgatgattcttgttccagaggcttataaaaatcatccaactctgtcaatcaaatatcctgaggtggttgatttctatgactattacaagggtcagatggaagcttgggatggaccagccttgcttttgttcagtgactttaagaatttaagaagtagcactctagtcaggaaagggtggttcttagaaactgacagtgatgggaaaactgttggtgcatgccttgatcgtaatggacttcgacctgctaggtattggcgaacatcagacaatatggtctatgttgcctctgaggtgggtgttgtgccagtggatgagtcaaaggttgtcttgaaaggccgtttaggtccaggcatgatgataacggttgatttacctggcggtcaggtctatgagaatacagaggttaaaaaacgagtagccttatcaagcccatatgggaactggatcaaggaaaatttgcggtctttgaagcctgggaacttcctttcagcctctgtgttggacaatgaggcattgatgtgggactacacttccactcttgaggctgcaattaaggcagccctgaagaggccgcatccaagacgggctagggtcttggtgatggatctaagagttgagaatagatttgggaggaaaagtcaagataggatttcaaggaccaattggtgtcaaataaagggtgaaaaacagtggagcctttatcaaagttatggagaaatagcatggggaggcaataggaagtgcaaatggtatctgggacaagatggacaaagggatttaggaagatggctaaagaaactcttggtgaatcaaaaggttgatgacctgtgggtaaagaatcttggtggtgaaagataccaaaaaggctttgagcaagagcttttgatgggttataccaatcctttggcaccaaaggtgccaagagagatattgtcgaaggcccgaaagaagaaagcagtttgtattgcatatattcaagcaatcaacgatatgtttgagagggtcacaactggaatgggagtacaagataggatcacaacagggcccatcgtacagaacaatgaagaaatagagggagatttaaaacttaggattcaagagggatggatcatgggtggaacggaggagtgctttggggcatttgggtactctagtgaagatgtccagatggtgatcgagagtatggctgctcaaggaaaggagcccacgttttgcatgggagatgatattccattggcagcattgtctcagaaacctcacatgctttttgattatttcaagcaacgtgcaaagttacttatctcattacatctggatcatgttacaaatcctgcaattgatcctcttcgagaaggattggttatgtctcttgaagtgaatattgggaagagaaggaatatattggaaactgggccagagaatgcttcacaggttatgttatctagtccagtattgaatgaaggggagcttgagtcattactaaaagactcatacttgaaaccacaagtattacctacattttttgatataagtaagggcattgaaggttccttggagaaagcattaaataagctttgtgaggctgcagatgaagctgtcagaaatggttcccagctgcttattctatcagaccattcagaagcactg

SEQ ID NO: 93154 - DNA, 432 bp, Glycine max
  Peptide Sequence Number=SeqID_209932
atggctacacatctgagagctcacaatatttggagctttgttgagacgggattaacggaaggagcaaatgatattgctaagaggagatatcagttggtgtatggagaagacatcctcaacaacaagatagtagacaaaattttacagacattgccgatgaagtttgatcatgtggtgactacaataattgagtcccacgacacaaacaccatgacaatagaaaagttgtatggaagcatcgaaagccacgtgagcagaatcttggagaagacaaaaaaagaaaatgaagaagcactaaagagtcaagtgaatctcaataatgttgcggaaaccagtcggagtgcagaaaatagagcctatggtaatttcaacagtggaggaagaggaaatttcaaaggtagaggtcgaggaaattacaatggcagaggctga

SEQ ID NO: 93155 - DNA, 783 bp, Glycine max
  Peptide Sequence Number=SeqID_209933
atggatgttaaatatgctttcttgaatggtattatggaagaagaagtatatgttgagcaacttgcaagatatgtgttcagaggaaaagaagacaaaatttatagattgaagaaagctttgtataggttgaagcaagcactaagagcttggtatacgaaaattgattcctattttgtgcagcatggtttcaagagatgtccttttgagcacacattatgtgtcaaatttgttgatcttgaagatattctcattgtgtgtctttatgttgatgatctaatcttcattgacaataattcaaagatgattgcagaatgcagagaggctatgataagctattttgaaatgacagatttaggcctaatgtcctattttcttggcattaaggtcattcaacaggataatgtgatttttatatcccaaaagaaacatgcaagtgatattctaaaggaattcaagatggaaaattcaaaaccaatttccacactagttcaagagaagttaaagctaacaaaggaaggtgatgaaaaaatgatcaatgcaactcaatacagaagtttgattggaaatctgaggaggtccaagcacattgatattcgatgtcacaagatttggaagttgatagttgataaagaaatgtggattaattattgtccgattgaaaatcaaatagtggatatttttacgaagccattgaagatggagttatttcacaagtttgctgtcaagctgatgcagcttctgagtcaatatatgatataccagtatgagcatcagttacgataa

SEQ ID NO: 93156 - DNA, 252 bp, Glycine max
  Peptide Sequence Number=SeqID_209934
atggtaaaaataaaaaaggaatttgggtctgtcagacaaccgtgtgaccatcccaggcacaaggaagtgtctaagaacgatcctctacagccaaagatgagactcctccaaagagaaacacatcaggccgttaatcacgctctgatcacacgaattcgtctcagtattgcacaaacatggatacaatcttcttcccatggtgtttcctacataacagcagcagcattggtcccaaatctttatcttttctag

SEQ ID NO: 93157 - DNA, 378 bp, Glycine max
  Peptide Sequence Number=SeqID_209935
atgccgatctccccctgcggatgtattagttggtctgtgtcgtcccgacatagggatcatgcccgcaagacaccagtggatctggagaagtccaacagggtcctggggtttccagctttgattatgagcctctgtcaattttacggagtgcctgtcacccccaacaaggtcattaggccccgcattaaccgggctttcatcaagaagtactgcgcccccaagcaggcacagggcgagacaccacaacagcattgggatggctggcagcaggcaacaggcgcaccaccaccacctctagagttcacctcagctcatccacaaaaaaggttagagcattgcctacggcacatggccgaccaagtccaaagccaaaggtaa

SEQ ID NO: 93158 - DNA, 198 bp, Glycine max
  Peptide Sequence Number=SeqID_209936
atggctctctctgaacactcatcagtgatcactggaaggaaaagagaggaatgcacgtggaagtcagtgccatgcatgagagaccccccaaaacagtgggatgacccattaggagaccgtcccctaaggggaatggtacggacaatagccgttttcaggtggaaaaaggctaggtatgcactgtgtacgtgttggtag

SEQ ID NO: 93159 - DNA, 244 bp, Glycine max
  Peptide Sequence Number=SeqID_209937
tcttctcccgtataaggttagagaacgtgtacctgaggctagtgtgagttccatcagagatgctggtggaattgcacctgcatcattgcatgggatttcaccagagccacaatcagcacccccacatgtgaattttcctgaagggtccttggagcagaaaatgaagacttggatgcatggaagttcaaagcctgttgatgataactgtggtttgcctgcagcagttaaggaggtcacactgtga

SEQ ID NO: 93160 - DNA, 822 bp, Glycine max
  Peptide Sequence Number=SeqID_209938
gagctactaggaaaggcatgcaggctatctggttcatgctattgttgttggtggctattgcattagggaattcagatattgattcactccttgaattcaagaagagtattcagaatgacccttctggattagtagttaattcttgggattccaggtctttagattccgatggttgtcctaagaactggcatgggatagtgtgtagtgaaggcagtgttatatctatcactctggacaatgctggtttggttggtgagtttaatttccttgcaattagtggccttacaatgcttcgcaatttgtctgctgtgaacaaccatttcacaggagatctgttatatattgctacaattgaatcacttgaatatgctgatttgtccctcaacaagtttaatggcccgttactctctaacttcactcagttgcgcaagttaatatatctgaatctttcttcaaatgaacttggaggtactcttcctattgagtttcacaaacttgagcagttgaagatttctggtacaccggatttgggactagcagatgagtcatttctctcttcaattcagtatttaaatattagccataattccttgagtggtgagttatttgctcatgatggtatgccttaccttgacaatttagaggtctttgatgctagtaataatcagttagagggtaatctaccttccttcacgtttgtggtatcccttcggattcttcgccttgcatgcaaccagttgactggtttactgcccgaagctctattgaaggaaagttcaatgatgttgtctgaactggatcttagtcaaaacaagcttgaag

SEQ ID NO: 93161 - DNA, 258 bp, Glycine max
  Peptide Sequence Number=SeqID_209939
atggagtataaccaaggtgttattgtgggaaaaggaatgcttttaaataggagagaaaagaaaaaggatagaaggcagttgccagctcagaggaggcgcaagatgacaagtgcctcaagctttctttccaacatgggaaatcaaatccaatccaatcccattcaaaagacaatgatagctcactgttttgatgctgccttgacttctacagttccaattcccaaatgctatgtacctaggaaatttattagtcattag

SEQ ID NO: 93162 - DNA, 288 bp, Glycine max
  Peptide Sequence Number=SeqID_209940
atgagaattgtcaaagctggaaatgcaaggttcattgaaaatggtgaaataagtgggagtacaattccacgagaagtggaaattaaagaagttagagtgcaagttcctttagcttgttcctctagcagattgccaaagggttgtaagagagttggttgtaagtgggtcttcaagactaaacctgactctcatggaaactttgaacattataaggttagacttgttactaagggatttactcagaaagatgacattgattataaagagacgttttcaccggtctcatga

SEQ ID NO: 93163 - DNA, 309 bp, Glycine max
  Peptide Sequence Number=SeqID_209941
atggaaggatttttagtgtctggaaaatatgttgcgttgcaaatttgtgatgacaaagatgttgaaaccatgctcgaaagttttcaacaacaagatcaaatgtcagttctggaattgtacatagaaaaagatgtggttggtggttctatgtttcattctgcaaattctcttacatcatgtggaaataatttatctaataatgaggtgcaaccgccaagaaatgtgagcagagcaatttacatagtgatgaagatgatgatgatgatgatgattatcttgtgtctaactcatacgttgaagagtctttag

SEQ ID NO: 93164 - DNA, 1017 bp, Glycine max
  Peptide Sequence Number=SeqID_209942
atgaaagcatgggaaaaatgggaatgtgaagctgtgataggtgcttttccatgtcttcaatatcttgatataagcaaatgtcccaagctgaaaggtgacctcccagagcaacttcttcctttaaagaatctagaaattagagagtgcaaacaacttgaggcttcagctcccagggctctagaactatacctgaatgactttggaaagctgcaacttgactgggcttatttgaaaaagctcataatggtcggacccagcatggaagcattgttgctggaaaagtctgatactttggaagaactggaaatttattgttgcttgcagttaggaatattttgcaattgtagaatgagggatgatggctgtgactctctaaagacttttccgctagatttcttcccaacactcaggacccttgatctcaatgacttgcgtaatctacagatgattacacaggatcagacccataatcatcttgaatttctgacaatcagaaggtgccctcaattagaatcattgcctggaagcacatctctgaaggaactacgaatatatgattgtccaagagttgagtcgttccctgaaggaggtttgccatcaaatctaaaagagatgcgactcataagatgctcgtccggactcatggcctcactgaaaggggctttgggagacaatccctctctggaaaccttgtcgataacagagctggatgcggaatcttttcctgatgaaggtttgctgccactctctcttacttgtctaaccatcagtgattttccaaatctaaaaaaactggactacaagggactctgtcagctctcctctctcaagaaattgattcttgatgactgccccaacctccaacagctaccagaggagggtcttcccaaatccatttcatatcttgaaattgaagactgccccaagctcaagcagcgttgccagaacccaggaggcgaagactggccaaagattgctcacattccaaccctgaatattagtcaatggttgtgctga

SEQ ID NO: 93165 - DNA, 678 bp, Glycine max
  Peptide Sequence Number=SeqID_209943
atggaggagcaattcatacttagagttccacctaatgtggcagagcggatagagcgtcttctgaatgaaaacaatgcttcttcatctgaagacaagtcactagatttgtcatttagagaggatggaagaagtggtacgtttatgattgggaatgaacaattcccagcttctctattggatcttccttgcgttgttgaatcctataagacttatgatgataactctttgattaagactgccaatattggtcagatgattatggtgagggaatctggtgatgctgctccagatgtaattgagtacagacatggcctcactccacccatgagagatgctcgcaagcgtagatttcgcagggagcctgatcttaatcctgagcttgtctcccgtgttgagaaagatcttctcaaaatcatggctggaggaacagcggacaatcttgatatccttacatctttttgcccacctgatagtggaaacaagcttaactttggttatttccttgaccgaaattcacatgtggaaacagctgagcaagaagaaggggatgagaatgcccgaggtgctaataaaaaatctgcacctaagcctgcaccaaaacatgatattccagagaatcttactaatgcaggagaagctgacaggagtgattctgaggaatctgatgactcagtctga

SEQ ID NO: 93166 - DNA, 219 bp, Glycine max
  Peptide Sequence Number=SeqID_209944
atgtctctctatggatcttctcctactagatataagtttggttatggtgttgttgcctttggggtaggaggagtttttgctgcggcttttggtgttggtgaaatggccatggtggtggaggaaaggagtaggaagagtgagaaagagaaaagagttgcatgcttcatcttccagtttccaagtcaagccctttggatggctttgatgattctggattaa

SEQ ID NO: 93167 - DNA, 315 bp, Glycine max
  Peptide Sequence Number=SeqID_209945
atgggtgccaagtacctcgaagtggtcaaacgagggtcgcatcccaacaacggatggtccccggacgaaattaggtaccgacacatcatcctgatactgtcgaattcgttcctcttgtttgacacaaggcgcaaaatgaccataatttttctctgcgtagcttttggacacgatcgagcctgggcggcaaggcgcagaatgactataatttgtctctgcgtgccaccggacacgatcgcctctggatggcaaaaaggtgtacgaaatgaccataatttgtctccacccacctctcgacttactgtccccgaatga

SEQ ID NO: 93168 - DNA, 963 bp, Glycine max
  Peptide Sequence Number=SeqID_209946
atggatcacaaattggtggtggtggaagctgatggaaactatgtgaaaccatttatcgttgatgacatagacatatattctggtgaaagttactcggttctccttacaacaaatcaagacccaaagaaaaactattggatttcagttggtgtgagaggaagaccacccaacaccccacaaggtttaactatcctaaactacaaaacaatctctgcctcagtttttcccacttctccaccacccatcacacctcaatgggatgattataatcgtagcaaggcattcacttacaaaattcttgccctaaagggaacggaacaacctccacaacactatgatcgtaggcttttccttctcaacacacaaaaccttgttgatggatacactaaatgggccattaacaatgtctcactagcattgccaacaactccttacctaggctccattaggtttaatgtgaatggtgcctttgacccaaaaagtccacctgacaatttctcaatggattatgacatcttgaaacctcccttgaaccctaatgcaaaaattggaagtggggtttacatgtttcagtttaaccaagttgttgatgtgatactccaaaatgctaatgtaatgaagggcaaaaacagtgagattcacccttggcatttgcacgggcatgacttttggattttagggtatggagatgggaaattcaaacaaggtgatgattccaaattcaacttgaagaacccaccattgaggaacactgcagtgatattccctcatggttggactgctttgaggtttaaggcagataatcctggagtttgggccttccattgccacattgagcctcatttgcacatgggaatgggtgtcatttttgctgaggctgttcaaaacgtgacgagtactatacctagggatgcttttgcatgtggcattctcaagaagttcctgaataaggaacacaactga

SEQ ID NO: 93169 - DNA, 525 bp, Glycine max
  Peptide Sequence Number=SeqID_209947
atgtatcagataggatgcatgaagaaaatgaaagtatgggttcttcatagattgttgccggatcttggtaactctaacctatctggacatttggtacctgaacttgggaagctggagcatctacagtatcttgagttgtacaaaaacaacattcaaggaactattcctccagaacttggaaacctgaagagtctcgttagcttggacttgtacaacaacaacatatcaggcaccatcccaccttcattggggaaattgaagaatcttgtctttttacgactcaatgacaaccgactaactggcccgatccccaaggaacttgctgctgtttcaagccttaaagtagtatgtgtgctttcaaagagcctaaacattcactttattttcagggatgtctccaataatgatttatgtggtacaattcctacctctgggccattcgagcatattccattgaataactttgagaataatcctcgtttggaaggtccagagttgttgggacttgatctcaatctgcgttga

SEQ ID NO: 93170 - DNA, 594 bp, Glycine max
  Peptide Sequence Number=SeqID_209948
atgagcaaaagcaataacaatataatgagctttaaagctctaaccttatggtgcattttgttgtctttgttgcaactatctctaggagctgtaaggcaccgtattaggtttaacgtagagtacatgtatcgtgagccagattgccatgagcacgttgtgatgggaatcaatggccagtttcctggcccaaccatcacagctgaagctggagacacccttgagattttactcaccaataagctctccacagagggaacagttattcactggcatggaattagacagtatggaacaccttgggctgatggaactgctgccatttcacagtgtgctattgctcctggagaaacttttaattacacatttacagttgacaggccgggtacatacttctatcatggacactttggtatgcaaagagcagcaggactgtatggttctctgatagtgaatttgccaaagggaaaaaaggagccattccattatgatggtgagttcaaccttttgctgagtgattggtggcacaaaagcacacattctcaagaggttggtctctcctccatgccattcagatggattaatgaacctcagtga

SEQ ID NO: 93171 - DNA, 624 bp, Glycine max
  Peptide Sequence Number=SeqID_209949
atgtcccttgaagagtcgctaagatctctttctcttgattacctcaacctcctcatcaacgggcaggccttcagcgacgtcactttcagtgtggagggccgcctggtccacgcgcaccgctgcatactcgccgccaggagcctcttcttcaggaaattcttctgtgggccggacgcgccgtgcggcctcgaccctgccggaccgcgaggcgttaactcctcgcgctccggggtaatccccgtcaactcggtgggctatgaggtgtttctcctcatgctccagtttctctacagtggccaggtctccatcgtgccccagaagcacgaggccaggcccaattgcggcgagcgcggctgctggcacacgcattgcacctccgccgtcgatctcgccctcgacaccctcgccgccgctagatactttggcgtcgaaccgctcgcattgctcactcagtcgtatgtttcatgggccttgggaattcggacagttactgcttctgggtctggtctcgttttgggaactgggaacggagggtctgtaatatggatgagaattttgggttctgaatttgtgcttcaatctttcccatcaggagttataccagcagttcgttctattctatga

SEQ ID NO: 93172 - DNA, 465 bp, Glycine max
  Peptide Sequence Number=SeqID_209950
atgaccactcttacacagatatggatgacgtttctacttagcaacattctgcccagcgaccacaatgcttatctccccctacgaaaggatcacgcccacaagacaccaagtggacccgaaggagtccaacagggccctggtgtttctagctttggttacgggcctctgtcagtcctacagggtgcccgcccccctagcaagggttgcgcccacaaaacacccagtggatttggaggagtccaacagggtcctggggtttccagctctgattacgggcctttgtcagttctatggagtgcccgtcacccccaacaagggcaagacaccataacagcctggggatggctggcagcgggcaacagacacatcgccgccacctccagagcccctcagctcatctacaaaggttggagcgttgcctacggcccgtggccaaccagcaggcgaccaagtccaaagccaaag

SEQ ID NO: 93173 - DNA, 165 bp, Glycine max
  Peptide Sequence Number=SeqID_209951
atggagggaccctattggatttggatgatggatggagcagaaaagactcttctttggtcacttggaatagatggtatccactgcccttctgatttttctgccttggatctctggcttttcaaatggtcaccatttgaagtgcggtttcatgggagattgggataa

SEQ ID NO: 93174 - DNA, 492 bp, Glycine max
  Peptide Sequence Number=SeqID_209952
atgaagcgagggcgagcatgccatgttttactgctctgtgttattcccaaagccgatacttccttttcaaaacttcgtcctccctctgcttctttctttcttagttgcagcgcgattgctgcatcgtcctccaataagagctcgctgctagtgaaccctaacacggcggcaacgagaggtgttcggttgaagctcagatcagcgatggcagcagcaacccgcacttctctgcggttcctcctctcagtctccgtaaccctaactctcgctcacctcgccgcctcaaattccgaaggcgacgctctctacacgctgaaacggagcctctcggaccctgacaacgttctccagagctgggatcccactctcgttagcccctgtacttggttccacgtcacctgcaaccaggacaaccgagtcactcgcgtgtatgcatcccctctctctgatcctcctagaggttgcgggattcatcaaattacatgccattaa

SEQ ID NO: 93175 - DNA, 264 bp, Glycine max
  Peptide Sequence Number=SeqID_209953
atgaagaagaaaaaggttgcaacagttggtatctcgctaagtgagacatatgcgcttagtgaacaacatccgctaagtgaggcacttagcgagcttagtgagttaggagaatctagaagagaatctgtcaaacatgcacccgctcaacgtgccatcaacgcccccactttttggaagaaagcaatagagatatacgtgagaggcgcaacagaggaaaacagggcaagggagtaccaaaaacctcagctttcaagaggattctag

SEQ ID NO: 93176 - DNA, 1281 bp, Glycine max
  Peptide Sequence Number=SeqID_209954
atgtcacatgacagatcaaggttcacttctctagaggcttgggaaaggtacacagacatagtggtgcctagaaagatacttttagagagaaatgtggtgatataccacactaagtttgatgatttcaaagaagagcttaagagaagaaattggcatgaagagttgaccagctttgaagaaggcagcattgatgttgcaattgtgagggagttctatgctaacctctatgatccagaggataaatcaccaaaacaggtgaaggtcagaggccatttagtgaagtttgacgaagacgctctcaacacattcttaaagactcctgtgatcattgaggagggggaaacactatctgcttattcgaggttcgcactcctgaggcctgatcctcaggaattggcagccaagctctatatcccagggaagggatttgagcttaatgttgatggcttgccattgaagatcctcataaagaacctgactaccattgctaagacttggagcaagatggacatgaatgtgggctgcttaatttctcatcagatctctatgatcgcccagcacgactcctctagacttgggtttccatccttaatcattgctttatgtagagctagaggagtcacttatgattctaggatgctggagagtcttcgtcccgccattaatttggcatatgtgaagaagaactgttggaatcttgatgatctaacagtgactttcagagggcctcgcaaggccaaggggaagaggtcagagactctcccatcttctgagattccctcatcagcaactccttccattatagctccagcttcttctaccccatctccatctgctccagcttcatctttaccaacaccagcttcagctcccactcctttgccagttcttgctgcagtttctacaggactctcctcattcacctctaagactttatttgctatgttgcagagcctgcacaaaggctatatcatcatcgtgcagtgcctacagagctcagttttgcaacctatgatgagcatggaggagttccttagcaagatggcttggccaggagtccagccttctccttcgggaggaggtgaggcctccacagcccaagagcctgtgccagaggaggacgagcccatccctcctgagccatttgtttatgagactgatccagttagtgctcaggaggaggtagcatcaccagctccagttcctgtctctccagcacccattactgatgattaccatccatctgcaccagcattggagcaagagcagcccattccatag

SEQ ID NO: 93177 - DNA, 261 bp, Glycine max
  Peptide Sequence Number=SeqID_209955
atgttgcctactttcgaaaacgggccccgatgggtgcagagaaacacgaggaactggaaccagagaggcggcatgcaaaccgaggcaggatttcagcatccaaaaaggtccaattttttctcctttgtggctgagtatgaggtcaaatcaaaggaaaaagcctccattgaagctccaaattcctcttcctttctaccccaaattgcaaggaaaagccattttcggagtcgtggagcatacctctacttcgtgggggtttaa

SEQ ID NO: 93178 - DNA, 234 bp, Glycine max
  Peptide Sequence Number=SeqID_209956
atgcagaagccagagacccagggaaaccagcctcccccagcctctttgctctgtgttgctgttggctttgtgaagaatgctgctgaactacagttcaagataagagagctatatcggcatattaacaacgactgttactgcttctttcttaggttgttagcgtttgattttagtggctttcaccaggcatatgttgtatcattactacctatccctgtaatcgcgttgttgtaa

SEQ ID NO: 93179 - DNA, 591 bp, Glycine max
  Peptide Sequence Number=SeqID_209957
atgccattatggaccttgtctaatatcttgagcaacttcctcgagaacttcagttcatggcattatggttcatatgccttgttctgggggactacaaggcaaaatggtgtcttcattataggcatcatcaaagggaaggaagtggtgatcttgccaacaaacattgttgttgcatctagttatgctgaagaaggtctagtttttgacaaggactgggagaaggagataacccaaaagattgtggatatcatgctttatggtactccacgacctattacagatgagaagaagacgatgatcaactttcttagaactgtaaatctgacctacgggttgcgagattatctgagtgacatggacaaattttgcaggttcaaccctaaggtgaagaagaaccttgttccctttggaatgttattcactcagattatgagaaatgttggagtgaatgtgtctggcatggaagcgtctgctagagcttctcagttgaaaggagtgacctttctgaagatggggattgctaaaaaatcccaaaatatgcttagaaacacatcaagaaggaacccaaggaagaaccacaatttgtggtag

SEQ ID NO: 93180 - DNA, 411 bp, Glycine max
  Peptide Sequence Number=SeqID_209958
atgggtgatcaacttgcaaagtttgattcaaaggtggataaaggatttttcctggggtattttgacacatctaaagctttcaaagtgattaactcaagaactttagttatggaagaatctatccatgttaagtttaatgatggtctaacaacttataggaagctatcagatcttgagaatgattttgtagatatgcagattggttcgtttgttgaacctaagatagataaaaaccataaactcaacaacctcagactaaggactaaaaatttgttaactatcaccctcaagataagatcattggagaataaactgaaggagtcaaaacctgatcatcattcaaagatcttgtgtgttgtgtatgaaatcaaatctaagatgatagataaaactctgttagttgatgattga

SEQ ID NO: 93181 - DNA, 750 bp, Glycine max
  Peptide Sequence Number=SeqID_209959
atggatactttgctcaaaacacccaacaagcttgagtttttgcacccacttcacggttactcggaaaaattgagcagttcaggttcctctagggtgcaaaatcagtattttgggtttggttccaagaaaccaactgtgagatggggtaaatgtggtaacttgagggctagtagcagtgcccttttggagcttgttcctgaattcaagaaggagaatctggattttgaacttcctttgtatgattcctcaaagggtgctatggttgatcttgctgttgtgggagggggccctgcagggcttgcagttgcacagcaggtttctgaggcggggctttcggtttgtgccattgatccaaaccctagattgatttggcccaataattatggggtttgggtggatgagtttgaggccatggatttgcttgattgccttgacaccatttggtctggcgcggttgtcttcattgacgacaaaacaaagaaggatctagataggccttatgggagggtcaacaggaagctgctgaagtccaagatgctgcagaaatgcatatcgaatggcgtcaagtttcaccaagcgaaagttatcaaggttattcatgaggaggccaaatctttgttgatttgtaatgatggtgtcactgttcatgccactgtggttctcgatgcaactggcttttcgagatgccttgttcagtatgataaaccgtataatccgggataccaagttgcttatgggattttggccgag

SEQ ID NO: 93182 - DNA, 126 bp, Glycine max
  Peptide Sequence Number=SeqID_209960
atgacagatggccgaccaataggcgaccaagtccaaggccaaaggacgcacctagttgctcatgatcctaggaatttaaataaaacaagcgcaaactcgaaaggtagcaagataccttggatatga

SEQ ID NO: 93183 - DNA, 273 bp, Glycine max
  Peptide Sequence Number=SeqID_209961
atgaaatttccgcatatagcaaaagaatgggtgcgaataaccataagaatgaccaaacttggtctctgcttgtcatcgggcccgccgcctctggatgacaaaagggtgcggataaccgtaagaatgaccaaacttggtctctgcttgtcatcgggcccgccgcctctggatgacaaaagggtgcgaataaccataaggtatctccgcgtatcatgggtgcagaatgaccaaacttggtctctgcttgtcatcgggcccgccgcctctggatga

SEQ ID NO: 93184 - DNA, 252 bp, Glycine max
  Peptide Sequence Number=SeqID_209962
atgggtgaagtagaggaagtgcaagagcagatagaggctgacatggaggccatgaaagagcaaatggccacaatgatggaggccatgatgagcatgaagaagataatggaagccaatgcggttgcagttgccgctaccagcgctgttgctaaggtgaacccgacgtccccatccgacatcaaccaaatgaaacatccaacctctgatatggtaggcaaagatttgggaagtatgaatggccccatgatgtga

SEQ ID NO: 93185 - DNA, 4851 bp, Glycine max
  Peptide Sequence Number=SeqID_209963
atgggcgacggcaaggtcaatctccccgacgatctcttctccgctaagccctccgattccctcagagatgaagcatccggaggacatggcggggagaaagggattggggcgctactcgatgattcaaaagatcaattgttgtctgacaacagcataccgttatccccacagtggctttattccaaacctgttgatgcaaagacaacttccaacccagtgggggtgaactcaactgatcccatactgaaagacagttggcgtttggagggatcccaggacaagaaagactggaggaggacagctcctgatgttgacatcagtcgccgctggcgtgaagaggagagagaaacaagcttgcttgggagaagggatcgtagaaaagaagatcgtcagaatacttcaacctcggagaatagatccttgccctctgatcgctggcatgagagccgtggttctggtcatgactctagaagggagaataagtggtcatcaagatggggtcctgaagataaggagaaggattctcgtaatgagaaaagaaatgatgttgagaaggaagatggtcactctgaaaaaccttctcctggtgttggcaatcgcattgggtctgatcgtgacactgattctcgtgataaatggaggccacgacatcgattggaagctcaagctgctggcgtgtctacataccgtgctgcacctggatttgggctggagaaaggacgtatagaaggctccaatgtgcgattttcaccaggaagaggaagggcgaataataatggaaacctacaaattgtaaggcctcctattggctctggtgctggatcagcacttgtggataggaataaaaccatactggggaagtctagtcttggtgctgattcatattactacccaaggggcaagctgcttgacatatatcgcaagcaaaaggttgatccaaattttgttagcttgccttctgagatggatcatgcatcaccaataactcaacatggttctgttgaaccattagcatttgttgctcctgctgctgaggaagagtctgtccttaaagaaatatggaaaggaaaaattactagcagtgaagtctcaggctactcctttagaggaagggatggagtgtcaaatgatgatatttcaggtcctggtattgcaaatgaaggaaaacaaccttccattggaagtggtgcaaaggttatatcaggaagtgatgtctcggatgattctgatcaaattctaattagttcggcatcaactgctggcggtttattgagaaatatagttgaggaagttgcaacttttcaagaaggcaaacagaagcatatggcaactattggtgtgcatgggagagatgagagttccgttaactgcattggggagggaagcattcctggaaaccaagttgctgaatcagcagattttgataaccatcagggacaagcttctggctttcgggaacatgctaatcggaatggtgttgaatcaattgctgcttctgaagtcagtagtaatctacctgatgattctcgctctctctttgatttttcatctctgcatcaaacttcatgcactaatcaacaggacttcaaaattaatgagaagacgtatccacctgaaagtgttattgctctcgaggagttgagtttgtgctatctggaccctcaaggggaaattcaaggaccctttcttgggattgacatcattttgtggtttgaacagggtttttttgggatggacttacctgttcgcttgtcagatgctcccgaaggatcaccatttcatgaacttggtgacattatgcctcatttgaaagtcaagtcaggattaggttctggtagtaacagggttattcaatcagaaccgactgatgccattggaaggaacctaaaagtagatgttcataattttgactatgatgggtcttctgttagtgatgatcaaccttggtcttcttcccgacctgatactacctcaagtgttggcattccttcccaaatacccaaccaaggttatcactctgaggtcaagttctccgatgaccagtgcttcagtaatattgttgctcatgacgaggatatcactttgtcaaaattggctggaagcataaatgaaaaacctatgacgaggcccatggatttcaatgcttcgtattcccatcctactggaaaacctgttgcaaatgaagttccagtgaatgatactcataataatgaggccgataagttgcacccttttgggctattgatgtctgaactcagagatggttctcatttaaggcgtgcacaatcttccaatagttctttgagattgggtgaccagggtcattttctagatccattaattgatagagatgctgcttttgctgatcaaagctctgttggtggcatggctaatcagcctcctttcagggagacatgggctgatgaatatgggttaaataggcattttaatggtaatccacatgtaggctcattagaagatcagttcttgtcccatatgggaccaaaatttaataattttgatgtggcagagcaactcatgttgcagaagcttcagaaagaaaggcttcaacagcagagtagtatatccaatcatttccctgctcatcataatgggtcagatttagagcgatttcctggttttgctctttctcagaacaagagccccaacatccagcagatgatgcagaattctggatcagattttgaacgtattctggaacttcagattcaacaacgccagcttgagcttcaacaacagcaagatatgcatcatcaacaactacttcaccaacaaatgaaacttcagccccaacaacaatctcaagttcagcagttgcttcttgaacagtttatgcatcagcagatccctgatcccaattttgggcagtcaaaacatgatatttctagggataacctgttagatcaggtacaattgaggagatatgtgcatgaattgcagcagaatccacattctttaaggcatcccgatccatcaatggaacagattatccaagcaaatatgggcatcaatgctgcccaaggaaggcaagctgatttggcagacctcttgttgcaagcaaggcatggaaatatattgccttccgaacaacagcttcattttcagcaagatcagcttcaggcacagcagttatctttggctcttagacggcagttagggttggatggagaaaggcattttggtaggtcatggccaatgaatgaaactggacagatggcaagaaatccagcaacccatcaactgggtcattcagctggatttaatgtttcagatatccataaacagcagcagaggcttgtgtcacaagaggagcaactaaattatttggggaggaatcttccagagcagaaccagagagggttctatgataatcctatgatgtttgagaggtctgcaccgatttcccaaggaagggaattacatgaccgccatcgctatttacatccaggtgatcaaatgggttctttatcctctcatcatctacaatcatctgatgatctttttggtcatcaccctgatgcttttaagagttcactccatggcaacaatgggcatgtggaaaatagctggattgatccacgggtgcaaatacagcaacaccttgaagctgtgaggcagagaagagagttaggagatactgttacatcagcagatctaaacatacctgcatctgctggtgctcatgaagagagttcagcacgaggttttatggaacgacttcatcaaaaactgggtgttcaatccacacaaccatcaactgttgataaatggcatcctctttcatcaagaagtgacaaatcttggcatgttcctgaggctagttcaataatgcatccttttgagcatccgtcagatcagcaagtccatctgaatgacccttttttagaaaggactcaaagtgctaattccaatgccttaatccatgatcatttaaccaacatgcatatgactgaccaatacaacaatctaggaaatactgaaagaatgcctcttcgatctagatccggttcattggttgaagaacaatcactgttatctgctaataaggacactttacatcccaattacagaattccttttcagattggtaaatcatctatggaaaaagacttacttgagttagaagcaaataagggtcagagacatgactatatgggcacaatgagcaatttggttcctgggatgtcagacatgtcagagcaagtggaaagcatcatgaattccatggaactgcccacaattgcccatagtagacatagctcactgagcagtgcaggtggtgatggtggttcatttggtcgtgagatgggtttgaataattcacgtggagatgaggtttctggtgacaggatacctccttcaacaaaagggtttgataatgctttccataagcgcccccatgtaacgcgggttttatcctcacctgatgtccagtcagaccagccatccgtaccccatgtcaatcaaaataatttaataaacctcacatctggtgaagggagaagagaaacgtctggaaattcgtcaatgagtagcatgacagaggcttctgggaaaaaggaggttcggtttagatcttcctccttcagtgaaggtgctgtgtcagagacatcatttatagatatgctcaaaaagcccgttcttcctgaggtggtggttgactcacatgcagccagtggaatcgggagcgagtcatccgatgcagcacaagcagggcgaagcgggaaaaagaaaggtaagaaaggaaaacagatagatccttctcttctcggtttcaaggtctccagtaaccggatcatgatgggtgagattcaacgccctgaagattaa

SEQ ID NO: 93186 - DNA, 486 bp, Glycine max
  Peptide Sequence Number=SeqID_209964
atgcaagctagtatctttgattacgtcaaggtaatgccgacttctgagcttagtatgagtgaagtcattaaggagctaaagcttgaggaaattgatggtcgatctgtgtggggtccttgtgtcaaaagtctactcgacgatataatagtcaagtggcatgttgcaatggagattatgatgctaggtctatatatagatattcttaagacaagaagaattacccaacctgaaaaaggggtcgctaccttaggtgagagaggggatgaggatctgaaccacgttaaacaagttgaggttgaagttatggatttagggtcttcttggcgatgggtccaagcggtgtatcctgtgggtggagtggtggtgcaagctaccatgtggaagaaacttacacttgagaggaagattgttggagtacaagaggacgaggaaggtgatgaaggtcaagtcatcgttgttgcaaaggaacacatacttctaccatag

SEQ ID NO: 93187 - DNA, 573 bp, Glycine max
  Peptide Sequence Number=SeqID_209965
atggacagcaaaaacgtcgtcgtttgcgacaacggaaccgggtatgtgaagtgtggttttgctggggagaatttccccacatcggtttttccctgtgtggtgggaaggccaatgctccgttacgaagaatcactcaccgagcaggcgcttaaggatattgttgttggagaagggtgtgcagacttgcggcatcagcttgatatatcttatcctgtgaacaacggcattgtgcaaaactgggatgatatgtgccatgtttgggatcatgcgtttttcaatgaattgaagattaaccctcaggactgtaagattctactcaccgacccgcctcttaatccttctaagaatcgcgaacaaatggttgagacgatgtttgagaagtacaattttgctggagtgtttatccaaatccaagctgttctaacattatatgctcaaggtttgctgactggattagttattgactcgggtgatggtgtcactcatgtgaaataccatgttgagtggcaatctctattggaaagttggtactggatgagcttgttggattctaaattgttggatgctcattag

SEQ ID NO: 93188 - DNA, 303 bp, Glycine max
  Peptide Sequence Number=SeqID_209966
atgttttcccactctcaactgcatagtaaaaacacagtgcttaaagttcctggcgtaaagaaaactttgggtattcctgaaatacctgttgctccacccaccacgaccagtgctactcaatctcccttttctatatttccagctctaaaacaagctacatctgcaacaacaaatgggtcaagctcaataccagatgaagtttcaaaatattcaaataaaaagatatcttctgcttctgttattcgtcaaaggcttagaagtttagagaaacaagtgaaaggaagaaagaagaacaagaagtga

SEQ ID NO: 93189 - DNA, 546 bp, Glycine max
  Peptide Sequence Number=SeqID_209967
atgattcagtctaaccttccagtatggctaccttgttatgacttcatttcagtcactcgccctgccttacatgaattttcttctgtcttctgtcattccctgctaaagtattacaagtctctcaagcagtttttgcctctcatgtactctttgtctgtcaatactaagggactctttggcttgaatgaaaaacactttatcttgctatatcaacacatagttttaagtggagggagcaccatgtatcctggattaccaagccgattggaaaaagaaatacttgatcgttatcttgatgttgtcctgaagggtaacagagatggattgaaggccaactcattgttcccttattctcatcttttctgctctgatggtgatcagaaattacgactaagaattgaggatccaccacgtaggaagcacatggtgtaccttggaggtgctgtccttgcaggaataatgaaggatgcaccagagttttggattaacagggaagattatctagaagaaggaattgcttgtcttagcaggtgtggccaggcatga

SEQ ID NO: 93190 - DNA, 306 bp, Glycine max
  Peptide Sequence Number=SeqID_209968
atggacgacctgcatcaaccaacgcaactccctttgccacctccaccacaagcgcgagtagcgtcacgctatcatgacactaatagatatgcttcccgcgacaaacccaccatccaagattcttcgggagctctcattggagttagatctaagaagaatgatgatgatgtggttgaagggggtgacagatctcagatgctagagatggacatttctcatggcataaaagatgaacaaggaaaacaaggggtatcactctattttggaatagctaatttggaaggtaaaaattatcttccgaaataa

SEQ ID NO: 93191 - DNA, 2064 bp, Glycine max
  Peptide Sequence Number=SeqID_209969
atgatgaattcattgtgtggaagctcagtgtccctcaagagtgagaacaacaactctagaaccaaagtccaacaacccaccactccttcaaatgactcagttatgcaatccaagaaaaacaatgccactcaatcctctggtgatctagaccaaaccagcctaaccccaccaagcttaaaccttccatcactcaaatttgaccttgatggagatgtggaagttcagtcaccagatagttcaatgtgggaatctttttttgctgaccacaatttagatggtgatttcatgatctcttccccagtgaggaccccacaagcctcttcctacaattgcaactacaactatgctcagggaatgcaaggccagagtctttcagggtgttccccacctcgtttctcatcatcacaaattggagccttcaacagcaacaaaggcaaaggacttagccccctccacagggttttcaactcacccaacaatcaatacatgcagcatgttgagaacctctcactgccagcaatagagttcttggaggactaccaattagggtactcttcatcaacaaccaacaagatgtgttgctctgatcacaacaacattgcaagttcatctgagtgctttgacttgtcaatgtctcatcaaatcccttcgtccatgttggatggcttggcactgcacaattcctcctcgaggtaccatcgtggatcggttgtcgtcgacgaagaatcgtcggtgcacggtggtggtgctggtggcttttctcagctatcagaagagagtgacatctatcaccagatggggtccatggctagtgcttctctttcacaggctctacaacaagaacactaccaagagaagcagcaagcacaacaactgcaacaacaacaacaacagcagcagcagcaccagcaagagaatctgatggtgcctattccaataggagtcgagcaggagcaagacagcgggcttcaactggtgcacctgctcctggcatgcgcggaggcagtagccaaagaagaatacatgctggcaagaaggtacctccaccacctcaaccgcgtcgtcacccccttaggcgactccatgcagcgcgtcgccgcctgcttcaccgactccctaagcgtcaggctcaactccaccctcactcccaaacctacaacaccttccaaacccttaaccccttcaaactccctcgaggtcctcaagatctaccagatcgtctaccaggcctgtccctacgtcaagttcgcccacttcaccgccaaccaggccatcttcgaggctttcgagaccgaagaacgcgtccacgtcatcgatctcgacatcctccagggctaccagtggcctgccttcatgcaggccctggcagcccgcccagcaggcgcaccttttttaaggatcacgggagtgggcccctcgatagacactgtccgagaaaccggacggtgtcttaccgagctggcccactccctacggatccccttcgagttccacgcggtcggggaacaacttgaggatctcaagccacacatgttaaaccgccgtgtcggggaggcgctggcggttaatgcggttaaccgcctccaccgcgtccccggcaaccacttgggcaatttgctgaccatgctacgtgaccaggcacctagcatagtaactctggtggagcaagaagcgagccataacggaccttactttctagggcgttttcttgaggcattgcattactactccgccattttcgactcgttggacgccacttttccggcggagtcggcgcagcgggcgaaggtggagcagtacatattcgcgccggagatacgaaacatcgtggcgtgcgaggggccggagaggttcgagaggcacgagaggttagagaagtggcggaagatgatggaggggaaggggttcaagggagtggtgctgagtccgaacgcggtgactcagtcgaagatattgttggggttgtattcatgtgaggggtataggttgacggaggataagggttgcttgttgcttgggtggcaggatagggccatcgttgctgcgtctgcatggcgttgttga

SEQ ID NO: 93192 - DNA, 756 bp, Glycine max
  Peptide Sequence Number=SeqID_209970
atgataaaactaccaatccagacgagcaccttgatgcattccacacccaggctaatctcaacaccaacaacgacgcaatctgatgtcgagtttttccaatgtccctcaaacgggtacggaggactccctccaaggtccatcgacagtttcgacacccttgttgaatgtttcagctctcagtatgcaaccagctggaatcttaaccctgaagtagcactacattccatgttactcgccttacgacatggtttagaaacgaggtctgacaagctggacaaaagccagataaaagggaaagaggtaccaagaccgaatcatgcaagtcggacgaaaggcataagccgaacaagcgtcaacctctcccaaggggacccaggagcaagacccgaaagacaccaagaggaccaacacagaaatcacgatagaagaagggaaagagaagaagacagaggcatcaccaacaaagacacgaacaacaaccttagcaagaacaagaaaaagagctcgcccaataaatcaaaggaaaatgctgaacgaactcgaagcctcccgaagctcgcagagaaagtgaagccattctacaagctactcaggaaaaatgagccgttcctatgggacgaagcttcgacactagatgatagagaaggtagcactgacactcataacctcggtccaatgcctaaggttgtatttccaaagtcaccaagtgatggtcaagacggactaccccatcaggcgggtgttgtgaaagcctga

SEQ ID NO: 93193 - DNA, 354 bp, Glycine max
  Peptide Sequence Number=SeqID_209971
atggaggtgtacatcaatgcagatgcattagcttacatgacttggaatcttattcaggtgctattatcattggataacacagcatttgaagatgaagaaagagctgatgtttcaaaaacatggatctctcgtccaaatccttctttcgcagctgcaagagaaatatccacgatgcctcacggaagatcaaagataacaatcatttcagagaaaacttgcaagaaactctttgttttccaaggaagtaagcaacccaacaataaaaaaagaaaacttgcaagaaacccacaaaaggaatgctcaaataatcaagagaaaggcaaacataaaccaaaccaaacccaagatgaatag

SEQ ID NO: 93194 - DNA, 237 bp, Glycine max
  Peptide Sequence Number=SeqID_209972
atggataaagaaagagaaggggggaatggttatagagagagagtttctcctataagagatgctcaggctttgggtgtacttaatagagagttccgagtctcgggtgatcacgcgctgagcgcaataatgtctgggcttagcgaggtggttacactcttagcgcgtgatttcacgctaaacgtgcctctaggcttcttcgtgggtcttttttacgctaagcttgagtttgctcgctaa

SEQ ID NO: 93195 - DNA, 183 bp, Glycine max
  Peptide Sequence Number=SeqID_209973
atggcgaccaataggaacttaaccgctcttagggcctttggcaagggttccaaaattttcatcccccacatggcgaaaggccaaggggagcttaggctatggaaattgtcaggaaggctcaccatcaaggatgacgtagtagctgaccttccttttcaggcattggacttcatttttgtttga

SEQ ID NO: 93196 - DNA, 2064 bp, Glycine max
  Peptide Sequence Number=SeqID_209974
atgggggagggatgttgtacgcagccttacccttgcataggcaaagaggctgtttccggattcgaacccatgaccaacaagtcaccaaggcacaactttaccgctgcaccagggctcgccctcaagttgattctaaaaaaacttcgtaccccattgcccagttgctttagatatgatctgaaaaataaaccttatgcacttttcatgttgaacagatactactctgccaaagaaggtgatgacattctggctggtccttacctcaagtcaaagcagatttttgaaggattcgatgtgggcaagatggactccacgatctcgtgcatcaaacttgagctaccctctattaggagaatacgagggggaacttgcaaaataaaagacttcgacgttcaaatggactccacgatctcgtgcgtcgaacttgagctaccctctattaggagaacacgaggggagacttgcaaaacaaaggactctgacgttcaacatcatgttacttgtcatgtcccttttgtggacattggacagtacataagccccccaatttctgagtcagcttgttggcgaaagaagttgtctgatgtcaaaggagattgtctagtgtcgaggttgtcgagggaggacatgttttttgttttgttggtggaatcagtcgtctcagttggagaatgcattaaagacaagcactttgtttgtctttcactgcgggcggtgcaacgcacgtatgttactcttgcatacgtgtcactcgaggagtgggcatgtactggagacacggggacacgccatgaggcttctgagagtgagctcttttcttttgagaggctagtggactcgcgccatgctggcggagcgagatggagtgacgacggggatgttagggttttcccgcgtaacaggcgtagccacaatgctaggttactttcgtcctctcctatcatcgttggctataagtggttaacatggaaaataggatgggtttccctgaatagtgtgtccaagaagctatttgagtttgactcaaacgtgtttcgttgcttcaagaactgcttcttcaaggtcctgatgaatgacgtcgtggctaatgagttgccactggatatgttgaccttagtggaaaagatcgataaggctattttggagcaattggatgcacgagacatcttgtcccttccttcggcgaacaaccctctcgctactttacatggtaaaatattttaccttgtatcttttgtgtctgatgccagacttgctagtggggtcatgccactgtctactgtcaagcctcctactactagggttgaccctaatgatgatgaagttgttgaggtcacccccaacgtgtctttctctgttttggctaagaggaagtgtgatgaaggtgctagggtcttaggtcgtaagaagtcaaggacctctttcagtttttgcgctttgaaggaggttgtcgggttgatgtctggttcgggtcgcccttctactgctggtttgcacgatctgccctcggctccattggttgtccaggctgttgctcatgttccttcgactcctttttctttgcctgctcaagaggtttttgtctctccttttactatgacttctcttattgttcctttggttgctcctgtcgtggtttctgcttccaccattgttatgcctttgctcagtgctgatggtgacgactgcagtttggcaattttggaggaaaatggacaacgacatcagaaagctctaagcaagttggcattcttagaggctaagatcgccaatttgagggccactgctcggactgtatggagagtcgagcgtcccaaggtggtcaatgccattgtcacctttgttgaggacttgcaaagagggaaaaatgacttggctggcaaggtggagagcattgtggatgagaaggatgagctcgccaagggagttgttgacctaggagttgctgatgttctagaaggaggctgtggagatgtgaaggacgatgaactgattgatgaagaagaaatagttgttgcggaagagaatgtcgacaaagggcaagatgacggggccaatgtttag

SEQ ID NO: 93197 - DNA, 246 bp, Glycine max
  Peptide Sequence Number=SeqID_209975
atgccggaggaagaagtagtggagctcaagttccgtctctacgatggatccgacatcggtcccttccgttactcccctgcctccaccatcgccatgctcaaggaccgcatttttgcagactggcccaaagggcttcggctccgacatcttgagcttcccttaaattctttgctgtcagcttcccttaacttctttgttgttgtgcaaacaaacacggccttgacgaccgttttttttggaaaataa

SEQ ID NO: 93198 - DNA, 223 bp, Glycine max
  Peptide Sequence Number=SeqID_209976
atggttcatgatgatgatgttgaaggtgaagaaaacacgatatggaagcacatgaagtcgtcttcacttgcgtgggtaacacactcgtgtgaatatgggatgcgatttggaaggcaaaatgaaagtgcatgtgtcaaatgcacttccatgttgcttggcctcactcttggacaccgtggtgcgcaatggtggctgggtactagggtgatggtggctggtgaag

SEQ ID NO: 93199 - DNA, 306 bp, Glycine max
  Peptide Sequence Number=SeqID_209977
atgcggggttacgttatggttacccgcacctttcgtcaaccaggggcaaacaagcccgtcgacgcacagagactaacgttgtctcctgcaccttttgtcgttctgactcgtgaagtcagcaagtcaggtggtaggcggagataccttatggttatccgcgcctttcgtcaaccgaggggaacgaattcgacgaaacattcaagcccaacgaagcgcgagatttttctctgctgggcagggatgatcgagtgcaatggcaaagggaagtgtcgtggttgtccaactttgtcgttttcaagacactga

SEQ ID NO: 93200 - DNA, 801 bp, Glycine max
  Peptide Sequence Number=SeqID_209978
atgaagacccctatgcatcctactacacatcttagactggacaaggaatcaacgaaggtggacaagactcaatacagagcaatgattggcttactgctctatctcactgtgtcacagcccgatataatgttcaatgtttgcttatgtgcaagatttctaaaggaaccaagggaagttcattcaactgtagttaaacgtatatttagatatctaattgaaactcctaaccttggtcttatattcaaaagaagagaaagtttcaaaactcataagctattgcgatgtgaactatgctggtggcaacttagtcacttggatatgcaagaagcagggctcaactacattgttgaagtagaatacatgtcagcaacaagttgttgcgctcaactcctatggataaagaaccagcttgaagacgacaatgtctatgagagtaaaattcctatcttttgtgataatagagctgttataagtcttttgaaaaacccaatattgcattccaaagcaaagcatatagagattaaacatcactttataagagaccatgttcaaaatggaacagtggatttacagtttgtacccactgatgatcagcttgttgatattttaacaaaacccttaactaaagaaaggttgattctattaagaagtcaacttggaatgatctttgttaatgattggcttaatttctatatgtcatccactagtgcatccaaggacatgttgaccactggaccttaccatacactcacaacgttcaatatatggatgacatatcatgcattttattcaaatacatga

SEQ ID NO: 93201 - DNA, 567 bp, Glycine max
  Peptide Sequence Number=SeqID_209979
atggatatatcaagttcacaatacaatagtgctggtgaatctggatggacacattacttggatcattcctctctttctgaaagttatttccagataagaggtgggatagaagaccatggaggaaagggagcaagagtggaggaagaggaagaagatttgtctatgatctctgatgcttcatttggtcctcaacattaccatgaagatgatggtcaacactattgtaagaaagctagtttcttagggaatgaagcagtggaaaatgcactggattttcccccatgtttcttgggaacaaaaataaagaaaaagtctaaattccagaaacacttcagtttctttgagcgttctcttggtggaaaacaagcttcagaggaaccaggtgttgacaatgcccttatgcagcaacaacctaatacaatgactattattgtccctcagcatcgacagcaaggacaagagattgccaaagtaaggtttttttcccatatcctttcaaatcatgatcttggtttccttcagatatctttcataggaggccatccttacttcagactaagggaataa

SEQ ID NO: 93202 - DNA, 822 bp, Glycine max
  Peptide Sequence Number=SeqID_209980
atggtgaagcacttggtgaaagagggcatgcccctaagtttggggacatcaacatccttgaattccaccatggcggaattctcagctgatcctggctttgctgagaaggctacaaagctttgttgctttggaagtaggagtttcaatggcatgaccacccaattgtgcctcaacattgctgaattggctcaaagatcttctccattggagaacaacaattctccattgcaagacctaatggaagtggctaattctcaagaggagtccgcaatctctgaacaaacagcaaatggagacactggggagaaaccttccccttatctagcgaagaccaatgcaaagcgcaacaagcctaacaaaggtgaggggaatgaaaatggccaagtgaaggcagaggaagagtccaaaggacgtaataatcataatgcaaatgatgagaaacagagcaagagtaactcaaaacctcctgagcctccaaaggattacattcatgttagagcaacacgaggtcaagccactaataatcatagtcttgcagaaagatatacccttaatactaacttcttcaacaccaaagaacaaaaggcagagaacaccaaggagcataaatgcctgtcctcaacctggactaatggatttgcttattgcaataccatgtcaatggtttcagttgtaaggcacgataactctgaaaagggaaactatgtggcttgtgcggtggcgcgacaagacgagacgctggacacgcgacaatgtactacgcccttcggccgaggtcactggggtgcaacaatgcaggcaaatagtagaggtcactgcgag

SEQ ID NO: 93203 - DNA, 219 bp, Glycine max
  Peptide Sequence Number=SeqID_209981
atgtcaccgcatcaaactcatcgagaaggagaagcagggtggtttttggacccagtggtgcaggggtggttttgcagtggccacgaggctggagtcaggagcaacattgagttcagatttggccagagtgggatatgtgcatgcttttggcatttggtgagtggtggtggtacacaacaaggaggtggtcgcggtgatgatggctgcatgtgggggtga

SEQ ID NO: 93204 - DNA, 222 bp, Glycine max
  Peptide Sequence Number=SeqID_209982
atggtgaaaggttgtggatactggagcatccccaacctgcagtggcatggtggtgcaggtggaggcacgccaacgactctgagtgaaggtgctgtttgggttgaggtgtgcaaaggcattccattgttgaccaacttgtccatcacttgggttcgcttaactcaaggcatgatgagactattccagattgccaccagcaacattaatggaatctggctttga

SEQ ID NO: 93205 - DNA, 618 bp, Glycine max
  Peptide Sequence Number=SeqID_209983
atgaagaacggtcacgaaattgatcacggaaacattatggaagcattatggaagcgcctcggccttgatttttcttcttcattctccttctcctcactaatttcacccctcacgcctatttataggaaaataaggggaggaggttgcatgacagctcgcccaggcgagctgcttgcttcacctttaagttttctaatgggcccagaatcatcatcagattttgaggcaatgtttgcccaggtctttttggcgagttttgggagtttgttgaaggttttgggggttcctaagtggatgactcaggttggtgacccagaggttgtggaagaagtctttttgatagttggctctggtagggccaacttgaatcctttgcctgtgcttcgtcctccccttaaggaggcgcctgattcatcggaatggagaaggaagagagataggagatgccacttcaaggagaagatgagtctagaagaagctcactgccatagcaggccatggataagagcttggaggaagaaggagatgaatgaagggagaggaagagaagagcacgaaattttgtgctctaaaagagctctgaaatctaaaattcaattttcaaatgatcaaacttga

SEQ ID NO: 93206 - DNA, 621 bp, Glycine max
  Peptide Sequence Number=SeqID_209984
atggagctccccggtttccggtgcccaccggataccttcacttactccatcctcataagctcctactgccggcatggaatcctcactggctgctggaaggccacaaggaggcgaatatacgaggccgggcgattattccggttgatgctcttcagaaaattggttcctgatgtcgtcacttacaatgccctaattgatgggtgctgtaagactttgcgcatggagagggcgctggagctgttcgatgacatgaaaaggagtggcgttgttccgaaccgtgttacttatgggtgctttgttagttactattgtgctgtgaatgagattgataagggtgttgagatgctgagggagatgcagaggctgggggacggggttgctagttcaagtctgtatacacccatcattcatgcgctttgcgaagctgggagggtcgttgaggcttgtgggtttcttgttgagttggttgagggagggtccatgccgagagagtacacttatgggttggtttgtgatgcgcggccggggagggtggtttgttcgaggatggtgatggttatggtgatgggatgcacaagagaattaaggatgggatatggaatagttactccaaggaactaa

SEQ ID NO: 93207 - DNA, 567 bp, Glycine max
  Peptide Sequence Number=SeqID_209985
atggagcgggcttttgcgaagttcccgacgcggcagagcgcgtggattaggtgcttcgtcggcgaggccttgttcactgaggagtttgatgaggcacgtgacggtggcggtggtcacgtgaggggagtgtttgaggaagtgccagaggggtttgagggcggtggcgcgggcgaggaggcaggcgagttcgcggcacgtgggctcggagtgggggaagttgaagcgggattcgagccagtggaagaactcgagggctttgagtgggcccaggtggtgggctttgtaggggtcgaggtgggccgtggggcccaggaggagggtgttattgcggagcttgcggtgttcgaggttgaggttgcgctgacggagaggggtgcggtggcggaaggtgtgctggcggccgatggagcgaggaaattggagtgtgtagtgggagatggaacggagaacttttgtgagggcttcgtttgcccagggaggggtgacggtgggggggggggggcatcgaatgggaggtctttgattaccaacaccagggcttggtttgcaaggtgtttggggaaatga

SEQ ID NO: 93208 - DNA, 2268 bp, Glycine max
  Peptide Sequence Number=SeqID_209986
atgccggatctgaagagttatgtctcaaatctgaatcgctctttgtttagcatcacgcgtagcaccgagatttcccggggaaacataaccgtcaacgtaacttcttctccttcttcttccatcatcatggagaatcatgataaccttgcagagaaagagaattcggctactaacataaccgaagagacgctaccttcttctccttcgatcaccgatcatgaagaagctgatcccaaacctgatgatgatcatggtgctgaagccaccgcccaagctgaaccatcgtctccaaagaaagatgaggaggaggcagaggcagagaagaaagaagaaaccgcgtctcctccgccaagccttgagaaagtttcagaagagattgacctgtttctcgtgactctgccgaagaaaaacgacgatgaaaatgctgcggagaagaattttgagattcctggcttttttgagagatacacggatctggtggagaagaagatagccaaatatgatgcggaagggaaggcgaaatggggagaggtggcggaggaagattcgtggttgcttgaaaccgcgaatcgggtttcgaagctgatgatgttgctgaatcatcatcatcatcatcttgttgaaccggaggaggaggagaaagagaacgacggtggaaatggaaaaggaaaaggaaaagactcgctggtgaatcgcgttgcatcgattcaccagcgtgtgatgtcgtatttggaggaggacttcagatttctgatggaagaatgtagaatcccaatcgaattagatccaggaggcaataataataacaatgacaccaaagggaaacaacaacaacaacaacaggtttcatcatcggaacaagaagaggtgaagaaagaccaagaaggcgaaatcgacgaaagtttcccgggttactctgaggagacaattgccagcttgagcaagatcgccggcgagatgttacccggcggctacgaatcggagtgctgccaggtgtacatcatctcgcggaggaacgcgttcgaggaggttcgcaagaagctagggctggagaggatcagcatcgacgacatggttctgaaggtgcagtgggaaactctcgccgcgaacatgatccctgcctggatcaacactctcaagcagtgcgcggcggtgtacttccccggcgagcgaaggctcgccgaggccgtgtttgccagcagcccctccgtctcggcggggctcttcggtagcctctcccgcggagttgtgatccagctcctcaactttgcggagggcgccgccatgaccaagcgcgccgccgagaagctcttcaagctcctcgacatgtacgagagcctccgggaggtcatcccaaaagtcaacggactattcccggatgagtccgtggaggaactgaagacggagatgaatgtcgccaagtcgcgactaggcgaggccgccatcttcatcttcagtgacctagaaaaccagatcaaactggagaccgcgaaaagcgcggtccccggcggagcagtgcaccccctcacacgctacataatgaactacctgagcgtagcgggagactacaaagaaaccctagaacaagtcttcaaagaccattccaagatcgaacgtgcagactccaccagcaggccgcacagcgaaaacgacggcgttccggagaagcaagcatcgtcaccgttcgcagggcaggttctccgagtcatggacttgctagactcaagcctagaaggtaaagggcgtttatacaaagacgttgcactgagcaatttcttcatgatgaacaacggaaggtacattctgcagaagataaaaggatcaagcgagatgagccaggtgatgggtgacacgtggataaggaagaaatcttctgaacttagaacataccacaagaactaccagagagaaacgtggaacagggtgctacagtttctgaacccggaagggttgaacgtgaacgggaaggtgcacaagccggtgctgaaggagaggttcaagagcttcaatgcgttgttcgatgagattcacaggacgcagagctcgtgggtggtgaaggacgagcaacttcagtcggagcttagggtttcgatctcgggagtggtggttccggcctacagggccttcattgggaggtttgcgcagatctttgacccaggaagacagactgagaagtacataaagtaccaacctgaagatattgagacctacattgatgagttgtttgaagggaaacctcaccagtccattgctagaaggagaacataa

SEQ ID NO: 93209 - DNA, 165 bp, Glycine max
  Peptide Sequence Number=SeqID_209987
atgggacgcggtcatcgtagtagtggctgttgcaatggcctcctagggcacaagctaaattccttcaagggaaagacaaagaggttgaaagaaaaagataaaaagagtttgaagattaagaaatcaactttggacaatggaagagagaatgagttatttttttag

SEQ ID NO: 93210 - DNA, 1470 bp, Glycine max
  Peptide Sequence Number=SeqID_209988
atgagatatggcggaggtagaaagaggcgaatgctgttgcaaccgtttttggttttgtgtgcgacggtgacaggtttgggattgtttatgttggcgctgaggccgttggatcctccgatcacggttgattttccgaaaaaaatcgagctcggagattcgaacagctcgagtttgaacggcggcggagagaagccgtgcgcggcggtggaggagatggggaaggatttcgaagctggtgttgtcgggaaggagacgctgagagtgaggagaattatcgaggaccacttcgatctgaacggtgcttcaagaatcagggatttgcccccagagcagttctgtagtcatggatttgttcttggaaagactgctgaggctggttttgggaatgaaatgtacaaggtcttaactgctgcagcactgagtataatgctaaaccggactgatgattttgaaaagcctgctcaaacaaatgtcctctgtagcaattggaaggaatggaagcaacctatcatatggtttcaaggaactacagatgctgtggcagctcaatttttcttgaaaaatatacactctcagatgaggattgctgcttttgatttatttggtgatccacaagttctgggatctcagccgaatgtatttggagagctcttgagagttctcatatctccttcaaaagatgttgaagcagctgtcaattgggttattggtggtgaggagaatcctgacatctcattgcatatgcggatgcttatgaataggtccataagagctgtacaggctgcattgcattgcatcaaaaaagtcatagagagtcagcacctaacttctagaccaaaggtggttgtggtgtcagatacaccttctcttgttaaaagtatcatgcccaacataagcgaatttgcacaggttctttattttgattatgaaaagttcaaaggaaatatctttgaaggtttgcccaagttagattttagagtgaaggattggggtccagcacccagatgggttgcttttgtggatttttttcttgcatctcgagctaaatatgctgttgtctctggagctcatcggcgcgttggaactacctatgctcaactaatcgctgcactggctgcaacacgcaatctgggagacaactcgtctagttcaagtttttcatttttgagcagtttccagagtactatgttgactgaaggtttaaagaatcaagttggttggggccatgtgtggaacagatatgccggaccattgagttgtcataaccagaccaaccaatgcgctttcacaccacttctccctcctggctggtgggatggcttatggcagtcacctattccaaaggatatcagccgtcttgctgcctatggcatcaaactgtctggtcttggcacagttgattatgattcccttcaaaattactgtagtacaaggaaaaatgttgagagaaccgtcacattcaatttgtag

SEQ ID NO: 93211 - DNA, 792 bp, Glycine max
  Peptide Sequence Number=SeqID_209989
atggcatcagaggagacaacaatttggaaggcaatgataaaaactccagcctccatagtgttgataatttacaccttcatatcaatgtggtttgtaggtggtctcactgccttccatttgtatttgataagtaccaatcagactacatatgaaaacttcagataccgatatgatcggcgagccaatccatataataaaggagtgttgaataatttcaaagagatattctgcatcagcatttccccttcaaagaacaatttcagggcaatggtgccaagagaaccagcattacctactcgatcggtgggtggaggctttatgaaccaaaatataggaaaagctggggaggacatagagatgggcaggaaaacagtgtgggacatgggtgctggaatggatgataacggagctccaataaacgatgatcgtgtgactataaaggatggcgaattgtctcctgaaattaggacaacagtagatgactcggaccgtgctggaatgcatcctaggcgatctagctggggaagaaaaagtgggagctgggaaatgtcccctgaagttctggctttggcggccagggtgggggaaccaaaccgtgtcggtggaggcagcagtagtttgatgcacgagaacagtcatgtgcatttgcaaggtgtttgcaagtgtttttttaggcattctgcttctaagaagaaattgtttggtgttctgagactttctctgtggctgaatgccagtgacttggagtattgggaatttgtccaggaggaaatcaatggtggatcaagctga

SEQ ID NO: 93212 - DNA, 741 bp, Glycine max
  Peptide Sequence Number=SeqID_209990
atgtacgtggtgcctccaccgcagcgctccgatccggggtcaggatccggtgatttgcgggtctaccaagcttggaagggtagcaataaattttttcttcaagggaggttcatatttggaccagatgtgagatcactggcactgacaattattcttatcgttgctcctgtcgcagttttctgtgtctttgttgccagaaaactgatggatgcattttctgaccactgggggatatccataatggctgttgctgttgtgttcacagtttatgtcttagttcttcttttgttaacgtctggccgagatccaggcataattccacgcaatgcacatcctccagagccagaaggcttggatagtaatctagatgttggtgctggtcagactcctcaattgcggttgcctcgctttaaggaggttgaggtgaatggcatccctattaaggtcaagtactgtgatacttgcatgctctacaggcctcctcgatgctcgcactgctcaatctgtaataactgtgtggaacggtttgaccatcactgtccttgggttgggcagtgtattgggctgagtagcttaaccccattgttaagtgtgacagagatggtttttgagtcagctttgaacttgttgaaagtagttgtaaaaagtactacactcgatgtattcaagagacctggttcttccatagagttcccaaatccaaagacaatgcctctcattatcaacccttcttgtttatag

SEQ ID NO: 93213 - DNA, 507 bp, Glycine max
  Peptide Sequence Number=SeqID_209991
atgaagtctgacaacccctggaaactcactggaaggcagccgagagaattttcagacactcaacctctggtgcatgcattttaccttgaccctaacctgaattcttggtggtccaagaaacatacattagtagttaaatccagtgctgaagcagaatacaggagtcttctagctgctgcctctgaaattcatgttccttgcttagcgaacttcatgttccttgctctgcccctggcatctacggcaacaatcaaagcacagttgctctttagtcataatcccatcctgccctctcgaatcaaacatatggagttggatattgctagagaaaaggtccttgataactcactaactgtcacgcatgtaccagcacttgatcagactgctgatattcttacaaagcctttgtctcaactcagattctctactgtaagagacaaactcagagtgattagtacctttcaaccacccgtgtttgaaggaggaatgttagagtatacgctgtaa

SEQ ID NO: 93214 - DNA, 258 bp, Glycine max
  Peptide Sequence Number=SeqID_209992
atgggcgaattcggagacccttttggccaaagtttccggcgagctcaacgagtcagggcgggtcggagacaaggcaagagggggttggtagggaggagaagaatcacacaacctgaagaggtcctaagtgagaaagaaaattatgtgaaggaaaaatttataagtttggatagaaaacttgtgatgaggttgcgacatacttcactattttgtgagagaatgaatgtgaagaagattggaggctcaaaaagcaaatag

SEQ ID NO: 93215 - DNA, 489 bp, Glycine max
  Peptide Sequence Number=SeqID_209993
atgataacaaaagatgatgacaaaggtgatgacaaaaagctcaaaggtcaatcaaagaatgagttcaagatattcaagatagaatcaagaacacttcaagattcaagaggaaagttgatttcaagagatcaagatttcaagaatcaagattcaagagatcaacattcaagactcaagattcaagaatcaagagaaggcttaatcaagataaaaatacaagtagtggggatgtctcctccacctctaggacctcacaatcactcacaaactcatctcaagctctcaggacggcttcctcttccagctctagtctctgcagatcttcacacaacatattctctcaaactctctagaacttggacctttctctctctagaactctccgattatgcagaagtttcaagaaacggcccaaactctcttcagaaatctgatttcaggcttaaatatgtggctttgttcatgctcatgcgcttagcacaattctga

SEQ ID NO: 93216 - DNA, 390 bp, Glycine max
  Peptide Sequence Number=SeqID_209994
atgggaaacagggaaccttcaagcaatacagatgacaaatattttcctctagagtcgataaaagcatattatacatacagtcacatctatcttccctcttggaaaagaagaatggaaattctgataatgaggagaaacgaatatgagctcagaatcaccgcggaaactgcatccataacaagttcctatgacaatagggtcattgaaaagtcaatgaaattcacaaggaggaccattcctttgaccatgcatcgatcttctaagttgccgttaaaaatgagggagatcctagcagattccgtatcctacaggctattgatttcaggtgaggacatgaagcataagctttcaaaatgtgcaggaggttccaggcaacaaaagccagagtga

SEQ ID NO: 93217 - DNA, 234 bp, Glycine max
  Peptide Sequence Number=SeqID_209995
atgaaggttaccgttccactgttagtgattgcttttgcttcggcgaaagcgggggcatttcaggcgaaaatcgatccgttaaagctggcgctgaaacaggctaacgcgctcgccagcaccgatcaggcgcagccgctggcgattgccgaagcgcatgcgcgcctggcgacggcggtgagcggctgtcagtgtccgttctgcacccagatgcggctggtgaataccggtttatga

SEQ ID NO: 93218 - DNA, 1074 bp, Glycine max
  Peptide Sequence Number=SeqID_209996
atgtcggaagtgaatattgatgccgcgctggtgcgtgagggcggggcggcgttgtcacgtaccgacgagaagctggtggaaatgagcaacggctgcatctgctgcacgctgcgcgaagatttactgctggaagtcaaccggctggctaaagaggggcgttttgatcatctggtgattgaatcgaccggcatctctgagccgttgccggtggcggaaaccttcacgtttgccgatgaagaggggcaaagcctgtccaccgtggcggcgctggataccatggtgaccgtggtggatggctacaatttcctgcgtgactatgattccagtgaaagcgtccgctcgagcggcgaatcgcttggcaatgaggatgagcgcacggtggtcgatttgctgatcgatcagattgaattctgcgatgtgctgattctcaacaaaaccgacctgattgatacggcggagcagacacggttgaccgcgattctgcactcgctcaatccacgtgcgcggattattcgcgcgcagtttggtcaggtggcgcttgatcaggtgctgaataccggcctgtttgacttcgatgctgcggcacaggcccccggctggctgaaagagttgcgcggcgagcacacgcctgaaactgaagagtacggcatccgcagctttgttttccgcgcacgtcgtcccttccatccgcagcgtttttaccaggtgattacgcagcacatgcagggcgtggtgcggtcgaaaggatatttctggctggcaacccgcccgcgtcacgccggatcctggtcgcaggccggcggcgtcacgcggcaggggctggccgggatgtggtgggcctgcgtgcctgaagatcgctggccgcaggacgcagacacgctgcattacatccgcgaaaactggcatgaaggcacgggggatgcgcggcaggagatggtgatcatcgggatcgatatggatgaaaccgtgctgcgtcagcagctgcaccgtgcgttactgaccgatgaggaaatggcgctggggccagacggctgggcacagttgcctgatccgttccagccatggtttgactga

SEQ ID NO: 93219 - DNA, 285 bp, Glycine max
  Peptide Sequence Number=SeqID_209997
atgaaatgggcaatgaggctgagagtggccttgtatttagcacaagcattggagtactgcagcagtaaaggaagggcattgtatcatgatcttaatgcttatcgagttttgtttgatcaggatggaaaccctaggctctcttgttttggactcatgaaaaacagcagagatggcagaagctatagtacaaatttagctttcaccccacctgagtatttgaggacagtatatgcatttctgattgtcttaaaaggaggtgttcaatgctataaaaaagcagtttag

SEQ ID NO: 93220 - DNA, 261 bp, Glycine max
  Peptide Sequence Number=SeqID_209998
atgatgcaagaaaaggatccgtctccgggaggctcggaaaatcccacgatagatttcgtggataaagacgttgtccaaaacgaaaaacttatgaatacccgctgtcacgaagcgagttctcacccgccctgtcacgtgcccccctacactgtcacgtatgacacagcatctatctattattacgcgttacgcgcgctttgccaattcatgtattcaaccactaccacttaccacgaatacgcaacaaccaacgtggcctaa

SEQ ID NO: 93221 - DNA, 189 bp, Glycine max
  Peptide Sequence Number=SeqID_209999
atgggatcagaaaccgtgagtaatggacacattaaagagagggtatgtcccagtcccatgtacaagaatatcacttcctatggacttcctagtaagacttctgttgtggggaatgagaacaaggattggggtgcgggggaaagtgatggggaagagggtcgggggaaagtgacttatgggagtgtagag

SEQ ID NO: 93222 - DNA, 1140 bp, Glycine max
  Peptide Sequence Number=SeqID_210000
atgggatgcacgaacacgaaagatataatgaaggagctgaattgtctattgcctatagtcaccaaggtggtgaaaccggcagttaaagttgctttcaaaattcatatctggctgggctcaaagcagcagccacagcaatcacaggaggtggtaccaaacttcctcagcctcccccaacagcaacaagggaataccaacaacaacaacatgggagagaacaaacctgcagaggtgaaggatttccagatagtggtagctgagaacaaggaagagagcaagaaacagcagcaacagttggcaccaaagaggagttccaacaaggacaggcacaccaaggttgaaggcaggggaaggaggataaggatgcctgctctctgcgcagccagaatcttccagttgaccagggaattgggtcacaaatctgatggggaaaccatccagtggctcctccagcaggctgagccatccatcatagctgccactgggactggcacaataccagcatctgctcttgctgctgctggaaactcactctcaccacaagctgcttctctttcatcatccttgcaccaacatcaacaaaagattgatgaattgggtgggtcaggggggagtagtagtagggccagctggcaaatggttggggggaatttggggagaccccatttgggtgtgggtgtggccacagcagcaggcctatggccccctcatgtcagtggatttggatttcaaacaccaccaacaacaacaacaccaacaacaacaacatcatcatctggtccatctaatgccaccttagccactgagagctccaattaccttcagaaaattgcattccctggctttgacttgcctacttctgccactaacatgatgggtcacatgagtttcacctcaattttgggtggaggtgggggtggtggggcccagcatatgcctggcttggagcttggtctttcccaggatggccatattggggtgttgaatcaacaggccttgaaccagatttatcagcagatgaatcaggctggtagagtgcatcatcatcagcatcagcatcatcatcagcatcatcagcagcaacaacaccatcagcaaactcctgctaaggatgattctcaaggctcaggaggacagtag

SEQ ID NO: 93223 - DNA, 207 bp, Glycine max
  Peptide Sequence Number=SeqID_210001
atggacatagactatgctataaggaaagacgaaccacctgcaatcactgatgaacgtagcctagctgacgttgcgctatatgagcggtgggagcgatttaactggctcagcgtgatgttcattaagaccaaaatctcggctgggatacgtggttctgttgaccaacatgaaaaggtccgagacttgcttaaggccattgatgactag

SEQ ID NO: 93224 - DNA, 207 bp, Glycine max
  Peptide Sequence Number=SeqID_210002
atgcagcaagctatatggttacgcaaagaacaggactgcagatacaaccaaattcaaagaggggcaccacaaagccctcttacctcagagactatgctagctagactacgagagtacgcgagggaaagattaaatttaccagcatacaaagacggtcgttataaaacccgtcgttgggtaatccaattcaacgacgatgcctattaa

SEQ ID NO: 93225 - DNA, 483 bp, Glycine max
  Peptide Sequence Number=SeqID_210003
atgatgacaaccccacgagagcaaaatatgggtgaattggctattaggaagggtgttgaagtctatcaaccaatcagaccactaccaaaatacatccgatcaactttccttcatgggtgcacaacaacctacatcacaatcagtttatgggatccactagtgaagaacctcatgggtgaagtcaaggagaagtttcttaattactccttcccagaaacaagggtggaagctataagagaaaatattgtcaattttagacaatttgccacagagtctctgtttgatgtttgggagaaatacaaagctctactccgcagttaccctagtcatggttattcaaggtatagcgaaatttccatgttcctaaagtggatcactcatgagtatagaaggatggtgaatttcgttggtaagggtaatttcttgaacaaaaccctcaccgaggtcaagaagatcattaaagacttggctgctagcgattag

SEQ ID NO: 93226 - DNA, 561 bp, Glycine max
  Peptide Sequence Number=SeqID_210004
atgagagaagagggtgatgaagagaaagaagagagcaaggaaatgggtggaaaggtcttatccactaagaccaacaatcagttagctaaggaagataggagggagatactcatagcctcagtaaaggacatcccttatcccttggacctggtcacaaaaaagggcaaatacatcaacaatgagagcatcatggtggaagcttattgcagtgctgtgattcaaaggattctaccacaaaagttcaaagacccagggagtgtagccatcccatgttctattgtggaggtgtcagtgggtctgccaattcactttttcggtggactttatgattatggatatagaagtggactccgatattcctctgatgctaggtcgtccattcatgcttactgcaatagagaaatgtcagttgtggacatggggaatgacaacttggagatgagcatcgaagaccaaaaagtcaccttcaacctgtttaaagcaatgaagcatcccagtgatagtaaagcatgcttcagggtagaggcaatagaacaagaagtcgacctcattgtgcagtag

SEQ ID NO: 93227 - DNA, 588 bp, Glycine max
  Peptide Sequence Number=SeqID_210005
atgttttcaacaacaacaaaagaaaatcctaaagggcattgcaatgctatcaggactaggagtgggctggtaattccagatagagtggcggaaaaggagaaggatcaaatagaaaggggggagaaaaaccaaaagagagcgatgaagaggtggctcatgacccaccaaagagcaaaagacaaggagaagcattatgcacgcttcttggaattgttcaatcaactcaatattattattccattcttagaagcattggagcaaatgacggtatactctgagtacatgaaggacttgttaaccatgaaaatgagcataagagatgaaagcatggggaccttaaaggctggctatagtgccattattcataagtccttgtcaattgggaatgcattcctcgatttaggagctagcatcaacttaatgcccttatctatgttagagagaatcaggaatgtagaagtgaatgagacttacataactgttcaactggcagattgttccatcagaatccctcatggagtggtggataacatgttggttgatgtgggaaattcacattgtcgaataactttgtcattatggatataa

SEQ ID NO: 93228 - DNA, 132 bp, Glycine max
  Peptide Sequence Number=SeqID_210006
atgtccattgatattgtttatgattgtattactagttgtggcttaaccaagtccattgatgacaacattggtgttcgtgatcttacggcctatgcaatggattcttgcgtgcaagagtgcaagaacaagtaa

SEQ ID NO: 93229 - DNA, 288 bp, Glycine max
  Peptide Sequence Number=SeqID_210007
atgcacattatcatgatttaccaatctcacaactactataatttacacaaaaaattaagtaacttcactagtaatgctgaatctgaatacgggtgttattcacaactagctgtcacattgagcaggagaggtgctattccggcctcatgcagttgcctcatattttcttctaaagatcaagcagctgatcttttcactaaggctctgttacctgctcctttcagcatggttgatcttcaccaaactatccgcttgagaggaggtaatacgcgtgttattcacagctag

SEQ ID NO: 93230 - DNA, 885 bp, Glycine max
  Peptide Sequence Number=SeqID_210008
atgaggatccgcaagaacgccaagctttcccctcttctcttctcgtcgtcttcgtgtctccaaggtggttcggttccgctggagacccacgtgtgccagttgaaccagtccccgtgggatgtgatcccctttgactctgactccatccagttccagctcgaccacagcttcgccgctggaaacaacaatggcagcgccgaaaattccttcggcgccgtcgagagcgtcgcgtcgatgatggatgcagataaaacttcttaccactcgactctagtggttgatgtggcgccgataaatatcgacgctacaacaaacatgaccaatccttgtcagtttaatgataagggttggccatgtatgaatgaagtcagacaagggcaatcattctgcgagcaacatttatcttattctctgctcactccccaccaccacaccagcaagaaaccacaagcgcaagctcaaccatccgcccctggaactcgccgtggcaagcctcggggagcggcggggaagaaggcggctgcgggggcgggggcaagttcgaacccgtatgaattctactactactccgggttcgggcccctgtggggcaaacgaagaggagatagaaatggaggagaagggagcaagaatagtagtgttggggtcgagaattcgacaatggtggagtccaagaatggagtgggtggtgctgacgatggtattaatgataatgtggcgagcgttgaggttggtccttcggtttcggagatggagcatgaggggattatcgactatgtggatgatgacgaagaagaagaaggagaagaagagggtgtcgacgatagcgggaagaagcgaatgaggaagcccgtgaaagcaaggtcgctgaaatcgctgatgtga

SEQ ID NO: 93231 - DNA, 267 bp, Glycine max
  Peptide Sequence Number=SeqID_210009
atgactaaacacaagcactggtttgtggggcacacaggaatgaaaagagttgcagccaatttgtgcagcagatcagatgaacagaagaggaatgaagcaacagtgaagatgcagagtttgaatttatatgaagcgaataggataacctattttattttcgcttcctatatattaggggagcctaatcatacgaagaattccacaaattcccagaaaacatcaaaactgttcacttcagcagtcggcactatttctaggatctcatga

SEQ ID NO: 93232 - DNA, 690 bp, Glycine max
  Peptide Sequence Number=SeqID_210010
atggcaatgttcacattctgtgtaaaccagtgtggaattgatgctgatgccatattgatgttgcagggaaccgaggcattttgtagtggtggtgaccaggctttgaggactgacaatggctattctgataatggaagtttcagtagcctcaatgtgttagacttgcaggtgcagatacgccgcctccctaaaccagtgattgcaatggtagcaggttatgctgttggaggagggcatgtattacatatggtctgtgatctaactattgcagcagataatgctatctttggccaaactggtcccaaggtaggaagctttgatgctggttttggaagttctatcatgtctcgtttggtaggtccaaaaaaagcacgtgaaatgtggtttctcacaaggttctatgatgccgttgaagcagagaaaatgggtcttgtcaacactgttgtaccacttgagaatttggagaaagaaacgataaaatggtgtcgggagatactgaggaacagtccaactgctattcgggtgctcaagtcagctcttaatgcagtggatgatggccattcgggacttcaggaaattggtggaaatgcaacactgatatactatggcactgaagaagctaaagaggggaagactgcatatttgcaacgtagacgccctgatttttctaagttcaatcggcgaccttaa

SEQ ID NO: 93233 - DNA, 186 bp, Glycine max
  Peptide Sequence Number=SeqID_210011
atgtctgaaagcaacaagatcagcaatatgatctatacattgaaagttacacttgttggaaagaatatgagtagtgagaacattagagcctggttaaccatgtgcttgaggctggatttgaacacaagaccacttgatgaagcaggacctgataccacggctgaaaccattccacccaagaattaa

SEQ ID NO: 93234 - DNA, 591 bp, Glycine max
  Peptide Sequence Number=SeqID_210012
atgaagctgactggcaagattgattttgtctccttgaacaacgtttccaagaagctgtttgagtttgactcaaacatatttcgccgttttaaggaccattttattaaggtcctgtctattgatgttgtggatgatggtttgccactgatgtttaatagggacgaggagccccacttcccattctactggcaatctgaccctactagagaaggtcgaaaaaactattttggagtagctgcggtctcgctggacgtgcgaacaattttgtctcttccttcggtgagcgatccccttgttgccttagatggtattatgggtggcttcgcctataggccacttgtgaagcaggtcggacatgcgggtagggatgttccactgtctgctattgctactgttgttggagaagggggtcaacctattagtgaagttggccctattgctattgttgttgaggtcacccccaacgctctttcctctattttggaaaagaggaagcgggatgaggtgttgggtcgtctagtcgaggccactcctactactattgaagttagtgttccagttactttagctggttctgttgtggccacttga

SEQ ID NO: 93235 - DNA, 411 bp, Glycine max
  Peptide Sequence Number=SeqID_210013
atggcacaagatttcaaaagctctcaccattgcctaactatttgggtgaagctaagaagccatagtcaagtgctcaaggaagtcttcactcccacaagcctgaacgaccaacttgtaggagtccttagggctcgccagtttcacctagcgttgaagagaagcaacactcgctaccaaggtgagaaaggacttgtatttcagaatgtcatccatcacccacttatagccagcaacggcaggtgtggacaacagcgacccaacgctatggctacattgcacacggggatatgtcgtgacatctccatcgttgctctctcttctcacaccccaaaagaaataaggaggaggatcacagtaaccaggacaggctcctcagcagcaacggaaggttgtgccctctcgcgagggtga

SEQ ID NO: 93236 - DNA, 484 bp, Glycine max
  Peptide Sequence Number=SeqID_210014
atgaaggttaaggaggagaagctggagatgaagcctggtttcattgcgacggaggtggaagatgaagaaaccctagtgcagaaatgcgagagtggcgatagtgacaatggtaatagtgatagtaacaacaacggtagcaatgacagtgatgatgatgacgttaaagtggttgtgacaatggtgataatgatgatgatggcgagccctggtgcagcggtaaagttgtgccttggtgacttgttggtcatgggttcgaatccggaaacagcctctttgcatatgcaaggcactccagctctcacatttctgaaacactcaagctctcacatttttaaaacactcaagctctcatgccaaaatcctcaaacctctcttgctctcgtcgttgtggtgcagtcatcgctgtcatgttctcatcaccatcgtgccgccatcgacgtcgaagttgtgaacccctccaccaatgtgctctcatcattagaag

SEQ ID NO: 93237 - DNA, 313 bp, Glycine max
  Peptide Sequence Number=SeqID_210015
atgggtgccaagcacctcacaaggaccaaacacaagttgcatgtcatcaacaaaggtccccggacgaaattaggagtcgcgggtgaccataaaatacctccgcatcaaaagaatgtttatacggataaccactcgggtatttccgcccgtcagcgtgactcaaatgtcagtatgacagatcttgtgagcgcggaagatgacgtaaatctccgcgtgtcaacgggcttgtcggccgcgattgacgaagggcgcagaatgaccataatttgtctctgcgtgccatcggacacaactgtgtctgaatggcaaaaag

SEQ ID NO: 93238 - DNA, 168 bp, Glycine max
  Peptide Sequence Number=SeqID_210016
atggttacaatggaggaaaagggagcaacggtggtgtcagtttcaaacggaggttccatggagggcaatctcaggatatttgaaaataaagagtgtcttgtcttaattatgagtgagaatatgcccgacataacaaagaccttggctaagcaggtcaagttcgattaa

SEQ ID NO: 93239 - DNA, 1338 bp, Glycine max
  Peptide Sequence Number=SeqID_210017
atggatgatgaatatgctaagcttattagaaggatgaacccaccaagggttgtgattgacaacaatgcctgtgaaaacgcaactgttattcaggttgacagtgtcaacaaacatgggattctccttgatgttgtccaagttatatcagatatgaaccttgtgataacaaaggcctacatctcctctgatgcggtgtggttcatggatgtgtttaatgtgattgatcataatggaaacaagatcagagataaggaagtcattgattatattcagaggagacttgaaaacaatcccagctttgcaccctcattgagagagtctgtaggggttgtaccaactgaagagcacaccgtaattgaactcactggcacagaccggccaggtttactatctgaaatctgtgcagttctcacagaccttcactgtaatgtggtgactgctgagatatggacacacaatactagagctgcagccgtagttcacgtgacggatgattccagtggctgtgccatcaaggatccatctcgcctctctacaataagggatttgctttctaatgtccttagggggagtaatgatccaaagacagcaaggacaacgctttcaccccctggtgttacaaatagggacagaagattgcatcagattatgtttgctgacagggactatgaaaggattgaaagagcaggacgagggggacttagagatagagataaacgccctctccctcatgtaactgttgtagattgtgttgagaaagattacactgtggttaccatgagagcacaagatcgaccaaagttgttgttcgatattgtttgcactttaactgacatgcagtatgtagtttttcatggtgttgtcaagacattaaggacagaagcttttcaggaattttatattcggcatgttgatggctttcccataagttcagaggcagagcgagaacgcctcgtgcagtgtcttgaagcagcaattgaaaggcgagcatctgagggaatggagctggagttgtgcacagaagatcgcgtgggactcctctcagatatcacgagaatatttcgcgaaaacagtttatgtatcaaaagagcagaaatatcaaccgaagaaggaaaggctagagatactttttatgtcacagatgttactggtaacccagttgaccccaagattatagattcaattcgcagacaaattggtgacaaagtactgaaagtaaaacataactctaatctttcaccaaagccctctcaaccaacaacaattggatttctcttaggaaattttttcaaagctcgatcttttcagaattttaagttgatcagatcttattcttga

SEQ ID NO: 93240 - DNA, 1572 bp, Glycine max
  Peptide Sequence Number=SeqID_210018
atgtcagttgaatgtatcttttttgattgcgatggcacgctggtcgacagcgaagtgatctgcacgcagtcctacgtcaacacctttgcccgttacggtatcgaactctcgctgcagcagatgtttgagcagtacaaaggggtgaagctttacgacatcatccgcgatgtgacggcacagcatcaggtaacactgccgctggctgaggtggagagtgcctaccgcgcggaagtggcgcgcctgtttgatcttgatctgcagccgattgccggcgccagagcgctggtggagcgcgtgaaggtgccgatgtgcgtggtgtcgaacggtacggtgaagaaaatggagcattcgctggggctgaccggcatgctgccgtatctgagcggacgcctgtacagcggctatgacattaatcactggaagccggatccggagctgatgtaccacgcggcggaacagatgcaggtgccgattgaaaagtgcattctggtggatgattcagaggctggcgcgcgggctggcatcgccgctggcataccggtgttttactactgtgccgatgcacacaatccggtgattgatcacccgctggtgacgcgttttgacgatatggcgcagctgccagcgctgtggcgtgcacgtggctgggatttggaacagcgtagcgacaatatccagcaggtaaatcagcgccagcagcgtaatcgcagcggtgaaagaaatatgcgtggccagcatgccgatcaccagcggaccgaaaccgccgacgccgcggccgaggttaaacaacacattctgcgcagtggcgcgcgcctgcggtgggaaagtgtccgagatcagcgcgccgtagccgccaatcatgccgttaacaaacatccccatgatggcaccggtaaacagcatcaccgtcgggtcgcgcagctgggcgtaaaccaccaccatcgccacggcaccaaactggtacagcaggaaaatcttccagcgcgcaaagcggtccgccagcacgccgaacagccagatgccgaatgtcatgcccaccaccgtaacggccgtccacaggccggatttggtcaggctgaagccaaagctggaagagagatagcttggcatccatatcatcaggccgtaatagccaaaattctgcaccgaacaaagaatcagaatgccgaggctggctttactggtggcgcgatcggcaaacagcagtttaatgcgcgcggaaaaggagagctgcggggttttttccacatggcgggtgaaggcttccggctcgcccatgctgcggcgaatcacaaacgacaccagcgccggcagcaggccaaccaggaacataccgcgccagccaatcacgctcagcagcggcggcgtgataaaggccgccagcaatacgccgagctgccagccgatacccacccacgccgaggcgcggttacgcttctccttcggccaggcttcggcaatcagcgccatgccgatgccaaactcaccgcccagtcccatgccggccagcgtacgatacgccagcagatcccagtagccctgcgccacggcgcacagcccggtgaacagtga

SEQ ID NO: 93241 - DNA, 1944 bp, Glycine max
  Peptide Sequence Number=SeqID_210019
atgagtgtgagagagagtggtgcaagaggactaagcaaggctgtgatctcagcctcaaagaagaggggaaggtggggcccagaagtggaggaaagactccacaggctgggttggcggcaacgactgagcccatccctggttggcaatgtgattgatccttttctgaagagccaccactcccttgcacttggcttcttcaattgggcctctcagcaacccggtttctcccacacacccttcaccttccactcactcctcaagtccctctcccacaccaaccacttctctgctattcattcactcctcaaacaggccaaggccctcaactttcccatccaaccttccctttttagctccattatagcctcccacgtcgcccgcaaccgtgcccgccaggccttttcgctctactgtggagttggttccctctctgctgaaattggagtggctacatctaactcgctcctggctgcccttgcctcggacgggtgcttggagagtgcccgcagggtgtttgatgaaatgtccgagaggggggttggtttcagcacgctgggattcggggtgtttgtttggcgggtttgtggagagggtgatttggagaaggtagtgagtctgttggatgaggttggggaatgtggttctgggattaatggttccgttgtggcggttttgattgttcatggactgtgtcatgcctctaaggtgtcggaggctctgtggatattggatgaactcaggagcaggggctggaaacctgatttcatggcttactgggttgttgcagccgcgttccggtcaatgggaaatgtggctgatgaggtgaaggttttgaagatgaagaggaagttgggggtggctcccaggagcagtgattacagggacttgatacttggtttggtttcggagaggcggatttatgaagcaaaagaagttggggaggttatagttggtggtaattttcctgttgaggatgatgttctcaatgcattgataggatcagtatctagtgttgatcccggttcagcaattgtgtttttcaatttcatggttgagaaagagaggttcccaactatcttaaccatcagcaatttgagtaggaacctgtgtgggcatggcaaagttgatgaattattggaagtgttccatgttttgaattctcacaactacttcaaagatgtggagggttacaatgtgatggtgtcatttttgtgcaaggctgggagagtgagggaaggctattctgttctgcaggagatgaagaagaaagggttccggcccaacgtcacgtcttataattacataatggaagcatgttgtaaggaagatctgctgcgtcctgcaaggaagctctgggatgagatgttttcaagtggctgttgcgggaacttgaaaacatacaacattcttatacaaaaattttctgaagtggggcaagctgaagaggctcatatgctcttttaccacatgttagacaagggggtggaacctgatgttacaagttacactttacttctagaaggactctgccaagaagacaagcttgaagcagcttttgagctctataacaagtctgtcaaacaggacatcatccttgctagagacatactgagctcatttatatcatcactctgcaggaaaggacatcttatggctgcctccaaattactttgcagtctcaatcatgatataggatgtgcagaatcccatgtaattttgttggaaagtttggcaaatgctcaagagattccaattgccattgagcacttgaagtgggttcaagaaaaatcaccttcgatactacaagatatatgtacaggacttttggcttctctttcttctgctacatgccccgagccaatattacaatttcttaaaagaatacaagatgtgtttaatttcccatacttagaaggatatctgcaaccaattattaccatgtga

SEQ ID NO: 93242 - DNA, 765 bp, Glycine max
  Peptide Sequence Number=SeqID_210020
atggctagtcattttgttcgttgggtggttaacccgcccctcaccccagagaccatgcgggttccacaggatgtgatgaccagcgccgggcacctgcctgataagcgccgcggccgctttcttgccgcacgcgcgctgctggcccagctgatgttgcgcgtctatggtattcgtgacctgccaccgctgatcgccagcagcagcggtcgcccctgctttgccgatcctaatctgcctgacttcagtatctcctatgccggtaacatggtcggcgtgctgctggcggaagaaggcgggcgcgctggcctggatatggaaatcgttcgggcgcatagccgtcaggcgcaggatgccctcacgcaggggctgtcatcgggtgaaaaggcgtggattaacgcccagcaggattttatggaagcggtgacgcagatctggacgctacgccagagcatcctcaaactgaccggcgaagcagatagcggtattgatgcgctgcggctgcatccggctgcgggtcggctgcgatccagcgtctatcccgatattcaggcggtgtgtgatgccgagccgacgctggtgtggtcctgcgcgctgtcgcccggcactgaacgtttacggctgtgggagattgatgcgcagcagcagtggcagtcgctgcgcgatgtggagatgagcaaacccaacatcgggccgcgcaccctgcgcctcaccagtctgcccggcgagcgtgtcgccagtcagccggaagtcaggcatcccggataa

SEQ ID NO: 93243 - DNA, 1311 bp, Glycine max
  Peptide Sequence Number=SeqID_210021
atgacagaactggatgtctacatgaacggctatcggacaggcgttttcagcagggcagcaaccggtgcacacaccttcagatattatgagagctggctgaatcagccgggtagccgaccgatatccctctccatgcctttgcgccaccagccttacaagggcgcggaggtctataacttttttgataacctgctgcctgataaccctgaaattcgcgcacgtattctgtctcgctatcaggccagctccacccagccctttgacttactcgcaaaggtcggcagcgacaccattggtgcgctgcaattgttaccgcctgacagtaaaccgcacactgtccgaacgatcgattaccgcaggttaagcgatagcgaactggaaaaaatcctttcaggctatcagtcaggcgcaccgcttggcatgctggaagagctaacggattttcgtatttcactggctggcgcgcaggagaaaacggcgctgttacgcatcgatcaacagtggtgcctgccgcagggcaatacgcccaccacccacattttaaaattgccgattggcaatattcagagccattcacatcgcatcgatctttcagatagcgtggagaatgagtggctttgtacgctgattgccagagaatttggcctggcagttcccccttgctttatcgtaaacaccgggaaaattaaagcactggccgtggagcggtttgatcggcgttatgcatcggatggacagtggatcatgcggttaccccaggaagatttttgtcaggtgctgaatgtgcccgcagcaggaaaatatgaaagccacggcggcccgggcatttctgcgattatggattatctcctgaattcagttaatgcagaacaggatcgatatgatttcatgaaagctcaggtcctgttttggctgctggcggccaccgatggccatgccaaaaacttttccatttttatcgaagcggaaggacgttttcgcctgacgccgttttacgacattctttccatttatcccgtgattggcggtgcgggattacacattcgtgatgcaaagctggcaatgggactgaacgggagcaaaggccggaaagccgcgatcgaacacattttcccgcgccattttatagaaaccgcaaaaacgacaaaatttgccctgacggcgatggcacacatcctcgatgagttcagagccaggacgccagaagtgatccaacgcgtgcaggagcaaatccctgcagccttcccgttacgcgtgagccagaccatcctcaatggctttaaggcgcgggccgcgcgtctgcagcagtaa

SEQ ID NO: 93244 - DNA, 528 bp, Glycine max
  Peptide Sequence Number=SeqID_210022
atgcacgtcggagttgttatgtctgttacctctcttgctcgccaggaatcgatctcgctggatgaatttcgtcacggcatgcgccgtctcactgccggtgtctcgctggtgaccacctcatccagcggagaaaagttcgggctgatcgccacctcggtcagttcgctggcagcggaaccgcccagcctgctggtctgcgttaaccgcagcgcatcaagccacgatgccattctgcaggcgggctactttgccgtgaacgttctgcgcgagcagcacgatgacctgtgcgcgcagttcagctcgccgacgcgccgcgctgagcgtttccagagcggtgaatggcaaaccctgaatacgggcgcgcccgtgctggctgatgcgctggtgagcttcgattgtcagctggaaaaaacggtggagtggaatacccacagcgtgctgctggcgcgtatcgtgggtattgcgctgccgggcgaagcgacagcgccgatggtctacttcaacagcggttttcactcgctgggctaa

SEQ ID NO: 93245 - DNA, 206 bp, Glycine max
  Peptide Sequence Number=SeqID_210023
gcggtcagaaagcgcctgcgaccgctatccgcggtagtcatccccggcgatcgcaaggaggatcgtcagcggaagggcggatcatagcgcaaagcgcctcagagatcttccctttctacacagttttgatccattttatccacagggtgtccaggcatgcatcagtttacgccgtctgcggaaaaagcgagcggggatcaggctga

SEQ ID NO: 93246 - DNA, 2427 bp, Glycine max
  Peptide Sequence Number=SeqID_210024
atggattcgcaacgcaatctctttctcatcgcttttctgttcgtgtcttttatgatctggcaagcctggcagacggaccacgctccgcagccacagcagacccagaccacgcagaacacaagcagcgcagcgggtgatgccgcctcttccggcgtgccggctagcggccagggcaaaacgatcaccgttaagactgatgtcctgtcactcaacattaatacccgcggcggtgatatcgagcaggcacagctgctgacttacccggacaaactgggttcagacgcgccgttccagctgctggaaaccactccggccttcgtttatcaggcgcagagcggcttaaccggccgtaacggtccggataacccgaacaacggcgcacgtccgctgtataccgcttcccaggatcacttcgagatggccgatggccagaccgagctgcgcgtgccgctgagctggaccggtgagaacggcgtggtttacaccaaaaccttcgtgttcaaacgtggcgaattcgcggttaacgtcgactacaacatcaataacgcctcgcagcagccgctggaagtggcgatgtttggtcagctgaagcagacgatcgatctgccgaagcatcgcgataccggcagcaataactttgcgctgcacactttccgtggtgccgcttactcgaccagcgatgcgaagtatgaaaaatacaaattcgataccatcgctgataacgagaacctgaacaccaccaccagcaacggctgggtggcgatgctgcagcagtactttgcgaccgcatgggtgccgcgcactcagggtaacaatacgctgtacaccagcaatctcggcaacggtgtggcggcaatcggctataagtcggcgcctgtgaccatcgccgccggcgcgcagcaggatctcggtgccaccctgtgggtcggtccggaaatccaggacaaaatggccgctatcgcgccgcacctcgatctgaccgtggattacggctggctgtggttcatctctcagccgctgtttaagctgctgaagttcctgcacagctttatcggtaactggggcttctccattatcgttatcaccttcatcgtgcgtggcatcatgtacccgctgaccaaagcgcagtacacctcgatggccaagatgcgtatgctgcagccgaagattcaggctatgcgtgagcgtctgggtgatgataagcagaagcagagccaggagatgatggcgctgtataaggcggagaaagtgaacccgctgggcggctgtctgccactggttatccagatgccaatcttcctggcgctgtactacatgctgtccggttccgttgaactgcgtcatgctccgtttgtactgtggatccatgacctgtccgcgcaggacccgtactacattctgccggtcatcatgggtatcaccatgttcttcattcagaagatgtcaccgaccaccgtgaccgatccgatgcagcagaagatcatgacttacatgccggttatctttaccgtgttcttcctgtggttcccgtcaggtctggtgctgtactacatcgtcagcaacctgccgcgacaagaagaaagcgtaacgcccggcaacgctgagcaggacgcaacatctccaggggcggcatttatgccgccctgttttttttggaagaaggtacttatgagccacagtgacactattgttgcccaggcgacgcctcccggccgtggtggcgtcggtattctgcgtatttccggtggcaaagccgctgaggtggcgcaggccgtgctgggcaagctgccgaagccacgctacgccgactatctgccctttaacgatgctgatggcagcgtgctggatcagggcatcgcgctgtggttcccgggtccgaactcctttaccggcgaagatgtgctggagctgcagggccacggcggcccggtgattctcgatctgctgctgaagcgcatcgtggcgctgccgggtgtgcgtattgcgcagccgggcgagttctcggaacgcgcctttctgaatgacaagctcgacctggcgcaggcagaagcgattgccgatctgattgatgccagctccgagcaggccgcccgctccgccgtcaactcgctgcagggtgccttttcactgcgcgttaatgcgttagtggaagcacttactcacttgcgcatctatgtggaagcagcgattgattttccggatgaggagatcgacttcctttccgacggcaaaatcgaagcgcagctgaatgcggtgatcggcgatctcaacggcgtgcgcgccgaagcgcgtcagggcagcctgctgcgtgaagggatgaaggtggtgattgccggtcgtcccaacgccgggaaatcgagcctgctcaacgcactggccggacgcgaagcggcgattgtgacggatatcgccggcaccacgcgtgac

SEQ ID NO: 93247 - DNA, 561 bp, Glycine max
  Peptide Sequence Number=SeqID_210025
atggctcctcaaaaagataattcaatggcctccacatatgaacaaaataaatgtgtttatacccaggacctcgaaaagaaacttcgtagaaaagatacccaaccgcctactacaactaggccatcatcttccaaaaagaatgatggcttatccgtttctattactcataggaagggctcattaactcccaaggatgaagaagatggaaatagaccaaagaaggtgactaatattggttggaagaacgtgtttcaaccaccaatggtgaatgatcctatgaaggttgagatcttgggtccttcgaagatagggtcatccttagagatttatggcggcgaggacttgacatgccatttttccttggtgactaaagaggtttggttgtctcaacctagcttgttcatgcacaagcttcaagagattggtgatgaggctggaaatgatttttttgttgttactaaagaggagatcaggaaggtagtgattgttggaccttgtggcctcaataacttacaaggggtgaattacttttccactaacaagtttttaacccccttctaa

SEQ ID NO: 93248 - DNA, 258 bp, Glycine max
  Peptide Sequence Number=SeqID_210026
atgaatgctttggtcatttataaatactgttttggacctgctctatttggccccgacgggtgcagagaaacacgaggaactggaaccagagaggcggcacgcaaaccgaggcgaaagggcgacctacccttcggcgaaagggcgacgcggggcttacgggtgcgtcttccatgggaggaaaatgcgtggagtcgccaccaacgtttattcgaggaaaacgtcagaaaaactggaaaaggtgtggtctacgaactttaa

SEQ ID NO: 93249 - DNA, 174 bp, Glycine max
  Peptide Sequence Number=SeqID_210027
atgatgcaaatttctcagggttgcgttgtgccacaaacaatgatggcgatggcagacacaacgatgatagttgttagtggtcacgaggtaatgagcacggggaagagaaagttacgagcagagaaaaaggttttcgatgagtgcggggagaaaagcagggtttggggtttttaa

SEQ ID NO: 93250 - DNA, 273 bp, Glycine max
  Peptide Sequence Number=SeqID_210028
atgagggtcacgagtatatcgagccccaagcatagacaagagttgttctgtgctgagagtggtaaccttgacaaatgcaagagttgcaggtcggcgaaatcaggtgtgtcagacgaatgcagtgcaccgcgttgctcttgcatacatgtcactcatggagtgggcacatactggagacgtggaacgtgggtgagtggagttgcgtcatggtgtaaaattttagggcatcattttagcttccgccagttaccgatgagtcgtgtctcccgctag

SEQ ID NO: 93251 - DNA, 306 bp, Glycine max
  Peptide Sequence Number=SeqID_210029
atgggaggatatttagccgacaaggacggtgtcgatgacactgtttgcgaaaagtacgacattaacaaggagaagtggacccaattttgtctaattcgtaaagacccttcgtgggaggatgtgcaaaagaaggcacaagccattcagaaacaaaacattgtccttccagtgttgtctcgtggaggttatgaaaatctagaaaacaagttgatggaggagaagaaaaagaaacaaatggaggaagctgctaaatccgaaagcattgacaccgtcattgatcctctatctcccatcaacgacacgtga

SEQ ID NO: 93252 - DNA, 258 bp, Glycine max
  Peptide Sequence Number=SeqID_210030
atgttgaatttttgggttacaagtgccatgcaacattatgtggcaacacgtccaatgttcattgatgtggaaataatgaatgcagacactaagctggttgtatattttattgtgttcacaaaaaccaatgttctcataattctgcatgcagagagttttagagtagtgaatcactgcccttttggacaaactgttagagaaaccatctcttgtcaatttaccttccgtggaggaaggtgggctcctattaatgagtag

SEQ ID NO: 93253 - DNA, 975 bp, Glycine max
  Peptide Sequence Number=SeqID_210031
atggtttctccactgaacccagaagctctggaatatttaccaaggcacaatcacaagcttcagcaacaacaacagcaagtacttcaacctcaaccccttccttgttccactttccctcccacttccatttttactcctcactgcaacttcttgttactgttctcttcatttccctcacgtcatccttataaccccttctattatcccactctaacacttccaccattaccaccttcttccattcccttagcactagaagctgatcaaccaactcgttttcatgaaataaaaaatggttctgattctgattctgattctaacccggttgaagcacatgcagtgaacaagaagaaggatcaaatggtaatagctgaagaaccaaaaactggttgtggttcgataggatttgtaaagaagcgagctttcaaggcttacattaatggccggtgtcttgagagttggagacaaaagagttacccgccgagaaggaaggtggaagaaaatggtcaacgtaaaagtgttgactttttgaggaaccgaaaggtttttaggcaccacccagcaaatgaacccttcaggggttttcccaagaggaatcgttttaatccctcgttgcctgttagggatggcgaaaccactgtgatgatcagaaatattcccagcaaatacacccgagaattgctggtgaagtttctggaagatcattgtctgaaagtgaatcgtactacagaaaatgaagcttgcaaggagaaaggcgaagaagaatccattggtttagcttttgatttcgtttatttgcccattgatttcaaatctaggatgaacaagggatacgcttttgtgaacttcactaagccccaggcagctcggaagtttcgtaacacagcctccagattgaaatgggacatgttccagtctaacaagatacgtgaagtggtttctgcacgtttacaagtatggtcacatacacattga

SEQ ID NO: 93254 - DNA, 102 bp, Glycine max
  Peptide Sequence Number=SeqID_210032
atggcatttgtcctctccaggctttggctcttcaaagaggcaaagttgtttgatggacaagcttatatgtacaaaacgtgtggaaattggaaaacatcatga

SEQ ID NO: 93255 - DNA, 498 bp, Glycine max
  Peptide Sequence Number=SeqID_210033
atgatgaatgaaaagggtgggtcatcatcgtcatccttatctcttgcgatggtgaagtgcaaatgtgagtgtgaaccatcagggagaaggttttggagatgcccacataggaacgaatcaagttcatgcagattttttcaatggattggtgatactgaggctaacaataacgtgactgtagaaggaagtgagttggtcctatatgttcaggaaaatgaagagttgaagctgaaacttgcttcattaatggaggaagctaaagcaagtgtagaagaaagaacaaatttgaggaaaaatattgttgcacaacaggaagaatgttgggcatccttagttgaagttgtgcagttgaagagtaaaagtggaaggaaaaagaataatcttgttattgaaaggaataaagtgaagttgtcaggttttgcagttgttcttcaagtgttcatttctttactaagcattgtaattgcaatgaatgttggtggtcatagaaggaactga

SEQ ID NO: 93256 - DNA, 510 bp, Glycine max
  Peptide Sequence Number=SeqID_210034
atggatatgtggccagttacagagtttgacgtgattcaaccaccaaaatacaaaaagggtcctgatagaccaaagaaattgagaaagagagagcctgatgaggaccctaataggactaggctaagaaaggacccaactccatataaatgcaatagatgtcgggcaataagtcataatacgaagaggtgtccattgccacctctagtagtacctaaagaagaaaatgaggaacctagtggagttgctgaaggtgtagttgagggtgcagctcaagttgagggtggcactaaagaagcagcaaaggctggcactgaaggagcaactcaggatggaaatgagggtgcacttgttggaggaaaaggtgtgcaacaatctgggcactgtgggcacaacagatctatcaatgaaaaaaagtacagaaacttgcttctaaacgcaaggcaccaacaacaagcgaaaaacttaaaggttgtcaactaccaactattgagaaaaaggttaagctggtaa

SEQ ID NO: 93257 - DNA, 411 bp, Glycine max
  Peptide Sequence Number=SeqID_210035
atggagctctctttattttcatgccttttcaccttcaaaattagtttttcctatttaattgtttactgccaagtagactcttccatctttgtttataagttgacaatcaacctcatagaccctgcctatctccaacaccttcattgtgctcagatatgttatccagagcccagcctaacatcatttgccactgcacactgttgtccaccattgactaagattgattcaaggagttttgatgataacaaagatgatgacaaaaatctcaaaagtcaagatcacttcatgataacaaagatgatgacattcaagaatgagttcaagattgagtcaagaacacttcaaagatcaagaggaaatttgatttcaagaatcaagaatcaagattcaagattcaagattcaagaataa

SEQ ID NO: 93258 - DNA, 477 bp, Glycine max
  Peptide Sequence Number=SeqID_210036
agtactcctctaggccgaagtgcaaccttgatcactgctctatgtggagctagaggagttacctctaacagtctgacctatgagagcctgatcctggccattaacttggcttacattaagaaaaattgttggaatgtggatgatctgacaattaacttcagaggggctaggaaggtagcctggcctagaaccttaccttctgctgtgagagagggtgagggccccagtgctcaggtacctcaacaggtacaagatgcgtcttctgaggctaccatccctagagcttttgaatttttaggtgcaggagtagggatgaaacctgatgaggttgttcttcctgagccaattgtgccagttatacataagactcttgaagcacgtgagtcacaattgagacaggaggctgctactcctgagaggacaccacagacctcaaaagatccactctcaccaaggatggacctatcttttgcttag

SEQ ID NO: 93259 - DNA, 540 bp, Glycine max
  Peptide Sequence Number=SeqID_210037
atggaaggcaagactgaaagtcatatgacatcagcagcaacctttgtggaagggggttcaagaagcttgtcactaattgcaagcatgagttccacctgtagtgcattcttgaatgtttctgatcatggtcgtccacatttcttagtatactcaactcagcctagtgcaccaccatcagctgcaggagggggaagtgaaccagctgcaattgctgtaggaagtccatctaccccacttacatttgatggaaatgagcaatcatcactacagcagatcccctatgttcaaactcggagttcttctttaacttctgcctctactgccgcaacaacaaatcttcaaggagttcactctaatgatagaagttttgcctctcattcttttcctgcaagccaagacagagcacatccatcagaacaatcactctctgattctctgcgctccagatttaatgcagtatccatgaggtatgatttcttggaaaccttgtatacaaagaatcaatttcgaagggcacaaggggatggaaggagaggctaa

SEQ ID NO: 93260 - DNA, 423 bp, Glycine max
  Peptide Sequence Number=SeqID_210038
atgacatgtgcattcttcaacaacatgtatccttcttcgaccttgacaataatggtgtcgtctacctattggacacatatatggacatggctaccttcaccttttttcccaatttacataaaaaacatacatagggcaaagcatggaagtgacactggtacctatgacacagagggaagcaagtatgcacgtgaggtgcctgataaattgactttgaaggagctgtggcacatgactgaaggaaacatggttgcatatgacttctttggctggtcctctatctttctcattcaactttttgcatcacgcatacagtttatgggtgatttttttgttaacaaactacaaggttgccagttagatggggaagtcagactactcaacaaatatgatacactggttagcacatggtttactaggtga

SEQ ID NO: 93261 - DNA, 180 bp, Glycine max
  Peptide Sequence Number=SeqID_210039
atggggcgggaaagaaaagaagaagaagaaaaatacaaaaataaaacaccattgtcatcccaagaggggaatgacgatggtgggtggggacaaggtggtcgccaaaaatcacttctggtggcggcgggtgaaataaatatggggagggaggaggaatctagtattgaagatgtaggataa

SEQ ID NO: 93262 - DNA, 861 bp, Glycine max
  Peptide Sequence Number=SeqID_210040
atggggaaaacaatgatagcaccaaatccagttcctaaaagcacatgctgcttttgcttgattgaagaatggtgtgacaacaacaacttcaaacttcctaaaaaatacaattcttcacatcaagaaacctatcctatagatagcaaagaggaaattccagctttggttgaaagcctatcatctattcatttagaagagcagacaatagcaatggagaagatacatatgctatcaaaggaaattcaggagaatagggttttcgttgctgaacatggaggaataccaccactagtgcaactcttgtgctatccagattcaaaaatacaagaacatgcagtgacaacacttttgaatttatcaattgatgagggtaacaagagtcttatatccacaaaaggtgtcattccaactatcatagaagttttggagaatggtagttatgtggctaaggagaactcagccgtagctttattgagcttgttaatgcttgatgagattaaagatattgttggtcaatcaaatgggttcccacctttggtggatttgttaaggaatagaacaattacaaggaagaaagatgttgtgacagctatttttaacttatctatcaaccatgcaactaaagtactgcatattagagctggcattatcgcaccattgcttcaattgctgaaggacccaaacttgagaatgatagatgaggctccctccattttgttactccttatatcaaattcagaagcaagagaagagattggacaaattagtttcattgaaacccttgttgagttcatgagagaagggagtacatggggagaatgtaatccagaaaatttgaaaagcatgaaagaaaactcatga

SEQ ID NO: 93263 - DNA, 264 bp, Glycine max
  Peptide Sequence Number=SeqID_210041
atggtccatattaattgttcggatgcagtttggcaaaaaccaccagtgggatttcttaaatgcaacatcgatgcttcgatctacaatgatcaatttggagttacagctatcatcagagatcatctcagtcaattcattttagcgaaaagtgcttgtttcaatggttcgatggatcaccccgcaagaaacagaagcaacaactctttgaggccatcaactagatttcgagttcgaatttgcaaaatatgttatcttcgaatttga

SEQ ID NO: 93264 - DNA, 432 bp, Glycine max
  Peptide Sequence Number=SeqID_210042
atgcagatgaagtgggtgatgaatgaagttctaagactctacccaacggcaccaaatgttcaaaggcaagcaagagaagacattcaagttgataacttaacagtgcctaatgggaccaacatgtggatcgatgttgtggccatgcatcatgacccggcattgtggggaaaagatgtcaacgagtttagaccagagaggttcatgaatgatgtcaatggtggatgtaaccacaaaatggggtacttgccttttggttttggagggagaatgtgtgttggtaggaacttgagctttatggagtataagatagttctaaccctactcctctctaggtttagtttcaaagtttcaccaggttataaccatgcaccctctatcatgctatcccttaggcccacttatggacttcttctcatagttcaacccctttag

SEQ ID NO: 93265 - DNA, 321 bp, Glycine max
  Peptide Sequence Number=SeqID_210043
atggagaaatttaatagggtgacaaaggtagacggttccgatgtcgccggcgctgatgcgacggaggaggtggatgtcgcggaaggagagggcggccttgcggaggaaggtggcagagcggatggcggagtaggcgaagtcggaggagcaacgaggcttgatggagagactctccggcgagggagggaggagattgaaggagagacggctgaaactggtgctgcaaatgctctcgcagctcatggagctttcaagtgtggaagaattcacggtctccaaactcacctcagaatcacgttcaccaccacaaccactccctaa
